United States Patent 11,078,247 (RNA ENCODING A THERAPEUTIC PROTEIN) - sequence listing, part 37

SEQ ID NO: 62627 - RNA, 1692 nt, Artificial Sequence
  derived and/or modified sequence opt3 from SLC22A6__Homo_sapiens__NP_004781
auggccuucaacgaccugcuccagcaagugggcggggucggaagauuucagcagauccagguuacccuugugguacugcccuuguuacugauggcuagccacaauacacuacaaaacuucacugcagccauuccuacgcaucacugcaggccaccggcggaugcuaaucucuccaagaacgguggccuggagguguggcuuccccgggaccgccaggggcagccugaaucuugucugcgauuuaccucaccacaguggggauugcccuuccucaauggcacagaggccaacgguacuggggcaaccgaaccuugcacagauggauggauauacgacaauaguaccuuuccaagcacuaucgucacagagugggaucugguguguucccaucgugcccugagacaacucgcucagucuuuauauaugguuggcgugcugcuuggcgcaauggucuucggguacuuggccgacaggcugggacggcgcaaagugcuaauucucaacuaucugcagaccgcuguaucggguacgugcgccgcguuugcacccaauuucccuaucuacugugccuuuagacuucugucaggcauggcuuuggccgggauuagccucaacugcaugacucugaauguugaauggaugccaauccacaccagggcaugugugggaacauuaauaggcuaugucuacagucugggucaguuccuccuugcugggguggccuaugcggugccgcauuggcggcaucugcaauugcuagucuccgcccccuuuuucgcauuuuucaucuacucuugguucuuuauugagagcgcucgcuggcacuccucaaguggacgacuggaucucacucugagagcccuucagaggguugcucggaucaacggcaagcgugaggaaggcgccaaacugagcauggagguguugcgcgcaucucuccagaaggaacugaccauggggaaaggacaagccuccgcuauggaguuacugagaugcccuacacuaaggcaccucuuccugugucuuucaauguugugguuugcgaccagcuucgcauacuauggucugguaauggaccuccagggcuuuggggugaguauuuaccugauccaggucauauucggagccguggaucuuccagcuaagcugguuggcuuuuuggugauuaauucucucggucggcgacccgcccagauggcagcccuguuacuggcugggaucugcauucuacucaacggcgucaucccucaagaccaguccaucgugcgcacgagccuggccguacuuggaaagggcuguuuggcagcgucguucaauugcauuuuucuguauacuggggagcucuacccaacaaugauaagacagaccggaauggguaugggcucuacuauggcuaggguuggguccaucgugucaccccuggucaguaugacagccgaauuauauccgagcaugccucuguucauuuacggagcagugcccgucgccgcuuccgccgugaccguucuuuugccagagacgcucggccagccucugcccgauaccgugcaagaccuagaaucucggugggcaccaacacagaaagaggcugguaucuauccccgcaaggggaaacagacuagacagcaacaggaacaccagaaguacaugguaccucugcaggccagcgcgcaagagaaaaacggccucuga

SEQ ID NO: 62628 - RNA, 1641 nt, Artificial Sequence
  derived and/or modified sequence opt3 from SLC22A7__Homo_sapiens__NP_006663
augggcuucgaggaacugcucgagcaggucgggggauuuggucccuuccaacuuagaaacguggcccuguuggcuuuaccuaggguucugcuaccacuccacuuucugcuuccgaucuuccuggcagccgugcccgcgcaucggugcgcuuugccuggcgccccagcaaauuuuagccaccaggacguauggcucgaagcccaucugccccgcgagccugaugggacccuguccucuugucuccgauucgcuuacccacaggcauuacccaacacaacucugggagaggaacgucagucaagaggcgagcuugaagacgagccugccacggugccaugcagucaagguugggaauaugaucacagcgaguuuuccucuaccauugcuacagagugggacuuggucugugaacagaaggggcugaauagggccgcgucgacuuucuuuuucgcaggagugcuaguuggcgccguggcuuuuggcuaccucucagaucgguucgggcgcagaaggcugcuucuggucgccuaugugagcaccuugguacucggacuggcaagugcugccuccguuucuuacgugauguuugcgauaacacggaccuuaacugguagcgcccuggcaggcuucacaaucauugucaugccgcucgagcuugaauggcuggacguggagcaucgcaccguggcuggggucuuguccucaacguucuggacuggaggcguuaugcuacuggcccucguggguuaucugauccgagauuggagauggcuucuguuggcuguaacccuccccugcgccccugggauucugaguuuauggugggugccagaaagcgcaagguggcugcuaacacagggacacgucaaagaggcccaccgguaccuccugcauugugcucgucuuaacggccgccccgugugcgaggacucuuuuucccaggaagcgguuucaaagguggcagccggcgagagagucgugaggcggccuagcuauuuggaucuguuccgaacuccacgccucagacacaucagucuguguugcguaguugugugguuuggggucaauuucucuuacuacggacuuucccuggacgugagcgguuugggccucaacgucuaucaaacccagcuguuauuuggggcuguggaacugcccucgaaacuacucguuuaccugucugugagguaugccggacggcgccuuacacaggcaggcaccuugcuggguacggcccucgcuuucgggacuagacuguuaguauccucagauaugaagaguuggagcacaguccuggccgugaugggcaaagcauuuuccgaggcggcuuucaccacugccuaccuuuuuacaucugaauuguauccgaccguucucaggcagacgggaaugggccugaccgcccuaguggggcgucugggagguagccucgcaccucuggcugcccuuuuggacggcgucuggcugucauuacccaagcucacauacgggggaauagcacugcuugcugccggcacugcgcuguugcucccagagacccggcaagcccagcugccugagacaauccaggauguggaacgaaagagugcucccacuucccuacaagaggaagagaugccaaugaaacagguacagaauuga

SEQ ID NO: 62629 - RNA, 1629 nt, Artificial Sequence
  derived and/or modified sequence opt3 from SLC22A8__Homo_sapiens__NP_001171661
augaccuucagcgagauccuggacagagugggcuccauggggcacuuucaguuccuccaugucgccauucuuggacugcccauauugaacauggcuaaucacaacuuacugcaaaucuuuacagcagccacuccuguucaucacugcaggccaccgcauaaugcgucuacgggucccugggugcuaccuaugggcccaaacgggaagcccgaacggugucuccgcuucguacacccuccaaaugcuucacugcccaacgauacccagcgagccauggagccuugccuugacggauggguguacaauaguacaaaagauagcauugucacugaaugggaccugguguguaacuccaauaaguugaaagagauggcacagucuaucuuuauggccggcauucucaucggugggcugguucugggagaucucucggaccguuucggcagaaggccaauauuaaccugcucauaucugcuuuuggcugcaagcggcaguggggccgcuuuuuccccgacauuccccaucuacaugguguuucgguuccuguguggauuugguauuucuggcaucacccuaagcacugucauucucaacguggaauggguaccuacacgcaugagagccaucauguccaccgcgcugggguauugcuacacguucggacaguuuauacuuccaggccuggcauaugccauuccccaauggaggugguugcagcucacuguuucaaucccuuucuucguguuuuuccugaguagcugguggaccccagagucuauucggugguuaguccuguccgguaagucaagcaaagcucucaagauccuucgccgaguggccguguuuaaugggaagaaagaggaaggagagagacugaguuuggaggaacuaaagcugaaccuccagaaagagaucucucuggcaaaggcuaaauacacagccuccgaucuuuucaggauucccaugcugcggcguaugacuuuuuguuugagccucgcgugguucgccaccggcuuugcauauuacucgcuggcuaugggcgucgaagaguucgggguuaauuuauacauacugcagaucauuuuuggagguguggacguaccggccaaguucaucacaauacuaucucucuccuaucugggccgccacaccacgcaagcugccgcacuuuugcuggccgggggagcuauucucgcgcugacuuuugugccucuugaucugcagacagucagaaccguguuggcaguuuucggcaaggguugccucucaaguagcuuuuccugucuguucuuauacacuucugaacuguaucccacagugaucaggcagaccgggaugggcgucagcaaccuauggacgcgggugggaucaaugguaaguccacucguuaaaaucaccggcgaggugcagccuuucauucccaauaucauuuacgggauaacagcccugcuuggagguuccgcugccuuguuucugccagaaacucucaaccaaccccugccugagaccaucgaggacuuagaaaacuggagccugcgagcaaagaaaccaaagcaggagccggaagucgagaaagccucucagcgcauuccccuucaaccucauggcccaggguugggaucaaguuga

SEQ ID NO: 62630 - RNA, 1797 nt, Artificial Sequence
  derived and/or modified sequence opt3 from SLC23A1__Homo_sapiens__NP_005838
augagagcccaggaggaccuggaaggcaggacccaacacgagacaacucgggaucccagcacgccucucccaaccgaaccgaaguucgacaugcuuuacaaaaucgaggaugugcccccuugguaucugugcauuuuguuaggguuucagcauuaccugacauguuucuccggaacuauagcugucccauuucuacucgcagaagcccugugcguuggucacgaccagcauauggugucucagcuuaucggcaccauuuucacauguguagggaucaccacucugauucaaacaaccgugggaauccgcuugccccucuuucaggcgucagcuuucgccuuucuggucccugcaaaggccauacuggcucucgagcgauggaaaugcccacccgaggaagagaucuauggcaacuggaguuuaccucugaauacgagccacauuuggcauccacguaucagagaagugcagggugcaauuaugguuuccucuguggucgaggugguaaucgggcuuuugggacugccgggcgcccuacucaacuacauaggcccccugacuguuaccccuacagugucgcuuauugggcugucagucuuccaggcugccggagauagggcggguagccacuggggcaucagugcauguuccauuuugcucaucauccuguuuucucaauauuuacggaaucugacuuuccuccuuccaguguaccgcugggggaagggacugaccuugcuacgcauucagauauuuaaaauguuccccaucaugcuggccauuaugacaguguggcuccugugcuauguccuuacccugacggacguuuugccuacugauccaaaggcuuacggcuuucaggccaggacagacgcacggggugauaucauggcuauagcccccuggauucgcaucccguacccuugucagugggggcuccccaccgugacugcggccgcaguacugggaauguucagcgcuacauuagccggcaucauugaguccaucggcgacuauuacgcuugcgcccgacuggcaggggccccaccucccccagugcacgcuauuaacagaggaauauucaccgaagguaucuguugcauuaucgcgggccuacucgggacgggaaauggcucaaccaguagcucucccaacaucgguguccuggggauuacaaaggugggcuccaggcggguugugcaauauggagcagccauaaugcuugucuugggcacuaucgggaaauuuaccgcucuguucgccucacucccugauccaauucugggagguauguuuuguacacuuuucggcaugaucacugcaguggggcugagcaauuugcaguuuguagacaugaacaguucucguaaucucuucguucugggauuuuccauguucuuuggcuuaacccugccgaacuaccuagagagcaaucccggugccauuaacacagggauccucgaaguggaucagauacugaucguccuuuugaccacugagauguucgugggcggaugccuggcuuuuauucucgacaauacggucccuggcucgccagaagagagagggcugauccaauggaaggccggagcacaugcgaacucugacauguccucaaguuuaaaaagcuaugauuuccccauugguaugggcaucgugaagagaauaacauuucugaaauacauuccuaucugcccaguuuucaagggguucuccucuagcucaaaggaccagauugcuauccccgaggauaccccggaaaauacugagaccgccaguguguguacaaaaguauga

SEQ ID NO: 62631 - RNA, 1953 nt, Artificial Sequence
  derived and/or modified sequence opt3 from SLC23A2__Homo_sapiens__NP_005107
augaugggcaucgggaagaacaccacaagcaaauccauggaggccggaucuucaacugaagguaaguacgaggacgaagcuaaacaccccgcauucuuuacgcugccuguggucauuaauggcggggccaccaguagcggagagcaggauaacgaagacacagagcucauggcgauauauacuaccgagaauggcaucgcugaaaaguccucucuugccgagacacuggauucgaccgguucauuggacccacaaagaagcgauaugauuuacacuaucgaagacguuccgcccugguauuuaugcauuuuccuggggcuacagcauuaccucacauguuuuaguggaaccaucgcagugccuuuccugcuugccgaugcuaugugcguaggcuaugaccagugggcaacgucccagcugauaggcacuaucuuuuucuguguggggauuaccacauugcuccaaacuaccuuuggaugcaggcugccacuguuccaggccucugcuuuugccuuccucgcgcccgcacgggccaucuuaagccuggauaaauggaaguguaacacaaccgacgucuccguggcuaaugguacggccgagcuuuugcacacugagcauauuugguacccucgcauccgagaaauacagggcgcaauuaucaugucaagucugauugagguugugaucgggcuacucggacugccaggcgcccuucugaaguauaucggucccuugacaauuaccccuacugucgcucucauagggcugagcggauuucaggcggccggcgaacgugcaggcaaacacugggggaucgcuauguuaacaauuuuccuggugcuccuguuuucucaauacgccagaaacguaaaguucccacuuccgaucuacaaauccaagaaaggauggaccgcuuauaaguugcagcuauucaagauguuucccauaauucuggccauccucguuucauggcugcuuugcuucaucuuuacggugaccgaugucuucccuccagacagcacaaaauacgguuuuuaugcaaggacugaugcccggcagggcgugcuguugguggcucccugguucaaggucccuuacccauuucagugggggcuccccaccguuagugcggcaggagugauuggcaugcugucugccguaguggcuuccaucauugagagcauaggugacuauuacgccugugcacgcuuaucgugcgccccgccucccccaauccaugcuauuaauagagggaucuucgucgaaggccugucuugugugcuagacggaaucuuuggcacagggaacggauccacuucaaguagcccuaauauugguguucucggcauaaccaaagugggguccaggcgggucauccaaugcggagccgcacugaugcuugcguugggcaugauugguaaguucucugcucuguuugccagccuccccgauccagugcugggggcacuuuucuguacacuguuuggcaugaucaccgccguaggauugucaaaccuccaguucauugaccugaauaguucccgcaacuuauucguucugggcuuuagcaucuucuuugggcuagugcuccccucuuaucugcgacagaauccucuugucacuggaauaacggguaucgaucaaguguugaacguccugcucacaaccgcuauguucgugggcgggugcguugccuuuauucuggacaauacuaucccaggaaccccggaggagagaggcauuaggaaauggaagaaagguguggggaagggcaacaagucauuagauggaauggaaaguuacaaccugcccuucggcaugaauaucauuaaaaaguaccggugcuuuagcuaucuuccuauauccccaacauucguaggguacaccuggaaaggauugcguaagucugacaacucgcgcagcuccgaugaggacucacaggcaacuggcuga

SEQ ID NO: 62632 - RNA, 3300 nt, Artificial Sequence
  derived and/or modified sequence opt3 from SLC24A1__Homo_sapiens__NP_004718
augggcaagcugaucagaauggggccccaggagagguggcuccuucggaccaaacgccugcacuggagccgauuguuauuccugcuaggaaugcucauuauagguuccacauaccaacaucugcguagaccuaggggccuuucuucacugugggccgcugugaguagccaccagccaaucaaguuggcaucccgggaccucucuucggaagagaugaugaugaugucaagcaguccguccaaacccucuagcgaaaugggagggaagaugcuggucccucaggccuccguuggcucagaugaggcgacucugaguaugacgguggaaaacauuccaagcaugcccaaacgcaccgcuaagaugaucccuacaacuaccaagaauaacuauucuccaacagccgcagguaccgagagaaggaaagaggacacucccacauccucacggacccucacguacuauacuagcaccaguucucgccagauuguaaagaaauacacaccuacuccacgaggggaaaugaaguccuauagcccgacccaagugagagagaaagucaaguacacacccucgccuaggggacggcgugugggcaccuauguuccaucuacguuuaugacuauggaaacaucccaugccaucacuccccgcaccacagugaaggauucagacauaaccgcuacguacaaaaucuuagagaccaauagucugaagagaauuauggaggaaacaacuccuaccacacuuaaaggcauguucgauagcacuccaaccuuuuugacacacgaggucgaagcaaacgugcugaccucccccaggucuguaauggagaagaauaaccuauucccgccucggcgaguugaaagcaauucaagugcccaucccugggggcucgugggaaaauccaacccaaagacuccucaggguacgguccugcuucacacacccgcuaccagcgagggccaggugacuaucucuaccaugacagggucaaguccagccgagaccaaagcguuuacugcagccuggagccugcgcaaucccuccccuagaacaucugugucggcuauuaagacggccccagcaaucgucuggagguuggcuaagaaaccgagcaccgcccccuccacuucaacaaccccuacaguucgggcgaagcucacuaugcaagugcaccauugcguaguggucaaaccaacccccgccaugcugacgaccccuaguccaucuuuaacaacugcacugcuccccgaagaacuuagcccguccccuucagugcugccacccagcuugccugaccuacaccccaagggagaauacccaccugaucuguucucuguugaggaacgcagacagggcugggugguccuccauguguuugguaugauguauguauucguugcucuggccauagugugugacgaguacuuuguccccgcucuuggggugauuaccgauaaacugcagaucuccgaggacgucgccggagcaacauucauggccgcuggcggcagugcgccagaauuguuuacuagccucauugggguguucaucucucacuccaacguuggaaucgguaccauugugggcucagcaguauuuaauauacuguucgucaucgggacgugcaguuuauucagcagggagauucugaaccuaacaugguggccgcucuuucgugaugugucguucuauauccuggaccuuauaauguugauucuguuuuuccucgauucccugaucgccuggugggaaucucuucuguugcuccuggcuuacgccuuuuauguuuucaccaugaaguggaauaagcacaucgaggugugggucaaagaacaguuaagccggcgaccuguggcaaagguaauggcccuggaggaccuaucaaaacccggagacggcgcuauugccguggaugagcuccaggacaacaagaaacugaaacuuccaaguuugcugacuagagguuccucuagcacaucccuccauaauucaaccaucaggagcacuauuuaccaacugauguuacacagucuggauccccuucgcgaaguucgguuggcaaaggagaaggaagaggagucucucaaccagggggcgagagcucagccucaagccaaggcagaauccaaaccagaggaagaggaacccgccaagcugccugcugucaccgugacaccggccccagugcccgacauaaaaggcgaucagaaggagaacccuggaggccaggaggacgucgcagaagcugagagcacgggggaaaugccaggagaggaaggugagaccgccggcgagggggaaacugaggaaaagucgggaggcgagacacagcccgaaggugagggggagaccgaaacacaaggcaaaggagaggaaugugaggaugagaaugaagcggagggcaagggggacaacgaaggagaggaugaaggugagauccaugccgaggacggcgaaaugaaagggaaugagggagaaacugagucacaggaacuaucugcugagaaccacggcgaggcaaagaaugaugaaaaagguguugaggacgggggcggaagugacggcggggauuccgaagaggaagaggaggaagaggaggagcaggaggaagaggaagaggaagaggagcaggaagaggaagaggaagaggaggaagaggaagaggaaaagggaaacgaggagccucugagccucgacuggccggaaaccaggcaaaaacaggccauuuaucuguuucuuuugcccaucguguucccacugugguuaacggugccugauguacgccgacaggagucucggaaguuuuucgucuuuacauuccucggcagcaucauguggauugcuauguuuuccuaccugaugguguggugggcccaucagguuggugaaaccauagggaucucagaggagauuaugggacuuacuauccuggcagcgggcaccaguauucccgacuugaucacaagcgugauagucgcccguaagggucucggcgauauggcugugucuuccucaguugggaguaauaucuucgacauuacugugggacugccaguaccuuggcuacuguucagccucaucaacggccugcaacccgucccaguguccucuaauggguuguuuugcgccauugugcuucuguucuuaaugcuccuguuugucaucucgagcauagcaucauguaaauggagaaugaacaagauucuuggauucaccauguuucugcuauacuucguuuuucucaucauuuccgugaugcuggaagauaggaucauaaguugcccgguaucuguguga

SEQ ID NO: 62633 - RNA, 1986 nt, Artificial Sequence
  derived and/or modified sequence opt3 from SLC24A2__Homo_sapiens__XP_005251482
auggaccugcagcaaagcaccacaaucacuucccucgagaaguggugccuugaugaaucucugucaggcuguagaaggcacuacagugugaaaaagaaauugaaguuaauucggguccuggggcuauucaugggacucguugccauaagcacgguguccuuuucuaucucggcuuucucagagaccgacacacagagcacuggugaagcaaguguaguguccggcccccgcgucgcccagggguaucaucagcgaacccugcuugaucugaacgacaaaauuuuggauuacacaccucaaccaccgcucucuaaggagggagaaagcgaaaauuccaccgaccacgcgcagggcgauuaucccaaggacaucuuuucacuggaggaacguagaaaaggugcuauuauccugcaugugauagggaugaucuacauguucauugcccucgcaaucguuugcgaugaguuuuucgugccuaguuuaacugucauuacagaaaagcugggaaucagcgacgauguggccggcgcuaccuuuauggcagccggcgggucugcuccagagcuuuucacguccuugauaggaguauuuauugcccacucaaacguugguaucggcacuauuguggggagcgcggucuucaauauccuguuugugaucggaaugugugcacuauucaguagggagauucucaaccugaccugguggccccuuuuucgggacgugucuuucuauauagucgaucugaucauguugauuaucuucuuucucgacaauguuauaauguggugggaaucccuguuacugcucacagccuacuucugcuaugugguauuuaugaaauucaacgugcaggucgagaagugggugaaacagaugauuaaucgcaacaagguugugaaggucacugcuccugaagcccaagcaaaaccaagcgcugccagagacaaggaugagcccacccuuccugcgaaaccaaggcugcagcggggcgguucgucugccuccuugcauaauucacuaaugcgcaacaguaucuuucagcugaugauccacacacucgacccgcuggcagaggagcuugggagcuacggaaagcugaaauacuaugauaccaugacggaggaaggccgauucagagagaaggcuuccauuuugcacaaaaucgccaagaagaaaugucauguggacgaaaaugagaggcagaacggcgcugccaaucacguagaaaagauugagcuccccaacucuacuagcacagauguugagaugaccccuucaagugacgcauccgaaccagugcaaaaugggaaccugagccauaacauagagggagccgaagcucagacugcggaugaggaagaggaccagcccuuaucucuggcauggccuucagagacacggaaacaagucaccuuucuaaucguguucccaauugucuuuccccucuggaucacgcugccggaugugcguaagccuaguagccgcaaauucuuucccaucaccuucuuugguuccauuacauggauagccguuuucucuuaccuuaugguguggugggcucaccagguaggcgaaacuaucgggauuucggaggaaaucaugggauugaccauucuggccgcaggcacaagcaucccagaccucauaacuuccgucaucguggccagaaagggucugggggauauggcuguuucaaguucugugggcagcaauauuuucgacaucaccgucggacuuccucugcccugguugcucuauacagugauucacagguuucagccaguagccguguccucaaacggccuguucugcgcaaucguuuuacuguuuauaaugcuacucuucgucauucugagcaucgcgcuuuguaaguggcggaugaauaaaauuuugggguuuaucauguucggacuguacuuuguguuccucguggucucuguucuguuagaggaccgaauacugaccugccccguguccaucuga

SEQ ID NO: 62634 - RNA, 1935 nt, Artificial Sequence
  derived and/or modified sequence opt3 from SLC24A3__Homo_sapiens__NP_065740
augagacccagcggcgacgaggauagggcccggcgccgacguagaaggcggcgcagaagggaccugcuccuuucccagcugugcuucuuggcuucuguggcauuacugcuauggucacucaguagccugcgggaacaaaaggagcuugaucugauggacuuggucggggaagaucgcaaauggaugauggcccgaaagcucaugcagguuaacgacacccugacauccgaggaugcgggacugagaaauucuaaaaacuguacugaaccugcucuccacgaguuuccaaaugacaucuucacgaacgaggauaggcggcagggugccgugguauuacaugugcugugcgcaauuuacauguuuuaugcccuugcuauagucugugacgauuucuuugugccgucguuggaaaagaucugcgagcgucugcaccuaucagaagacguugcaggcgccaccuucauggcugccgggagcagugcgcccgagcucuuuacauccgugauuggagucuucaucacuaaaggcgauguggguguagggaccauuguuggaucugcaguguuuaauauccuguguauaaucggcgucugcggccuuuucgccggacaggugguggcucugagcuccugguguuugcuccgcgacucaauuuacuauacacugagugucaucgccuuaauuguuuuuaucuacgacgagaaggugagcuggugggaaucucugguacucgugcuuauguaucugauauacauugucaucaugaaguauaacgcaugcauucaucaauguuucgagagaaggaccaaaggggcugguaauauggugaacggcuuggccaauaacgcggaaaucgaugacuccucaaauugcgaugccacuguugugcuacugaagaaagcaaacuuucaccggaaggcuagcgucaucaugguggacgagcuccugagugccuacccucaucagcuuucuuucuccgaagcugggcugcgaauuaugauaacaagccacuucccacccaaaacccgcuugucgauggccucuagaaugcucaucaaugagaggcagcggcugauuaacucccgcgcauacacgaauggagagucagaaguagccaucaagauaccuauuaagcacacuguugagaacggcaccgguccaaguagcgcucccgauagaggggugaacggaacaaggcgugacgaugucguggcggaagcaggcaaugagacugaaaacgagaaugaggacaacgaaaaugaugaggaagaggaagaggacgaggaugacgacgaaggcccuuauaccccauuugauacaccguccgggaaauuagagaccgucaagugggccuucacguggccccugucuuuugugcuauacuucacuguuccuaacuguaauaaaccacggugggaaaagugguuuauggugacauucgcuagcucaacccucuggaucgccgcauuuaguuauaugaugguauggauggucacuaucauuggauacacacuggguauccccgacgugauuaugggcauaaccuuccuugccgcugggacguccguuccugauugcauggccagcuugaucguggcacgacagggaaugggcgacauggcggucucuaacucaauugguaguaauguguuugauauccugaucgggcucggccugccaugggcccuucaaacccuggcuguagacuauggaagcuacauuagauugaacuccaggggccucauauauucuguggggcuguuacuggcaucgguuuucgucacaguguuuggagugcaucuaaauaaauggcagcucgauaagaaacuggguugcggcugucuuuugcuguacggggucuuccucugcuuuagcaucaugacugaguucaacguuuucaccuuugugaaucugcccauguguggagaccacuga

SEQ ID NO: 62635 - RNA, 1869 nt, Artificial Sequence
  derived and/or modified sequence opt3 from SLC24A4__Homo_sapiens__NP_705932
auggcccugagaggcacccucaggccccuuaaggugcggcgccgacgugagaugcugccucagcaagucggguucguuugcgcuguguuggcauuaguauguugcgccagcggacuguuugguucccuaggccacaaaacagcgucugcuucaaagagagugcucccagacacuuggaggaaccggaaacugauggccccggucaaugggacgcagaccgcaaagaacuguacagaucccgccauccaugaguucccuacugaccuuuuuaguaauaaagaacgccagcacggagcugugcuguugcauauucucggcgcacuguacauguucuaugcccuggcuauaguuugcgaugacuuuuucgugccaagccucgaaaagaucugugagagauuacaccuguccgaagaugucgccggugcgaccuuuauggcagccgggucuucgacacccgagcuuuucgcuucagugauuggaguauuuaucacccauggcgacguuggcguggggacuauugucggaagcgccguguucaacaucuugugcauaaucgguguguguggccuguuugcagggcaggucguuaggcuaacauggugggcugugugccgggauaguguauacuauaccauuuccgugaucguccucauuguguucaucuacgacgagcaaauaguuuggugggaaggacuggugcuuauuauccuguaugucuuuuacauuuugaucaugaaguauaaugugaaaaugcaggccuucuucacgguaaagcagaaaucuaucgcgaacggcaauccuguuaacagcgagcucgaagccgguaaugauuuuuacgacggguccuacgaugacccaucagugccccuguuaggacaggucaaggagaaaccucaauauggcaagaacccaguggucaugguggaugagauuaugaguagcucuccgcccaaguucacuuuuccugaagcaggccugcgcauaaugaucaccaauaaauucgggccacgaacaagacucaggauggcuucccggauuaucauaaacgagcgucagcgccuuauuaauucagccaacggaguuagcaguaagccccugcagaaugguagacacgaaaacaucgagaacggcaaugugccuguagaaaacccagaggacccccagcaaaaucaggagcagcaaccgccuccccagccaccucccccagaacccgagccugucgaagcugacuuuuugucuccauucuccgugccggaggccaggggagauaaaguuaaguggguguuuacuuggccccuaaucuuccugcucugugucaccauuccuaacugcagcaaaccacggugggaaaaguuuuucauggugacauuuaucaccgcaacgcuguggauugccguauucucguacauaaugguguggcuuguuacuaucauuggguauacacugggcauccccgacgucaucauggguauuaccuuuuuggcugcggggacuucugugccugauuguauggcaucccucauaguggcccgacagggccugggagacauggcugucucaaauacaaucggcaguaacguuuucgauauuuuaguggggcugggagugccauggggucuacagaccaugguagucaauuacggcagcacggugaaaaucaacucccgcgggcucguuuauucugugguccugcuuuugggaagcguggcccugaccguucucggcauucaccugaauaaguggagacuugacaggaagcuggguguguacguauugguccucuaugcaaucuuccugugcuuuucaauaaugaucgaguucaacguguuuacauucgugaauuuacccaugugccgggaggaugacuga

SEQ ID NO: 62636 - RNA, 1503 nt, Artificial Sequence
  derived and/or modified sequence opt3 from SLC24A5__Homo_sapiens__NP_995322
augcagaccaagggcgggcaaacaugggccagaagggcucugcuccuuggaauccugugggcaacugcccacuugcccuuaagcgguacgucccugccucagcggcuaccacgcgcgaccggcaacucuacacagugcgugauuucaccgaguagcgaguuccccgaaggguuuuucacucgacaggagcguagagacggaggcauaaucauuuacuuucucaucauugucuauauguucauggcuaucuccauaguuugugaugaauacuuucugccuucucuugagaucauuucggaaucacuggguuugagccaagacguggccgggaccacauucauggcagccggaaguuccgcuccagagcucguaaccgcauuucugggcguguucaucacuaaaggcgauauugggaucucuacaauacugggaagcgccauuuauaaucucuuagguaucugcgcugccuguggccugcuuuccaacaccgucucaacguugaguugcuggccccuguuuagggacugugcggcauacacuauuagcgccgcugccgugcuagggaucaucuaugauaaucagguuuacugguaugagggagcacuccugcuucugauuuacggcuuguacgugcucguccugugcuucgacauaaagaucaaccaguauauuaucaaaaaguguucuccuugcugugcuugcuuagccaaagcgauggaacgguccgagcagcaaccacugauggguugggaagaugaggggcagcccuuuauacgcagacagucaaggaccgacagcggaauuuucuacgaggauaguggcuauucucagcucuccaucagccuucauggccugucgcaagugucugaagacccuccauccguauuuaauaugccggaggccgauuugaagcggaucuucuggguucuaucacugcccauuaucacacuccuguuccuuacuaccccugacugucgcaagaaauuuuggaagaacuacuucgugauuacauuuuucaugagugcaauauggaucagcgcuuuuaccuauauucuggucuggauggugacgaucacuggggaaacauuggagaucccagauaccgugaugggacucacucuguuagccgcugguacauccauucccgacaccauagccucuguccugguugcacgaaaaggcaagggggacauggccaugagcaauaucgugggaucaaacguauucgauaugcuaugccucggcauuccuugguuuaucaaaacggcuuucauuaaugguagugcgccagcagaagugaacuccagagggcugaccuacaucacaauaagccuuaauaucucuauuaucuuuuuguuccuggccguccacuuuaacggcuggaagcucgacaggaagcugggaauugugugccuucugucauauuugggccucgcuacucugaguguuuuauacgagcuggggaucauaggaaauaacaaaauucgggguuguggcggguga

SEQ ID NO: 62637 - RNA, 891 nt, Artificial Sequence
  derived and/or modified sequence opt3 from SLC25A10__Homo_sapiens__NP_001257817
auggccgcugaggcaagaguguccaggugguacuucggcgggcuggccagcugcggagcggcuuguugcacccacccccucgaccuucugaagguccauuugcagacacaacaggaaguuaaauuacggaugacugguauggcccugcgcgugguacgaacggauggcauccuagcacucuauucugggcugucagccagucuuugucgucagaugaccuacagccugacaagauuugcuauuuaugagacugugagggaccgggucgcaaagggaucccagggcccuuugccauuccacgaaaaagugcuccuggguucuguuucggggcuggccggaggcuuugugggcaccccggcugaucucgucaacgugcgcaugcaaaaugacguaaaguuaccccaggggcagagaaggaacuacgcccaugcgcuggauggacuuuaucggguugcacgcgaggaagguuugcgaagacuguucucaggcgccacaauggcuagcaguaggggagcccuagugaccgucgggcagcucuccugcuacgaccaagcaaaacagcuggugcuuucuacuggcuaucugagcgauaauauauuuacacacuucguggcuuccuuuaucgccgcggccggugacgagccuccaccccaagggggaugugcaaccuucuugugccagccucucgauguccugaagacgcgguuaaugaacucaaagggcgaguaccagggcguuuuucauugugcuguggaaacugccaaacuggggccacucgcuuucuacaagggacuuguacccgccgguauucgucugaucccucacaccguguugacauuugucuuccuagagcagcugcgcaaaaauuuuggcauuaaggugccaaguuga

SEQ ID NO: 62638 - RNA, 2037 nt, Artificial Sequence
  derived and/or modified sequence opt3 from SLC25A12__Homo_sapiens__NP_003696
auggccgugaagguccagaccacaaaaagaggcgacccccacgagcugaggaacaucuuccuccaauacgcuagcacugaaguugauggggagcgguauaugacgccugaagacuuugugcagcgcuaccuuggacuguauaaugauccaaacuccaauccgaagauuguacaguuguuagccgguguggcagaccagaccaaagauggccugauaucuuaccaagaguuccuagcguuugaaucaguccucugcgcucccgacaguauguucaucguggccuuucagcuguucgauaagagcgggaacggagagguuacauuugagaaugugaaagaaauuuucggccagacuaucauucaucaccauaucccuuuuaacugggacugugaguucauacgacuucacuuuggucauaaucguaagaagcaccugaacuauaccgaguucacacaguuuuugcaagaacuccagcuggagcacgcaagacaggccuucgcucugaaagauaaguccaaaucugggaugaucucgggacucgacuucucagauauuauggucaccaucaggagccauauguuaacuccauuuguggaagagaaucugguaagugcagccggcggcuccauuucucaccagguuagcuucuccuacuuuaacgcuuucaauucacuuuugaacaauauggaacuggugcggaagaucuauaguacacuagccgggacccgcaaagacgucgaggugacgaaggaagaguuugcgcaaagcgcaauaagauacggacaggugacuccccucgagauugauauccuguaccagcuugccgaccuguauaacgcuucugguagguugacccucgccgacauugaacggaucgcaccucuggcugagggcgccuuaccauacaaucuggcggaacuccaacgccagcagucccccgggcuuggacgaccuaucuggcugcagauugccgagucagcauauagauucacauugggcagcgucgcuggugccguuggggcuacugccguguacccaauagaucuaguaaagaccaggaugcaaaaccagcggggaaguggcucuguggucggcgaacugauguauaaaaacuccuuugacugcuucaagaaagugcuccguuacgagggguuuuucggacuguaucgcggucuuaucccgcagcugauuggcguugcacccgagaaggccaucaaauugacagugaaugauuuugucagagacaaguucaccaggcgggaugggagcgugccucucccagcugaaguacuggcgggaggcugugccggugggucgcagguuauauuuacgaaccccuuagagauugugaaaauccgacugcaagucgcaggcgaaaucacuacaggaccucgcgugucugcucuaaauguccucagagaccugggcauuuucgggcuuuacaagggagccaaggcaugcuucuugagggauaucccauuuuccgccauuuacuuccccguguaugcucauuguaaacugcuccuggccgacgagaacggucacguuggcgggcuuaaucuguuggcagcgggagcuauggccggcgugccggcagccucacucguaaccccugcugaugucauaaagacucgguuacagguggccgcacgcgcuggucagacaaccuacagugggguuaucgacugcuuuagaaaaauucugagggaagagggccccagcgccuucuggaagggaacggcggcccguguguuucgguccucuccacaguucggcgucacccuggugacauaugagcuacuccaacgaugguuuuacaucgauuucgggggacugaaaccugcugguagcgaacccacuccaaagucaagaaucgcagaccuucccccugccaacccagaccacauuggcggguauagguuggcuaccgccacauuugcaggaauagagaauaaguucggccuguaccucccgaaauuuaagagucccuccguagcggugguucagccuaaagccgcugucgccgcaacucaguga

SEQ ID NO: 62639 - RNA, 2031 nt, Artificial Sequence
  derived and/or modified sequence opt3 from SLC25A13__Homo_sapiens__NP_001153682
auggccgcugcaaagguggcccugaccaaaagagcggaccccgcugagcucaggacaaucuuccuuaaguacgccagcauugaaaagaacggcgaguuuuucauguccccuaaugauuuugucacucgguaucugaacauauucggggaaucucagccaaauccgaagacgguugaguuguuaucaggagugguagaccaaaccaaagauggucugaucaguuuucaggaguucguggcauuugaaagcguccuaugcgcccccgacgcucucuucaugguggcauuucagcuguucgauaaggccggcaagggggagguuacauuugaagacgugaaacaggucuucggacaaacuaccauucaccagcauaucccuuuuaacugggauuccgaguucgugcagcuucacuucggcaaggaacgcaaacgacaucugacauacgcugaguuuacccaguucuugcucgagauucaacuggaacacgccaagcaggcguuuguacagcgugacaaugcaagaacugguaggguuacagccaucgauuuccgggacauaauggugaccauccgcccacauguccugacgcccuuuguggaggaaugucucguggcugccgcagggggaacuaccucucaccaggucucguucucauauuuuaacggcuucaauagcuuacugaacaauauggagcuuauuagaaaaaucuacaguacauuggcuggcacuaggaaggauguugaagugaccaaggaggaguuuguacuggccgcgcaaaaauucggacaggugacaccuauggaagucgacauucuauuucagcucgccgaucuguaugagccacgggggcgcaugacccuugcagacaucgaacgaauagcuccccuggaggaagguacguugccuuucaaccucgccgaggcucaaagacagcagaaggccuccggcgacucugcaaggccagugcuguuacagguugccgagagcgcuuaccgguuugggcugggauccguggcgggcgcagucggugccacugcuguguauccgauugaucucguaaaaacacguaugcaaaaucagcgcucaaccgggaguuucguuggagaacuuauguacaagaacagcuucgacugcuuuaaaaaggugcugagauacgagggcuucuuuggcuuguauagggggcuacugccccagcuccugggagucgccccugaaaaagcaaucaaacuuacugugaaugauuucguccgggacaaguuuaugcacaaagaugguucugugccacuggccgcugagauuuuggccggcgggugugcaggaggcucccagguuaucuucacaaacccccucgaaaucgugaagauucgacugcaaguagcgggugagauaaccacggggccucgcgucucagcuuuaagcgugguuagagaccugggcuuuuucggaaucuacaaaggcgccaaggcaugcuuucuaagggauauuccauucagugccaucuauuuucccuguuacgcucaugugaaagccucuuucgcaaaugaggacgggcaggucuccccgggaagccuccugcuugcuggugccauagcgggcaugccugccgcuucguuggugacccccgcagauguaauuaagacacggcuccagguggccgcucgcgccgggcagacuaccuauucuggaguuaucgacugcuuuagaaagauccugagggaagagggcccaaaagcacuguggaagggugcgggggcccgugucuuccgguccucaccucaauucggcgugacacuucugacuuacgaauugcuccagcgaugguuuuauauugauuucggaggcgugaaacccauggggagugagccaguccccaagagcagaaucaaccugccugcuccaaacccggaccacguuggagguuacaaauuagccguggcaaccuuugcuggcauugagaauaaguucgggcuguaccuaccccucuuuaagccuuccgugucuacaagcaaagccauaggaggcgguccauga

SEQ ID NO: 62640 - RNA, 978 nt, Artificial Sequence
  derived and/or modified sequence opt3 from SLC25A14__Homo_sapiens__NP_001269124
augggcaucuuccccgggauuauacugaucuuucucagagugaaguucgccaccgcugcagucauuguuagcggacaccagaaauccacaacugugucucaugagaugucaggucuuaacuggaagccuuuuguauacggcgggcuggccaguaucguggcggaguucggaacguuuccagucgacuugaccaaaacaagguuacaagugcagggccagagcauugaugcucgguucaaggaaaucaaauaucgcgguauguuucacgcccuguuccgaauaugcaaggaagaggggguucuagcacucuacuccggaaucgccccggcucugcuucgucaggcaucuuauggcacuauuaagaucggcauuuaccaaucgcugaaaagauuguuuguggaaaggcucgaggacgagacccugcugaucaauaugauauguggggucgugucaggaguaauuagcaguacaaucgccaaccccaccgauguucucaagauucggaugcaggcucaggguuccuuauuccagggcucuaugaucgggagcuuuaucgacauuuaucaacaggaaggaacucgcggccuguggagagguguggucccuacagcccagagggcggcaauaguggugggggucgagcuuccaguuuacgauaucaccaaaaagcauuugauucuguccggaaugaugggcgacacgauccuaacucacuucgugucaaguuuuaccugcggccucgccggggcucuggccagcaaucccguagaugugguccggacacgcaugaugaaccagcgagcaauagugggacauguugaccuuuauaaagguacuguggauggcauucugaagauguggaagcacgaaggguucuucgcuuuguacaaaggauuuuggccuaauuggcucagacugggcccauggaacaucaucuucuuuauuaccuacgagcaauuaaagaggcugcagaucuga

SEQ ID NO: 62641 - RNA, 906 nt, Artificial Sequence
  derived and/or modified sequence opt3 from SLC25A15__Homo_sapiens__NP_055067
augaaaagcaaccccgccauccaggcugcaauugaccugaccgccggcgcggcugggggaacagccugcgugcucacuggucaaccuuucgauacgaugaaggucaagaugcagaccuuuccagaccuuuacagaggccugacagauuguugcuugaaaacuuauucccagguuggguucaggggauuuuacaagggcaccucuccggcauuaauagccaauaucgcugagaacucagugcuguucauguguuaugguuuuugccagcaaguagugcggaaagucgcagggcuagacaagcaggccaagcucagugaucugcagaaugcugccgcgggcagcuucgcauccgccuuugcugcccuugugcugugucccacagaauugguuaaaugccgccuccagaccauguacgagauggaaacuucuggaaagauugcaaaaucgcaaaacacaguguggucagucaucaagagcauucugcgaaaagacggcccucugggguucuaucacggacucaguuccaccuuacugcgugaggugccagguuacuuuuucuuuuucggcggguaugaacuuucuaggagcuuuuucgcuuccggaagaucaaaggaugaguugggccccguaccucugaugcuaaguggugggguuggaggcaucugucucuggcuggccguguacccagucgacugcauaaagagccggauccaggugcuuucuauguccggcaaacaggcgggguucauucgcacguuuaucaauguggucaagaacgagggaauuacugcccuguacucagguuugaaacccaccaugaucagagcauucccugcuaauggcgcccucuuucuggcuuaugaauacagcaggaaguuaaugaugaaccagcuggaggccuauuga

SEQ ID NO: 62642 - RNA, 705 nt, Artificial Sequence
  derived and/or modified sequence opt3 from SLC25A16__Homo_sapiens__XP_006718050
augaugaucagaauuuuccccuacggcgccauacaguuuauggcuuucgagcacuauaagacccugaucacaacuaaacucgggauuagcggacaugugcacaggcuuauggcagguuccauggccggcaugacggcggucaucugcaccuacccucuggacaugguucgggugcgcuuggcuuuucaaguaaagggggaacauucuuauacaggaauuauccacgccuucaaaacuauauacgcaaaggagggcgguuucuucggguuuuaucgaggauuaaugccaaccauccugggcauggccccguacgcuggcgugucauucuuuacauucgggacccuaaaaagugucggacucagccaugcacccacucugcuuggucguccuuccucugauaacccaaaugugcugguuuugaagacacacgugaaccuccuguguggcggggucgccggagcuauugcccagaccaucucguaucccuuugacgugacgagaaggcggaugcagcugggcacuguacucccugaauuugagaagugcuuaaccaugcgcgauacaaugaaauacguuuacggucaccaugggauuagaaagggacuguauaggggccuuucauugaauuacauccgguguauaccaagccaggcgguggcauuuacuaccuaugaacugaugaaacaauucuuccaccuaaacuga

SEQ ID NO: 62643 - RNA, 948 nt, Artificial Sequence
  derived and/or modified sequence opt3 from SLC25A18__Homo_sapiens__NP_001290413
augacccaccaggaccugagcaucacagccaagcucauuaacggcgggguggcuggacuugucgguguuacuugcguguuccccauagaucuggcaaaaacgagauugcaaaaucagcauggcaaggccauguacaaagggaugaucgacuguuuaaugaagaccgcgagggcugagggauuuuucggcauguaucggggugccgcaguaaaccugacccuagugacuccugaaaaagccauuaagcucgcugcaaaugacuuuuuccgccgacugcuuauggaggaugggaugcagcguaaccugaagauggaaauguuggccggaugcggcgcuggcaugugucaggucgugguuaccugcccaauggagaugcucaaaauccaacugcaggaugccgggagacuggcggugcaccaucagggauccgcaucugccccgucaacaaguaggagcuacaccacugguuccgcuucuacacaccggcgccccucggccacccucauugcaugggaauuacugagaacgcagggccuugcuggguuguauaggggacugggcgccacucuacuccgggacaucccuuuuucaauaaucuacuucccacuguuugcgaaucuuaacaaucuggguuucaacgaguuggccgggaaggcuagcuuugcacauaguuucgucuccggauguguggccggcucuauugcugccguagcaguuacaccccucgaugugcugaaaacacgcauccaaacuuuaaagaaaggccugggggaggacauguauagcggaauuaccgauugcgcccgaaagcucuggauccaggaagguccuuccgcuuuuaugaagggcgcgggguguagagcacuugucauagccccacuguucggaauugcucagggcguguacuuuaucgguauuggggagaggaucuugaaaugcuucgacuga

SEQ ID NO: 62644 - RNA, 963 nt, Artificial Sequence
  derived and/or modified sequence opt3 from SLC25A19__Homo_sapiens__XP_006722070
auggugggcuacgaccccaagccugaugggagaaacaauaccaaauuccaggucgccguugcuggaagcguguccggucugguaacaagggcacucaucucuccauuugacgugauuaagauacgguuccaacuucagcacgagcgccugucacgaagugauccgagcgccaaauaucauggcaucuugcaggcgucccgucagauuuuacaagaagaggggcccacugcuuuuuggaagggacacgucccugcccagauccugucuauuggcuacggugcagugcaguuccuaucguuugaaaugcucacggagcugguucauagagggucaguguaugacgccagggaguucagcguccacuuugugugcggaggccuugcugcauguauggccacccugacaguacauccaguugauguguugcggacucgcuucgcugcccagggcgaacccaaagucuacaacacccucagacacgcgguggggacaauguauaggagugagggaccucaaguguuuuacaagggucuggcaccaacccugaucgccauauuccccuaugcuggccuccaguuuuccugcuacucuagcuuaaagcaccuguacaaaugggccaucccugcagaagggaagaaaaaugagaaccuucagaauuugcuguguggauccggcgcuggugucauuucaaagacucuaacauauccacucgaccuguucaaaaagcggcuucagguugggggauuugaacaugcccgcgcggccuucggccaagugcgaagauacaagggccugauggauugcgcaaaacagguauugcagaaggagggggcucucggauucuuuaaaggucugaguccgagcuuacugaaggccgcucucucuaccggcuucauguuuuucuccuaugaguuuuucuguaacguguuucacugcaugaauaggacggccucacaacgguga

SEQ ID NO: 62645 - RNA, 957 nt, Artificial Sequence
  derived and/or modified sequence opt3 from SLC25A1__Homo_sapiens__NP_001243463
auguuccccgccgcucuggcaagaaggccucggcgcccaaagagcggcaccggggagggaccggaacgacagcgucccgguggcucccucagaucuggguuuccugugccagccggaggccuugcgggugggaucgagauuugcauaacauuccccacugaauacgucaaaacgcaacugcaguuggacgagaggucacacccuccacgguaucgcggaaucggcgauuguguuagacagaccgugaggagucauggcguauuagggcuguaccggggacuaagcucccuccuguaugguucuauucccaaggcugccgugcgcuuuggcauguucgaauuucuuucgaaccacaugcgagacgcacaggggagacuggauucaacaaggggauugcucugcggccugggugccggggucgcugaggcagugguuguggucuguccuauggagacuaucaaagugaaguucauucaugaccaaaccagcccaaauccgaaauaccggggauuuuuccacggcguacgugaaaucguucgcgagcagggccugaaggggacauaucagggacucaccgccacuguguuaaagcaggguaguaaccaagcuauaagauuuuucgucaugacaucccugaggaauugguaccggggcgauaaccccaauaaaccuaugaacccacuuaucaccgggguguuuggagccauugcgggcgcagccucuguguucgguaauacgcccuuggacgucaucaagacucgaaugcaggggcuggaagcucauaaauaucgcaacaccugggauugcggccuacagauucucaagaaagagggacugaaggccuuuuacaagggcacaguuccuagacuugggagggugugucuggacguagcaaucguguucgucauauacgaugaggugguuaaauugcucaauaagguguggaaaacugacuga

SEQ ID NO: 62646 - RNA, 906 nt, Artificial Sequence
  derived and/or modified sequence opt3 from SLC25A20__Homo_sapiens__NP_000378
auggccgaccagcccaagccuaucagcccacugaaaaaccuccuugcuggcggguucggaggugugugccuggucuuuguuggccacccguuggauaccgugaagguaagauuacaaacacagcccccuucccugccagggcagcccccuauguacucuggaacuuucgacuguuuuaggaaaacgcuauuccgggagggcauuaccggucucuaucgcgggauggcagccccaauaaucggagugacacccauguuugcggucugcuucuuuggcuucggccuggggaagaaacuucagcaaaagcauccugaagaugugcugucauacccacaguuguuugcugccggaaugcucagugguguuuucacuaccggcauuaugacaccgggggagcgaaucaagugucugcugcagauucaggcaagcuccggagaaucuaaauauaccggcacucucgacugcgccaagaaauuauaccaagaguuugguauccgugggauauauaagggaacagugcugacccuuaugagagauguccccgcuucgggcauguacuucaugacguaugaaugguugaaaaauaucuuuacuccugagggcaagagggugucagagcugagcgcaccacggauucuaguagccgggggaaucgcugguauuuucaacugggccguugcgauacccccugacgugcucaagagucgcuuccagaccgcaccacccggcaaauacccgaauggguuuagagauguccugagggaacuuauccgggacgagggagugacaucccuguacaagggcuucaacgccgugaugauucgcgcuuuuccugccaaugcagcuuguuucuuggguuuugaagucgccaugaaauuccucaacugggcgacucccaaucuguga

SEQ ID NO: 62647 - RNA, 897 nt, Artificial Sequence
  derived and/or modified sequence opt3 from SLC25A21__Homo_sapiens__NP_001164641
augagcgccaagcccgaggugucccuggucagagaggcuucuaggcagaucguugcaggcgggucagccggacucguggaaauuugccuuaugcacccucuggacguagugaaaacccgguuccaaauacagcgcugugcgacagauccaaacaguuacaagagcuuggucgacuccuuucgaaugaucuuccagauggaagguuuauuuggcuucuauaaagggauucugccgcccauccuagcugagacuccuaagcgugccgugaaauuuuucacguuugaacaguacaagaagcuccugggauauguuucucuuucgccagcacugaccuucgccauugcuggcuuggguucagggcucacagaggcaaucguggucaaucccuuugaggugguaaaaguuggacugcaagccaacagaaauacuuucgcugaacagccuagcaccgugggcuacgccaggcagauaaucaagaaagagggcugggggcugcagggacucaacaaggguuuaacagcgacccugggccggcauggggucuuuaauaugguguauuucggauuuuacuauaacgugaaaaauaugauuccagucaacaaggaucccauccuugaguucuggcgcaaguucggcauugguuugcugagugggacuaucgcauccguuauaaauauuccuuuugacguggccaaaucuagaauccaaggaccacagccgguacccggcgaaauuaaguacaggacaugcuucaaaaccauggcuacgguguaccaggaggaaggcauccuagcccucuauaaggggcugcuuccuaaaaucaugcggcugggaccagguggcgcagucauguugcucguguacgaguauacuuacagcuggcugcaggaaaacuga

SEQ ID NO: 62648 - RNA, 972 nt, Artificial Sequence
  derived and/or modified sequence opt3 from SLC25A22__Homo_sapiens__XP_011518673
auggccgacaagcagaucagccugcccgcuaaacucauuaacggcgggauagcaggacuuaucggugugaccugcgucuucccuauugaucuggccaagacaagauugcaaaaucagcagaacggccagaggguuuacacuuccaugucugacuguuuaaucaaaacggugcggucagagggguauuuuggaauguaccgcggcgcggcuguaaaucugacccuagugacaccagaaaaggccauuaaacucgcagccaacgauuucuuucgacaccaacugaguaaggacggucagaaacuuacucuguugaaggagaugcucgcugggugcggagcaggcaccugucaggucaucgugacaaccccgauggaaaugcugaagauacagcugcaagaugccggccguaucgcugcccagagaaaaauucucgcggcacaggggcaguuaagcgcccaaggaggugcucagcccuccguugaggccccugcagcuccaaggcccacugccacacagcugacccgggaccuuuugcgcucuagaggcaucgcggggcuguauaagggacuaggcgccacgcuccugagggaugugccuuucucggucguguacuuuccacuuuucgcaaaucugaaccaauugggucggcccgcuucagaagagaaaagcccuuuuuauguaaguuuccucgccgggugcguugcuggauccgccgcagccguggcugucaauccaugugacguggugaagacucgccugcagucuuuacagcgaggcgucaacgaggauaccuacagcggcauucuggacugcgcgagaaagauccucaggcaugaagggccguccgcauuucuuaaaggagccuauugucgggcucugguuauagcccccuuguucgguauugcacaggugguauacuuucuaggcaucgccgagucacugcucgggcugcuucaagauccucaggcuuga

SEQ ID NO: 62649 - RNA, 1407 nt, Artificial Sequence
  derived and/or modified sequence opt3 from SLC25A23__Homo_sapiens__NP_077008
augagaggcagccccggggacgccgagaggcggcagcgcuggggacgacuguucgaagaguuggauuccaacaaggacggucguguggauguccacgaacuuagacaaggccuggcuaggcucgggggaggcaauccugacccaggugcacagcaggggaucucuucagagggagaugccgacccggauggcggcuuagaccuggaagaguuuagucgguaccuacaggagcgcgaacaaagacuccugcuuauguuccauagccuggauaggaaccaggacgggcacauugauguuuccgagauacagcagucuuuucgggcguugggaaucucgauuucacucgaacaagcugagaaaauccugcauagcauggaccgcgaugguaccaugacaauugacuggcaggaguggcgagaccacuuccugcuccauaguuuagaaaauguggaggauguacuguauuuuuggaagcacuccacugugcuugacaucggcgaaugcuugacgguccccgaugaguucucuaaacaggaaaagcugaccgggaugugguggaaacagcuaguggccggagcaguugccggcgcugugagcagaacagguacugcaccucucgacaggcugaaggucuuuaugcaagugcacgccuccaagaccaaccggcuuaauauacugggaggguugcguucaaugguacucgagggcggcauccgcagucuguggagagggaacggaauuaauguuuuaaaaaucgcuccagagagcgccauuaaguucauggcguacgaacagaucaaaagggcaauacugggucagcaagagacacuccaugugcaggaacgguuugucgccggcucucuugcuggggccaccgcacagacuauuaucuaucccauggaggugcugaagacacgauugacccuacgcagaacgggacaguacaaaggccugcucgauugugcuaggcggauucuggaacgcgaggguccuagagccuucuauaggggguaccuuccaaacgugcugggcaucauccccuaugcgggaauugacuuggccgucuacgagacucucaagaauugguggcugcaacaguacucccacgauucagcagacccuggcauauuaguucugcuagcuugcgggaccaucagcaguacauguggacagauugccucuuauccacucgcucuggugcguacucggaugcaggcccaagcauccaucgaagguggcccgcagcuuagcauguuggggcugcuccgacauauacugucgcaggagggaaugagaggccuuuacagggguauugcccccaacuuuaugaagguaaucccugcugugucuaucuccuaugucguguacgaaaauaugaaacaggcgcuggggguuaccucacgcuga

SEQ ID NO: 62650 - RNA, 1512 nt, Artificial Sequence
  derived and/or modified sequence opt3 from SLC25A25__Homo_sapiens__NP_001006642
auggugagcuccguccugugcagauguguugccucucccccuccagacgcugcagccaccgcggcuucaaguagcgccuccucuccggcaucggugggcgaucccugcgggggagccaucugugguggcccugaccacaggcuccggcuuuggcgccuguuccagacauuggauguaaaccgagacgggggauuaugcgugaaugaucuggcugucggccuacguagacucggucugcauaggacugagggggaacuucaaaagauugugcaggcaggagacaaagaucuggacggccaguuggauuuugaggaguucguucacuaccuccaggaccaugagaagaaacugcggcugguguuuaagucacucgauaaaaagaacgacggccgcauagaugcccaagaaaucaugcagagcuuaagagaccugggggucaagauuagugagcagcaggcugagaaaauccuuaaguccauggacaaaaauggaacgaugaccauugauuggaacgaauggagggacuaucacuugcugcauccaguggagaauauccccgaaauaauccuauacuggaagcacucuacaauuuucgauguaggugagaaccucacuguuccugacgaguuuaccguggaagaacggcaaacaggcaugugguggcgccaccuggucgccgggggaggcgcgggugcagugagccgaaccuguacugccccacuugauagacugaaaguguugaugcagguccaugcuuccaggucaaauaacauggggaucguuggaggcuucacacagaugauucgggaaggcggggcccguagucucuggcgcggaaaugguaucaacgugcugaagauagcacccgagagcgcuauuaaguuuauggccuaugaacagaucaaaagauuaguaggcucugaccaagagacccugaggauucacgagcggcucguggcggggucccuugccggagcaaucgcucagucaagcaucuacccuauggaaguccugaagacgcgaauggccuugcgcaaaacuggccaguauagugguaugcuagauugcgcuagaaggauucuggcccgggaggggguggcagccuucuacaagggcuauguuccaaauaugcucggaauaaucccguacgcuggcauugaccuggcgguguacgaaacccuuaaaaacgcauggcugcaacauuaugccgucaauucugcugaucccgggguguuuguauugcucgccuguggaacaauguccagcacuugcggucagcuggcaucguacccuuuagcccugguucgcaccagaaugcaggcucaggccucuaucgagggcgcaccagaagugacaauguccucacuauucaagcacauacucaggaccgagggggcguuuggacuguaucguggccuugcucccaacuucaugaaagucauuccugccgugaguaucagcuacgucguguaugagaauuugaagaucacgcuggguguucaaucccgguga

SEQ ID NO: 62651 - RNA, 903 nt, Artificial Sequence
  derived and/or modified sequence opt3 from SLC25A27__Homo_sapiens__NP_001190980
augagcgugcccgaggaagaggaaagacugcucccucuuacccagagguggccacgggccuccaaguuccuguugucuggcugcgcugcaacagucgccgaguuagcgacuuuuccgcuggaccuaacgaaaacccgccuccaaaugcagggggaagcugcccuggcacgacuuggagauggugcccgugagucagcucccuacagaggcaugguuaggacagcacuggggaucauugaggaagagggauucuugaagcucuggcagggcgugacuccugccauauaucggcacguaguguacaguggugggcgcauggucaccuaugaacaucugagagaggugguuuuuggaaaaagcgaggacgaacacuacccacuguggaaguccgugaucggcggcaugauggcuggggucauuggacaguuccucgccaaccccacagauuuagugaaaguacaaaugcagauggaggguaagaggaagcuggaaggcaaaccucuucgguuucgcgggguucaucacgcguucgcaaagaucuuggccgagggaggcauucgaggucugugggcugggugggugccaaauauccagagagccgcucuagucaacaugggagaccucaccacuuaugauacagugaaacauuaccuggugcuuaauacgccccuggaagacaacauaaugacccacggcuugucuucgcucuguucaggccuggucgcaagcaucuuagggacuccugccgauguuauuaagaguaggaucaugaaucagccacgggacaaacaaggacguggucugcucuauaaguccucuaccgauugccuuauucaggcggugcagggcgagggguuuaugagccuguacaagggauucuugccguccuggcuacgcauguga

SEQ ID NO: 62652 - RNA, 906 nt, Artificial Sequence
  derived and/or modified sequence opt3 from SLC25A2__Homo_sapiens__NP_114153
augaaaagcggccccgggauccaggccgcuauugaccugaccgcaggagccgcggguggcacagcuugcgugcucacugggcaaccuuucgauacgauaaaggucaagaugcagaccuuuccagaccuuuacaaaggacugacagauuguuucuugaagacuuaugcccagguuggcuuaagagguuuuuacaaagggaccggaccggcacugauggccuauguggcugagaacuccguacuauucaugugcuacggcuuuugucagcaauucgugaggaaggucgcaggcauggacaagcaggccaaacucucugaucugcagacagcugccgcggggucauuugcaagugccuucgcugcccuugcacugugccccaccgaauuggugaagugucggcuccagacuauguaugagauggaaaugagcggaaaaaucgcuaagucccacaauacaauuuggucuguugugaaagguauccugaagaaggacggcccucugggguuuuaccauggacucucgucaaccuuacugcaagaggucccaggcuauuucuuuuucuuugguggguacgaacuuagccgcaguuucuucgccuccggacgaucuaaagaugaguugggccccgugcaccugaugcuaagcggcgggguagcgggaauuugccucuggcugguuguguuuccugucgacuguaucaagucccguauacaggugcuuucaauguacgguaaacaggccggcuucaucgggacgcuguugaguguggucagaaacgagggaauuguugcacucuauagcggccugaaggcuacuaugaucagggccauuccagcuaauggugccuuauuuguggcauacgaauauucucggaaaaugaugaugaagcagcuggaggccuacuga

SEQ ID NO: 62653 - RNA, 936 nt, Artificial Sequence
  derived and/or modified sequence opt3 from SLC25A36__Homo_sapiens__NP_001098117
augagccagagagacacccuggugcaccucuucgccggcgggugcggagguacagucggcgcuauccuuacuuguccccuggagguugugaagacgagguugcaauccucuucaguaaccuuauacauuagugaagugcagcugaacacaauggcaggggccagcgucaaucgggugguuuccccuggaccacuacauugccucaaagugauacuggagaaggaaggcccgcgcucucuuuuucgaggucuggggcccaacuuggucggaguggcgccuucgcgugcuaucuauuucgccgcauacucaaauuguaaagagaagcucaacgauguauuugacccagauagcacucagguucacaugauuagugccgcuauggcaggcuucaccgccaucacagcuaccaaucccauuuggcugaucaaaacuagacugcagcucgacgccaggaaccggggcgaacgcagaaugggggcguuugagugcgugaggaaggucuaucaaacagauggauuaaaggguuucuaccggggcauguccgcaucuuaugccgggauaagcgagaccgugauccauuuugugauuuacgaauccaucaaacagaagcugcuugaguauaaaacggcuucaacuauggaaaaugacgaggagagugucaaggaagccagcgauuucguuggaaugauguuggcagcugccaccucuaaaacaugugcgacuaccauugccuacccucacgaggugguacgcacacgacugagagaagagggcaccaaguacagguccuuuuuccagacgcuaucacuccuggugcaggaagaggguuaugggagccuuuaccggggacugacuacacauuugguccgucaaaucccaaacaccgcaauaaugauggcuacuuaugagcucgugguuuaccuguuaaauggcuga

SEQ ID NO: 62654 - RNA, 1017 nt, Artificial Sequence
  derived and/or modified sequence opt3 from SLC25A37__Homo_sapiens__NP_057696
auggagcugagaagcggcuccguggggucucaggccgucgcuaggcggauggacggagauucacgcgacgguggcgggggaaaggaugcaaccggcagugaagacuacgagaaccuccccacaagcgccuccguuucuacucacaugacggcgggugcuauggccgggauccuugaacauucggugauguauccuguagauucagugaaaacccgaaugcaaagccugaguccagacccgaaggcacaguacacauccauuuauggagccuugaaaaagauaaugcguacugagggcuucuggagacccuuaaggggcgucaaugugaugaucaugggggcuggaccugcacacgccauguacuuugcuugcuaugaaaacaugaaacggacccugaaugauguuuuccaucaccaggguaacucucaucuagccaauggcauugcggggagcauggcaacacuccugcacgacgccgugaugaacccagcugaggucgugaagcagcgccuucaaauguacaauucccagcacagaucagccaucaguuguauuaggaccguauggcggacugagggacugggcgcauuuuaucgcagcuacacaacccaguugacgaugaacauccccuuccagucuauacauuuuaucacuuacgaguuccuccaagaacagguuaauccucaccgaaccuauaacccacagucccauauuaucucaggugggcuggcuggagcccuggcggccgcagcuacaacuccccucgaugugugcaagaccuuacugaauacacaggaaaacgucgcccuuagcuuggcuaauauuaguggcagacugucuggcauggccaacgcauuuaggaccguguaccaacuaaaugggcucgccggauauuucaaagguauccaggcucgggugauauaccagaugccuuccacggcgauuagcuggucggucuaugaguuuuucaaguacuuucugacuaaacgucaacuugagaaccgcgcaccauauuga

SEQ ID NO: 62655 - RNA, 915 nt, Artificial Sequence
  derived and/or modified sequence opt3 from SLC25A38__Homo_sapiens__NP_060345
augauccagaacagcagacccucccugcuccaaccucaggacgugggcgauaccgucgagacacuuaugcugcacccaguuauuaaggccuucuugugcgggucuauaucaggaacuuguaguacguuacuguuucagccgcuagaccuccugaaaaccaggcuucagacacugcaacccagcgaucaugguucccggcgcgugggcauguuggcuguacuccugaaggugguccgaacugaaucucugcucggguuauggaaaggaaugucgccuucaaucgugcguugcguuccaggcguggguauuuacuucgggacccuguauagccuuaagcaguacuuuuugagaggacaucccccuacagcacuggagagugucaugcuaggcgugggcuccaggucuguagccgggguuuguaugagcccaaucaccgugauuaaaacucgguaugaauccggaaaguacgguuaugagucaaucuacgcggcucuccgcaguauauaucacagcgaaggccacagagggcuguucucuggacuuacagccacccuguugagggacgcacccuuuuccggcaucuaccucauguucuacaaucagacgaagaacauugucccucaugaucagguggacgccacucugaucccaauuaccaauuuuucaugcgguaucuucgcugggauauuagcaagccuggugacacaaccggccgaugucauuaaaacucacaugcagcucuauccccuuaaguuucaguggaucggacaggcuguuacccugauuuucaaagacuacggcuugcggggcuuuuuccaagggggaaucccucgcgcccuacgaagaacacugauggcggcaauggccuggaccguguaugaggagaugauggcuaagaugggucucaaaaguuga

SEQ ID NO: 62656 - RNA, 1086 nt, Artificial Sequence
  derived and/or modified sequence opt3 from SLC25A3__Homo_sapiens__NP_002626
auguucagcuccguggcccaccuggcuagagcaaaccccuuuaauaccccucaucuccagcuuguccacgacggccugggggauuugaggucuucaaguccaggaccgacaggucaaccccggcgcccucgaaacuuagccgcggcugccguugaggaauacagcugcgaguucggcuccgcaaaguauuacgcccuguguggguuuggaggcgugcuaucuugcggucucacucauacggcuguagugccacuggaccuugucaaaugucguaugcaaguggauccccagaaguauaaagggaucuucaauggauuuucgguuacccugaaggaagacggcgugagaggcuuggcaaaagggugggccccuacauuccucggauacucaaugcagggucugugcaaguuuggcuucuaugaggucuuuaaggugcuguacagcaacaugcucggggaagagaauacuuauuuauggaggaccagucuguaccuugcugccuccgcgucugcagaguucuuugccgauauugcuuuggccccaauggaagcagcuaaaguacggauacagacacagcccggauacgccaacacccugcgcgacgcggccccuaagauguauaaagaggaaggccuaaaggcauucuacaaagguguugcuccacucuggaugagacagaucccguauacuaugaugaaguuugccuguuucgagaggacaguggaggcucuguacaaguucgucgugcccaaaccucggagcgaaugcuccaagccagagcagcuuguggucaccuuuguugccggguauauugcaggaguguucugugccaucguaucacaccccgcugauaguguggucagcgugcugaauaaagaaaaggggucuuccgcgucauugguucucaaacgccugggcuuuaagggcguguggaaaggauuauucgcacgaauuaucaugauagguacgcugacugcccuccaaugguuuaucuacgacagcgucaagguguauuucagacuuccuaggccacccccgccugagaugcccgaaagucugaagaaaaaguugggccuaacccaguga

SEQ ID NO: 62657 - RNA, 1017 nt, Artificial Sequence
  derived and/or modified sequence opt3 from SLC25A40__Homo_sapiens__NP_061331
auggaccccgagaccagaggccaggaaaucauuaaggugacaccucugcaacagaugcucgcuagcugcacuggggcuauacuuacguccgucaucguuaccccacuggaugugguaaaaauuagguugcaggcacagaacaauccguuacccaagggaaaauguuucguguacucuaacggucugauggaccaccuaugcgucugugaggaaggcgggaauaagcucugguauaaaaagccuggaaacuuucaaggcacacuggaugccuucuuuaagaucauucggaaugaggguaucaaaucacuuuggagugggcugccacccacuuuggugauggcgguuccugcuaccgugauauacuucacaugcuaugaccagcucagcgcccugcugcgcuccaagcucggagaaaacgagaccuguaucccaauugucgcaggcaucguggcccgauuuggcgcuguaacuguuauuucucccuuagagcugauccguacaaaaaugcagucgaagaaauucucauacguggaacuucauagauuugucagcaagaaggugagugaggauggguggauauccuuguggaggggaugggcaccuaccgugcugcgggacgucccauucucugccauguauugguacaauuaugaaauucucaaaaaguggcuaugcgagaaaagcggucuguacgagccgacguuuaugaucaacuucacuuccggcgcucuuucagggaguuuugccgcgguugcaacccugcccuucgaugugguaaagacacagaaacaaacucaguuguggaccuacgaaagccacaagauuucuaugccucuccauauguccacauggaucaucaugaaaaauauuguggccaagaacggauuuucaggccuguucagcgguuuaauaccacgccugaucaagauugcucccgccugugcaaucaugauaaguaccuaugaguucgggaaagccuuuuuccagaagcagaaugucagaaggcaacaguacuga

SEQ ID NO: 62658 - RNA, 1113 nt, Artificial Sequence
  derived and/or modified sequence opt3 from SLC25A41__Homo_sapiens__NP_775908
augggcgcccagcccggggagccucaaaauaccugcagcagaauccagacacuguucaggcgggugaagacucuccuuauuaaagcuccaccgcccccucagccacccccuccacccccuuccuggaacccaggauguacgcacgucuacgguuaugcauuuggccauaugcacgacaacaaucuggaacauuugccgucucagcaaguuuuagauaccggggagcagcugauggugcccguagaagugcuagaggucgacaacaaggaagcccucuggaaauuccugcuuucaggagcgauggcuggcgccgugagucgcacagguacugcaccucuggaucgagccaagguuuacaugcaaguguauagcuccaaaaccaauuuuacaaacuugcucgggggacugcagucuaugguccaggagggcggcuuccguucgcuguggagagggaauggaauaaacgugcucaagaucgcuccagaguacgcaauuaaguuuucaguauucgaacagugcaaaaauuauuuuugugguauccagggcagucccccuuuccaggagagguuacuggccgggagccuugcuguugccauuucccaaaccuugaucaacccaauggaagugcugaagacucggcuaacacuccgcagaaccggacaguacaaaggccugcuugacugcgcgaggcagauacugcaacgggaggguacgcgcgcauuguaucgaggguaccuccccaauaugcugggaaucauuccguacgccuguacugauuuagcugucuaugagaugcugcagugcuuuugggugaagucuggcagagacaugggcgauccuagcgggcucgugucccuuucaagugucacccugagcacaacuuguggacagauggccucuuaccccuugacccuaguuaggacacggaugcaggcacaagacaccguggaagguuccaacccaacgaugcguggcguacugcagcgcauccucgcucagcagggguggcugggacuuuauagaggcaugacuccuacacuguugaaagugcuccccgccggugggauuucauacgucguguaugaggcgaugaagaagacccugggcaucuga

SEQ ID NO: 62659 - RNA, 957 nt, Artificial Sequence
  derived and/or modified sequence opt3 from SLC25A42__Homo_sapiens__NP_848621
augggcaacggggugaaggagggacccgucagacugcacgaagacgccgaggcuguucucagcuccucugugucaaguaaaagggaucaucggcagguacuuagcucccuguugucuggugcauuagccggcgcgcuggcuaagaccgccguggcaccucuagaccgcacaaaaaucauuuuccaagucucgucaaagcgauuuagcgccaaagaggcuuuccgugugcucuacuauacuuaccugaaugaaggguuucuuagucuguggagaggaaacuccgcaacgaugguuaggguggucccauaugccgcuauacaguucucugcccacgaagaguacaagcggaucuugggcagcuauuacgguuuucgcggggaggcgcucccgcccuggccuagacuguucgcaggagcccuggcuggcaccacagccgcaucccucacuuauccauuagaucuggugagggcucggauggccguaacccccaaggaaauguacucaaauauuuuucauguuuucauccgcauuagucgagaggaaggccuuaaaacauuguaccacggguuuaugccuaccgugcugggagucaucccauaugcgggucucagcuucuuuacuuacgagacacuaaagucucugcauagagaguauuccggcaggcggcagcccuacccuuucgaacguaugauauuuggggccugcgcaggacuuaucggccagucagcuagcuauccacuggacguggugcgcagaaggaugcaaaccgccggugucacgggguacccgcgggcuaguauugcccgaacuuugcgcaccaucguuagagaggaaggagcagugaggggccucuauaaaggccugucuaugaacuggguaaaggggcccauugccgugggaaucuccuucacaacuuucgauuuaaugcagauacugcuccggcaccuucagagcuga

SEQ ID NO: 62660 - RNA, 1026 nt, Artificial Sequence
  derived and/or modified sequence opt3 from SLC25A43__Homo_sapiens__NP_660348
auggccaccuggagaagggacggccggcugacagggggacagcgccuccuuugcgcuggucuggcaggcacuuugagcuuaucccugacggccccacuagagcucgcgaccgugcuggcucaagucgggguugugcgaggacacgcccguggcccuugggcaacaggucauagaguauggagggccgaagggcuucgggcucuguggaagggaaacgcaguggccuguuugcgccucuucccaugcucugcuguccagcuggccgcguacagaaaauuugugguucuguucacugaugaccucggccacaucucacaguggaguagcauuauggcaggcuccuuagccgggauggugucuaccauagucacauauccgaccgaucugaucaagacuaggcuuauuaugcagaauaucuuggagcccucguaccggggacugcuacaugcuuuuucaacaauuuaucaacaggaagguuuccucgcccuguaccgcggcgugagccuuaccguaguuggggcacugccuuuuagugcuggauccuugcucguguauaugaaccuggagaaaaucuggaauggcccacgagaccaguucucuuuaccccagaacuuugccaaugucugucuggcggccgcagugacgcaaacucucagcuucccuuuugaaaccgugaagagaaaaaugcaggcucaguccccauaccuuccccacucagguggggucgauguucauuucaguggagccguggacugcuuuaggcagauaguaaaggcucaaggcgugcugggcuuguggaacgggcuaacagccaaucugcucaagaucgucccuuauuucggaauuauguuuagcacuuucgaguucuguaaacggaucugccuguaccagaacgguuacauucuuucuccacuguccuauaaguugaccccgggcguggaucagucacuccaaccccaggagcugcgugaacugaaaaaguuuuucaaaacacgcaagccuaagcccaaaaagcccaccuuauga

SEQ ID NO: 62661 - RNA, 795 nt, Artificial Sequence
  derived and/or modified sequence opt3 from SLC25A45__Homo_sapiens__NP_001265179
augcccguggaggaguucgucgccggcuggaucagcggggcucugggacucguucuuggucacccuuuugacaccgugaagcuguugggcuucuuuaaagggauguccuucccaauugcaucuauagccguagugaacucagucuuauuuggaguguacaguaauacacugcuaguucucacugcgacgagccaucaggaaagaagggcucaaccgcccuccuauaugcacaucuuccuggccggcugcaccgguggguuucuucaggcauacugucuggccccuuucgauuugauuaaggugcggcuccagaaccagacagaaccacgcgcucaacccggaucuccuccaccccgauaucagggcccuguccauugcgcagccucgaucuuucgugaggaaggcccaagagggcuguucaggggagcuugggcccugacucuccgggacaccccgacaguggguauuuacuuuaucaccuaugagggcuuaugucgccaguacacucccgaggggcagaauccuucaagcgcgacaguacugguugcaggaggcuucgccgguauagcuaguuggguggccgcaaccccacuugaugucaucaaauccagaaugcaaauggacggguugaggcggcgcguguaucagggaaugcuggauugcauggugucuagcauucgacaggaaggccuaggcgucuuuuucagagggguuacgaucaacuccgcuagggccuuccccgugaaugcgguaacuuuucucucauacgaguaccugcuucggugguggggauga

SEQ ID NO: 62662 - RNA, 1014 nt, Artificial Sequence
  derived and/or modified sequence opt3 from SLC25A46__Homo_sapiens__NP_001290178
augcaccccagaaggccugacggcuucgaugggcugggauaccgggguggcgcccgcgacgagcagggguuuggaggcgcuuucccagcacguagcuuuuccaccgguucugaucucgggcauugggugacaacuccgcccgacaucccuggaucacgaaaccuucacuggggcgaaaagaguccacccuauggcgucccuacgaccagcacaccauacgaggggcccacugaggaaccuuucuccucuggagguggcgggucgguucaaggacagucaagcgaacagcugaauagauuugccggcuucgguauuggguuggcgaguuuauuuaccgagaacgugcuggcucauccaugcauaguacuaaggcggcagugucaagugaauuaucacgcccagcauuaccaccucacaccguucaccgucaucaacauuauguauuccuuuaauaaaacucagggaccccgcgcacuguggaagggcaugggcucuacauucaucgugcaggggguuacccuuggagccgaggguauuaucagcgaauuuacgccucugccaagagagguguugcacaaauggucccccaagcaaauaggcgaacaucuccugcugaaaucacucacuuacgucguggcuaugccuuucuauagugccagcuuaaucgagaccguacagucuaugcuggaugcauacuuuccagagcuuauugcuaacuucgccgcguccuugugcucagacguuauccuguacccccuagaaacagugcuccacaggcugcauauucaggggacucggaccaucauagauaauacagaccuuggauaugagguccugccgauuaacacccaguacgaaggcaugcgcgauuguaucaauacgauucgacaagaggaagguguguucggguuuuauaagggcuucggagcagugaucauccaguacacuuugcacgccgcuguccuccagauuacaaagauaaucuauagcacccuguuacaaaacaauauuuga

SEQ ID NO: 62663 - RNA, 927 nt, Artificial Sequence
  derived and/or modified sequence opt3 from SLC25A47__Homo_sapiens__NP_997000
auggacuucguggccggcgcuaucgggggagucugcgguguugcagugggcuacccccuggauaccguaaaggugaggauucagacagagccuaaauauacugggauauggcacugugucagagacacguaccaucgggaacgcguguggggauuuuaucgaggccucagccuuccaguuugcaccgugucccuggucucuucagugaguuucgguacauaccgucacuguuuggcccauaucugcagauuaagguaugggaacccggaugcgaagcccacuaaagcugacauuacccugagcggaugugccuccggccuaguacggguuuuucucacaucuccuaccgagguggcaaagguccgccugcaaacucagacacaggcccagaaacaacagagaaggcuuucggcuucaggcccacuggcagugcccccuaugugcccagugcccccugccuguccagaaccgaaguaccgggggcccuugcacugccucgcuaccgucgcccgcgaggaaggacuguguggucuguauaagggcagcagugcgcucguuuuacgagaugggcauuccuucgcaacguacuuucugucuuacgccgugcuuugcgagugguugagcccugcuggacacuccagaccagacguacccggcgugcuggucgccggugggugugcaggagugcuagcuugggccguugcgacuccuauggaugugaucaaaucaaggcuccaggccgacggccagggccaacggcguuaucgcgggcugcuucacugcauggucaccagugugagagaggaaggaccaaggguacuguucaaggguuugguucucaauugcugucgggcauuucccgugaacauggucguguucgucgcuuacgaggccgugcugcgauuagcucgcggccugcucacauga

SEQ ID NO: 62664 - RNA, 897 nt, Artificial Sequence
  derived and/or modified sequence opt3 from SLC25A4__Homo_sapiens__NP_001142
augggcgaccacgccuggagcuuccugaaggauuuucucgcugggggaguggcagccgcggucuccaaaaccgcuguugcccccaucgagagagugaaacuucuguugcagguacaacaugcaucuaaacagauuucagccgaaaagcaguacaaagguauaaucgacugcguggucaggauuccuaaggagcagggcuucuuaaguuuuuggcgggggaaccuggcuaaugugauccgcuauuucccaacacaagcacuaaacuuugccuucaaggauaaauacaagcagcucuuucugggaggcguugaccgacacaaacaguucuggcguuauuuugcugguaaucuugccagcgggggagcggcaggcgccacuucccuguguuucguguacccguuggauuuugcuagaacgaggcucgccgcagacgucggcaagggggcugcccagcgggaauuucauggacugggugauugcauuaucaaaauauuuaagucugacggccugcgcgggcucuaucaaggauucaacgugucgguacagggcaucauuaucuacagagcggccuauuucgguguuuacgauaccgcaaaggggauguuacccgacccuaaaaaugugcacauuuuugucucauggaugaucgcucagagcgugacagccguggcuggacuggucaguuacccauucgauacuguuaggcggcgcaugaugaugcaguccggccgaaagggcgccgacauaauguauaccgggacaguggauuguuggagaaaaauugcaaaggacgagggagccaaggcuuucuucaagggugcguggucuaacguacuuaggggcaugggaggggcauuuguguugguccuguacgacgaaaucaaaaaguauguguga

SEQ ID NO: 62665 - RNA, 924 nt, Artificial Sequence
  derived and/or modified sequence opt3 from SLC25A52__Homo_sapiens__NP_001029344
augcccuucaugagaaagauccugagcaacaugauugacuccgaggcccacgagaaaaggccuccaauacucaccucuucaaagcaggauaucaguccgcauauuacaaaugugggcgaaaugaaacacuaccuuugcggguguugcgcugcauuuaacaaugucgccaucacuuaucccauucaaaagguucuguuccggcagcaguuguacggaaucaaaacgcgcgacgcgguguuacagcugcgacgugaugguuuuagaaaccuauauaggggcauacucccuccacugaugcaaaagaccacaacucuugcucugauguucggguuguacgaagaccucagcugucugcugcggaagcauguacgcgcccccgaguuugcaacccacggaguggccgcuguccucgcaggcacagccgaagcuaucuucaccccuuuagagagagugcagacucugcuucagaaucauaaacaccacgauaaguuuacaaacaccuaucaggccuucaaagcguugaagugccaugguauuggggaguacuauaggggacugguuccaauccuauuucggaauggccucuccaacgugcuguucuuuggccuucgcgggcccauuaaagaacaucugccuacggcaacuacccacucugcccacuuggucaaugacuucaucggagguggccuccugggggcuauguuaggauuucuguguuucccaauaaacgugguaaagacacgacuccaaucgcagauuggcggugaguuccagucauuuccgaagguuuuccagaaaaucuggcuugaaagagauaggaagcugauuaauuuguuucguggggcccaccuaaacuaccaucggagccugaucaguuggggaaucauuaaugcaacuuacgaguuccuccugaaauuuauauga

SEQ ID NO: 62666 - RNA, 897 nt, Artificial Sequence
  derived and/or modified sequence opt3 from SLC25A5__Homo_sapiens__NP_001143
augaccgacgccgcugugagcuucgcaaaggauuuucuggccggcggggucgcggcugccaucuccaaaacagcaguugcccccauugagagagugaagcuccuucugcagguacaacacgcuucuaaacagauaacugcagacaagcaguacaaaggaaucauugauugcguggucaggaucccuaaggaacaggguguguugucauucuggcggggcaacuuagccaauguuauucgcuauuuuccaacgcaagcucugaacuucgccuuuaaggacaaauacaagcagaucuuccuagggggaguggauaaacgaacccaguuuuggcucuauuucgcgggcaaucuggcaagugguggggccgcuggagccacaagccuuuguuuugucuacccgcuggacuucgcacguacuagauuggcugccgaugugggcaaggcgggcgccgagagggaauuucgggggcucggagacugccugguaaaaauauauaaguccgaugguaucaagggccuguaccagggguucaacguuucugugcaaggaauuaucauuuaucgcgcagcuuacuuuggcaucuacgacaccgccaaagguaugcuccccgauccuaagaauacacauauagucauuucguggaugaucgcucagaccgugacugccguggcaggguuaacaucauauccauucgacaccgucagaaggcggaugaugaugcagagcggacgcaaaggcacggauauuauguacacuggcacccuggacuguuggcgaaagaucgccagagacgaagggggaaaggcuuucuuuaaaggugcguggaguaacguucuuaggggcaugggaggggcauucguguugguacuguaugaugagaucaaaaaguacacauga

SEQ ID NO: 62667 - RNA, 897 nt, Artificial Sequence
  derived and/or modified sequence opt3 from SLC25A6__Homo_sapiens__NP_001627
augaccgagcaggccaucagcuucgcuaaggacuuucuggcaggcgggauugccgcggcuauauccaaaacagccguggcacccaucgaaagagucaagcuccuucugcaaguucagcacgccucuaaacagauugcugcagauaagcaguacaaaggaaucguggacugcauuguaaggaucccuaaggagcaagguguguugucauucuggcggggcaacuuagccaaugucauacgcuauuuuccaacucaggcucugaacuucgccuuuaaggauaaauacaagcagaucuuccuagggggaguggacaaacauacgcaguuuuggcgauauuucgcgggcaaucucgcaagugguggggccgcuggagccaccagccuguguuuuguuuacccgcuugauuucgcacguacaagacuggcugccgacgugggcaaguccggcacugaaagggaguuucggggguugggagauugccucgucaaaauuaccaagucugacgguauccgcggccuguaucaaggguucucggugucaguacagggaauuaucauauacagagcggccuauuuuggcguuuacgauacagcaaaggguaugcugcccgacccuaaaaacacccacauuguggucagcuggaugaucgcucagacugugacagccguggcuggggucguuaguuacccauucgauaccgugaggcggcgcaugaugaugcaguccggacgaaagggcgccgacauuauguauacgggcacuguagauuguuggagaaaaaucuucagggacgaagggggaaaggcauuuuucaaaggugccuggucuaaugugcuccggggcaugggaggggcuuuugucuuagugcuguacgacgagcuuaagaaaguuaucuga

SEQ ID NO: 62668 - RNA, 2106 nt, Artificial Sequence
  derived and/or modified sequence opt3 from SLC26A1__Homo_sapiens__NP_071325
auggacgagagccccgaaccucugcagcaaggcagagggccagugccggucaggcggcagcgccccgccccucgaggacuccgugagaugcuuaaggcuagacuguggugcuccuguucuugcucaguuuugugugugagggcauuaguacaggaucugcuaccagccacccgguggcuccgccaguacagacccagggaauaucuggcgggugacgugaugaguggccuugucaucgggauuauacuggugccucaagcuaucgccuacagcuugcucgcaggacugcagccaauuuauucccuguacacaucuuucuuugccaaccucaucuauuucuuaaugggcacuucgcggcacguuucaguggguauuuuuagccugcuuugcuugauggucggacaggugguagaucgcgagcugcagcuagcuggguucgaccccagucaagauggccuccagccuggcgcaaauuccucuacgcugaacgggagcgccgcuaugcuugacuguggacgagauugcuacgccaucagaguugcgaccgcacugacauugaugacuggucucuaucaggugcugaugggcgucuuaaggcugggguuuguguccgccuaccucucacagccacuucuggacggauucgcuaugggcgccagugugaccauauugacaagccaacuaaaacaucugcucgguguccggaucccgcgucaccaggggcccggaaugguugugcugaccuggcuuucucuguugcgcggcgcaggccaggcuaauguaugugauguggucacuuccacagugugccucgccguucuguuagcggccaaggaacugucagacagauacaggcaucggcuacgagugccucucccaaccgagcugcuugucauugugguagcaacguugguuagccacuuugggcaacugcauaaacgcuucggaaguucuguggcuggugauauccccacuggcuuuaugccuccacagguccccgagccgagacucaugcagaggguggcccuggacgcugucgcccuugcacugguggccgcugcguucuccauuagcuuggcagaaauguuugcccggucgcacggguauucuguucgcgcuaaccaggagcuccuggccgugggauguugcaauguauuaccugcauuccugcacuguuuugccaccuccgcugcccuagcaaagucacucgucaaaacagcgacuggcugcagaacccaacugaguagcgugguuuccgcuacagugguccuuuuggugcugcucgcccuggcacccuuauuccaugaucugcagaggucuguacuugccugcgugaucguugucagcuugcguggugcucuccggaaggugugggaccugccacgacuauggagaaugaguccugccgacgcacuggugugggcugggaccgccgcgacguguaugcucgucucaacugaagccggccugcuugcuggaguuauauugucccuguuaagccucgcaggcaggacacagcgcccccggaccgcccugcuugcuagaauuggggauacugccuucuacgaggacgcaacagaguuugaaggacuggugccagagcccggugugaggguauuccgcuuuggcgggccuuuguauuacgcgaacaaggauuucuuucuccagucucuguauucacuaaccggacuggacgccggcugcauggcugcccgacggaaagaaggugggagugagacgggcgucggagaaggcgggccagcacaaggagaggaucucgguccggugagcacccgugcugcccugguucccgcagccgcuggcuuccacacaguggucaucgacugugcgccucuuuuguuucuggaugccgcagggguguccacuuuacaggaccucagaagggauuacggagcucugggcauuucucuucugcuagccugcuguucgccacccguucgcgacauccucagccgggguggguuccugggcgagggaccuggcgauaccgccgaagaggaacaguuguuucuguccgugcaugacgcuguacagacagcaagagccaggcaccgagaguuagaagcgacugacgcucaccucuga

SEQ ID NO: 62669 - RNA, 2220 nt, Artificial Sequence
  derived and/or modified sequence opt3 from SLC26A2__Homo_sapiens__NP_000103
augagcuccgagucuaaggaacagcacaacgugucacccagagacagugccgagggcaaugauagcuacccuuccgggauccaucuggaacuccaaagggagucuucgaccgacuucaaacaguuugaaacaaacgaucagugccggccauaucaccgcauucuuauagagcgacaggagaagucagacacuaauuucaaagaauuugucaucaagaaacugcaaaagaacugucagugcagcccggcuaaggcuaaaaauaugauuuugggauucuuacccguucugcaguggcuaccuaaguacgaucucaaaaagaacauccugggugacgugaugaguggccuuauuguagggauccuguuggugccacaguccauagccuauucucuccuggcgggacaagagcccgucuacggccuguauacgagcuuuuucgcuuccaucauuuacuuucucuuagguaccucacgucauaucaguguggggauuuucggaguucugugucuuaugaucggcgaaacaguggauagagaguugcagaaagccggcuaugacaaugcacacagcgccccuucucuggggauggucuccaacggaucaacucuacucaaucauaccagcgauaggauaugcgacaagaguuguuacgcuauuaugguggguucuacaguaaccuuuaucgcaggcguuuaccagguggccaugggguucuuucaggucggauucguguccguguaucugagcgaugcacuucugucgggcuuugucacuggugccucuuucacaauuuugaccucccaagcgaaguaccuccugggguuaaaccugccacggacgaauggaguuggcucacucaucacuaccuggauccacguguuccgcaacauucacaaaacaaaucuuugcgaccugauaaccaguuugcuaugucugcucguacugcuucccacuaaggagcugaacgaacauuuuaaaagcaaguugaaagcaccuaucccaauugagcucguggucgugguugccgcuacacuggccucccacuucggcaaguuacaugaaaauuauaacucuagcaucgcagggcacauaccgaccggauuuaugcccccuaaagugccagaguggaaccugauucccucagucgcuguggaugccaucgcgaucaguauuaucgguuucgccauuacgguaucccuaagcgaaauguuugcaaagaagcacggcuacacuguuaaagcuaaucaggagauguaugccauaggguucugcaacaucauuccuucauuuuuccauuguuuuacaaccucugcugcccucgcaaagacucuggugaaagagaguacaggaugccacacccagcuuagcggcgucgugacggccuugguccugcuccuggugcuucugguuaucgcuccauuguucuacucccuccaaaagucugugcuggguguaaucaccauugucaauuuaagaggggcgcugaggaaauuucgggaccuacccaagauguggucgauaagccgcauggacacagugaucugguucguuacuaugcucuccucagcacugcuuaguaccgaaauuggcuugcuggugggagucuguuuuucuaucuucugcgugauucuccgaacacagaagccgaaaagcucccuguuaggccugguagaggaaucagagguguucgaaagcguuucugccuauaagaaccuucagaucaaaccugggauaaagaucuuuagauucgucgcucccuuguacuacauuaauaaagagugcuuuaaguccgcccucuauaagcagacugugaacccaauccugauuaaaguggcauggaagaaagccgcuaagaggaaaaucaaggagaaggucguuacccuaggagguauacaagaugaaaugagugugcagcugagccaugacccucucgagcugcacacaauugugaucgauuguucugccauucaguuccuugacaccgcaggcauccauacuuugaaagaaguacggcgugauuacgaggcgauagggauccagguccuguuagcucaaugcaaucccacggugcgcgacucccucacaaacggagaauauuguaagaaagaggaggaaaaucugcuguuuuacucaguuuaugaggccauggcauucgccgaagugaguaagaaccagaaaggcgucugcgugccaaauggucuuagcuugucguccgauuga

SEQ ID NO: 62670 - RNA, 2295 nt, Artificial Sequence
  derived and/or modified sequence opt3 from SLC26A3__Homo_sapiens__XP_011514169
augaucgagcccuucggcaaccaguacauuguggccagaccugucuauagcaccaaugcuuuugaagagaaccacaagaaaacagggaggcaucacaagacuuuccuggaccaucucaaaguuugcuguuccugcucuccacaaaaggcaaaacggauagugcuuucacuguuuccgaucgccaguugguugcccgcguaccgcuuaaaggaauggcugcuaagcgauauuguauccggaaucucuacggguauuguggcuguccuccagggccuggccuucgcacuucugguggacaucccuccaguuuauggguuguacgccucguuuuuccccgcuauaaucuaucucuuuuucggaaccucacgacacauuagcgugggcccuuuuccaauccugaguaugauggucggucuggcaguguccggggccguaucuaaggcuguucccgaucguaaugccacaacucucggauuaccuaacaauagcaacaauuccucacugcuugacgaugagagagugagggucgcggcagccgcuagugugaccguguugagcggcauuauccagcuggccuucggcauacuacggauuggguuugucguuaucuaccucucugaaucccugauuucaggauucacaaccgcagcugccgugcauguacuugugagccagcugaaauuuaucuuccaauugacugucccaagucacacagacccggugucuaucuucaagguucucuauuccguguuuagccagauugagaaaaccaacauagcggaucuggucacggccuuaaucgugcugcucguaguuucgauugugaaggagaucaaucagcgcuucaaagacaaacuucccgucccuauaccaauugaauuuaucaugacugugaucgcagcuggugucucuuacggcugugauuucaagaacagauuuaagguggccguugugggggacaugaaucccggauuccagccuccaauuacccccgauguagagacauuucaaaacacugucggcgacugcuucgguaucgcuaugguggccuuugcaguugccuucuccguggcuucagucuacagucugaaguaugauuacccguuggacgggaaucaggaacuaauugcgcugggacucggcaacauaguguguggcguauuuaggggguucgcaggaagcaccgcccugucccggucugcugugcaggagagcacagguggcaaaacccagaucgccgggcuuauuggagcaaucaucguucugauugucguguuggccauaggcuuucuccuggcuccuuuacaaaagucagugcuggccgcacuagcgcucgguaaucugaaagggaugcuuaugcaguucgcugagaucggccgcuuguggcgaaaggacaaauaugauugccugauuuggaucaugacguucauuuuuacuaucguccucggacugggccuugggcuggccgcaaguguugccuuccaguugcucacaauaguguuuagaacccaauuccccaaguguuccacucuggcuaacaucggaaggacaaacauuuacaagaauaaaaaggacuauuacgauauguaugaaccagagggugugaaaaucuuucggugcccuagccccauuuacuucgccaacaucggcuuuuuccgucgcaaguuaauagacgcaguaggguuuucuccacugaggauucuaagaaaacggaauaaggcucuccgaaagauccgcaaacugcagaagcagggacuuuugcaggucacccccaaaggcuucauuuguacgguggauaccaucaaggacucagaugaggaacuggacaacaaucaaauagaaguucucgaucagccuaucaacacaacugaccugccauuucacauugauuggaaugacgacuuaccgcugaacaucgaggugcccaaaauuagucuucauagcuugauccucgauuucuccgccgucucuuuucuggacgugucgagcguuagaggucuaaaguccauacugcaggaguucauuaggaucaagguggauguauacaucgucgggaccgacgaugacuucauugaaaaacucaaucgguaugaguuuuucgauggcgaagugaagucaaguaucuuuuuccugacaauucacgacgcggugcuucauauauugaugaaaaaggauuacucuacuagcaaauuuaacccuucccaggagaaggacggaaagaucgauuucaccauuaauacaaacggcgggcugcgcaauagagucuaugaaguuccaguggagaccaaauuuuga

SEQ ID NO: 62671 - RNA, 2343 nt, Artificial Sequence
  derived and/or modified sequence opt3 from SLC26A4__Homo_sapiens__NP_000432
auggccgcucccggcgggagaagcgagccuccacagcugccggaauacuccugcucuuauauggugucaaggcccgucuacagugagcucgcauuccaacagcagcacgaacggcgccuucaggagcgaaagacccugcgugaaagccuugccaaauguugcuccuguucuagaaagagggcguuuggaguuuuaaaaacacuggugccuauccuagaguggcucccaaaguaucggguaaaagaguggcugcuuucggacgugauuucaggugucagcacuggccugguggcuacguugcaagggauggccuacgcacuccuggccgcuguucccgugggauauggccuguacagugcauucuuuccuauacucaccuauuucaucuuugguacaucccgccauauuucugucgggccauuccccgugguaucuuuaaugguuggauccgugguccugucaauggccccugaugaacacuuucuugugaguagcucuaacggcacuguguugaauaccacaaugaucgacaccgcugccagagauacugcgaggguccugauugcauccgcccuaacacuccugguuggcaucauacagcuuaucuucgggggacugcagauugguuuuaucgugcgguacuuggcugacccacucguaggcggguucaccacggccgcagcuuuucaggugcuggucucacaauuaaagauugugcugaacguuagcacuaagaauuacaacggagugcucaguaucauauauacccuugucgagauuuuccagaauaucggcgauacaaaccuggccgacuuuacugcggguuugcuaaccauugugguaugcauggccguuaaagaacugaaugaucgcuuccgacauaagaucccggugcccaucccuauugaggucauagugacaaucauugcaaccgcuaucucuuacggggccaaccucgagaaaaauuauaacgcuggaauagucaaguccauuccaagaggcuuccugcccccugaacuuccacccgugagccuguuuucggagauguuggccgcaucuuucuccaucgccguuguggcuuacgcgaucgcaguaucagucggcaaaguguaugccacgaaguacgacuauacuauugaugggaaucaggaauuuaucgcuuucggaauuaguaacauauuuagcgguuucuuuuccuguuucguugccacaaccgcacucucuaggacugccgugcaggagagcacaggcgggaagacccaagucgcuggaaucauuucagccgcaaucgugaugaucgcgauucuggcuuuaggcaaacugcuagaaccgcuccagaagaguguacuggccgcagugguuauagccaaucuuaaagguauguuuaugcaguugugcgacaucccucggcuguggcgucaaaacaagauugaugcugucaucuggguguucacguguauuguguccaucauacucgggcuggaccuuggccuguuggccggacucaucuuuggccuguuaaccgucguucugcgcgugcaguuccccagcuggaaugggcuaggaucuauuccaucaacagauaucuacaaaaguacuaagaacuacaaaaacauugaggagccucagggugugaagauccucagauuuagcucccccauauucuauggcaauguagacggguucaagaaaugcauuaagucuaccgucggauuugacgcaaucaggguguacaacaaacggcugaaggcuuugcgaaaaauucagaaguugaucaagucgggccaacugcgcgccacuaaaaaugguauaaucagcgaugcgguuuccacaaacaaugccuucgaaccagacgaggauauugaagaccucgaggaacuggauauccccaccaaggagauugagauccagguggacuggaacucagaauuaccugucaaagugaauguuccaaaggugccgauacacagucugguacuugauuguggggcuauuagcuuuuuggacgucgugggcgugagaagccucagggucaucguuaaagaguuccagcggaucgaugugaacguauauuuugcaucccugcaggacuacgugauugaaaagcuagagcaaugcggauucuuugaugacaauauccgcaaggacacauucuuucugaccguccaugaugccauucucuaucugcagaaccaggugaaaucacaggaaggccaagggagcauacuugagacuaucacguugauucaggacuguaaggauacacuggaguuaaucgaaaccgagcucacugaagaggagcuggacguucaggaugaagcuaugagaacccuugccucuuga

SEQ ID NO: 62672 - RNA, 2139 nt, Artificial Sequence
  derived and/or modified sequence opt3 from SLC26A5__Homo_sapiens__NP_001161434
auggaccacgccgaggaaaacgagauccuggcugcaacccagagauacuauguggaaaggcccauuuucagccauccuguccuccaagagcggcuucacacaaaggauaaaguuccagacuccauagccgauaagcugaaacaggcguuuacuugcacgccgaagaaaauccgcaauauuaucuacauguucuugcccauuaccaagugguuaccugcuuauaaguuuaaagaauacgugcugggcgaccuaguaucugggaucucaacaggagugcuccagcugccacagggucuugccuucgcaaugcuggccgcugugcccccuauauuuggcuuguauaguagcuucuacccagucaucauguauuguuuucucgggacuucccgacauauuucuaucggacccuucgcaguuauuucgcugaugaucggcgguguggccguccgucuggugccugaugacauaguaauuccagggggaguuaacgcuaccaauggcacagaggccagagaugcgcucagggugaaggucgcaaugucagugaccuuacugagcggcaucauucaauuuugccuuggggugugucgguucggauuugucgccaucuacuugacugagccgcugguucgcgguuucacaaccgcugccgcagugcacguauuuacgaguaugcuaaaauaccucuucggcgugaagacuaaaagauauuccgggaucuucucugucguguacagcaccguugcugugcugcagaacgucaagaaucuuaacgugugcucccugggaguaggcuugaugguuuuuggucuccuguuagggggaaaggaguucaaugaaagguuuaaagaaaagcugcccgccccuauuccacucgaguucuuugcgguggucaugggcacaggcauaucagccggguucaaccuuaaagagaguuauaauguggacgucgugggaacucugcccuugggucuacugccuccagcaaaccccgauaccagccucuuucaucugguuuacguggacgcuaucgccauugcuaucguaggcuucucugucacaauauccauggccaagacccuugcaaauaaacacggguaucagguggauggaaaccaggaacugauugccuugggccucuguaauucaaucgguagccuguuucaaacguucaguaucucuugcuccuuaagccggucgcugguucaggaggggacuggcggaaagacacagcuagcuggcugucucgcgucucugaugauucuuuuggugauccuggcaaccggguuucucuucgaaucccugccgcagacuauuuggcuuacaaccuuugucucaagucuguucuugggacucgacuacggucugauaacggccgugaucauugcuuuacugaccguaaucuaucgcacacaaagcccuuccuacaaagugcuaggcaagcuccccgagacugauguuuacaucgacauugacgccuaugaagaggucaaggagauaccagggaucaaaauuuuccagaucaacgcaccuauuuacuaugccaauucugaucuguacagcaacgcucuuaagcgaaaaaccggagugaaccccgccgugaucaugggcgcaagaaggaaggcgaugcggaaauaugcuaaggaagucgguaaugccaacauggcaaaugccacaguugugaaggcugacgccgagguggauggggaagacgcaacuaaaccagaggaagaggauggcgagguaaaguaucccccuauagucaucaaaucaaccuuuccagaagagaugcagcguuucaugccgcccggagacaacgugcacacaguuauuuuggauuuuacccaagugaauuucaucgacagugucggcgugaagacucuggcugggauuguuaaagaauacggagauguggguaucuacguauaccucgccggcugcuccgcgcaggucgugaacgaccugacgcgcaauagauuuuucgagaacccugccuuaugggaacugcuuuuucauagcauacacgaugcuguguuggggucucagcucagggaggcacuggccgagcaggaggcuucagccccacccagucaagaagaccuagaaccuaaugcaacaccagcgacccccgaggccuga

SEQ ID NO: 62673 - RNA, 2217 nt, Artificial Sequence
  derived and/or modified sequence opt3 from SLC26A6__Homo_sapiens__NP_001035544
auggaccugagaaggcgggauuaccacauggagcgcccccuccuuaaccaggaacaucuggaggaauugggccgaugggggagcgccccucguacccaccaauggagaacaugguuacagugcuccagggcucgggcauaugcccugcuacuccagcaucugccagugcuugucuggcugccgcgcuaccccguuagagacugguugcucggagaucugcugucuggucucucaguggcgaucaugcaguuaccucaaggccuggcuuaugcccuuuuggcagggcugccacccguauucggacuauacaguagcuuuuauccuguguucauuuacuuucucuucggcacuuccaggcacauaucugucgguacguuugccgugaugucgguuaugguggggucagucaccgagagccuggcuccacaggcacuuaaugacaguaugaucaacgaaacagcccgggaugcugcccgcgugcagguagcguccacucugucuguuuuggugggacucuuccaggucggccugggcuuaauucauuuuggguucguggugaccuaucugagcgagccccucguccgaggauacacaaccgcagccgcuguucaaguguuuguaucccagcuuaaguacguguucggucugcacuugucaagucacagcggcccucuaucucugaucuauacuguccucgagguguguuggaaacugccacaguccaagguugggacaguggucaccgccgcaguggcuggaguaguucuuguggucgugaaacuguugaaugacaagcuccagcaacagcugccgaugcccauuccuggcgaauuacugacgcuaaucggugccacugggauaucauacggaaugggccucaaacauagauuugaggucgaugugguuggcaacaucccagcggggcuggugcccccuguagccccaaauacccagcuuuucagcaaguuggucggaagugcauuuacaauugcugugguugguuucgccaucgcuauuucucugggcaagaucuucgcccucaggcacggguaucggguggacuccaaccaagaacuggucgcacuuggacugagcaauuugauaggcgguauuuuucagugcuuccccgugucguguucuaugucccguucacucguacaggagaguacugggggcaacagccagguggccggagcuaucuccucucuguuuauuuuacugaucaucguuaaacuaggcgaacucuuccaugaucugccgaaggcgguccuugcagccauuauaaucgugaauuugaaagggaugcugcgccaacucagcgacaugagaucacuguggaaggcuaacagggccgauuuacugauuuggcuugugaccuuuacagcaaccaucuugcucaaucuggaccuaggacuggucguugccgugauauucagucuccugcuugugguaguccggacgcagaugccucacuacuccguguugggucagguucccgauacugacauuuaucgagacguggcugaguacagcgaggccaaagaaguccgcggcgugaagguuuuuagaucuucagcaacaguguauuucgcgaacgcugaguuuuacagugaugcccugaagcagaggugcgggguagacgucgauuucuuaaucagccagaaaaagaaacuccugaagaaacaagaacagcuuaagcugaaacaguugcaaaaggaggagaagcuccggaaacaggcagccuccccaaagggagcuucugugucgaucaaugugaacaccagccuggaagacaugcgcuccaauaacgucgaggauuguaaaaugaugcagguuucaaguggcgacaagauggaagaugccacugcaaacggucaggaggacucuaaagcuccugaugggagcacacuaaaggcccugggccucccccaaccagacuuucacucccugauucuugauuugggagcgcugucauucguggacaccguaugcuuaaagagccucaaaaauaucuuucaugacuucagagaaauugagguggaggucuacauggccgcuugucacucucccgugguuucccagcuggaagcaggccauuucuuugaugccaguauaacgaagaaacaccuuuucgcuagcgugcaugacgccgucaccuuugcacugcagcacccuaggccagugccggauucucccguuuccgugacacgucuauga

SEQ ID NO: 62674 - RNA, 1971 nt, Artificial Sequence
  derived and/or modified sequence opt3 from SLC26A7__Homo_sapiens__NP_439897
augaccggcgccaagaggaaaaagaaaagcaugcugugguccaagaugcacacaccccagugcgaggacaucauucaaugguguagacggcgccucccuauacuugauugggcuccacauuacaaccugaaagaaaauuuguuaccggacacugugucugggaucaugcuggcaguccagcagguuacgcagggacuagccuucgcggugcucucaaguguacaccccguguuuggucuguauggcagccuuuucccugcuauuaucuacgccauuuuugggaugggacaucacgucgcaaccggcacauucgcccugacuuccuugaucucugcuaacgcaguggagcgaauaguuccacaaaauaugcagaaccucaccacacagucgaauaccucagugcugggucugagcgauuuugaaaugcagcguauccaugucgccgcugccgugaguuuccucgggggaguaauucaaguugcgauguuuguguuacagcugggcuccgcaacuuucgucgugacagagcccgugaucucugccaugaccacgggcgcugccacucacgucguuaccagccaggugaaguaucuuuuggggaugaagaugccuuacauuuccggaccacugggauuuuucuauaucuacgcauauguauuugaaaacauaaaaucagugagacuagaggcucuccugcuuagucuguugagcauugucgugcucguucuggugaaggaguuaaaugaacaguucaaaaggaagaucaaagucgugcugcccguagaccucguucuuauuaucgccgcgucuuuugccugcuacuguacaaacauggagaauacuuacggccuggaaguggucgggcacaucccucaagguauuccauccccgcgggcacccccuaugaacauauugucagcugugaucaccgaggccuucggcgucgcucuaguggguuauguugccagccuggcacucgcccaggggagugcuaagaaguucaaauacucuauugaugacaaucaggaguuucuggcgcauggacuuuccaacaucgugagcucguucuuuuucugcauaccaucugcagccgcuaugggccgcacagccggccuguauuccaccggggcaaagacgcaaguagccuguuugauuucaugcaucuuuguccucaucgugauuuacgcuaucggaccccuguuauauuggcugccuauguguguucuagccaguauuauaguggucggucucaaaggcaugcugauccaguucagagaucuuaagaaauacuggaauguggacaagauugauugggggaucuggguaagcacuuauguguuuacaaucugcuucgcagcgaacguuggauugcuguuuggcgucguguguaccauugcuauagugaucgguagguucccacgggccaugacugucuccauuaaaaauaugaaggaaauggaguuuaagguuaaaacagaaauggacucugagacccuccaacaggugaagaucauuagcaucaacaacccccugguguuccuuaaugccaaaaaguuuuacacggaucugaugaacaugauacagaaagaaaaugcaugcaaccagccguuggacgauaucucaaagugugagcagaauacccuccugaacaguuuauccaaugggaacugcaaugaggaagcuagccagucuugcccuaacgagaaguguuaccugauucuagacugcucaggcuucacauucuuugacuauaguggaguaagcaugcucgucgaaguguacauggauuguaaaggccgcuccguugacgugcugcuugcccacugcacugcaucuuugaucaaggcuaugaccuauuacgggaaucuggauucggagaaacccauuuucuuugaaagcgucuccgccgcgaucucacauauacacaguaacaagaaucucucuaaacugagcgaccacuccgagguguga

SEQ ID NO: 62675 - RNA, 2913 nt, Artificial Sequence
  derived and/or modified sequence opt3 from SLC26A8__Homo_sapiens__NP_001180405
auggcccagcuggagagaagcgcuaucuccggcuucucuucaaagaguaggcggaacagcuuugcauacgacgugaaacgcgaagucuauaaugaggaaaccuuccaacaggagcacaagcgaaaagccuccucuucggggaacaugaauauuaacauaacaacuuuucgucaucacguucagugcagauguucauggcauagguuccuccggugcgugcuuacgaucuuucccuuccuggaauggauguguauguaccgcuugaaggauugguuacugggagaccuacucgcggguauuagcguaggccuggugcaggucccucaagggcuuacccugaguuugcucgcuagacagcugaucccaccgcugaauauugccuaugcagccuuuugcuccucugugaucuacguuauauucggaagcugucaccagauguccaucggcucauuuuuccucgugagugcuuuacugauuaacguccuuaaagugagccccuuuaauaacggucaguugguaauggggucuuucguuaagaaugaguuuuccgcaccuucauaucugaugggauacaacaagagccuaaguguggucgccacaacuaccuuccucacaggcaucauucaacugaucaugggcgugcuugggcugggauucauagcuaccuauuugccagagucugccauguccgcguaccucgcagccguggcucugcauauuauguuaagccagcugacuuuuaucuucgguauuaugaucucguuucacgccggccccaucucuuucuuuuacgauauuauaaauuauugcgucgcacucccuaaagcuaacuccacaucaauccuuguuuuccugaccgugguaguggccuugaggauuaauaaguguauccggauaaguuuuaaccaguacccaauugaauuucccauggagcuauuucugaucaucggguucacggucauugcgaauaaaaucagcauggccacugaaaccucccagacacucauugacaugauaccuuauucuuuucugcuuccagugacuccggauuucagccuguugcccaagaucauucuccaagcauuuucacugaguuuaguuuccagcuuccugcuaaucuuccucgggaaaaagaucgcuucucugcacaacuacucagugaacaguaaucaggaccuuauugccauaggcuugugcaacgucgugagcuccuuuuuccgcucuuguguauuuaccggugcuaucgcccgaacaauuauccaggauaagucgggaggaagacaacaguucgcaagccugguuggcgccggcgugaugcuccugcuuauggucaaaauggggcauuucuucuauacccugccuaaugcuguguuggcgggaauuauccucuccaacgucauaccauaccuggagacgaucucaaauuuacccagucuguggaggcaggaccaguaugauugcgcacuauggaugaugacuuuuucuagcuccauuuuccucggucuggacaucggccuuauuaucucagugguuagcgccuuuuucauaacaaccgugcggucucaccgugcuaagauuuugcugcucgggcaaaucccuaacacuaauauuuaccgcuccaucaacgauuacagagagauaaucacaauuccaggaguaaaaaucuuucaguguugcaguagcauuaccuucgucaauguguauuaccugaagcauaaauuacugaaggaaguugacauggugaaagucccccuuaaggaggaagagaucuuuucuuuguucaacuccucagauacgaaucuccagggcgguaagauauguaggugcuucugcaacugugacgaccuggaaccgcuaccucggauucuguauaccgagcgauuugagaauaaacucgaucccgaagccaguagcaucaaccugauccacugcucgcacuucgaguccaugaauacaucucagacugcaagcgaagaccaagugccauacaccguaucaagugugucccagaagaaccaggggcagcaauaugaggaaguugaggaggucuggcuuccuaacaauucuagccgcaacuccucacccggcuugccagauguggccgaaagccagggaagaaggagucugauucccuacucugacgcuuccuuacucccuagcgugcauacaaucauucuggauuuuucgaugguccacuauguugacucacggggccuuguggugcugcgccagauauguaaugccuuccagaacgcaaauaucuugauucucaucgcggggugccauucuaguauuguaagagcuuuugagaggaacgauuucuuugacgccggaaucacuaaaacccaacuguuccuauccguccacgaugcagugcuguuugcccucagccguaagguuauagguucuagcgaacuguccaucgacgagucagaaacagugauucgggagaccuacagugagacugauaaaaaugacaacagccgauacaagaugucuuccucauuccuuggcagucagaagaaugucagcccaggguuuaucaaaauucagcaaccgguggaagaggaauccgaguuggaccuggaguuagaaucugagcaggaagcuggacucggccuggaucuugaccuggauagagagcuagaacccgagauggagccuaaggccgaaacggagacaaaaacccagacugaaauggagccacagcccgaaaccgagccugagauggaaccaaaccccaagucgaggccgcgcgcacauacauucccucaacagcgguauuggccaauguaccaccccagcauggcuucaacccagucccagacucaaacaagaacguggaguguugagaggcgccgacacccuauggacucuuauagccccgaagguaauuccaacgaggauguguga

SEQ ID NO: 62676 - RNA, 2664 nt, Artificial Sequence
  derived and/or modified sequence opt3 from SLC26A9__Homo_sapiens__NP_599152
augagccagcccagaccuagguacguggucgaccgggccgcuuauucccugacccucuucgaugacgaguuugaaaagaaagaucgcacauacccaguuggcgagaaacuucgaaacgcauuccguugcagcucagccaagaucaaggcggugguauuugggcuguugccgguguuaaguuggcugcccaaauauaagauuaaggacuacauaaucccugaucuacucggaggucugagcggcggguccauucaagucccacagggaauggcuuucgcccuucuggcaaauuugcccgccgugaacggccucuauucuucguuuuucccucugcugacuuacuuuuuccucggugggguucaccagauggugccaggaacguuugcugucaucucaauuuuagugggcaauaucugucugcagcuugcacccgaaagcaaauuccaaguauuuaacaaugccaccaacgagaguuauguugacacagcugccauggaagcggagagauugcauguguccgcaacucuggccugccuaaccgcuauaauccagaugggccucggguucaugcaguuuggauucgucgccauuuaccugucugagagcuucaucagggguuuuaugacagcagcuggccuucagauucugaucuccguguugaaguacauauucgggcucaccauuccuucauauacuggaccaggcaguaucguguuuacauucauugauaucuguaaaaaucugccgcacaccaacaucgccagcuuaauuuuugcgcugauaucuggugccuuccucguccuuguuaaggaacugaaugcacgguacaugcauaaaauccgcuuucccauuccuacggagaugaucgugguaguggucgcuacugccauauccgggggaugcaagaugccaaagaaauaucacaugcaaauugugggcgaaauccagagaggcuuccccaccccuguuucaccaguggucagccaguggaaggacaugaucgggacagcuuuuaguuuggccauugugucuuacguaaucaaccuagcaaugggaaggacucuggccaauaaacaugguuaugauguugacuccaaccaggagaugauugcucucggcuguagcaauuucuuugggucguucuuuaagauacacgugaucugcugugcgcugucugucacccuugcaguggauggagccggcgguaaaucccaagucgcuucacugugcgugaguuugguugugaugauuacaaugcucguacuggggaucuacuuauauccccugccgaagucuguccuaggcgcccucaucgcagugaaccugaaaaauucccuuaagcaguugaccgacccuuacuaccuguggcggaagucuaaacucgauuguugcauuuggguugugagcuuccugucaaguuucuuucuuucccugcccuauggagucgccgugggcguagcuuucagcguguugguugucguguuucagacgcaauuccgcaacggguacgcccucgcacaggugauggacacugacauauaugucaacccaaagacauacaaucgagcgcaggauauccagggaauuaaaaucauuaccuauuguucuccucuguacuuugcuaacucagagaucuucagacaaaagguuauagccaaaacugguauggacccccagaagguguuacuggcaaagcagaaauaucuaaagaaacaggaaaagaggcggaugcguccaacacaacagcgcagaagucucuuuaugaaaaccaagacggugagccugcaggagcuucagcaagauuucgaaaaugccccaccuaccgacccaaacaauaaccagacaccggcuaauggcacuuccguaucuuacaucaccuuuucgcccgauagcuccucacccgcccagagugagccacccgcaucugcugaagccccuggggagccaagcgacauguuggcguccgucccuccguucgugacauuucacacucugauucucgauaugucaggaguuagcuucguggaccugaugggcaucaaggccuuagcuaaacugucuuccaccuacgguaagauuggggucaaaguguuucuuguuaacauccaugcacagguguauaaugauauaagucacggcggaguauucgaggacggcagcuuggaaugcaagcaugucuucccuucuauucacgaugccgugcucuuugcucaagccaacgcaagggacgugacaccagggcacaauuuccagggagcgcccggugacgccgagcugucccuauacgauucagaagaggacauccggaguuauugggaucuggaacaggagauguuuggcagcauguuccaugcugagacccucacugcccuggaaucgcuuuccgcagcugggggaugcuacccuuaucgaucugagagcuuggucucaccccuguuuacgcgccaagccuuagcagccauggacaaacccccugcucacaguacacccccaaccuccgcgcucucucuggccgcagaaggccaucuugauuuccagcuguugagaguuagccagaagcagaaggacaaauacaacugugcuggucuccuguauaagcuacaaaaagugucccagucaccgcacgggagcguaagugauggcgugaggcugucucggacuuga

SEQ ID NO: 62677 - RNA, 1977 nt, Artificial Sequence
  derived and/or modified sequence opt3 from SLC27A1__Homo_sapiens__XP_011526304
augagagcccccggcgcuggggcagccagcguggucucccuggcgcuccuuuggcuguugggauuaccuuggaccuggucugcugccgcagcccuggguguuuacgugggcucagggggauggagguuccuacggaucguaugcaagacagcucgccgagaccucuuuggccugagugugcuuauucgugucagacuggaguugaggcggcaccagcgcgcaggucauacuauaccaagaaucuuccaagccgugguucagaggcagccggaacggcucgcucugguggaugccgggacgggagaguguuggaccuuugcgcagcuggacgcauauagcaacgccgucgcuaaucucuuccgccaauuaggcuuugcccccggcgaugugguagcaauuuuccuggaagggcgaccugaguuuguuggacuuugguugggucuggcuaaagccggcauggaagcggcccuacucaacgugaaucugagaagggagccacuugcauucugccuggggacauccggagcuaaggccuugaucuuuggcggugagauggucgcugccguggcagaagugucugggcaccucggaaaaucgcugauuaaguucuguucaggcgacuuaggccccgaggggauccugccugauacucaucuccuugacccacuguugaaagaagccagcaccgcuccccuagcgcagauaccuaguaagggaauggaugaccggcuguuuuacaucuauacauccgguaccacuggccucccaaaggcagccauugucguucacucucguuacuaucgcauggcugccuucgggcaucacgcauacagaaugcaggccgcugaugugcuguaugacugccuuccgcuguaccacagcgccggaaacaucauuggcguaggucaguguuugaucuacgggcucacagugguccugaggaaaaaguuuuccgcaucacgguucugggaugacugcauaaaauauaauuguaccauuaacggcgugcgacauugccgcuuacugugucuaguugugcaauacaucggagagauuugcagauaucuccugaagcagcccgucagggaggcggaacggcgccacagagugaggcuugcuguaggcaauggguugcguccugccaucugggaggaguucacggaacgguuuggaguucgacagaucggugaguucuacggcgcaacugaauguaacugcaguauugccaauauggaugggaaagugggaagcugcggcuuuaacucuagaauacugccacaugucuaucccaucaggcucgugaaggucaaugaggacaccauggaacugcuucgcgacgcucagggucuguguauuccuugccaagccggggagccaggcuugcucgugggacagaucaaccagcaagauccccugcggagauucgacggcuacguuuccgaaucagcaacaagcaagaaaauagcucacaguguguuuucuaagggggauuccgccuauuuaagcggagacguacuggucauggaugagcuagguuacauguacuucagggaccgcucgggcgauacuuuucgauggcguggggaaaaugugucuaccacagagguugagggagugcucucccggcugcuuggccagaccgacgucgcgguguaugguguagccgugccggggguugaaggcaaagcuggaauggcagccgucgcugauccucacucauugcuggaccccaacgccauuuaccaggagcuccagaaggugcuggcaccauaugcgagaccuaucuucuuaaggcugcuuccccaaguggauacgacuggcacauuuaaaauccagaagacccgcuugcagcgggaaggguucgacccaagacagacaagugacaggcucuuuuuccuggaucuaaaacaaggacauuaccugccccucaaugaggccgucuauacucgaauuuguagcggcgcuuuugcccuguga

SEQ ID NO: 62678 - RNA, 1704 nt, Artificial Sequence
  derived and/or modified sequence opt3 from SLC27A2__Homo_sapiens__NP_001153101
augcugagcgccaucuacaccgugcucgcuggccuucuguucuugcccuuacuggucaaccuaugcuguccuuauuucuuccaggacauuggguacuuucucaagguugcagccgugggaagaaggguacgguccuaugguaaacgccgaccagcgcguacaauacugagagcuuuccuugagaaggccaggcaaacuccgcacaaacccuuucuguuguuccgggaugaaacgcucaccuacgcacagguggaccgcagaucuaaucaggucgccagggcucugcaugaucaccugggccuccggcagggggacugcguggcauuacugaugggaaacgagccugccuauguuuggcuuugguugggccuggugaagcuagguugugcuauggccugccucaauuacaacauccgcgcgaaaucacugcuucauuguuuucaaugcuguggggcaaagguccuguuggugaguccagaacuccaggccgcuguagaggaaauucugcccagcuuaaagaaagaugacguuuccaucuauuacgugucucgaacaucgaauacugauggaauugacucauuccuggauaaggucgacgaggugagcaccgagccuaucccagaaaguuggagauccgaggugacauuuucuacccccgcccucuacauauauacuagcggcacaaccggcgcaacgcuugcucugaggacuaaauucuccgccucacaguuuugggaugacugccggaaguacaacgucaccguuauccaguauauuggggaauugcuacguuaccuguguaauaguccucaaaaaccaaacgaucgcgaccacaaggugagacucgcgcugggaaauggucuuaggggcgacguauggcggcaguucgugaagcgauuuggggauaucugcauuuaugaguucuacgccgcaacagagggaaacaucggcuucaugaauuaugcucgcaaagucggugccguggggagaguuaacuaccugcagaagaaaauaauuacuuacgacuugaucaaguaugauguggaaaaagacgagccggucagggaugaaaauggauacugugugcggguacccaagggcgagguuggccuccuggugugcaaaauuacccaguuaacaccuuuuaacggguaugcuggagccaaggcacaaaccgaaaagaaaaagcugcgcgacgucuucaaaaagggugaucuauacuuuaauagcggcgaccuccugaugguggaucaugagaacuucaucuauuuucacgacagagucggggauacguucagguggaaaggagagaacguggccacuacagaaguugcugacaccgugggccuuguagacuuuguccaggaggugaauguuuacggugugcacgucccagaucaugaagggcguaucggcauggcgucuauuaagaugaaggagaaccacgaauuugacggcaaaaaguuguuucagcauauagcagauuaucugcccuccuacgcccggccucgauuccucagaauccaagacacuauugagaucacaggaaccuuuaaacacaggaagaugacgcugguggaggaaggguucaauccagcuguaauaaaagaugcccuuuacuuucuggacgauaccgcaaagauguaugugcccaugacagaggacauuuacaacgccaucucagcuaagacuuugaaacucuga

SEQ ID NO: 62679 - RNA, 2193 nt, Artificial Sequence
  derived and/or modified sequence opt3 from SLC27A3__Homo_sapiens__NP_077306
augggcgugugccagagaaccagggcccccuggaaggagaaaagccaacuggaacgggcugcacucggguuccgcaagggagguuccggcauguuugccucuggguggaaccagacagucccuaucgaggaagcgggaucaauggcugcccuucuguuguuaccacugcuacuccugcuuccgcuguugcuccugaaacugcaccucuggccccaguuacgauggcugccugcagaccuugccuucgcuguucgugcauuguguugcaagagagcccugagggcucgggcccuagcggcagccgcugccgauccagagggccccgaagguggguguagucucgcauggcgccuggcugagcuugcccagcaaagagcggcccauacuuuucugauucacggaagcaggcgguucuccuacucugaggcagaacgcgagucgaaucgagcugccagagcuuucuugagggcccucggcugggacuggggcccugaugggggagacucaggugaaggcagcgcaggggagggagagcgggccgcuccaggcgcgggugaugcagccgcugggaguggagccgaauuugcaggcggcgacggggccgcucguggagguggcgccgcagcgccccuguccccuggggcuacgguggccuuacugcucccagcaggaccggaguuucuuuggcugugguucggcuuggccaaagcuggucuacgcaccgccuuuguacccacagcacugagaagggggccucuccugcauugccuucggucuuguggcgcucgagcccugguguuggcgccagaguuccucgaaagccuggaacccgauuuaccugcccugcgcgcuaugggacuacaccucugggcagccggcccagggacucaucccgcuggaauauccgaccugcuugccgaggucucagcagagguggaugguccgguuccuggcuauuugaguagcccccagucuaucaccgacacaugccuguacauuuuuaccuccgggacuacaggacucccaaaggcggccagaaucucacaccugaagauucuucagugucagggcuucuaucaacugugcggugugcaccaggaagaugucaucuacuuggcucucccucuguaucauaugagcgggaguuuacugggcauagugggauguaugggcaucggggccaccguaguucuaaaaucuaaguuuuccgcaggacaguucugggaggacugccagcaacacagggugacggucuuccaguacauuggugaacucugucgguaucuggugaaccagcccccaagcaaagcugagcgcggccauaaggugagacuugccgucgggucgggauugaggcccgauacuugggaacguuuuguucggcgauucggcccucugcaagugcucgagaccuacggucugacagaggggaauguagcaacuaucaacuacaccggccagagaggagccgugggcagggcuucuugguuauauaaacacauuuuuccauucucccugauccgcuacgacgucacaaccggggaaccgauacgggacccccagggacacugcauggcgacgucaccuggcgagccaggucuuuugguggcccccguuagucagcaaagcccuuuucucggguaugcaggaggcccagaacuggcucaggguaagcuacugaaggauguguucagacccggcgacgucuuuuucaauacuggggaucuccuggugugcgacgaucagggauuucuuagguuccaugaccgcacaggcgauaccuuucgauggaaaggggagaacguagccacuacagaaguugccgagguguucgaggcuuuggacuuucugcaggaagucaauguguacggagucaccgugccgggccacgagggucgggcagggauggccgcguuaguucuccguccuccacaugcucuggaucuuaugcaacuguauacgcacguguccgaaaacuugcccccuuacgccagacccagguuccuccgccugcaggagucucuagcaaccacagagacuuucaagcagcagaaaguacggauggccaaugaaggauuugacccaagcacccugucagauccucucuauguccuggaccaagcugugggcgcauaccuucccuugacaacugccagauacagugcgcuguuagcugguaaccucaggauuuga

SEQ ID NO: 62680 - RNA, 1932 nt, Artificial Sequence
  derived and/or modified sequence opt3 from SLC27A4__Homo_sapiens__NP_005085
augcugcucggcgccagccuuguggggguccuguuguucuccaaguuaguucugaaacuacccuggacccaggugggauuuucucuccuguuccuuuaccuggguucaggcggguggagauuuaucagaguauucauuaagacaauacggcgcgacaucuuuggaggcuuggugcuccugaaagucaaggcuaaagugcgacaaugccugcaggagcguagaacuguuccuauucucuucgcaaguacggugaggcggcacccagauaagaccgccuuaaucuuugaagguacagacacucauuggaccuuccgccagcuggaugaguauagcuccucugucgcgaacuuucuucaggcuagaggguuggccucgggagacguggcagccauuuucauggaaaauaggaacgaguuuguaggccuguggcuaggcauggcuaagcucgggguugaagcagcccugaucaauacaaaccuucggcgcgaugcucuguugcacugucucaccacuucacgagccagagcgcugguguucggaagcgagauggcaagugccauaugcgagguccaugcuuccuuagacccgucucugagccucuuuuguuccgguucaugggaacccggcgccgugccuccaaguacagagcaccuugauccccuguugaaagacgcaccuaagcaucuaccaagcugccccgauaaaggguucaccgacaagcuguucuacaucuauacgucuggaacuaccggccucccuaaagcugccauugugguccacuccagguacuaucggauggcggcccugguuuacuaugguuuucguaugcgcccaaaugauaucguguacgacugucuuccgcuguaccacucagcagggaacauuguaggaaucggccaaugcuugcuccauggcaugacaguggucauaagaaagaaguucagcgcuaguagguuuugggaugacuguauuaaauauaauugcacuaucgugcaguacauuggggaacugugucgguauuuacugaaccagcccccucgagaggccgagaaucagcaccaaguucgcauggcucuaggaaacggucucagacagucuaucuggaccaauuucuccagcagguuucauaucccacagguggccgaauuuuacggcgcaacagagugcaacuguucgcuggggaauuuugacucucaggucggagccugcggcuucaacucccggauucuuucauuuguguaucccauacgcuugguaagaguuaaugaagauaccauggagcugaucagggguccugacggggugugcauuccaugucaacccggcgaaccgggacagcucgucggccguaucauacagaaggauccucugcggcgauucgacggguaccuuaaccaaggagcuaacaauaaaaagauugcgaaagauguguuuaagaaaggugaccaggcauaucugacgggcgaugucuuggugauggacgagcucggguaccuguacuucagagauaggacuggagacacauuucgcuggaagggcgagaacguuaguaccacugaaguggaggguacauuaagccggcugcuagauauggccgacguagcugucuaugggguggaaguucccggcaccgagggcagagccggaauggcagccguggcuuccccaacggggaauugcgaccucgaaagguucgcccagguccuggagaaggagcuuccuuuguacgcacgccccaucuuccugcgacuccugccagaauuacacaaaaccggaacauauaaguuucagaaaacugagcugcggaaggaagguuucgaucccgcgaucgugaaagacccucuuuucuacuuggaugcucaaaagggccguuauguaccacucgaccaggaggccuacucuaggauucaggcaggggaagagaagcuguga

SEQ ID NO: 62681 - RNA, 2073 nt, Artificial Sequence
  derived and/or modified sequence opt3 from SLC27A5__Homo_sapiens__NP_036386
augggcgugagacagcaacuggcccuccuucuguuguuacugcuacuccugugggggcuuggacagcccgucuggccuguugcuguggcacugaccuugagguggcuccugggugacccaacaugcuguguacugcucggcuuagccaugcuggcgcggccguggcuugggcccugggugccucacggauugagccuggcugccgcagcccuagcucucacucugcuuccagcacgccugcccccuggcuugcgauggcucccagccgaugucaucuuccuggcuaagauuuuacaucugggucucaaaauacgugggugccuuuccagacagcccccugacacguuuguggaugccuucgagaggcgggcgcgcgcacagccaggcagagcccuguugguuuggaccggaccgggcgcugggucugugacauuuggagaacuagacgccagggcaugucaagcugccugggcgcugaaggccgagcucggugaucccgcaucacugugcgcuggcgaaccuacugcccuucuggucuuggcuagucaggccgugccagcacucuguauguggcugggguuagccaaacugggaugccccaccgcuuggaucaacccucacggccgggguaugccacuagcgcauagcguacucuccucuggggcacgcguucugguggucgaccccgaucuucgagagucguuggaagagauucugccgaagcuccaggccgagaauaucagauguuucuaccugucacacacaagcccuacccccggagugggcgcucuuggcgccgcacuggacgccgcuccaagucauccugugcccgccgauuugagggcagggauuacuuggcgguccccagcgcucuuuaucuauacaucuggaaccacgggucugcccaaaccugcuauauuaacucacgaacguguccugcagaugagcaagaugcuaucccucucaggcgccaccgcagacgauguuguguacacaguacugccacuuuaucacgugaugggguuggucgugggaauccugggcugccucgaccugggugccacuuguguuuuagcuccgaaguucaguaccagcugcuuuugggaugacugucgccaacauggggugacagucauucuguacgugggcgagcuuuugagauaucucugcaacaucccccagcagccugaagacaggacccacacgguacggcuggccaugggaaauggccuacgagcagauguuugggagacuuuccagcaacgcuuugggccaauuagaaucugggagguguacggaucuacagaagguaacaugggccuggucaauuauguggggaggugcggagcucucggcaaaauguccugucugcuucggauguugucacccuucgagcugguccaguuugacauggaagccgcggagccugugcgcgauaaccaggguuucugcauaccaguuggguuaggcgaacccggacuccugcuuaccaaggugguaagccaacagccguuugucggcuacagagggccuagggagcugagugagcguaaauuggugcggaauguucgacagucuggagacguguacuauaacacuggugauguccucgccauggacagagaaggcuuccuguacuucagggaucgccuaggggacacauuucgguggaagggagagaauguguccacccaugaaguagagggcgugcugagccagguugauuuccuccaacaggucaacguguauggugugugugucccagggugcgaaggcaaaguuggaauggcugcagugcagcuggcccccggccagacguuugacggggagaaacuuuaccaacacgugagagcuugguugccugccuaugcaacaccccacuucauuaggauccaggaugcgauggagguaaccucgacuuuuaagcugaugaagacccgcuuaguccgagaaggauucaaugugggcauuguuguggacccacucuuuguccuggacaaccgggcccagucuuuccguccucuuacagcugagauguaccaggccgugugugaagguacuuggagacuguga

SEQ ID NO: 62682 - RNA, 1950 nt, Artificial Sequence
  derived and/or modified sequence opt3 from SLC28A1__Homo_sapiens__NP_004204
auggagaacgaccccagcagaaggcgggaauccaucucucugaccccuguggccaagggccucgagaauaugggggcugauuuccuugaaucacuggaggaaggacaguugccacgcagugacuuaagcccggcagagauucgauccucuuggucggaggccgcgcccaaaccuuuuucacguuggagaaaccugcaaccagcucuaagggcccggagcuucugccgcgaacacaugcagcucuuuagauggauagguacaggccugcuuuguacugggcugagugcauucuugcucgucgccugccugcuggauuuucagagggcucucgcauuauucguucugacgugugugguacuuaccuuuuugggacaucggcugcuaaagcgccuccugggccccaaacuucgaagauuccugaagccucagggucacccaagguugcuccugugguuuaaacggggguuagcccuggcugccuuccucggacuugugcugugguugucccuagacacaucucaacgucccgagcagcuggucagcuuugcgggcaucugcguguucguugcacuccuguuugccuguuccaagcaucacugcgcugugucauggcgcgccgucaguuggggccuugggcugcaguucguguugggacuccugguaauuagaacugaaccugguuucaucgcauuugagugguuaggcgagcagauuaggaucuuccugagcuacaccaaggcugggucuuccuuuguuuucggagaagcccuagugaaagaugucuuugcguuccaagugcucccaauaaucguguuuuucucaugugucauuagcguucuguaucaugugggccuuaugcaguggguaaucuugaagauugccuggcugaugcaagugacaauggguaccacugcaacagagacccucagugucgcugggaauaucuuugugucucagacggaagccccgcugcuuauacggcccuaccuggcugacaugacuuuguccgagguucacguggucaugaccggaggcuaugccacaauugcaggcagccuccugggggccuacaucucguucggaauugaugcuacuucuuuaaucgcggcauccgugauggccgcuccuugcgcccuggcacuaucaaaacucguauauccagaaguugaggagaguaaguuucgacgcgaagagggugugaaacugaccuacggcgacgcccagaaccuuaucgaagcugccagcacaggggcagcgauuuccgucaagguggucgcuaauauagccgcaaacuugaucgccuuccuggcugugcucgauuuuauuaaugccgcacugucuugguuaggagacaugguugauauccagggccugagcuuccagcuuauauguucauauauuuugagacccguggcuuuccucauggguguagccugggaggacugcccugucguggcggaacugcuagggaucaagcuguuucucaacgaguucguugccuaccaagaucugaguaaauacaagcagaggcggcuugcuggcgcagaggaaugggugggagaccgcaaacaguggaucuccgucagagccgagguguugaccacguuugcucuguguggcuucgccaauuuuagcucuauugggaucauguuaggaggucucacuucaaugguaccacagaggaagagugacuucagccaaauugugcugcgugcacuuuuuacaggcgcgugcguuucccuggucaacgccugcauggcugggauauuguauaugccccggggagccgaaguggauuguaugucucuccugaauaccacucuaucgagcuccucauucgagaucuaccagugcugucgagaagcauuucagagugugaacccggaguucucuccugaggcucuggacaauugcuguagauuuuauaaccacacaauuugcgcccaguga

SEQ ID NO: 62683 - RNA, 1977 nt, Artificial Sequence
  derived and/or modified sequence opt3 from SLC28A2__Homo_sapiens__XP_011520500
auggagaaggccagcggcagacaguccaucgcucugucuaccguggaaacagggacugucaaccccggacucgagcuuauggaaaaagagguugaaccugaggguucaaagaggacggacgcacaaggccacagucugggggauggauugggcccaagcaccuaccagcggcgcucccgauggccguucucuaaagcccguucguuuugcaagacacaugcgucauuauucaaaaagauucugcuaggucuccugugucuugcuuaugccgcauaccuguuggccgcuugcauacucaauuuucagagagcacuggcccuguucgugaucacuugucucguaauuuuuguguuaguccacagcuuccugaagaaacuuuuggggaagaaacugaccaggugccuaaagcccuuugagaacagucggcuccgccuguggacaaaauggguguucgcuggaguuucccuugugggccugaucuuguggcucgcccuggacaccgcgcagagaccugaacaauuaauuccauuugcaggcaucuguauguucauacugauccucuuugccugcucuaagcaucacagcgcugucuccuggaggacuguguucucagggcuuggacugcaguuuguauucgguauuuugguuauccggacagaucuaggcuauaccguguuccaguggcugggggagcagguccaaauuuuucucaauuacacgguggccggaaguagcuucguguuuggcgacacucuggucaaggauguuuucgcauuucaggcucuacccaucauaauuuucuuugguugugugguaucuauccuguauuacuuggggcucgugcagugggucgugcagaaaguugccugguuccugcaaauuaccaugggaacaacugcgaccgaaacauuagccguggcaggcaacaucuuugucggcaugaccgaggcuccucugcuaauccgcccauaucucggggacaugacgcuguccgagauucaugccgugaugacuggagguuucgcuacaauaucaggcaccguacuuggggccuuuaucgcauucggaguugaugccagcaguuugauuucugcuuccgugauggcggcacccugcgcccuggcuagcucgaagcucgccuacccugaagucgaggaaucuaaauuuaaguccgaggaaggcgugaaacugccacgagguaaggagagaaauguccuugaggcagccucaaacggggcuguggacgccaucggccuggcaacuaauguugcggcuaacuugauagccuuccucgcagugcuggccuucauuaaugcugccuuaaguuggcugggagaacuuguagauauccagggccucacauuucaggucaucuguagcuaccugcuuaggccgaugguguucaugauggggguugaguggaccgacugccccaugguggcagaaauggucggaauuaaauuuuucaucaacgaguuuguggcuuaucaacaguugucccaguacaagaauaagcggcugucugguauggaagaguggauugagggcgaaaaacaguggauaagcguacgugccgagaucauuacgaccuucucacucuguggguuugcgaaccugaguuccaucggaaucacauuaggcggucugacuagcauugugccucaccgcaagucugaucuuucaaaaguugucgugagagccuuguucaccggggcuugcgugagucucauaagcgcaugcauggccggcauccuguaugucccaaggggagcugaagccgacuguguuuccuuucccaauacaucuuucacuaaccggaccuacgagacauauaugugcugucgaggccuauuucaaucgaccagccugaaugggacuaacccuccauccuucucaggacccugggaagauaaggaguuuagugcaauggcgcucacgaacugcugugguuucuacaauaacacagugugcgccuga

SEQ ID NO: 62684 - RNA, 2076 nt, Artificial Sequence
  derived and/or modified sequence opt3 from SLC28A3__Homo_sapiens__NP_001186562
auggagcugagaagcaccgccgcucccagggcagaaggcuacuccaacgugggguuccagaaugaggaaaacuuucucgagaaugaaaacacaucuggaaauaacucaauccggagucgcgccguccaaagccgagagcacacuaauacgaagcaggacgaggaacagguuaccguggagcaggauuccccucguaacagagaacauauggaggacgaugacgaggaaaugcaacagaaagguugccuugagaggcgguaugauacaguauguggcuucugccgcaagcacaaaacuacccugagacauauuauaugggggaucuuguuagcgggauaccuggugauggucauuucugcuugugugcuaaauuuucacagggcccucccacuguucguuaucacaguggcagccaucuuuuucgucgugugggaccaucuuauggcuaaguaugaacaccggauugaugagaugcugucgccgggccgccgauugcucaacucacacugguuuuggcugaaauggguaauauggagcagucugguucucgcagugaucuucugguuagccuuugacaccgcuaagcugggucagcagcaacuugucuccuucgggggauugauuauguacaucgugcugcuauuucucuucucuaaguaucccacuagaguguacuggaggccuguccuguggggcauuggccuucaguuucuguuggggcuccugaucuuacggacagauccaggauucauagccuucgacuggcugggucgucagguucagaccuuucucgaauauacggaugcgggcgccagcuucguguuuggggagaaauacaaggaccauuucuuugcauucaaaguacuucccauuguggucuuuuucuccacugugaugucaaugcuguacuauuugggacuaaugcaauggaucauucgcaagguuggcuggaucaugcuggugaccacagguaguagcccuaucgagucugucguggcuuccgggaauauuuuuguaggacagacugaaucaccacuccugguuagacccuaccuuccuuauauaaccaaaagcgagcugcacgccaucaugacagcaggcuucaguaccauugcuggcucuguguugggggccuacaucuccuuuggagucccaagcucgcaucuccugacggcgucugugauguccgccccggcaucauuagcugccgcuaagcuguucuggcccgaaacugagaagccuaaaauaacacuaaagaacgccaugaaaauggaaaguggugauagcggcaaucuccuggaggcagccacccagggggcuuccucuagcauuucacuugucgcgaacaucgcagugaauuugaucgccuuucuggcucuccugaguuucaugaacuccgcccuuagcugguucggaaacauguuugacuauccacaacugucuuucgaguugauuugcucauacaucuuuaugcccuucaguuuuaugaugggcguugaauggcaggacagcuucaugguggcaaggcucauugguuauaagacauuuuucaaugaguuuguagccuacgaacaccuguccaaauggauacacuuacggaaggaagggggcccuaaauucgucaacggagugcagcaguacaucucuauucgaucggagaucaucgcuacuuaugcccuguguggcuuugcaaauauugggagccuaggaauaguuaucgguggccucaccuccauggcgccaucacgcaagagagauauugcuaguggggccgugagggcacugaucgccggaacggucgcuugcuucaugaccgccuguauugcaggcauccuuucuagcacacccguggacauaaacugccaucacguauuggagaaugcuuuuaacuccacuuucccggguaauaccacaaaggugaucgccuguugccaaucacugcucagcucuacuguugcgaaagggccuggcgaggucauucccggaggcaaccauucccuguacaguuuaaagggguguugcacccugcuuaauccaagcacauucaacugcaauggaaucucuaacaccuuuuga

SEQ ID NO: 62685 - RNA, 1371 nt, Artificial Sequence
  derived and/or modified sequence opt3 from SLC29A1__Homo_sapiens__NP_001071643
augaccacaagccaccagccccaagacagauacaaggccguguggcugaucuucuuuaugcucggccuugggacucuguugccuuggaacuucuuuaugacggcuacccaguauuucacaaauagguuagauaugucccagaacgucucucugguuacugcagagcuaucaaaagacgcccaggcgagugcugccccagcagccccgcuccccgaacggaauagccuguccgcuauuuuuaacaaugugaugacccuuugcgcaaugcugccuuugcuccuguucacauaccugaacucuuuucuccaucaacgcauaccacagucgguacgaaucuuaggaucacugguggccauucuuuuggucuuccugaucaccgcuauucuagugaagguucagcucgaugcccugcccuuuuucgugaucacuaugauaaaaaucguccuuauuaauagcuuuggugcgauccugcagggcaguuuguucgggcucgcaggacuguuaccugccuccuauacagcuccaauuaugucuggccaaggucuggccggguuuuucgcaagcguggcuaugaucugugccauagcguccggaucagagcucagugaaagcgccuucggcuacuuuauuaccgcaugcgcuguaaucauucuuacgaucaucuguuaucugggcuugccccgucuagaguucuacagauauuaccagcagcugaagcucgaagggccuggagagcaggagacuaaacuggaccuuauuucuaagggugaggaaccaagggccggcaaggaagaguccgggguuucagugagcaacagucaaccgaccaaugagucucacuccauaaaagcuauccugaagaacauuagcgucuuggccuuuucggugugcuucaucuuuacaauaacuauuggaauguuccccgcagugaccgucgaaguuaaaucuuccaucgccggcucaaguacaugggagcgguacuuuaucccugugagcuguuuccucaccuuuaauauuuucgauuggcugggucgcuccuuaacggcuguauuuauguggccagggaaggacucuagauggcugcccagccuagugcucgcgaggcuggucuucgugccucuuuugcugcucugcaacaucaaaccacggcgcuaucugacuguuguguuugaacaugaugcaugguucauuuucuuuauggccgcuuucgccuuuucaaauggauaccuugcaagucuguguaugugcuucggccccaagaaggucaaaccggccgaggcugaaacagccggcgcaauaauggcguuuuucuugugucucgggcuggcuuuaggagccguguuuuccuuccuguuucgagcaaucguauga

SEQ ID NO: 62686 - RNA, 1371 nt, Artificial Sequence
  derived and/or modified sequence opt3 from SLC29A2__Homo_sapiens__XP_011543277
auggccagaggcgacgcucccagggauagcuaccaccugguggggaucuccuucuuuauucucggacuugguacccuguugccuuggaacuucuuuauaacagcaaucccauauuuccaggcccgguuagcgggcgcuggaaauucuacugcccgcauucugucaacgaaccauaccgggccggaggacgcauuuaauuucaacaauugggucacacuacucagucaacugccccuucuguuguuuacucuccugaacagcuuccuguaccagugcguuccugaaaccgugcgaauccucggcuccuuacuggccauucuuuugcuguuugcucuaacagcagcccucguaaagguggauaugucuccaggucccuucuuuucgaucaccauggcuucagucuguuucauaaauagcuuuagugccgugcugcaggggucccuuuucggacagcugggcacuaugccuucuacauauagcaccuuguuccucuccggccaagggcuggcgggaaucuuugcagccuuagcuaugcugcucucaauggccagugguguugacgcagagacgagcgcucuuggcuacuucauuacuccaugcguggggauccugaugucuauugucuguuauuugucccuaccccaccugaaauuugcccguuacuaucucgcgaacaagucaagccaggcccaggcacaggaacuggagaccaaagcugaacuucugcaaagugaugagaauggaaucccuucuuccccacagaagguggccuugacacucgaccuggauuuagagaaagaaccggagagcgaacccgacgagccucagaagccaggcaagcccucgguauucacuguuuuucagaaaauauggcugaccgcucuaugccucgugcuggucuucacagugacccuuucuguguuuccugccauuacggcaauggucacuuccucaacaaguccagguaaguggagccaauucuuuaaccccaucuguugcuucuugcuguuuaauauuauggauuggcucgggagaucccugaccucuuacuuccuuuggccggacgaggauagcaggcuguugccucuccugguuuguuuacgguuucuguucgugccccuauucaugcucugccauguaccacagcgcucaagacugccuauccuuuuuccccaggacgccuacuucaucacuuuuauguugcuguucgcugugaguaacggauaucucgucucccugacaauguguuuagcgccaaggcaagugcugccccacgaacgggagguugcaggcgcccuuaugaccuuuuucuuggcucucggccugagcugcggggccucucuaucauuucuguucaaagcacuccuguga

SEQ ID NO: 62687 - RNA, 1428 nt, Artificial Sequence
  derived and/or modified sequence opt3 from SLC29A3__Homo_sapiens__NP_060814
auggccguggucagcgaggacgauuuccagcacuccucuaacucaaccuacagaacaacgaguagcucccugagggcugaccaagaagcacuccuugagaagcuguuggaucggcccccuccaggcuuacagcgcccggaagaccgauuuugcgggacuuauaucauuuucuuuucucugggaauagguucgcuacuccccuggaauuucuuuaucaccgccaaagaguacuggauguucaagcugcguaacucaagcaguccugcgacaggcgaagauccagagggguccgacauucuuaauuauuuugagucuuaccuggcuguugccagcacugugcccuccauguugugucucguagcaaacuuccugcuggugaauagagucgccgugcauaucaggguucucgcuucauuaaccgugauucuggcaaucuuuauggucauaacagcccuugugaaaguagauaccaguagcuggacucggggauucuuugcuguuacaaucgugugcauggucauuuugucuggcgccuccaccguguucucaagcaguaucuaugguaugacggggucuuuuccuaugcgcaacucccaggcgcugauuagcggaggcgcaaugggcgggacugugucggccgucgcuucucuaguugaccucgccgcauccucagaugugagaaauagugcucuggccuucuuccuuaccgcgacaguauuucugguguuguguaugggacucuaccuguuacugagcaggcucgaauaugcccgguacuacaugcgcccaguccuugcagcucacguguucuccggugaggaggaacugccccaggacucuuugagcgccccuucaguugcuagucgauuuaucgauucccauacuccaccgcuaagacccauacugaagaaaaccgccagccucggcuucugcgugacauaugucuuuuucauuaccucucugaucuacccugcaauuuguacgaacaucgagucacuuaauaaggggaguggaagccuguggacuacaaaguuuuucaucccauugaccacuuuucuccuguauaacuucgccgacuuaugcggcaggcaacugacagcuuggauucaggugcccgguccuaauuccaaagcgcuaccaggguuuguacuccugcggaccugucuuauacccuuguucguucugugcaacuaccagccgcgugugcaccucaagacggucguguuucagucugaugucuauccugcacugcuuucgagccuguugggacucuccaauggcuaccugucaaccuuagcccugcuauauggccccaaaaucgugccacgcgaacucgcugaggccacagggguugugaugaguuucuacguaugucugggacuuacuuuggguucugcaugcagcacccugcucguccaucugauuuga

SEQ ID NO: 62688 - RNA, 1593 nt, Artificial Sequence
  derived and/or modified sequence opt3 from SLC29A4__Homo_sapiens__XP_006715730
augggcagcguggggucccagagacuggaggaacccucugucgccggaaccccugacccagguguugugaugucauucacauuugauagucaccaacucgaggaagcugcagaggccgcgcagggccaggggcuuagggcucggggaguaccggccuucacugacacgacccuggaugaacccgugccugacgaucgcuaccaugcaaucuauuuugccauguuguuagcuggcgucgguuuccugcuaccauacaacagcuuuauuacagacguggauuaucuccaccauaaguaccccgggacuuccauaguuuucgacaugucucugaccuauauccuuguggcacuggccgcugucuugcucaauaacgugcugguagagcgacugacacuccacacccguauuacugccggauacuuacuggcgcuuggcccuuugcuguuuaucucgauuugcgauguuuggcuacagcucuuuucaagagaccaagcauaugccaucaaucuggcugccgugggcacagucgcauuuggguguaccgugcagcagagcaguuucuacggauacacggguaugcuuccaaaaagguauacucagggcgugaugaccggggaguccacagcuggagucaugauaucucugagccggaucuugacuaagcuccuguuacccgaugaacgcgccuccacccugauuuucuuccucguuucaguggcgcuugagcuguugugcuuucuacugcaucuccugguaagaaggagucgguucgugcuuuucuacacaacccgcccucgagacagccacagaggcaggccaggucuggggcggggauauggcuaccguguccaccaugaugugguugccggcgacgugcacuuugaacauccggcacccgcuuuggccccuaacgagucuccaaaagacucccccgcucacgaggucacggggucaggaggugccuauaugcgcuucgaugugccuagaccaaggguacaacggagcuggcccacuuuucgagcacuccuguuacaccgcuacguuguggccagagucaucugggcugacaugcugaguauugcggugacauauuucaucacccuaugucucuuuccgggccuggaaucugagauaaggcauugcauucuuggggaaugguugccuauccugauuauggcagucuucaaucucuccgauuuugugggaaagauccuggccgcccuucccguugacuggcggggcacucaccuguuggcuuguagcugccuccgcgugguauucaucccacuguuuauuuuaugugucuacccuucggguaugcccgcacugagacauccagccuggcccugcauauucucucuacucauggggaucuccaacggcuacuuuggaucagugccuaugauucuggcugccggcaaaguuaguccaaagcagagggagcuugcagggaauacaaugaccgugagcuauauguccggauugacgcuggguucugcggucgcuuacuguaccuauagccucacacgugaugcccacggcucaugccugcaugcaaguacugccaacggguccaucuuagcuggacuguga

SEQ ID NO: 62689 - RNA, 1626 nt, Artificial Sequence
  derived and/or modified sequence opt3 from SLC2A10__Homo_sapiens__NP_110404
augggccacagcccucccgugcugccacucugcgccuccgucucucuucuagggggauugaccuucgguuacgaguuagcuguuaucucaggcgcacugcuaccgcuccagcuggacuuugggcuuaguugucuggaacaagaguucuuggugggaagccuccugcugggcgcccucuuagcgucccugguagguggguuucuuauugauugcuauggaagaaagcaggcuauauugggcucuaaccuggugcuacucgccggcucgcugacacuugggcuggcaggaucauuggccuggcucguccuggguagggcugugguuggcuucgcaaucagcuuaaguuccauggccuguugcauuuacgugucugaacuggucgggccccggcagcgcggagugcucguaagccuuuaugaggcuggcaucacuguugguauucuguuguccuacgcccuaaauuaugcgcuggcagggacgccuuggggauggcgacauauguuuggcugggccaccgcuccagccgugcuccagucacugagucuucuguucuugcccgcaggcacagacgaaacugcuacccacaaagaucucaucccucugcaagggggagaggccccaaaguuaggucccggccguccuagauacagcuuucuggaccuauucagggcgcgggauaacaugcgcgggagaacaaccgucggacucggccuggugcuuuuucagcaguugacuggucagccaaaugugcuguguuaugccucuacaauauucuccucagucggguuucauggcggaagcagugcaguucucgcuucugugggccugggggccguaaaaguggcugccacccuuacggcaaugggacuggucgacagggccggucggcgcgcuuugcuccuggcgggcugcgcauuaauggcccuguccgugagcgggaucggacugguuucguucgcugugccgauggauucuggccccuccugucucgccgucccuaacgcaacuggucaaaccgggcugccaggcgacucaggacuuuugcaggauaguagccugcccccuauuccacgaacaaaugaggaccagagagaacccauccucuccacugccaagaaaaccaagccgcacccuaggucuggcgaucccagcgcuccaccucggcuggccuuaucaagugcacugcccgggccaccccuuccugcgcguggacaugcuuugcuccgcuggacagcccugcuaugccugaugguguuuguauccgcauucagcuucgguuuuggcccaguuaccuggcucgugcugucugagauuuacccggucgaaaucagagggagggccuucgcuuuuuguaacucauucaauugggccgcaaaccuuuuuauaaguuugagcuuccuggacuuaauuggaacgaucggccucuccuggacuuuucugcuuuacggucugacagcuguguuggggcucggcuucauuuaucuguuuguccccgagaccaagggacagucucuagccgagaucgaucaacaguuccagaaacggcgauuuacucugucguucggccaccgccaaaauagcacagggaucccuuacuccagaauugaaauaucagcggccaguuga

SEQ ID NO: 62690 - RNA, 1491 nt, Artificial Sequence
  derived and/or modified sequence opt3 from SLC2A11__Homo_sapiens__NP_001020109
augagagcccugaggcggcucauccagggccgcauucuucuguugaccauaugcgcugcagggaucggagguacauuccaauuuggcuacaacuuaagcauuaucaaugcccccacucugcacauucaggaguucacgaacgaaaccuggcaggcgcgaacaggggagccucuaccagaccaucucgugcugcuuauguggucccugaucgucucuuuguauccgcucggaggccuguuuggugcucugcucgccgggcccuuagcaauaacucugggacguaagaaaucacuuuugguuaauaacaucuucgugguaagugccgcuauucuguuuggcuucagcagaaaggcaggcuccuuugaaaugaucaugcuagggaggcuccuggugggagucaaugccggugugucuaugaacauucagccuauguaccuuggcgagucggcuccaaaagaacugcggggugccguugcgaugucaagcgcaaucuucaccgccuugggaauagugaugggccaagucgugggucuccgcgagcuguuagggggaccccaggcuuggccucugcuccuugccaguugucugguaccaggcgcauugcagcuagcuucccugccccuccugccugagucuccaagauaucuucugauugauugcggcgacacagaagccuguuuggcggcccucaggcggcugcgcgggagcggagauuuagcaggggagcuggaagaacuagaggaggagcgagcugccugccagggcuguagagcuaggcggccgugggaacucuuucaacaccgugcccugcgcagacagguuaccucccuuguggucuuggggucagcaauggagcugugcggaaaugacaguguguacgccuaugcuagcucuguguucaggaaggcgggcguccccgaagcaaaaauccaguacgccauuaucgguacuggguccugugagcuccugacagcuguugugucaugcguagugaucgagcgggucggccgacgcgugcuucugauuggaggcuauagcuugaugaccuguugggggaguauauuuacgguugcccucugccugcagucuuccuucccuuggacuuuauaccuggcaauggccuguaucuuugcuuucauucucagcuucggaaucgguccagccggcgugaccgggauacuagcaacagaacuguuugaucaaauggcgagacccgcugccugcauggucugcggagcacuuauguggauuauguugauccuggugggccucgguuucccuuuuaucauggaggcccugucgcauuucuuauacguaccauuucuggggguuugugugugcggcgcuauuuauacuggacuuuucuugcccgaaaccaagggcaagacauuucaggagaucucuaaagaacuccacaggcugaacuucccgcggcgcgcccaggggccuaccuggagaucccuagaggucauucaaucaacggagcuguga

SEQ ID NO: 62691 - RNA, 1854 nt, Artificial Sequence
  derived and/or modified sequence opt3 from SLC2A12__Homo_sapiens__NP_660159
auggugcccgucgagaacaccgaaggcccuagccugcucaaucagaaggggacagccguugagacugaaggauccgguucuagacacccaccgugggcuaggggcugcgggauguucacguuucuuucaagugugaccgcagccguaagcggacuguuggugggcuacgaguuagguaucauuuccggggcgcugcuacaaauaaaaacacuccuggcucuuucuugucaugaacaggagauggucgugucgucacugguuaucggagccuugcucgcaagccugacuggcggcgugcugauugaccgguaugggcgccgaaccgccaucauucucaguuccugcuuacugggacuugguucuuugguccugauccuaagccucuccuacacagugcugauaguaggccguaucgcuauugggguuucaaucagucuuagcucuauugcaaccuguguguauaucgccgagauagcuccccagcacagaaggggacuguuggucucccucaacgaacugaugauugugaucggcauuuuaucagccuacaucagcaauuaugcguucgcaaacguguuucaugguuggaaguacauguucgggcuggucaucccucucggaguucuucaggccauugcuauguauuuucugccacccaguccucgguucuuggugaugaaaggccaagagggcgccgcaucuaagguacuagggcgccugagagcucucuccgauacuacagaggaacugaccgugauaaaaagcucgcuuaaggacgaguaccaguacucuuuuugggaucuguucagguccaaggacaauaugcggacgcgcaucaugauuggauugacucucgucuuuuucgugcagaucaccggucagccaaacauacuguuuuaugccucaacaguuuuaaaaagugugggcuuccaaagcaaugaagcggccucccuggcaucuacuggggucggagugguaaagguuauuagcaccauccccgcuacacuacucguggaucacgucggcucaaaaaccuuucugugcaucgguaguuccgugauggccgcuagccuugucacgauggggauugugaacuugaauauccauaugaacuucacucacauuugucgaucucacaauucaauaaaccagagucuggacgagagcguuaucuacggcccuggaaaucucuccacaaacaauaacacccugagagaucauuucaagggcauuucuucgcacagcagguccucacuuaugccacugcggaacgacguggauaaacguggggaaacuacaagugccucuuugcucaaugcaggacugagccauaccgaguaucagaucguaacggacccgggugauguccccgccuuuuuaaaguggcugucccuagcuucacuccugguguacguugcggcauucagcaucggccuugggccuaugccaugguuggugcugucugaaauuuuucccggaggcauacgcgguagagccauggcucucaccuccaguaugaacugggggaucaaucuguuaauuagccugacauuccuuacugucaccgacuugaucggccucccuugggugugcuuuauuuauacaaucaugucucuggccucccuacuguucguagugauguuuauaccagagacuaagggauguucacucgagcagaucaguauggaacuggcaaaaguuaacuacgucaagaauaacauuugcuucaugagccaccaccaagaggaacuugugcccaaacagccgcagaagaggaaaccucaagagcaguugcuggaauguaauaaguuaugcggccgggggcagucgcgacagcucucccccgagaccuga

SEQ ID NO: 62692 - RNA, 1947 nt, Artificial Sequence
  derived and/or modified sequence opt3 from SLC2A13__Homo_sapiens__NP_443117
augagcagaaaggccuccgagaacguggaauacacccugaggucucucucaagucuuaugggcgagcggcgccgaaaacagcccgaaccugacgcugcaagcgccgcgggggagugcucccuguuggcugccgcagaaucuucgacaucauuacaaagcgccggagcugguggcgggggagucggcgaucuggagcgugcagccagaaggcaguuccagcaggacgagacuccagcuuuuguuuaugugguagccguguucagugcgcuagguggguuucucuucggauacgauacgggcgucguguccggcgcaaugcugcuucugaagcggcaauugucucucgacgcccuguggcaggaacugcucguuagcuccaccgugggggcugccgcagucucagcuuuagccggaggugcgcugaauggcguguuugggcgcagagccgcaauccuuuuggcuagugcccuguucacagcuggaagcgccguacuagcagccgcuaacaauaaagagacucuccuggcgggcaggcuuguugugggucuggggauuggaauagcaucuaugaccgucccgguguauaucgccgaagugucacccccuaacuugcggggccgccucgucacaauuaauacccuguuuaucacuggcgggcaguucuuugcuuccguuguggauggagccuucagcuacuuacagaaggacgguuggcgauauaugcugggccucgcagccguaccagcugugauucaauuuuucggguuucuuuuccugcccgagaguccuagaugguugauccagaaaggacagacacagaaggccaggcggauacuaucucaaaugcguggcaaccagaccaucgaugaggaauacgacuccauuaagaauaacaucgaggaagaggaaaaagaggucgguagcgcagggccagugauuugucgcaugcugucguaucccccuacgagaagggcgcucaucguuggcugcggacugcagauguuccaacagcuuucuggcauaaauacuauuauguacuacuccgcuaccauccugcagaugucagggguggaggaugaccgguuggccauuuggcucgcaagugucacagccuuuacuaacuucaucuuuacccuggugggaguaugguuaguugaaaaggugggucgacgcaaacugacauucggcagccuagcugggaccacggucgcccucaucauucuggcacuuggauuuguguuguccgcucaggucucuccaagaauaacuuucaagccgaucgcccccagcggccaaaaugcgacauguaccagguauucauacugcaacgaguguaugcuggauccugacugcgguuuuuguuauaaaaugaauaagaguacugugauugauuccagcugcguuccagugaacaaggccucuacaaaugaagcugcaugggggcggugugagaacgaaaccaaauucaagacggaggacaucuuuugggccuacaacuucugccccaccccuuauucauggacagcucuccugggccuuauacuguacuugguauuuuucgccccaggaaugggccccaugccguggacugucaauagugagauuuauccucucugggcacgcagcaccgggaacgcguguuccucuggaaucaauuggaucuuuaacgugcugguuucguuaacauuccugcacacugccgaauaccuaaccuacuauggugcuuucuuucucuacgccggcuucgcagcuguggggcugcuuuuuauuuauggaugcuugcccgagacaaaaggcaagaaacuggaagagaucgaaagccucuucgacaauagacugugcaccugugguacuuccgauucagacgaggggagguacauugaguauauacgugucaagggcaguaacuaccauuuaucugauaaugacgccagcgauguggaauga

SEQ ID NO: 62693 - RNA, 1494 nt, Artificial Sequence
  derived and/or modified sequence opt3 from SLC2A14__Homo_sapiens__NP_001273163
auggacaacagacagaaugugacccccgcccugaucuucgcuauuacagucgcaacuauaggcagcuuucaauucggguacaacacgggaguuaucaaugccccugagaccauuaucaaggaauuuauuaacaaaacacucacugauaaggcgaaugcuccaccguccgaggugcuucugaccaacuuguggucuuuaucaguagccaucuucaguguggguggcaugauagggagcuuuuccgucggacuguucgugaauagguuuggccggcgcaacucuaugcuaaucguuaaucuccuggcagccacaggugggugccuuaugggacuguguaaaauugcugaaucgguggagauguugauccucggccgacuggucauuggccuguucugcgggcucuguaccggauuugugcccauguauaucggugaaauaucaccuacugcauuacguggcgccuucgggacacugaaccagcuuggaauuguaaucggcauuuugguugcucagaucuuuggucuggagcuaauccucgggagcgaggaacuguggccagugcuucugggauucaccauuuugcccgccauacuccagagugcggcacugccuugcuguccagagucccccagauuuuuacugaucaauaggaagaaagaagagaacgccacgcggauucuccaacgccuuuggggcacucaggacgucucucaggauauccaggagaugaaggacgaaagcgcuagaaugucccaagagaaacaggugaccgugcuggaauuguucagggucucaaguuaccggcagccuauaauuaucagcaucguucuacagcugucucaacagcucuccggcauuaaugccguguucuauuacucaacagggaucuuuaaggaugcaggaguacagcaaccaauuuaugcuacuauaagcgccgguguggucaacaccaucuucacacugcuuagucuguuuuugguggagcgcgcgggccgaagaacccuccacaugauugggcugggaggcauggccuucugcucuacguuaaugacuguuucccugcuacucaagaaucauuacaacgguaugagcuuuguguguaucggggcaauccuggucuucguggcuugcuuugaaauuggcccgggacccauaccuugguucaucguagccgaguuguuuucgcagggcccaaggcccgcugccauggcaguugccggguguucuaacuggacauccaauuuccuugugggacugcucuuuccuucagcugcguauuaccugggugcauacgucuucauuaucuuuaccggcuuccuuauuacuuuccuggccuuuacauucuuuaaagugccagagacccgggggcguacguucgaagacaucacccgcgcuuuugagggacaggcccacggcgcagauagaagugguaaggacggggucaugggcaugaacagcauagaacccgccaaagagacaacuaccaauguguga

SEQ ID NO: 62694 - RNA, 1575 nt, Artificial Sequence
  derived and/or modified sequence opt3 from SLC2A2__Homo_sapiens__NP_000331
augaccgaggacaaggugacaggcacucuggucuucacgguuaucaccgccgugcucgggagcuuucaguucggauacgauauugguguaauaaacgcuccccaacaggugaucauuucccacuauagacauguccuuggcgugccucuggacgauaggaaagcaaucaauaacuacguuauuaauucuacagacgaauugccaacuaucucauauaguaugaacccgaagcccaccccuugggccgaggaagagacaguggcggcugcccaguuaauaaccaugcuguggagccuauccgucucuucguuugcaguagggggaaugacugccucauucuuuggcgguuggcucggggauacacugggacggaucaaagcuaugcuuguggcaaauauucugagcuugguuggcgcccuccugaugggcuucaguaagcuggggccaucccacauccucauuaucgcuggacgcucuauaagcgguuuauacugcggccugauuuccgggcuugugcccauguauaucggagaaauugccccuaccgcguugcgaggcgcacuggguacguuucaucagcuagccaucgucacugggauccucauuucacaaauaaucggacuggaguucauucuuggcaacuacgaccuguggcacaucuugcucggccugaguggggugcgugcuauauuacagagccugcuccuguuuuucuguccagagucucccagauaucuuuacauuaaauuggaugaagaggugaaggccaagcagucccuaaaaaggcugcggggauacgacgaugucaccaaggacaucaaugaaaugcgcaaagagagagaggaagcaucaagcgagcagaagguuaguaucauucaacucuuuacaaacucuuccuauaggcagccuauccugguggcucuuaugcugcauguagcccagcaguucagcgguauuaauggcauauuuuacuauucgacuucuaucuuccaaaccgcggggauuuccaaaccaguguacgccacaaucggagucggcgcagugaacaugguuuucaccgcugugucagucuuuuugguggaaaaggccggucggcgcagucucuuccugaucgggaugagcggcauguuuguaugcgcuauuuucauguccguuggauuagugcugcuaaauaaguuuucuuggaugagcuaugucucaaugauagccaucuuccucuuugugaguuucuuugagauuggcccggggcccaucccuugguucauggucgcagaauuuuucucccagggaccacgacccgccgcucuggcgauugcagccuuuagcaacuggacguguaauuucaucguggcucuuugcuuccaguacauagccgauuuuugugguccuuauguuuucuuuuuguucgcaggcgugcugcucgccuuuacucuguucacauuuuucaaaguaccagagaccaaggggaaaucuuuugaggaaaucgcugccgaguuccaaaagaaaucaggaagugcacacagacccaaggcggcugucgaaaugaaauuucuuggcgccacugagacaguguga

SEQ ID NO: 62695 - RNA, 1491 nt, Artificial Sequence
  derived and/or modified sequence opt3 from SLC2A3__Homo_sapiens__NP_008862
augggcacccagaaggugacacccgcccugaucuucgcuauuacugucgcaacgauagggagcuuucaauucggauacaacaccgguguuaucaaugccccugagaaaauuaucaaggaauuuauuaacaaaacacucacugacaagggcaaugcgccaccguccgaggugcuucugaccucuuuguggucauuaaguguagcuaucuucagcgucgggggaaugauaggcuccuuuucugugggucuguucgugaacagauuugggaggcgcaauucgaugcuaaucguuaaccuccuggccgugacaggaggcugcuucaugggccuuuguaaagucgcaaagucaguggaaaugcugauuuuggggcggcucguaaucggacuguuuugcggucuguguaccggcuucguucccauguauauuggggagaucagcccuacugcccuccgaggagcuuuuggcacauuaaaucagcuggguauaguggucgggauucuuguggcacagaucuucggauuggaauuuauucugggcagugaggagcuauggccacuccugcuuggcuucaccauccugcccgccaucuugcaguccgcugcccucccuuucugcccagaaucuccccguuuucuguuaauuaacagaaaggaggaagagaaugcgaaacaaauacugcagaggcucugggggacgcaggaugugagccaggacauccaagagaugaaggaugaauccgcacggaugucacaggagaaacaggucacuguucuugaacuguuccgcgugaguagcuacagacagccuauuaucauaucuauuguauugcaacuaucccagcagcugucaggaaucaacgccguguuuuauuacagcaccgguaucuucaaggacgcuggcguccaagagccaauuuaugccacaaucggggcaggagugguuaauacuauuuuuaccguggucagucucuuccugguggaaagggcuggccggcgcacacuucacaugauaggucugggcgggauggccuuuuguucuaccuugaugacgguaucccuccuguuaaaagauaacuacaauggaaugagcuucguuugcaucggcgcgauucugguguuugucgccuucuuugagaucgggccgggacccaucccuugguucauuguggcagagcuauuuucgcaggguccacgacccgcugccauggcugucgccggcuguucuaacuggacuuccaauuuccucguggggcugcuuuucccuucagcagcccauuauuugggagcuuacguuuuuauaaucuucacaggcuuucugauuaccuuccucgcguuuacuuucuuuaaggugccagaaacaagagguaggaccuucgaggacaucacgcgggcauuugaagggcaggcccacggcgcugaucguaguggaaaggacggcguaauggagaugaacagcauugaacccgccaaagagaccacaacuaacgucuga

SEQ ID NO: 62696 - RNA, 1164 nt, Artificial Sequence
  derived and/or modified sequence opt3 from SLC2A4RG__Homo_sapiens__NP_064446
auggagagacccccuccaagggccgcuggccgggacccgagcgcacugcgcgccgaagcgcccuggcuccgagcugaggggccuggaccacgugccgcacccgugaccgucccuacaccaccccaggguuccucuguuggcgggggauucgccggccuugaauuugcuagaccucaagagucagaaccaagggcaagugaucugggugccccgcggacuuggacgggggcugccgcgggaccccgcaccccuagcgcacacaucccagugcccgcccagagagcuacaccuggcaaggccagguuggacgagguaauggcagcugccgcguuaacuucccugucuaccucgccacuacuccugggcgcccccguggcagcuuucucaccggagccugggcuugaacccuggaaagaggcccugguccggccaccuggaagcuacaguuccucuagcaacuccggugauuggggcugggacuuggcuucagaucagaguagccccucuacaccauccccuccucucccaccggaagccgcacauuuucuguucggggagcccacccugcgcaagcgaaaaagcccugcccaggugauguuucaaugccucuggaagucauguggaaaaguuuuaaguacugcuucugcgaugcagagacacauuaggcuggugcaucuuggccggcaggcagagccagaacaguccgacggugaggaagauuucuauuacacagaguuggacgucgggguggauacccugacggacggacuaagcucgcucacucccguaucuccuaccgccuccaugccacccgcuuuuccgcgucuggaacuuccugagcuguuggagccacccgcccucccuucaccccugcgcccacccgcacccccauuaccgccucccccaguucugaguacaguggccaauccccaaagcugccacuccgauagagucuaucagggcugucucacuccugcuaggcuugaaccacagcccaccgaggugggcgccugcccuccggcacugucuagccggauaggggugacauugcgaaagccacgcggagacgcgaagaaauguagaaaggucuacgguauggaaaggcgggaucuauggugcaccgcuugucgcuggaaaaaggccugccagagauuccuggacuga

SEQ ID NO: 62697 - RNA, 1476 nt, Artificial Sequence
  derived and/or modified sequence opt3 from SLC2A5__Homo_sapiens__XP_011540307
augagacugacucucgugcuugcccuggcuacauugaucgcagccuucggcagcuccuuucaguacggguauaacgucgcggcuguuaauucucccgccuuacugaugcaacaguucuacaacgagacuuauuacggaaggacgggugaauuuauggaggacuucccucuaacccuccuguggucagugacaguaaguauguuuccauucggcggguuuauuggaagccuucuggugggcccguuggucaauaaguucggucggaaaggggcacuccuguuuaacaauauauucuccaucgugcccgccauucugaugggaugcucucgcguugcuacuucguuugaacucaucauuaucucacgauuacuggugggcauaugugcaggcgucagcaguaacgugguaccuauguaucuuggggaguuggccccaaagaaucugcguggagcucuagguguugugccccaacucuucaucaccgucggcauucugguggcccagaucuuugggcuuagaaaccuguuggcgaauguggauggauggccuauucuccugggcuuaacaggugucccagcagcccugcagcuccuucuguugcccuucuucccugaauccccaagguaccuacugauccagaaaaaggacgaggcugccgcuaaaaaggcacuccagacccugcgggggugggauucuguugaccgcgagguggccgaaauaagacaggaggaugaagcggagaaggccgcaggauuuauuagcguacuuaaacuguucaggaugcgguccuugcgcuggcaacuccugucaaucauuguguuaaugggcggccagcagcugaguggggucaacgcuaucuauuacuacgccgaccagaucuaucuaagcgcuggagugccggaggaacacguucaauacgugacugccgguacaggcgcagucaaugugguaaugaccuuuugcgccguuuucguggucgagcuccuggggcgaagacuuuugcugcuccugggauuuucuauuugucuuauagcuugcugugugcugacggcggcauuggcccuccaggauacugucuccuggaugcccuauaucucaauugugugcguuaucagcuacgugauaggccaugcucuggguccuaguccaauucccgccuuacugaucaccgaaaucuuccuacagucuuccaggccuagcgcauuuaugguagggggcucgguccacuggcucucuaacuucacagugggacugauuuuuccauucauccaagagggccuugggcccuauuccuuuauuguuuucgccgugauauguuugcugacuaccaucuacauuuuucucaucgucccggaaacaaaggcuaaaaccuucaucgagauuaaucagauauucacgaagaugaacaaagugucagagguauauccugaaaaggaggaacugaaggaguuacccccagugaccagugaacaguga

SEQ ID NO: 62698 - RNA, 1338 nt, Artificial Sequence
  derived and/or modified sequence opt3 from SLC2A6__Homo_sapiens__NP_001138571
augcaggagccccugcucggcgccgaagggccugacuacgauaccuucccagagaagccgcccccuagcccaggagacagagcuaggguggguacacuucagaacaaacgggucuuucuggcaacuuucgccgcgguuuugggcaauuuuuccuucggguaugcuuuaguguacacgucucccguaaucccugcccuggaacgcucacuagauccagaccuccaccugaccaagagucaggcaagcugguuuggauccguguucacacuuggcgccgcugccggugggcugucugcaaugauuuugaacgaucuccugggacgaaaacugucgauaauguuuucagcuguccccagcgccgcgggcuaugcacucauggccggcgcucauggguuauggaugcugcuuuugggacguacucugaccgguuucgccggcgggcuaacagcagcuugcaucccuguguacguuagugagauugccccaccgggagugagaggcgcgcucggugccacuccccagcugauggcagucuuugggucccuuucucuguaugcuuugggacuccuguuaccuuggagguggcuggccguggcuggcgaagccccaguacucaucaugauucuucuguugagcuucaugcccaauuccccucgguuucuacugucacgcggcagagacgaggaggcacucagggcccuggcuuggcuucgggggaccgauguugacgugcacugggaguucgaacagauccaagauaacguccgccgacagaguagcagagugucuugggcggaagcaagggccccacaugugugucggcccauaacagucgcucuguugaugcgucuccugcagcaguuaaccggaaucacgccgauucugguuuaccuacaauccaucuuugacucaacugccgugcuccugccucccaaggaugacgcagccauuguaggugcugugcgccuuuugagcguccugaucgccgcacucaccauggaucuggcgggcagaaaagugcuucuguucguuaguggguaugcugugggauggggcccaauaacaugguugcucaugucugagguccugccuuuaagggcccgggguguggcauccgggcugugcguacuagccagcuggcucacugcuuucguucugaccaagucguuucuucccguggucucuacauucggcuugcaagugccauuuuucuuuuucgccgcaauuugucuggucucccucguguuuaccggaugcuguguucccgagacgaagggccgaucacuggaacagaucgagaguuucuuucgcacugggagaaggagcuucuuacgguga

SEQ ID NO: 62699 - RNA, 1236 nt, Artificial Sequence
  derived and/or modified sequence opt3 from SLC2A8__Homo_sapiens__NP_001258640
augacccccgaggacccugaagagacacagccacugcucggcccgcccgggggaagcgccccuagagguaggcggguguuccuugcugcauuugccgcggcucugggcccauuguccuucggguuugccuuaggauacucuucacccgcaaucccuagucugcaacgcgccgcuccacccgcaccucgacuagaugacgccgcugccagcugguucggcgcggucguuacucucggugcagccgcugggggagugcugggcggcuggcuuguagaucgugccgggagaaagcuguccuugcuccugugcucugugccauuugucgcaggauucgcugugauuacggccgcgcaggacguuuggaugcugcucgguggcagguuacugaccgggcuugccuguggaguggcaucguuggucgcuccgguguauauaucagaaaucgccuaccccgcuguacggggccugcuagguagcugcguucagcucaugguggucguggggauucugcuugccuaucuggcaggauggguguuggaguggcgcuggcucgccguccugggcuguguuccuccaaguuuaaugcugcuccuuaugugcuuuaugcccgaaacaccuagauuccuguugacucagcacaggcggcaagaggcuauggcggcacuacgcuuucuguggggcuccgagcaggggugggaagauccacccaucggagccgagcagucuuuccaucucgcucugcuucgacagccggguauuuacaagccuuuuaucauaggcgugagccugauggccuuccaacaguuguccgggguaaacgcagugauguuuuaugccgaaaccaucuucgaggaggcuaaguucaaagacucaagucucgccagcgucgugguuggagugauucagguccuguuuacagcaguggcggcuuuaaucauggauagagccggcaggcggcugcuacucguacugucugguguugugauggucuucuccaccucagcauuuggggccuacuucaaacuuacucagggcggacccggcaauagcagucacguggcuauuucugccccagucuccgcacaaccuguggacgcuagcguuggguuggccuggcuggcggugggaucgaugugucucuuuaucgccgguggcccccaggcucuguggucucuucuggcaugcuugcguuuccuccaucugcaguguccauuucacuucguauuaugccccuga

SEQ ID NO: 62700 - RNA, 1536 nt, Artificial Sequence
  derived and/or modified sequence opt3 from SLC2A9__Homo_sapiens__NP_001001290
augaagcugagcaaaaaggacagaggcgaggaugaagaguccgacucugccaaaaagaaacucgauuggucaugcagucuucugguggcuagcuuggcaggggccuucggauccucguuuuuauacgguuauaaccugucugucguuaaugcgcccaccccuuacaucaaggcuuucuauaacgaaucaugggagaggcggcacggccgcccaauugacccggauacacuaacucuccuguggagcgugacgguaaguauauuugccaucgggggacuugugggcacccugauugucaagaugaucgguaaaguguuggggcgaaagcauacacuccuggcaaauaacggauucgccauuuccgcugcacugcucauggccuguucuuuacaggcuggcgccuuugaaaugcugaucguuggccguuucauaauggggaucgacggagguguggcgcuuagcgucuugcccauguaccuguccgagauuucaccuaaagagaucagaggcagucuagggcaagugacugcaauuuuuaucugcauaggaguauucaccggccagcuccugggucuuccagaacuguuggggaaggagagcacauggcccuaucucuuuggaguuauuguggucccugccguggugcagcuguuaucucugccauuccuccccgauuccccuagguaccuucuguuggaaaaacacaaugaggcucgggccgucaaggcauuucagaccuuccuaggcaaggcugacguuucacaagagguggaagagguacuggccgaaagccgcgugcagagaaguaucaggcucgucucugugcuggagcuucugcgggcgccauauguucgcuggcaaguggucacugugauuguaacaauggccuguuaccaguugugcggccucaacgcaaucugguuuuacaccaauuccaucuucgggaaagcugguauuccgcccgccaagauaccuuauguuacgcugagcacuggaggcaucgaaaccuuagcugccguguucucggggcuggucauugagcaucuaggacgaagaccacuccugaucggcgguuuugggcuuaugggcuuguucuuuggaacacugacuauaacccucacacugcaggaucacgcacccugggugccuuaccuuucuauugucggcauccuggccaucauugcuuccuucuguucagggccaggagguauccccuuuauuuugaccggcgaguucuuucagcagagucagaggccggcggcauucauaaucgccgggacggugaacuggcucagcaauuuugcuguuggacuguuauucccuuuuauucaaaaaucccuggacacuuauugcuuccuaguguuugccacaaucuguaucaccggcgcaauuuaccucuauuucguacugcccgaaacuaagaaccggacauacgccgagauaucucaggcuuucagcaaacguaauaaggccuauccaccugaagagaaaaucgauucagcagucaccgacgguaagauuaacgggcgccccuga

SEQ ID NO: 62701 - RNA, 1458 nt, Artificial Sequence
  derived and/or modified sequence opt3 from SLC30A10__Homo_sapiens__NP_061183
augggcagauacagcgggaagaccugcaggcugcucuuuaugcuugugcugacagucgccuuuuucguugcugaguugguguccggauauuuagguaacucuaucgcacugcuaucagacaguuuuaauaugcucagcgaucugauuucccuuuguguaggccugucugccggguacauagcgcggcgccccacucgaggauucucggcuacguauggcuacgcccgugcagaaguggucggugccuugucaaacgcuguguuucucaccgcacugugcuucacaaucuuuguugaggccgugcugagacucgcuaggccugaacggauugacgauccagaguuaguccugaucguggggguacuuggauugcugguuaauguggucggccuacucauuuuccaggacugugccgcgugguuugcaugcugucugcgcggcagaagcaggcggcuucaacagcgccagcagcuggccgaagggugcgugccgggagcuuucgguggcccccaaggggccgaggauccuagacgagcagcugacccaacugcccccggaagugauuccgcggugaccuugaggggcacaucugucgagcggaaacgugaaaagggugccaccguuuuugcaaacguggcuggggacagcuucaauacucagaacgagccugaagauaugaugaaaaaggagaaaaaguccgaggcccucaauauccgcggaguacuguuacacgugaugggcgacgcucugggcucagucgugguugugauaacagccaucauuuucuauguccucccacuuaagagugaagaucccuguaacuggcagugcuacaucgacccuagccugaccguguugaugguaauuaucauacuaucuuccgcauucccacugauuaaagagacggccgcuauccuccugcagaugguuccgaagggggugaauauggaagaguugaugucaaaacugagcgcgguccccggaauuaguucugugcaugaaguccacaucugggaguugguguccgguaagaucauugcaacucuccauauaaaauauccuaaggauagaggcuaccaagacgccagcaccaagaucagggagauuuuccaccaugcugggauccacaacguuacaauacaguuugaaaauguggaccugaaagagccauuagaacagaaggaucugcuacuccuguguaacucgcccugcauuucuaaaggaugugccaagcagcuuugcugcccuccaggcgcauugccccuggcccacguaaaugguugugcugagcauaacgggggcccgucccucgacacuuacggaucagauggccugagucggcgagacgcccgcgaagucgcaaucgaggugagccuugauuccugccugucugaccacgggcaaagccuuaauaaaacccaggaggaucaguguuauguuaacagaacacauuucuga

SEQ ID NO: 62702 - RNA, 1524 nt, Artificial Sequence
  derived and/or modified sequence opt3 from SLC30A1__Homo_sapiens__NP_067017
augggcugcugggggagaaacaggggacggcugcucuguaugcuugcccugaccuucauguuuaugguguuggaggucguugugagccgcguaacauccucuuuagcuaugcugucagacaguuuccacaugcuaagcgaugugcucgcacuggucguggcccuuguugcggaacgauuugcucguagaacucaugccacgcagaagaauaccuucgguuggaucagggcagaggugaugggcgcccuggucaacgcuauuuucuugacagggcucugcuucgcaauacugcuggaagccaucgagcgguuuauugaaccccacgagaugcaacagccucucgugguauuaggaguuggcguggcuggucugcuugucaauguguuggggcugugucuauuccaucaccauuccggauuuucucaggacucgggccacggccacucacaugggggacacggucauggccacgggcucccaaaaggaccgcgcguuaagagcacuagacccggcaguuccgauaucaacgucgccccuggugagcaggggccagaccaagaagagaccaauacacugguugcgaacaccucuaauagcaacggacuuaaacuggaucccgcagacccugaaaauccaagguccggcgauacuguggagguacaggugaacggcaauuugguccgggagcccgaccacauggaacucgaggaagaucgcgccgggcagcugaacaugcgaggaguguucuuacauguucugggugacgcucucggcucagugauugucgugguaaaugcccuuguguuuuacuucaguuggaaggggugcagcgagggagauuuuugugugaacccuugcuucccagacccguguaaagcauucgucgaaaucauaaauucuacacacgcuuccguguaugaggccggccccugcuggguccuguacuuggauccuacccuaugugugguuauggugugcauccugcucuauacgacuuacccacugcuuaaggagucagcgcugauuuugcuccagaccguacccaagcaaaucgacauuagaaaccugaucaaagaauuaaggaacgucgaggguguggaagagguucaugaacugcacguguggcagcuagccgggagccggauaauugcaacagcucauaucaagugugaggacccuaccaguuauauggaggucgccaaaacuauuaaggauguguuucacaaucacggcauccaugcuacaaccauccagccagaauuugccucuguaggauccaaaagcucggugguucccugcgagcucgcaugccguacgcagugugcccugaagcaaugcuguggcacucuuccgcaggcuccuucugggaaggacgcggagaaaacacccgcagucuccauuucaugcuuggaacugaguaacaaucucgaaaagaaaccacgcagaaccaaggccgagaacauaccugcuguggugaucgagauuaaaaauaugcccaacaagcagccagaaagcucccuguga

SEQ ID NO: 62703 - RNA, 1167 nt, Artificial Sequence
  derived and/or modified sequence opt3 from SLC30A3__Homo_sapiens__NP_003450
auggagcccagcccugccgcuggcgggcuggaaaccacaagacucguguccccaagggaccggggaggugcaggcgggucucuucgccugaagucauuguucacugagccgagugaacccuuaccugaggaaagcaaaccagucgagaugcccuuucaccauugccaccgagauccucugccacccccuggacuaacgccagagcgucuccaugccagaaggcagcuguacgcggcuugugccguuugcuucguguuuauggcaggcgaaguaguggguggguaucuugcccacucccuggcuaucaugaccgacgcagcccauuugcucgcugaugucggaucuaugaugggcucgcuguucucacuguggcucagcacacggccggccacucgcaccaugacauuuggcuggcacagaagugagaccuuaggggcgcuggcauccgugguuucucuuuggauggugacuggaauuuugcuguaccuagccuucgucaggcuccugcacagcgacuaucauauagaagguggcgcuaugcuucugacagccuccaucgcagugugugcuaacuugcucauggccuuuguacugcaccaagcggggcccccucauucacacggaagucggggcgccgaguacgcaccauuagaggaaggucccgaggaaccucugccacucgggaauaccagcguucgcgcugccuucgugcacguccuuggagaucuguugcagucuuuuggcgugcuagcugccuccauucugaucuauuucaagccccaguacaaagcagccgacccgauuucaacguuucucuucagcaucugcgcucugggcaguacugcgccuacccuucgagaugugcugagaauauugauggaggggacacccaggaacgucggauuugaaccaguucgggacacucuccugucugugccugguguacgugcaacccaugaguuacaccugugggcccuaacacucaccuaucauguggcuuccgcccaccuggcaaucgauagcacggccgaccccgaggcuguccuugccgaagcaucgucucgcuuguacuccagauucggcuucucaaguuguacucugcaaguggagcaauaccagccagaaauggcgcagugccucaggugucaggagcccccucaggcuuga

SEQ ID NO: 62704 - RNA, 1290 nt, Artificial Sequence
  derived and/or modified sequence opt3 from SLC30A4__Homo_sapiens__XP_011520299
auggccggcagcggggcuuggaagagacugaaauccaugcucaggaaggacgaugcaccccuuuuccugaacgacaccucugccuuugauuucucagacgaggcgggagaugaagguuugagucgguuuaauaaauuacgcguggucguugcugacgauggcagcgaggccccugaacgaccagugaacggggcacacccgacacugcaggccgacgaugacucccuacucgaucaagaccugccccuuacuaauucucagcugucguugaagguagauucaugcgacaacuguagcaaacagcgugagauccucaagcagagaaaggugaaagcuaggcugacgauugcagccguccuguaccucuuauucaugauaggagaacuggugggcgguuauaucgcuaauagucuugccauuaugaccgacgcguugcauaugcugacagaucuauccgcaaucauucucacucugcuugcccugugguugucuagcaaguccccuaccaaacgguuuacauucggguuucaccgccucgagguucugucagcuaugaucaguguguuacuggucuacauacucaugggauuccuucuguaugaggccgugcaaagaaccauccauaugaacuacgaaauuaauggcgacaucauguugauuacugcagcuguaggcguugccgugaacgucaucaugggguuucuacugaaucagagcggacacaggcauucucacucccacucacucccaagcaacagucccacacgggguucuggcugcgagcgcaaucaugggcaggauucccuggcggugcgagccgcauucgugcacgcucuuggagaccugguccagagcguuggcguguugauagccgcuuauauuaucagauuuaagccugaauacaaaauugccgauccaaucuguaccuauguauucucgcuccugguggcauuuacgacuuucaggaucauuugggacaccgucgugauaaucuuagaggguguucccucucaucugaacguggauuacauuaaggaggcccuaaugaagaucgaagacgucuacuccguggaggaucucaauauauggucacugacaagugggaaaagcacugcuauuguacacauccaacuuaucccuggauccucuagcaagugggaagagguucagucaaaagcgaaccacuugcugcucaauaccuucggcauguaucggugcacaauucagcugcagaguuaccgucaagaaguggaccgcaccugugcaaacugccaguccagcucuccauga

SEQ ID NO: 62705 - RNA, 2298 nt, Artificial Sequence
  derived and/or modified sequence opt3 from SLC30A5__Homo_sapiens__NP_075053
auggaggaaaaguacggcggggacgugcuggccggacccgguggcgggggaggccucgguccugucgauguuccaagcgcuagacuuaccaaauauaucgugcuguugugcuucacaaaguuuuuaaaagcaguagggcuguucgaguccuacgaccuacucaaggccgugcacauuguccaguuuauauucauccugaaacuuggaacugcguuuuucauggugcuguuucaaaagccguucucuucaggcaagacgauuaccaaacaucaguggaucaagauuuuuaaacacgcuguugccggcuguaucauaaguuugcucugguucuuugggcugacacugugcggaccccucaggacuuuacugcuuuucgaacauagcgauaucguggucauuuccuugcugucugugcuauuuaccucgucagguggcgggccugcaaagacacggggagccgcuuucuucaucauugcaguaaucugucuccugcuuuuugacaacgaugaccugauggccaaaauggcugagcacccagaaggccaucacgauagcgccuugacccacaugcucuauacugcgauagcauuccuggguguugccgaccauaagggaggaguguuacugcucguccuugcucugugcuguaaggugggcuuucacacagccagucgcaaauuguccguggaugucggcggggcaaagcgacuacaggcucugucucaucucguuagcgugcugcuucugugccccuggguaauuguguuguccgucaccacggagucaaaaguggagaguugguucagccucaucaugccuuuugccacuguuauuuucuuugugaugauccuggacuucuacgucgauucuaucuguuccgugaagauggaaguaucaaaaugcgcgcguuaugggagcuuuccaauuuucauaagugccuuacuguuugguaauuucuggacccaccccaucacagaccagcuaagagcaaugaacaaggcugcccaccaagagucuacugaacauguucucuccggcgggguggucgugagcgcuaucuuuuucauucugucggccaauauacuuucuuccccuucaaaaaggggacagaagggcaccuugauugguuacaguccagaggggacaccgcuguauaacuucaugggcgaugcauuucagcacagcucccagucuaucccccgguucaucaaggagagccucaaacaaauucuggaagagucagacagucgccagaucuuuuacuuccuuugucugaauuugcucuuuaccuucgucgaacuguuuuacggaguguuaacgaacucccugggccuaauuagcgacggguuccauaugcucuuugauugcucugcccugguuaugggacuuuucgcugcguugaugucaagauggaaggcaacuaggauauuuaguuaugguuacggccggaucgagauucugagcggguucaucaauggacucuuucugaucgugauugccuucuucguauuuauggaauccgucgcucgcuuaauagacccuccagagcuggauacacacaugcuuacccccgugucuguuggcgguuugaucgugaaccucauugggaucugugccuucucgcaugcacacagccacgcccauggcgcuucccagggaucaugccacaguucugaccauagccacucccaccauaugcacggccauucagaucacgggcauggacacagccacgguucugccggcgggggaaugaaugcaaacaugcgaggcgucuuucugcaugugcuagcggacacucuggguuccauugggguaaucgugaguacaguucucauagagcaguucggcugguuuaucgcugauccucugugcagccuuuucauugccaucuugauuuuucugucugucgugccauuaaucaaagacgcaugucaagugcuccugcuuagacugcccccggaauaugagaaggaauugcacauagcccucgagaaaauucagaagaucgaaggacugauuuccuacagggauccucauuucuggcggcacucagcuaguaucgucgccggcaccauacauauccagguuacgagcgacgugcuagagcaacguauugugcagcagguaaccgggauccugaaggaugcaggagucaauaaccucacaauucagguggagaaagaggcuuauuuucaacacaugucgggccuguccacugguuuccacgacguucuugccaugaccaagcagauggaaucuaugaaauacugcaaggacgggacauauaucauguga

SEQ ID NO: 62706 - RNA, 1506 nt, Artificial Sequence
  derived and/or modified sequence opt3 from SLC30A6__Homo_sapiens__NP_001180442
augggcaccauccaccuguucagaaagccccagaggagcuuuuucgggaaacuccuucgggaauuucgccugguggccgcugaccgacguuccuggaagauuuuguuauucggagucauaaaccugaucugcacagguuuucuacucaugugguguucuucaacuaauaguauugcacugacggccuacaccuaucuuacaaucuucgaucuguuuagagacggcguuagcccuuucugguugggguggucccaaacuccagaucucaaauggucuacccaucugggacugccgaagugcugggacaacaggcgggaacuccccuguuuaucaaauucgcugaugacaugccuuauuagcuacugggugaccuugcgcaaaccuaguccaguauauuccuuuggcuucgagagacuggaagugcuagcggucuuugcuucuacugugcucgcccagcugggugcacuuuucauccugaaggagagcgccgaaagguuuuuggagcagcccgagauacacacagggcggcuccugguuggaaccuucguggcuuuauguuucaaccuguuuacgaugcucuccauccgcaauaagccuuucgcauacgucucagaagccgcuaguacuagcuggcuucaggagcauguggccgaucugucucgauccuugugcggcauuaucccaggccuaucaagcauuuuucugcccagaaugaacccuuucguacucaucgaccuggcgggggcauuugcccuuuguauaaccuauaugcugauugaaaucaauaacuacuucgcuguugauacagccagugcaauugcuaucgccuugaugacuuuuggaaccauguauccaaugucuguguacuccgguaaaguccuccugcaaacaaccccgccccacgugaucggccaguuagacaagcugauuagggaggugagcacgcuagaugggguccucgagguucggaaugaacauuucuggacucugggauuuggcucgcuugcggguucugugcacguacguauacgcagagacgccaacgagcagaugguguuggcacacgucacaaauaggcuguacacccucguguccacucugacaguucagaucuucaaagaugacuggauucggccugcccuucugucagggccaguggcugcuaacgucuugaauuuuagugaucaucacgugauccccaugccucuccugaagggaaccgacgacuuaaacccaguaacgagcacccccgccaaaccguccucuccucccccagaguucagcuuuaauacaccuggcaagaacguuaaccccgugauacugcuaaauacucaaacccgaccauauggcuucgggcucaaccauggacacacacccuacucaaguaugcugaaucagggucuuggcgucccugggauuggagcaacucagggcuugcgcaccgguuucacaaacaucccauccagauaugggaccaauaacaggaucggccagccgcggcccuga

SEQ ID NO: 62707 - RNA, 921 nt, Artificial Sequence
  derived and/or modified sequence opt3 from SLC30A7__Homo_sapiens__XP_011539081
auguucuuugacagcaccgccauccuggcuggccucgcagccuccgugauuucuaaguggagagauaacgacgcguucucauacggguaugucagggcugagguucuugccggauuugugaauggucuguucuugauauuuacagcauucuuuaucuucagugaaggcguagagcgggccuuagcucccccugaugugcaccaugaacgccugcuacucgucagcauucugggguuugugguuaaccuuaucggaauuuucguguuuaaacacggcggucaugggcacucccauggaucuggccacggccacucgcauucacuguucaauggggcauuggaccaggcccacggacaugucgaucacugccacagccaugaggugaagcacggugcugcccauagucacgaccaugcgcacggccacgggcauuuucacucccaugauggaccaucucucaaagaaacuacgggcccgagccgacaaauccugcaggguguauuccugcacauacucgcagacaccuuaggguccaucggaguuauugccucagcuaucaugaugcagaacuucggccugaugauugccgaucccaucuguaguauacuuauugcaaucuugauuguggucagcgugaucccucugcuacgugagucugugggcauccucaugcagagaacaccaccccugcuugaaaauucccugccucaaugcuaccagaggguccagcaguugcaagggguuuauucacuccaggagcagcacuuuuggacucuguguagcgacguguacguaggaaccuuaaagcugauuguggcuccagaugccgacgcgcgguggauacucagucagacacauaacaucuucacccaagccgguguccgccagcuuuaugugcagauugauuuugcagcuauguga

SEQ ID NO: 62708 - RNA, 963 nt, Artificial Sequence
  derived and/or modified sequence opt3 from SLC30A8__Homo_sapiens__NP_001166286
auguaccacugccauagcggcuccaagcccaccgagaaaggggccaacgaauaugcuuacgcaaaguggaaacuguguucugccucagcgaucugcuucauuuuuaugauagcugagguggucggaggucacaucgccggcagucucgcaguugugacagacgccgcucaucuucugauugauuugacuagcuucuuacugucccuauuuucucucuggcugucgucaaagccuccaagcaaaagacuuacguucggguggcacagggcagaaauccugggagccuugcucaguauucuguguaucuggguagugaccggcguccugguguaucucgcuugcgagcgguuacuguacccggacuaucagauacaagccacaguuaugaucauuguguccucuugugcggucgcagccaauaucgugcuuacuguaguuuugcaucagcgcugccugggucacaaccacaaggaagugcaggcuaaugccagcguccgagcagcuuuugugcaugcccuaggggaucucuuccaguccauuucagugcugaucagugcgcuuauaauuuacuuuaagcccgaguauaaaaucgccgacccuauuuguaccuucaucuuuagcauccuggucuuggcaucuacaauuaccauacucaaggauuucuccauccuguuaauggagggaguuccaaaaucacugaacuacagcggcgugaaggaacucauucuugcuguagacggcgugcugaguguccacucuuugcauaucuggucccuaacuaugaaucaagugauacugagcgcccacguugcuacagccgcaucgcgugauucucagguggucagaagggagauugccaaagcucucuccaagucauuuaccaugcacagucugacgauccagauggaaagccccguggaccaggauccugacugccuuuucugugaggauccaugcgacuga

SEQ ID NO: 62709 - RNA, 1707 nt, Artificial Sequence
  derived and/or modified sequence opt3 from SLC30A9__Homo_sapiens__NP_006336
augcugcccggccucgccgcugcagccgcgcacagaugcagcugguccucucuuuguaggcugcgguugcgcugccgagcugccgcauguaacccuucagaccgucaggaguggcaaaauuuagugaccuucgggaguuuuagcaacauggucccaugcucccauccguacaucggaacacugucucagguuaagcuauauucgacuaaugugcagaaagaaggucagggcucacaaacgcucagaguagagaaggugcccagcuucgaaaccgccgaggggauuggaacagaacugaaagcuccucuuaagcaggagccacugcaggucagggugaaagcaguuuugaagaagcgggaguacggcaguaaauauacucagaacaauuuuauaaccggugugcgcgccaucaacgaguucugucucaaguccucugaucuggaacaacugagaaaaauuaggcggcgcagcccccacgaagacacagaguccuuuaccgucuaccuccgaucagauguggaggcuaagaguuuagaaguaugggggagcccugaggcccuggcgagagaaaagaaacuuaggaaggaggcagaaaucgaguaucgggagcguuuguuccgcaaucagaaaauucugagagaauacagggacuuucuaggaaacacuaagccacggucucgaacagccuccguuuucuuuaaaggccccggcaagguggucaugguggcuaucugcauaaaugggcucaacuguuucuuuaaauuccuggccuggaucuauaccggaucagcaagcauguuuagugaggcuauucauucucuuuccgauacgugcaaucagggucuguuggcccucggcaucagcaagucggugcagacuccugacccaucucacccguacggguucuccaacaugcgcuacauuucaagucugaucagcggagucggcauauucaugaugggugcgggguuauccugguaucauggaguuaugggccugcuccacccccaaccuauugaaucucuucugugggccuacuguaucuuggcaggcagccuagugucagagggggcuacccugcucguagccgugaaugaacugagaaggaacgcucgggccaaaggaaugaguuuuuauaaguacgucauggagucccgcgauccaagcacaaaugugauucuucuggaggacacugcagccguuuugggugugaucaucgcugcgaccugcaugggccucacaucuauuaccgggaacccccuguaugauucauuaggaagucugggcgucgguacgcuacucgggauggugagcgcauuccugauauacacuaacacagaagcccuuuugggcagauccauccagccugagcagguacaaaggcugaccgaacuccuggagaaugacccaucuguucgugcuauucacgaugugaaggccacugaccuuggacugggcaaaguccgguuuaaggcagaaguggauuucgacgggcgagucgugacaagaucguauuuggagaaacaggacuuugaucagaugcuccaggagauccaagaaguuaagacccccgaggaacuggagacguucauguuaaaacauggagagaacauaauugacacccugggugccgaaguggauaggcuagagaaggaacucaagaaacgcaauccggagguacggcacgucgaccuggaaauccuuuga

SEQ ID NO: 62710 - RNA, 573 nt, Artificial Sequence
  derived and/or modified sequence opt3 from SLC31A1__Homo_sapiens__NP_001850
auggaccacagccaucacaugggcauguccuacauggauucuaacucaaccaugcagcccagucaucaccauccuacaacuagcgccucccacucucacgggggaggugacucgucaaugaugaugaugccaaugacguucuauuuuggcuucaagaauguggagcugcucuuuagcgggcuugucaucaacaccgcuggagaaauggcaggcgccuucguugcgguguuucuguuggcuauguucuacgaggguuuaaaaauugccagagaaagucugcuaaggaagucccaaguaucuauacgguauaauagcaugccggugcccgggccuaacggaacaauccucauggagacucauaaaaccgucggccagcagaugcuguccuuuccacaccuucugcagacaguguugcauauuauccaaguugugauuucauacuuccucaugcugaucuuuaugaccuauaauggcuaccugugcauagcagucgccgcuggggcaggaacugguuauuuccucuuuaguuggaagaaagccgugguaguugauaucacagaacacugucacuga

SEQ ID NO: 62711 - RNA, 432 nt, Artificial Sequence
  derived and/or modified sequence opt3 from SLC31A2__Homo_sapiens__NP_001851
auggccaugcacuucaucuuuagcgacaccgcugugcuccuguucgauuuuugguccguccauucucccgcaggcauggcccuuucaguucugguguuguuacugcuagcgguacucuacgaggggauuaaggugggaaaagcuaagcugcuuaaccagguccuggugaauuugccuacaaguauaagccaacagacuaucgccgaaacggacggugauuccgcaggcucugacucguucccaguugggagaacccaccauaggugguaucucugccacuuuggacagucacugauucaugugauccaggucgugauuggcuacuucaucaugcuggccguaaugagcuauaacacauggauauuucucgguguuguguuagggagugcugucggauacuaucuggcauacccgcuuuuguccacugccuga

SEQ ID NO: 62712 - RNA, 1578 nt, Artificial Sequence
  derived and/or modified sequence opt3 from SLC32A1__Homo_sapiens__NP_542119
auggccacccugcucagaagcaagcuguccaacguggcuacaucugucucaaauaaaagucaggcaaagaugagcggcauguucgccaggaugggguuucaagcggcuacugacgaggaagccguuggauucgcacacugcgaugaccuggauuuugagcaucggcaggguuugcagauggacaucuuaaaagccgaaggcgagcccuguggggaugaaggagcugaggcaccuguggagggcgacauucacuaccagcgcgguuccggggccccacugccgcccucuggaucgaaggaucaaguaggcggcgggggagaguucgguggccaugacaaaccuaagauaacggcuugggaagccggguggaacgugaccaaugcgauccagggaauguuuguccuaggccucccauaugcaauucugcacgguggguaccuuggacuguucuugaucauuuuugccgcugugguuugcuguuauacaggcaagauccucauagccugccuguacgaagagaacgaggauggcgaagugguccgagugcgugacucauauguagcaaucgcuaaugccuguugcgcgcccagauucccuacucuugggggaaggguugugaacgucgcccagauuaucgagcucgugaugaccuguauuuuauacguggucguuagcgguaaucugauguauaacaguuuuccaggccuucccgugucccagaaaucuuggagcaucauagcaacagcuguauugcugccuugcgccuuccuaaagaaucucaaagcuguguccaaguuuucacugcuuuguacccuggcccauuucgucauuaacaucuuggugauugcauacugccucagucgggcccgcgauugggcuugggaaaaaguuaaguuuuacaucgacgugaagaaauucccaaucagcauugggauaaucgucuucucuuauacuucccaaauuuuucugccgucauuagagggaaauaugcagcagcccagcgaguuccacuguaugaugaacuggacacacaucgcggcaugcgugcugaagggccucuuugcccuuguagcuuaccugaccugggccgaugaaacgaaagagguuauaacugacaauuugccugguaguauuagagcaguggucaacaucuuccuaguggccaaggcucugcucucuuauccacugcccuuuuucgccgcagucgaagugcuugagaaaucccuguuucaggaagggagcagggcguucuuuccugcuugcuacucgggcgacggacgguugaagucuuggggccucacccugcgcugugccuuaguuguguucacacugcuaauggcaaucuauguaccacauuuugcccuccugauggggcuuacuggauccuugaccggugcuggccugugcuuccuccugcccucacuuuuucaucugcgauugcucuggagaaaacuguuauggcaccaagucuucuucgauguggccauuuuuguuaucgggggaauuuguagugugagcggcuucguccacucccuggagggucuaauagaagcauacaggacaaaugcugaggacuga

SEQ ID NO: 62713 - RNA, 1650 nt, Artificial Sequence
  derived and/or modified sequence opt3 from SLC33A1__Homo_sapiens__NP_001177921
augagccccaccaucucccacaaggacucuucaagacagaggcggccuggcaacuucagucauagccuggauaugaaauccgggccacucccgcccggagguugggacgauucucaccuugacucggccggccgcgagggggaucgagaagcucuguugggagacacaggcacuggugauuuucuuaaggcaccucaaucauuccgugccgagcugagcaguauucuacuccugcuuuuucuguacguguugcaggggauaccacucggacuggcgggcuccaucccccugauucuccagucuaaaaaugucagcuauacggaccaggcuuucuuuuccuucguuuucuggccuuucucauuaaagcugcuuugggccccauugguggaugcaguauacgugaaaaacuuuggcagaaggaagaguuggcugguccccacccaauauauccuagggcucuuuaugauuuaccugagcacacagguggaccggcuucugggaaauacugaugaccgcaccccugauguuaucgccuugacaguggcuuucuuccucuuugaauuucuggcagccacccaggacauagcugucgacgguugggccuuaacuaugcugucuagagagaacgugggcuaugcguccacaugcaauucaguagggcagaccgcaggauacuuccucggcaacguucuuuuucuggccuuggaaagcgcugauuucuguaauaaguaucuaagguuucaaccacagccgcgggguaucgugacgcugagugacuuccucuuuuucugggggacugucuuucugauuaccacaacucuuguggcccuguugaaaaaggagaacgaggugucugucguuaaagaagagacccagggaaucacagauaccuacaagcuccuguucgcaauuaucaaaaugcccgcuguguuaacguuuugccugcuaauacucacugccaagauuggcuucuccgcggccgacgcaguaacaggccugaaguuaguggaagagggggucccuaaagagcauuuggcucugcucgccgugccaaugguuccccugcagaucauucuuccucugaucaucagcaaguacaccgcuggaccacaacccuugaauacuuuuuauaaagccaugccguaccgccuccuguuaggucuggaauaugcacuacucgugugguggacaccuaaggucgagcaccagggcggguuccccauuuacuauuacauagugguacugcuuucguaugccuugcaucagguuaccguguacucuauguacgucuccaucauggcuuuuaacgcgaaagugucagauccacugauuggaggcacguauaugacccuccugaauacagucaguaacuuaggugggaauuggccuagcacuguggcacuguggcuuguugaccccuugaccgugaaggaauguguaggcgccuccaaccaaaauugccgaacaccagaugcugucgagcucuguaaaaagcugggaggcucuugcgugacugcccuagacggguacuauguugaaagcaucauauguguguucauuggauucgguuggugguuuuuccugggccccaaguuuaaaaagcuccaggaugaggggucaaguuccuggaaaugcaagagaaacaacuga

SEQ ID NO: 62714 - RNA, 1023 nt, Artificial Sequence
  derived and/or modified sequence opt3 from SLC34A1__Homo_sapiens__NP_001161051
augcugagcuacggcgagagacucgggucccccgccgugucuccucuuccagucaggggaggucacguuaugcggggcaccgcuuucgcauaugugccgucaccccagguacugcaucgcaucccugggacaagugccuacgcguuucccagcuugggaccaguggcuuuagccgaacacacuugcccuuguggcgagguccuggaacgacaugagccacuacccgcaaagcucgcccuggaagaggagcaaaaaccugaaucccgucuugugccaaagcugagacaggcuggugcaauguugcucaaaguuccgcugaugcugacguuccucuauuuauuugugugcucucuggacaugcuuucgucagccuuccaguuggcugggggaaaggucgccggcgauauuuuuaaagacaacgcgauacugagcaaucccguggcaggccuaguaguugggauccucgugaccguccuggugcagaguuccucuacaagcacuuccauuaucgugucaauggucaguagcggacuucuggagguuucuuccgccauuccuaucauaauggguucaaacaucggcaccagcgugacaaauaccauuguagcuuugaugcaagccggggauaggacugacuuccggcgcgcauuugcuggagccacagugcacgauuguuucaacuggcucaguguccugguguuacugccacucgaagcggccaccggcuaccuucaucacaucacgagacugguuguggcaucuuuuaauauucacggugggagggacgcucccgauuugcuaaagaucauaacugagccuuucaccaagcugauuauccagcucgacgaguccgucauuacaagcaucgccacuggagaugaaucgcugcggaaccauucucuuauccagauuuggugccacccagacucccugcagcaaaauuuggagggccgcgaaauaacccauuuugaucuccgaaagaaacaggcuauggaggacucaagugugccccacuguccguga

SEQ ID NO: 62715 - RNA, 2070 nt, Artificial Sequence
  derived and/or modified sequence opt3 from SLC34A2__Homo_sapiens__NP_001171470
auggcccccuggccugagcugggcgacgcucagccaaacccggauaaguaccucgaaggggcagccggacaacagcccaccgcgccugacaaaagcaaggagacaaauaaaaacaauacugaagcuccagugacgaagaucgagcuucugcccuccuauucuaccgccacauugauugaugaaccuacugaggucgacgauccauggaacuuacccacccugcaggacucagguauaaaauggagugagagagauacaaagggcaagauccuaugcuucuuucaggggauuggaaggcucauccugcuucugggcuucuuguacuuuuucguuuguagccucgacauucuguccucugcauuucaacuggugggugggaaaauggccggacaguucuuuagcaauucaagcaucaugaguaacccucucuuaggccugguaauaggcgugcuugucaccguguugguucaguccucuagcacuuccacaucaaucguggucaguauggugucgucuucccugcuaaccguacgggcugcaauuccaaucauuaugggggccaauaucggaacgucaauaacuaacaccauuguugcucucaugcaagugggugaucgcagcgaguuccgacgugccuuugcgggcgcaacaguccacgacuucuuuaauuggcugagugugcuugugcuguugccggucgaaguugccacucauuaucucgaaaucauuacccagcugaucguggagucuuuccacuuuaagaacggggaggaugcucccgacuuacugaaaguaaucacaaagccuuucaccaaacucauugugcagcuugauaagaaggucauaucccagaucgccaugaaugacgaaaaagcaaagaacaaaagccuggugaagauuuggugcaaaacguucacuaauaagacacagaucaacguuaccgugccaucgacugcuaauuguacaucucccuccuugugcuggaccgacggaauacaaaacuggacgaugaaaaacgucaccuacaaggagaauauugccaagugucagcauaucuuugugaacuuccaccuaccugaucuggcgguaggcacaauccuccugauucuuucacuguugguucucugcgguugucugaucaugauugugaaaauauuagggaguguccugaagggacagguggccacugucaucaaaaagaccauuaauacagacuuuccauuccccuuugcauggcuaacuggcuaucucgcuauccuggugggcgccgggaugaccuucaucguucaaagcuccucuguguuuacaagcgcucuuaccccguugauuggaauagguguaaucacuauugaaagagccuacccucugacgcucggcucaaacaucgggacaaccacuaccgcaauucuggccgcucuugcgagucccggaaaugcacugagguccagcuugcagaucgcccucugccauuucuuuuucaacauaucuggcauccuguuaugguauccaauuccuuuuacacggcugcccauccgcauggcuaaaggucuagggaauauuucagccaaguacagaugguucgcagucuuuuaccucaucauauucuucuuucugauuccacuuaccguguucggcuugagucuggccggauggaggguucucgugggcgucggggugcccguaguguuuaucauuauccugguuuuaugucugcggcuuuugcagagccgcugcccucgaguccucccaaagaaacugcagaacuggaauuuccuaccgcuguggaugagaucccucaagcccugggaugcuguggugucuaaauuuacuggauguuuccaaaugaggugcugcuguugcugucgggucugcugucgugccugcugucugcuuugcgguuguccuaagugcugucgcugcucgaaaugcugugaggacuuggaagaggcacaggagggccaggauguuccagugaaggcgcccgaaacauuugacaacauaacgaucagcagagaggcucagggggaagugccugccuccgauucaaagaccgagugcacugcacuguga

SEQ ID NO: 62716 - RNA, 1800 nt, Artificial Sequence
  derived and/or modified sequence opt3 from SLC34A3__Homo_sapiens__NP_001170788
augcccagcucccugccuggcucucaggugccacacccgacccucgacgccgucgaucuuguugagaagacacugagaaacgaagggacuucaaguagcgcucccguguuggaggaaggagacacggauccuuggaccuuaccacaacugaaagacacaucccagcccuggaaggagcuaaggguagcaggucggcuccgccgaguggccggcucuguccugaaagcgugcgggcuucugggaucguuguacuucuuuaucuguucacucgaugugcugagcagugcuuuccagcugcucggcuccaagguugccggugacauuuuuaaagauaauguggucuuaucuaacccuguggcagggcugguaauaggaguucuugugacugccuugguccagagcuccucaaccaguagcucuaucgugguguccauggucgcugcaaagcugcuaacaguucgugugucaguaccaauuaucaugggcgugaaugucggcaccagcauuacaaguacucucgugucuauggcccaauccggggacagagaugaauuucagagggcuuuuagcggaucggccguucaugguaucuucaacuggcugaccgugcuuguccuguugccccucgagucugcgacggcacuguuagagcggcuguccgaacucgcccuuggcgcugccucacugacuccucgcgcacaggcuccagacauauugaaggugcuaaccaaaccgcugacacaccucaucguacagcuggauagugacaugauuaugagcuccgccacugggaaugcgaccaacucuagccuuaucaagcauuggugcggaacaaccggccaacccacgcaggaaaauucaaguuguggugccuuugggccuugcacugagaaaaacuccacagcaccagcugauagacugcccuguaggcacuuguucgccggaaccgagcucacugaccuggcuguuggcugcauuuuacuggccggcagccuacucgugcugugugggugccuugucuugaucgugaagcugcucaauucuguccugcggggacgcguggcacagguugugcgaacaguaauaaacgccgacuuuccuuucccacuugguuggcugggcggguauuuggcuguccucgcgggagcaggccugaccuuugccuuacagucaaguagcguguucacggcugccguugugccccugaugggugucggggugauuucccuagauagagcauacccgcuccugcuuggcucuaauaucggaaccacaacuaccgccuugcuggcugcccucgcaucgccugcggacaggaugcugagcgcuuuacaaguagcccugauucauuucuucuucaaccuugcaggcaucuugcucugguaucuggugcccgcccuacggcugccaaucccucucgcucgucacuuugggguugucacagcccgcuacagauggguggcaggaguguaucugcuuuuggguuuccuguuacucccccuggcugccuuuggccuuucccuggccgggggaauggucuuggcggcuguuggcgguccacucguggggcuggugcuacugguaauucucgucacugugcugcagaggcggcgacccgcauggcuuccuguucgcuugagaucaugggccuggcugccagugugguuacacagucucgagccgugggauaggcuggucacccgguguugccccuguaaugugugcucuccuccaaaagcuacaaccaaggaagccuacugcuaugagaaccccgaaauacuugcaagccagcaacuguga

SEQ ID NO: 62717 - RNA, 837 nt, Artificial Sequence
  derived and/or modified sequence opt3 from SLC35A1__Homo_sapiens__NP_001161870
auggccgcucccagagacaacgugacccuucucuucaagcuguacugccuggcagucaugacauugauggccgcgguuuauacuaucgcuuuaagguacacgcggaccagcgauaaagagcuguauuuuuccacaacugccguguguauuaccgaaguaauaaagcuacuccugucugugggcauccuugcaaaagagacagggucacugggacgcuucaaggccaguuugcgagaaaauguccucgguagcccuaaagagcugcugaagcucuccgugccaucuuuaguuuacgcugugcagaacaauauggcauuucuggcccuuucgaacuuggacgcugccgucuaucaagugaccuaccagcugaagauuccgugcacugcgcuauguacaguacucaugcugaaucguacccuuucaaaacugcaguggguuagcguguucauguugugcgcaggcgucacgcucgugcaguggaagcccgcccaagcuacuaaaguggucguugaacagaacccucuguuaggguuuggagccaucgcaauugcugugcuguguaguggcuucgccguacucgcguccgugggugggcuuuauaccucugucgugguuaaguacacagauaauaucaugaaaggauuuagcgccgcagcugccauagugcuguccacuaucgcuucagucauguuguucggccuacagauuacccugacauuugcccucggcacccugcuugugugcguaaguaucuaccuguauggguugccaagacaggacacgacuagcauucaacagggagagacagcaucuaaggagaggguuaucgguguguga

SEQ ID NO: 62718 - RNA, 729 nt, Artificial Sequence
  derived and/or modified sequence opt3 from SLC35A2__Homo_sapiens__NP_001027460
auggccgcugugggcgcagggggaagcaccgccgcgcccgguccuggcgcugucuccgccggggcacuggagccaggaacagccucugcugcacacagaaggcucaaguacaucucacuugccguucuggugguacagaacgcuaguuugauuuuaagcauacgguaugcccgcacucugccgggcgaccgauucuuugcgacgaccgcaguggucauggccgaagugcuaaaaggucucacaugccugcuucuguuguucgcucaaaagcgugggaauguuaaacaucucgugcuguuucugcacgaggccguccucgugcaguacguagauacuuuaaagcuggcaguucccucccuuaucuauaccuugcagaacaaucugcaguacguggcuauuucuaaccuaccugccgcgacauuccaaccaucgcccagauguucacagagccauagucucugccugugucuuaggcugcgggccuugcgcuccccugcagcuucuagagccgcuaccacuacagccgcagucuuuccacccuggaggccucaccauggagcccucagcgcuaaaguguccgcgggcgaagugcgggcaggcucaaaugggggaacccagggucgcggcacgggggucgagggaguuggccaucugcaggacccaagucgacacccgcccgguccugggagcucuggauucggcagaugguccuuuuuaccaggccacuga

SEQ ID NO: 62719 - RNA, 936 nt, Artificial Sequence
  derived and/or modified sequence opt3 from SLC35A3__Homo_sapiens__XP_011539439
augagcuccagaucugugcugucacccgucguuggcaccgacgccccugaucagcaccucgagcuuaagaaaccacaagaacugaaggagauggaaagguugccguuagcuaacgaggacaaaacaauguucgcaaaucugaaguacgugagucuagggauccucguauuucagacuacgagccuggugcuuaccaugcgguauucccgcacacugaaagaagagggaccccgauacuugucuucgacugccgucgugguugcggagcuccugaagauuauggcuugcauacugcucguguauaaggauucaaaauguagcuuacgugcccugaacagaguccuucaugacgaaaucuugaauaagccuauggagacccugaaacuagcaauuccaagugguaucuacacacuccagaacaaucugcuuuauguggcccuguccaacuuggaugcugcaaccuaccagguaacuuaucaacucaagauucugacaaccgccuuauucucuguuagcaugcuguccaaaaagcucggcguguaccaguggcuuucacuggucaucuugaugacggggguggcuuuugugcaguggcccagugacagccagcuagauucuaaggaacuguccgccggaucacaauucgucggccucauggcgguucugacugcaugcuuuagcagugguuucgccgggguguacuuugagaaaauacuuaaggagaccaaacagucuguauggaucaggaauauucagcugggauucuuuggcuccaucuucggcuugauggggguguauauuuacgacggagaacucgucagcaagaacggcuuuuuccaggguuauaaucggcugacauggaucgugguuguguuacaaugucuguuuccuuggucgcacccaugcaacaauucuuacuucuucgucuggcuauga

SEQ ID NO: 62720 - RNA, 975 nt, Artificial Sequence
  derived and/or modified sequence opt3 from SLC35A4__Homo_sapiens__NP_542401
augagcguggaggacggcgggaugcccggacuggguagaccuaggcaggcccgguggacccucaugcuucuguuguccacagcuauguacggcgcacacgccccauuacuggcgcuaugccaugucgaugggcgcguuccguuccgacccucuucagcugugcuccugacugaacuuacgaagcuguugcucugugccuuuagucugcugguaggauggcaagcauggccucagggcccacccccuuggcgucaggccgcuccauucgcacucagcgccuuacuguauggugcuaacaauaaccuugugaucuacuugcagagauauauggaccccuccaccuaccaaguccugucuaaucuaaaaauugggucgacagccgugcucuauugccugugucuuaggcaccggcugucaguucgccagggauuggcgcuccuguuacugauggcagccggcgcuugcuacgccgcaggcgggcuccaggugccuggaaacacucuuccaagcccgcccccugcugccgcggccaguccaaugccccugcauauaaccccuuugggucuacugcuccugauccuuuauugucugauuuccggcuugucuagcgucuacacagagcuccugaugaagagacagagguuaccacuggcacuacaaaaucucuuucuguacaccuucggggugcuuuugaaccugggacuccacgcuggcgguggguccggacccggccugcuugaaggcuuuucagggugggccgcucugguaguuuugagucaggcccucaauggacuguuaaugagcgcagugaugaaacaugguucuuccaucacucggcuguucgucgugucaugcagccuaguggucaacgccguucucagugcugugcugcuucgcuugcagcugacagcggcauuuuuccucgccacccuguuaauuggccuggcuaugcgacuuuauuacgggucuagauga

SEQ ID NO: 62721 - RNA, 1020 nt, Artificial Sequence
  derived and/or modified sequence opt3 from SLC35B2__Homo_sapiens__NP_001273442
augcugcucgccaugcccgcucuuugguaccuggcaaccagcuggugcuccacaucuggcgggagaacuacguggaggccugugucauauuugaccuggggagucuuacaggagcggguuaugacacgcaguuacggugccacugcgaccagcccaggcgaacgauucacagacucccaauuucuggugcuaaugaaccguguacucgcucugaucguggccgggcuuucuuguguccugugcaagcagccgagacacggagcacccauguauagguacucguucgccucauugagcaaugugcucaguuccuggugucaguaugaggcucugaaauuuguuucuuucccuacccaggugcuggcaaaggccagcaaagucauuccagugaugcucaugggcaaguuaguaucccggcgcucauacgaacauugggaguaucugacugcuacacuuauaaguaucgguguuagcauguuuuugcugucuuccgggcccgaaccuagaucaagcccagccaccacgcuaaguggacucauucugcuugcgggcuacaucgcauucgauucuuuuacuuccaacuggcaagacgcccuguucgcuuacaaaaugagcucggugcagaugauguuuggcgucaauuucuuuucuugcuuguucaccguggggucccuccuggagcagggagccuuacuggaggguacaagguuuaugggccggcacucagaguucgcagcucaugcccuccuucugaguauuuguagcgcgugcgggcaguuguucaucuuuuauacuauaggacaauucggcgccgcaguguuuaccaucauuaugacacuacgccaggcuuucgccauccugcucuccugucugcuuuacggucacaccgucacgguuguagggggacugggcguggcuguggucuuugccgcauugcuccugcgaguguaugccagaggcagguuaaagcagcgggggaagaaagcuguucccguggaaucuccuguccagaagguguga

SEQ ID NO: 62722 - RNA, 996 nt, Artificial Sequence
  derived and/or modified sequence opt3 from SLC35B4__Homo_sapiens__NP_116215
augagacccgcccuggcugugggccucgucuucgcagggugcuguagcaacguuaucuuucuugagcuguuggccaggaagcacccuggaugcgguaauauugugaccuucgcgcaguuuuuauucauagcuguagaaggcuuucuguucgaggccgaccuagggcggaaaccaccggcaauccccauucgcuacuaugccaucauggugacaauguuuuucacugucuccgugguuaacaauuacgcucucaaccugaauauugcaaugccucuucauaugaucuuucgaucuggaucacugauagccaacaugaucuugggcauuaucauucucaagaaacguuauaguaucuucaaguacacgagcauagcucugguguccgucgguauuuuuaucuguaccuucaugucugccaaacaagugacaucgcagucaagccugagugaaaaugauggguuucaggcguucguaugguggcucuuaggaauuggcgcacugacuuucgcccuuuugauguccgcuagaaugggcaucuuucaggagacccuguauaagagguucgggaagcacucuaaagaagcccuauuuuacaaccaugcacucccacugcccggauucguuuuucuugcuagcgacaucuaugaucacgccgugcuguucaauaaguccgaguuguacgagauuccugucauaggugugacacucccaaucaugugguuuuaccuguuaaugaacauuaucacccaauaugugugcauacggggcgucuucauucugacuacagaaugugcgucacucaccguuacgcuugugguaacucugcgcaaauuugugaguuugaucuucagcauccuauacuuucagaaucccuucacccuguggcauuggcucgggacacuguuugucuucauuggaacucuuauguauaccgagguguggaacaaucugggcacaaccaagucugaaccucagaaagacuccaagaagaacuga

SEQ ID NO: 62723 - RNA, 1056 nt, Artificial Sequence
  derived and/or modified sequence opt3 from SLC35C1__Homo_sapiens__NP_001138738
auggcccugaccggcgcuagcgaccccuccgcagaggccgaagcgaacggggagaagccuuuccugcuuagagcucugcagaucgccuugguggucucuuuauacuggguuacaucaauuaguaugguguuucugaauaaauaucuacucgauagcccaucccugaggcuugacacuccgauauucguaacguuuuaccaaugccuggugaccacauugcucuguaagggacugucugcacuggccgcuugcugucccggugcagucgauuucccuucgcuccgguuagaccugcgcguggcccgaucaguucuuccauugagcguggucuuuaucggcaugauuacuuucaacaaucugugccuaaaauauguggggguagcuuuuuacaacguuggacguagucucaccacaguguucaauguccugcuuuccuaucuguugcucaagcagaccacuucuuuuuacgcccuguuaacauguggcaucauuaucgguggguucuggcugggaguggaucaggaaggcgcggagggcacccucagcuggcuugggacgguguuuggaguccuggcauccuugugcguuucacuaaacgccauauauacuaccaaagugcugcccgcuguagacgguaguaucuggagacucacauucuacaauaacgugaaugccuguauucuguuucuuccucuguugcuccuguuaggcgaacugcaggcacuaagggauuucgcucaacucgggagcgcccacuucuggggaaugaugacucugggcggucuuuuuggguucgcgaucggauacgucaccggcuugcagauuaaguuuacaucuccacugacccauaacguguccggcacggccaaggcaugcgcucagacuguucucgccgugcuguauuacgaggagacaaaaucauuccuuugguggaccagcaauaugaugguccucgggggaaguucugcuuauacuugggugcgggguugggaaaugaagaaaacacccgaggaaccuuccccaaaggacagcgagaaaucggccaugggcguauga

SEQ ID NO: 62724 - RNA, 1251 nt, Artificial Sequence
  derived and/or modified sequence opt3 from SLC35D3__Homo_sapiens__NP_001008783
augagacagcugugcaggggccgggugcucgggaucagcgucgccauugcucacggaguuuucuccgguucucuuaacauacuguugaaguuuuuaaucucacgcuaccaauucaguuuucugacccuagugcagugucucacaagcuccacugcagcccugucucuugagcuguugcgacgucucggccugauugcgguacccccuuucgggcugucgcucgcuagaucauuugccggaguggcagucuuaagcacgcugcagaguucccuuaccuuguggucucugaggggccuaagccucccaauguaugugguuuucaaacggugccugccgcuugugacaaugcugaucggugucuuggugcucaagaauggggcccccuccccuggaguacuggcugcaguuuuaauuacuaccuguggcgccgcucuggccggcgcgggggaccucacaggagauccaaucgguuacgugaccggcguccuugcagugcuggugcaugccgcuuauuugguccuaauacagaaagccucagcagacacugaacacgggccccugacagcucaauacguuaucgccgugagugcgaccccucuccugguaauuugcagcuuugccucuacggauuccauccaugcauggacuuucccaggauggaaggaccccgcuaugguguguauuuuugucgccugcauccuuauaggcugugcuaugaacuucaccacacugcacugcacuuauauuaauucagccgugaccaccagcuuuguugguguggucaaaaguaucgcaacaauuacgguggggaugguagccuucucugauguugagccuacuuccuuguuuaucgcuggaguggucgugaacacacucggcagcaucauuuacugugucgcgaaguucauggaaacccgcaagcagucgaauuaugaggaccuggaagcacagccaagaggcgaggaggcccaguuaucuggggaucaacugccguucgugauggaggaacuacccggagaagguggcaacgggagguccgagggaggcgaggcugccggugggccugcacaggaaucacggcaggagguucgcggcaguccacgaggagugccccucguagccggcagcuccgaagaggggucuagaaggagccugaaagacgcuuaccuugaagucuggcgguuggugcguggaacucgcuacaugaagaaagauuaucugauagagaaugaggaacucccuucaccauga

SEQ ID NO: 62725 - RNA, 1227 nt, Artificial Sequence
  derived and/or modified sequence opt3 from SLC35F1__Homo_sapiens__NP_001025029
augauucccccugagcagccacaacagcagcugcagccgcccagcccugccccacccaaccacguggucaccacaaucgaaaaucucccugcugagggcuccgggggagguggcucucuuucagcaaguagcagagccgggguuaggcaacggauacgcaaggugcugaaccgagaaauguugaucuccguagcguuaggacaggugcugucucuacucauuugcggcaucggucugacuucgaaauaccuuucagaggacuuccaugcuaauacgccagucuuucagagcuuccugaacuauauuuugcucuuucugguguacaccacaacucuggccguucgucagggggaagagaaucucuuagcaauccugagaaggcggugguggaaguauaugauacuuggauugaucgaucuggaggccaacuaccuaguggucaaggcuuaucaauacaccacacucaccaguauucagcugcuugacuguuucgugauccccguaguuauucuguuguccugguuuuuccuccugauccgcuauaaagcagugcacuuuauaggcauugucgugugcaucuuaggcaugggguguauggugggagccgauguccugguugguagacaucagggcgcuggggaaaauaaacucgugggagaccuucugguauugggcggugccacucuauacgggauuucuaacgugugggaggaauacaucaucaggacacugagccgggucgaguuccucggaaugauuggccuguuuggcgcguucuuuuccgggauacagcuugcaaucauggagcacaaggaacuguugaaggugccuugggauuggcaaauuggacuccuguauguugguuucucagccugcauguuuggcuuauacaguuucaugccaguggucaucaaaaagaccagcgcuacgucugugaaucugucccuacucacugccgaccuguauucacuuuucuguggguuguuucuguuccauuacaaauuuagcggacucuaucugcuuaguuucuuuaccauacugauuggcuugguacucuacucuuccacaagcacuuauaucgcacaggauccgcgcguuuacaagcaguuccgaaaccccucggguccuguggucgaccugccaaccacagcucaaguggagcccucugucaccuacacguccuuagggcaggaaacugaggaggaaccucacgugagaguugccuga

SEQ ID NO: 62726 - RNA, 1125 nt, Artificial Sequence
  derived and/or modified sequence opt3 from SLC35F2__Homo_sapiens__NP_059985
auggaggccgacagccccgcuggcccuggggcaccagaaccgcuggccgagggagcggcugccgaguucuccucucuccuuagaaggaucaaggguaaacuguuuaccuggaacauuuugaagacaauagcauuaggccagaugcugucacuaugcaucugugggacugccauuacgagucaauaccucgcugaacgguauaaagugaauacccccaugcugcagagcuucaucaacuacugccuucuguuuuugauuuauacagucaugcucgcauuccgcuccggaucugauaaucugcugguuauccucaagcgaaaaugguggaaguacauauuacugggccuugccgacguggaagcuaacuauguaaucgugcgugccuaccaguauacuaccuugacaucgguccagcugcuagauuguuuugguauuccugugcucauggcgcugucaugguucauccuucacgcaagauacaggguuauucauuuuaucgccguggcugucugccuguugggggugggaaccaugguaggcgccgacauacucgcaggccgggaggauaauagcgggagugacguucugauuggagauaucuuagugcugcucggugcuucccuuuacgccauuucuaacgucugugaggaauauaucgugaagaaacugagccgccaagaguucuugggcaugguggggcuauuuggaacuaucauuuccggcauacagcugcucaucgucgaauacaaggacauugcgucaauccacugggauuggaaaauagcccugcuuuucguugcauuugcucugugcauguucuguuuguauaguuuuaugccacucgugauuaagguaacaagcgccaccucugugaaucuggguaucuuaacggcugaccuguacucccuauucgucgggcuuuuccuguuuggauauaaauucucaggccuuuacaucuugagcuuuacugugauuaugguuggcuucauccuguauugcaguacccccacaagaacugccgagccugcagagucuuccgugccacccgucaccagcauugggauagauaaccucggacugaagcucgaagagaaucugcaggaaacacauucggccguguuguga

SEQ ID NO: 62727 - RNA, 1266 nt, Artificial Sequence
  derived and/or modified sequence opt3 from SLC35F3__Homo_sapiens__NP_001287774
augaagaaacacagcgccagaguggcuccccuguccgcaugcaacucuccuguccucacccuuacaaagguugagggcgaagagaggccacgggacucaccggggcccgccgaagcgcaggcuccugccggaguggaggcagggggccgcgccagucgacguuguuggacuugcagcagagcucaacugaaaaagaucuucugggguguagcaguggucuugugugugugcuccucuugggccggaucgacgcaguuagcuaaacugaccuuuaggaaguucgaugccccauuuacacuaacuugguucgcgaccaauuggaacuuucucuucuuuccccuguacuauguuggccauguguguaagucaacagaaaaacagagcgucaagcagcgguaccgcgagugcuguagauucuuuggugacaaugggcuuacccugaaaguguucuuuacuaaggcagccccuuucggaguauuguggacacucaccaacuaucuguaccugcacgcuauuaaaaagauaaauacgacugauguuagugugcucuuuugcuguaacaaggccuucgucuucuuacuguccuggaucgugcuuagggaccgguuuaugggcgugcgcauugucgcagcuaucuuggccauugcgggcaucguuaugaugaccuaugccgauggguuccauucucacagcgugauaggaaucgcacugguaguggcuuccgccucaaugagugcucuauacaaaguccucuuuaagcugcuucuggguagcgccaaauucggcgaggcagccuuguuucucucuauucuggggguguucaauaucuuauuuauuacaugcaucccaauaauucuguauuucacuaagguugaauacugguccucauuugacgauauccccuggggaaaccucuguggcuucagcgugcuucuguugaccuuuaauauuguccuaaacuucgguaucgcugugacauacccuacccugaugagucucgggaucguacugucuauuccaguuaaugcggugauagaccauuauacgucccaaaucgucuuuaacggagugcgagucauugcaaucauaauuaucggccuuggcuuccuguugcuccuguuaccggaggaaugggauguguggcugaucaaacuacucacuagacugaagguuaggaaaaaggaggagcccgccgaaggggcugccgaccuuagcucgggaccucagucuaagaaucggcgugcacgcccauccuucgccagauga

SEQ ID NO: 62728 - RNA, 1599 nt, Artificial Sequence
  derived and/or modified sequence opt3 from SLC35F4__Homo_sapiens__XP_011535022
augcuggugcaccucagagacagccuuuacccccagcugggcaucaaccaauuguccuauaccaggaaguuagccacacgguguucuucagucguuacugcuaguuacacggugcugaaaccugagaagcgcaaaauucuacuccaguauaaguuccagaaagaaaccuuucagcugccauucaagacaacuuuuuggauaaauaacuuccaaaucguaauuuuuccgcuugggagccugugcuccaccucucgaucgucagugacacguugcaagcccggagcaaauuguccuagcagucauuccgguaucucuagacaguugagcccacucuccgucaccgaggauucaagugcccccauucuggaacugcagaaccagggcagcucuggggugugcggacacaggguugagcggcaaaaucgcuccgcggacgauggcacucagacacauucagaaaacagcagucaggagaauagaaucaaagcuaggugucucucuugcaccuccaugguguuaaaggguauaugggggcugcuuaucauuuugagcgucucgucuuccugggugggaacgacucagaucguaaaaauuaccuacaagaacuucuauuguccauuuuucaugacaugguuuucaacuaauuggaacaucauguucuuuccuguuuacuauaguggccaccuggccaccgcacaagagaaacagagccccaugaagaaguuccgggaaugcucccgcauauuuggcgaggacgggcuaacacucaaacuguuccuuaagcgaaccgccccuuucucuauucuguggacguugacuaauuaccucuaccuguuagcucugaaaaagcucacagcaaccgaugugagcgcccuguuuuguugcaacaaggcuuucgucuuucuuuugucauggaucgugcuaaaagacagauucaugggagugaggauugucgccgcgaucauggcaaucacugguauuguuaugauggccuaugcugauaauuuucaugccgacaguauaaucggcguggcauucgcuguaggguccgccagcacaucugcgcuguacaaagugcucuuuaagauguuccugggaucagccaacuuuggcgaagcagcucacuucgucaguacccuuggguuuuucaaucugauuuuuaucagcuucacgccagugauauuguauuucaccaagguugagcacugguccucuuuugccgcucucccgugggguugucugugcggaauggccggcuuauggcuggcauucaacauucuagugaacgucggcgugguacucacauaccccauccugaucucgauugggacuguucuuagcgugccuggaaaugccgcugucgauuugcugaaacaggaggugaucuuuaacgucgugcggcucgcggcaaccauuauaaucugcauugguuuccugcuuaugcuguugccagaagagugggacgaaaucacacuccguuuuaucaauucccugaaggagaaaaagucagaggaacauguugaugacgugacugaucccaguauucacuuacgcggcagagggagggccaacggaaccguaucuauaccucuggcuuga

SEQ ID NO: 62729 - RNA, 1116 nt, Artificial Sequence
  derived and/or modified sequence opt3 from SLC35F6__Homo_sapiens__NP_060347
auggccuggaccaaguaccagcuguuccucgcuggccuuaugcuggugacagggagcaucaacacuuuguccgcaaaaugggccgacaauuuuauggcggagggaugcgguggcucuaaggaacacucauuccaacaucccuuuuuacaggcugucgggauguuccugggagaguuuaguugucuagccgcauucuaucuccugagaugcagggccgcuggccagagcgauuccucuguugacccucagcaaccauuuaacccgcuucuguucuugcccccugcacucugugauaugacggguaccucgcugauguacguggcccugaauaugacaucagcuagcaguuuucagaugcuccgcggggccguaauuauauucacuggauuauuuuccguggcguuccugggccggcgacuugucuugucucaguggcugggcauccuagcaaccauugccgggcucgugguugugggacuggcugaccuucugagcaaacacgauucccagcauaaguugucagaagucaucacaggugaccuccugauuaucauggcccaaauaaucguggcaauucagaugguauuagaggaaaaauuuguuuauaagcacaacgugcauccacugcgugcugucggcaccgaggggcuuuucggauucgugauccuuagucuguugcuagugcccauguacuauauuccugccggcagcuuuucugguaauccaagagggacucuggaggaugcgcucgacgccuucugccaggucggacagcaaccccugaucgcaguugcucuccugggcaacauauccucaauugccuuuuucaauuuugcuggcaucagcgugacaaaggaauugagugccaccacgaggaugguacucgauucucugcggacuguggucauuugggcauuaucccuggcccuagggugggaggcuuuccacgcgcuccagauccugggauuucuuaucuugcugauugguaccgcacucuacaacggccugcaccgcccucuucuggggagauugagcaggggacggccacucgccgaagagucggagcaggaacgccuguuaggcgguacacgaacuccgauaaaugacgcuucuuga

SEQ ID NO: 62730 - RNA, 1098 nt, Artificial Sequence
  derived and/or modified sequence opt3 from SLC35G1__Homo_sapiens__NP_001128130
augagaccccaggacagcaccggcguggccgagcugcaagaaccugggcucccacuuacagaugacgcuccgcccggagcaacugaggaaccugccgcggcugaggccgcaggggccccagauaggggccggugcuggcuguguuuguccucucccugcuguucacgcacggaaccugaggcuaagaaaaaggcaccaugccccggguuaggacuguucuacacccuacucagugccuuucuguucagcgucggcucccuuuuuguuaaaaaggugcaggacguacacgcuguggagaucucugccuuccgaugugucuuucagaugcuggugguuauuccuugcuugauauaucguaaaacagguuucaucgggccaaagggacagagaauuuuucucauccugaggggcgugcugggcucgacugcgaugaugcucauuuacuaugcauaccaaaccaugucauuagccgaugcuacagucaucaccuucagcaguccgguguuuacuuccauauucgccuggaucugucugaaggaaaaauauucucccugggacgcacuuuuuacaguauucaccauuacggggguuaucuugauugugcggccuccauuucuguucggaagcgauacuuccgguauggaggaaucauacaguggccaucuaaaggggaccuucgcugccaucggaagcgcggucuuugccgcaucuacacucgugauacugcgcaaaaugggcaaguccguggacuauuuccuuucaauuugguacuacgucguucuggguuugguggagagcguaaucauucucagugugcugggggaguggucuuuacccuauugcggacuggauagacucuuucuuaucuucaucggccuguuuggcuuggguggacagauuuucauaacuaaagcucuacagaucgaaaaggccgguccugucgcuauuaugaagaccauggacgugguuuuugccuucaucuuucagauaauuuucuuuaacaaugugccaacaugguggaccgucggcggggcacugugugugguagccuccaacguuggagcugcgaucaggaaaugguaccaaagcucgaaguga

SEQ ID NO: 62731 - RNA, 1239 nt, Artificial Sequence
  derived and/or modified sequence opt3 from SLC35G2__Homo_sapiens__NP_001091069
auggacaccagccccuccagaaaguacccugugaaaaagagggucaaaauccacccaaacacaguuauggugaaguauacuucucauuacccgcagcccggcgaugacggguaugaggaaauuaaugagggauacgguaacuucauggaagagaauccuaaaaagggccugcucucagaaaugaagaaaaaggggcgggccuuuuucggaacgauggauacccuuccacccccuacagaggacccaaugauaaacgagaucggccaauuucagaguuucgcugagaaaaauauuuuucagagccgcaagauguggaucguacuguucgguuccgcauuggcccacgggugcguggcguuaauuacucgacuggucucugaucguucgaaagugcccucacuagaacucaucuuuauaagaagcguuuuccaggugcugaguguccuugugguauguuauuaccaagaagcuccuuuuggaccauccggcuauaggcugcgguuguucuuuuacggcguuugcaacgugaucucuauuaccugugccuacaccagcuucuccaucgucccgcccucaaaugggacaacuauguggcgcgcaacaaccacgguguuuagugccauucucgcuuuccugcugguggacgagaagauggcauaugucgauauggccacuguugugugcagcauccucggaguauguuuagugaugauaccuaacauugucgacgaggauaauucucugcuuaacgcuuggaaggaagccuucgguuacaccaugacagugauggcgggcuugacuaccgcacuguccaugaucguuuauagaucaauuaaagagaagaucagcauguggacagcccuauuuaccuucggguggacgggaacuaucuggggcauuaguacaauguuuauacuccaggaaccaaucauuccccuggacggugagaccuggucuuaccuuaucgcuauaugcguguguuccacugccgcauuccugggggucuauuacgcuuuggauaaauuucauccugcccucgugagcacaguacagcaccuggaaauuguuguggcgauggucuuacagcugcucgugcuucauaucuucccaucgaucuaugacgucuuuggaggcgugauuaucaugauuucuguuuucgugcuggccggcuacaaguuguacuggaggaaucuacggaaacaagauuaucaggagauacuggacucccccaucaaguga

SEQ ID NO: 62732 - RNA, 1017 nt, Artificial Sequence
  derived and/or modified sequence opt3 from SLC35G5__Homo_sapiens__NP_473369
auggccggcagccaccccuacuucaaccugccugacuccacccauccaucuccgcccucagcuccuccaagucucagauggcaccagaggugccaacccagcggggcaacaaauggacuucugguggccuuguuagguggcgggcugccugcgggauucgucggcccacuaucccggauggcuuaucaggguucuaaccuccccucgcuggagcuucugaucugucgcugcuuguuccaucucccuauugcccugcugcucaaguuacgaggggauccacugcuuggaccgcccgacauacguggcugggcauguuuuugcgccuugcugaauguucuaucaaucggcugugcuuacagcgcagugcagguagugccugccgggaacgcugccacugucagaaaaggaaguuccacggugugcucugcgguucucacccugugucuugaaagccagggucugggcggguaugaguggugcggauugcucggcuccauucuggguuuaaucauuauccuggggccaggacucuggacacuucaagaaggcacuaccggcguguacacaacccugggguauguccaggcauucuugggaggucuagcccugucacucggccugcuuguguacaggagucugcacuuucccagcuguuugccuacuguagcuuuccucucugggcugguuggauuacugggcugcgugccaggucuauuuguccuccagacacccgugcugccguccgaucuuuugucauggagcugugugggggccgagggcauacuggcacucgucaguuuuaccugcguuggauaugcugugacgaaggcccauccugcgcugguaugcgccgugcuucacucugaagucgugguugcacugaucuugcaguacuacaugcuccacgagacuguggcucuguccgacauuaugggcgccggggucguguuaggaagcaucgcuauuaucaccgcccggaaucugucgugugagcgcacagguaaaguagaagaguga

SEQ ID NO: 62733 - RNA, 1017 nt, Artificial Sequence
  derived and/or modified sequence opt3 from SLC35G6__Homo_sapiens__NP_001096084
auggccggcagccaccccuaccugaacccuccagacuccacccauccgucucccccuucagcuccacccagucucagauggcaccagugcugucaaccuagcgaugcaacaaaugggcuucugguggccuuguuaggagguggccugccagcgggguucgucggaccccuaucccauauggcuuaucaggccucuaaccucccuucgcuggagcuucugaucuguaggugcuuguuucaccucccaauugcacugcugcucaaguuacggggcgacccgcugcuuggucccccugauauacgcgggcgagccuacuucuaugcuuugcugaauguucuaucaaucggaugcgcauacagcgccgugcagguagugccagcuggcaacgccgcgacuguccguaaaggcaguuccacgguguguucugcaguucucacccugugccuugaaagccaggggcuguccggauaugacuggugugguuugcucggcucaauucugggguuaaucauuaucgugggacccggccuguggacacuccaagaggguauaacuggggucuacaccgcccuuggauauggccaggcuuuugugggcgggcuggccuugagucuaggacugcucguauacagaagccugcauuucccuucuugccuuccaacaguugcauuucuguccgguuuggugggccuccuggggucaguccccggauuauucgugcugcagccgccugugcuacccagcgaucucccaaguuggucuugugucggcgcuguugguauccuggcccuuguguccuuuaccugcguaagcuacgcggugacuaaggcccacccugcauuggucugugcugugcugcacucggaaguuguggucgcccucauucugcaguauuacaugcuucaugagacaguggcucccucugacaucguaggggccggcguugugcugggauccauugcaaucauaaccgccuggaauuugucaugcgaaagggagggcaaagucgaggaauga

SEQ ID NO: 62734 - RNA, 1431 nt, Artificial Sequence
  derived and/or modified sequence opt3 from SLC36A1__Homo_sapiens__NP_510968
augagcacccagagacugaggaacgaggacuaccacgauuauuccucuacagacgugucacccgaagagaguccuagcgaaggccucaauaaccuuuccucuccagggucguaccaacgguucggacagucaaauagcacuacgugguuucagacccugauccauuuguuaaaggguaacauuggcacagggcugcuaggacucccgcuggccgucaaaaaugcuggcauaguuaugggucccaucagucuucugauuaucgggauuguggcaguacacugcaugggaaucuuggugaagugugcccaucacuucugccgccgacucaacaaauccuuugucgauuauggcgacacugugauguacggccuggagucuagcccuuguuccuggcugcguaaucaugcgcacugggggagaaggguuguggauuucuuucucauagucacccaguuaggauucugcuguguguauuuuguauuccuggcugacaacuuuaagcaaguuaucgaagccgcaaaugguacaaccaacaauugccacaacaaugagacugugauucuuacaccaaccauggauucacgguuguacaugcugaguuuccuacccuuucucguccugcuuguguucauccgcaaccugagagccuugagcaucuuuucucuccuggcuaauauuacgauguuagugucccuggucaugauauaucaguucauuguucagaggaucccugacccaucacaucucccccuuguggcaccuuggaaaacuuacccacuguucuuuggcaccgccauuuucagcuuugaggggaucggaaugguauugccgcuagaaaacaagaugaaggauccccggaaauucccucugauccucuaccugggcauggugauugucacaauacuuuauaucagucuggguuguuugggguaccuccaguuuggagcuaacauucaaggcucuaucacucugaauuuaccaaacugcuggcuguaucaguccgugaagcuacucuacagcauaggcauuuucuuuaccuaugcccugcaguucuacguucccgcggagaucaucauuccauuuuucgugucgcgcgcaccugaacacugugagcuugucguggacuuguuuguacgaacaguucuggugugccucaccuguauccuggccauucuuauacccagacuggauuuggucaucucucucgugggguccgucucaaguagcgcucuggccuuaauuaucccgccucugcuagaggugacgacuuucuauuccgaaggaaugucuccccucacaaucuuuaaagacgcacugauuagcauacuugguuucguuggcuucgugguagggaccuacgaggcuuuguacgaacugauccagccaucaaaugccccuauuuuuaucaacaguacuugcgcguucauuuga

SEQ ID NO: 62735 - RNA, 1452 nt, Artificial Sequence
  derived and/or modified sequence opt3 from SLC36A2__Homo_sapiens__NP_861441
augagcgugaccaaguccacagagggcccccagggggccgucgcuaucaaacuggaccucaugucuccuccagaaucagcaaagaaacuugagaacaaggauaguacuuuccuggacgaaagcccguccgagucugccggauugaaaaagacgaaggguauuaccguuuuucaagcguuaauacaccuggugaaaggcaauauggggacaggaauccuaggccucccccuggcuguaaagaacgccgguauucuuauggggccucugucguugcucgugaugggauucaucgcaugccauuguaugcacauucuggucaaaugcgcccagagauuuuguaagaggcugaauaaaccauucauggauuacggcgacacugugaugcauggccucgaagcuaaccccaaugcaugguuacagaaccacgcccauugggggcggcacaucguuucauuuuuccugauaaucacccagcuuggauuuugcuguguguauauugucuucuuggcugauaaucugaagcaagugguagaggccguuaacagcacaaccaauaacugcuacaguaaugagacugugauccuaacaccuaccauggacucccgccucuauaugcugucuuuucuuccauuccuggucuugcucgugcugauucgaaacuuacguauccugacgauauuuagcaugcucgcgaauauuuccaugcuugugucacuggucaucauuauccaguacaucacucaggaaauucccgauccuaguagauugccgcuaguugcaagcuggaagaccuauccacuguucuuugguacagccauauucucuuucgaguccaucggcgugguacucccccuggaaaacaaaaugaagaaugcuaggcacuuuccugccauucuuucacuggggaugagcaucgugacuucauuguacauaggaauggcagcucucggcuaucugcgguucggugacgauauuaaagccucuaucuccuuaaaccugccaaacuguuggcuauaccagagcgucaagcuccuguacaucgcggggauucuuugcaccuaugccuugcaauuuuacgugcccgcagagaucauuauaccuuucgcuaucucgcgcguuucuacaagaugggcccugccacucgaccuguccauuaggcuugugauggucugucugaccugcuugcucgcuauccugaucccccgguuagaucuggugauuagucuaguaggaaguguuagcggcacggcccucgcacugauaaucccgccucuuuuggaggugacuacauuuuauuccgaaggcaugucuccccugaccauuuucaaagacgcccucaucagcauucugggguuugucggauucguggucgguacuuaccaggcuuuagaugagcugcuuaagucagaagacagucauccauuuuccaauagcacaaccuucgugcgcuga

SEQ ID NO: 62736 - RNA, 1602 nt, Artificial Sequence
  derived and/or modified sequence opt3 from SLC37A1__Homo_sapiens__NP_061837
auggccagacugcccgcuggcaucagguucauuauaucuuuuucccgggaccagugguaccgcgcauucaucuuuauucucaccuuccuucuguaugccucuuuucacuugucacgaaagccuaucaguauugugaaaggggaguuacauaaguacugcacagcgugggaugaagcugacguccguuucagcucccaaaacagaaaaucuggaucggccgcaccacaccagcugccggauaaugagacugacugugguugggcccccuuugauaagaacaauuaucagcagcuacucggcgcucuggacuacucauuccuuugcgcauaugccguugggauguaccugagcggaaucauaggcgaaagguugccuauccgguauuaccucacguuugguaugcuggcuaguggggccuucaccgcgcuguuuggacucggcuacuucuauaacauucauuccuuuggcuucuacgugguaacacaagugaucaauggguuaguccagacuaccggauggccaucugugguuacaugucuggguaacugguucggcaaagggcgcagaggacuuauuaugggcguguggaauagccacaccuccgucgguaacaucuuggggucacugauagcaggauauugggugaguacuugcuggggccugagcuuuguaguucccggcgccauuguggcugccauggggaucgucuguuuccucuuucugauugagcauccuaaugaugugaggugcagcuccacacuugugacccacucaaagggauacgaaaacgguacgaaucggcugcgcuugcagaagcagauccucaaaagcgagaagaacaaaccacuggaccccgagaugcaauguuuacugcucagugauggcaaggggucuauccacccuaaucaugucguuauucuuccaggagacggcgguuccgggacugcagcuaucagcuucaccggcgcccugaaaauaccgggagugauugaauuuucguugugccuacuguucgcgaagcucguaucuuauacauuucuguucuggcuuccccuguacaucacuaacguggaucacuuggacgccaagaaagcaggcgagcucuccacccuguuugaugucgggggaauauucgguggcauuuuagcuggggugaucucagaccgacuggaaaagagagccaguacauguggacuaaugcuccugcuugcugccccuaccuuguauaucuuuagcacgguuuccaaaaugggccuggaggcaacuauugccaugcuccugcuuucuggugcucuggugagcgggccauacacauugaucaccacugcggucucagcagaccucggcacacauaagagucugaaaggaaaugcccacgcuuuauccaccgugacggccauuauagauggcaccgggagcguaggagcagcccuggguccccuacucgcuggccugcuuucuccuucaggguggaguaacguuuucuacauguugauguuugccgacgcaugcgcgcuacucuuccugaucagguuaauucacaaggagcugagcuguccaggauccgcuacaggcgaucaggugcccuucaaagaacaguga

SEQ ID NO: 62737 - RNA, 1506 nt, Artificial Sequence
  derived and/or modified sequence opt3 from SLC37A2__Homo_sapiens__NP_001138762
augagaagcucccuggcccccggcgugugguucuuuagggcuuucucucgggacucaugguuucgcgggcucauccuucuguugaccuucuuaauuuacgcaugcuaucacaugagucgaaagccuauaagcaucgucaaaucccgucugcaucagaacuguucugagcaaauuaagccaaucaaugauacacacucgcuaaacgacacuauguggugcucaugggccccguuugauaaagacaauuacaaggaacuccugggagguguugauaacgcguuccuuauugcuuaugccaucggcauguuuauaagcgggguguucggagagagacugcccuugagguacuaucucagugcaggcaugcugcuguccggucucuuuacgucuuuauucgggcugggauacuuuuggaauauccaugaacuuugguauuucguagugauucaggucuguaacggcuuggugcagaccacaggcuggccuagcguugugacuugcgucgggaauugguuuggaaaagguaagcggggcuucaucauggggauuuggaacucccacaccucagugggaaauauccugggcagucuaauagccgguauuuggguaaacgggcaguggggacucagcuucaucguuccaggcauuaucacagcugugaugggcgucaucaccuuucuguuccuuauugagcaucccgaagacguggauugugcaccuccacaacaccacggggagcccgccgagaaucaggacaacccugaagauccaggaaauucuccgugcuccauacgcgagucaggucuggaaacuguggcuaaguguagcaaaggccccugcgaggagccugccgcgaucaguuucuuuggggcauugaggauuccaggagucguugaauuuucucucugucuguuauucgccaagcugguguccuacacauuucucuacuggcuuccccuguauaucgcuaacguagcccauuucagcgcaaaagaggcuggcgacuugucgacccuauuugaugugggugggauaauuggcggaaucgucgccggccuggugucugacuacacgaaugggagagcgacuaccugcuguguuaugcucauccuggccgcaccuaugauguuccuuuauaacuacauuggacaggaugguaucgcuuccucaauugugaugcugauaaucugcggcggguuggucaacggaccauaugcccucauuacaacugcugugagugccgaccugggcacccacaagagcuuaaaagguaaugcaaaggcccuguccacaguaaccgcuaucaucgacgggacgggcucuauuggagcggcacuaggcccccuccuggccgggcuuauaagcccgacuggauggaacaauguguuuuacauguugaucucagcugauguucuggccugccuccugcuuugucggcuggucuauaaggaaauuuuggcauggaaagugagucucucccgcgguagcggcuacaaggagaucuga

SEQ ID NO: 62738 - RNA, 1290 nt, Artificial Sequence
  derived and/or modified sequence opt3 from SLC37A4__Homo_sapiens__NP_001157749
auggccgcucagggcuacggguauuacagaaccgugaucuucagcgcaauguuuggagguuauucccuguacuauuucaacaggaagacauuuucuuucgucaugcccucacucguugaggaaauuccucuugacaaagaugaccugggcuuuauaacuagcagccaauccgccgcguacgcuaucucuaaguucgugucggggguauugucagaucagaugagcgcccggugguuauuuaguuccggacugcuacucgugggccuggucaauauuuucuuugcauggucuagcacggugccaguuuucgccgcucuuugguuucugaacgguuuggcacaggggcucggauggccgcccugcggcaaagugcugcgcaagugguucgagccuucccaguuuggcaccuggugggccauccugucaacaaguaugaaucucgcugggggauuagguccaauucuggccacuauccuugcgcaaagcuauucuuggcgauccaccuuggcacugucaggcgcccuaugugucgugguaaguuuccucugccugcuucugauacacaacgaacccgcugacguuggguugcguaaucucgauccuaugccaagugagggcaaaaagggaucucugaaggaagaguccacauuacaggagcugcuccuuagccccuaccuguggguguugucgaccgguuaccuagucguguucggggugaaaacuuguugcacagacuggggacaguuuuuccugauccaggaaaagggccaaucugcccucgucggcuccucauauaugagugcacuggagguugggggacuuguggguagcauugcugccggcuaccuguccgauagagcgauggccaaagcaggguugucuaacuauggaaauccuaggcauggccuccuguuauuuaugauggcugguaugaccguaagcauguaccuguuccgggugacggucacuucagacaguccaaagcuauggauccucgugcugggggccguuuuuggcuucuccagcuauggaccgauugcucuuuuuggcgugaucgccaacgaaucugcacccccuaauuugugugggaccucacacgccauagucggacugauggcuaacguggguggcuuccucgcggggcugccauuuaguacaauugcaaaacauuacagcugguccacugccuucuggguagcugagguuaucugcgccgcaucuaccgccgccuuuuuccuucugcgcaauauuagaacaaagaugggaagggugucgaagaaagcugaguga

SEQ ID NO: 62739 - RNA, 1464 nt, Artificial Sequence
  derived and/or modified sequence opt3 from SLC38A1__Homo_sapiens__NP_001265316
augaugcacuucaagagcggccuggagcucaccgaacuucagaacaugacagugcccgaggacgauaauaucuccaacgacucuaaugauuuuacugaagucgagaacgggcaaauuaauucaaaauucauaagugacagagaaagcaggcggucccugacgaacucucauuuggagaagaaaaagugcgaugaguacaucccuggaaccacaucguuagguaugucaguuuuuaaucugagcaacgccauuaugggcagugggauccuaggacucgcuuucgcacuggccaauacuggcauucuucuguuuuuggugcuccugaccuccguaacacugcucucuaucuauagcauaaacuuacugcuuaucuguuccaaagaaaccgguugcaugguguacgagaaguugggggaacaggucuucggaacuacaggcaaguuugugauuuucggcgcgaccucacugcagaauacgggggcuaugcuaaguuaucucuuuaucguuaaaaacgagcugccaagcgccauuaaguuccuuaugggaaaagaggaaacuuuuucugcaugguacguggacggucgcguccuggugguaaucguuaccuucggcauaauuuugccgcucugucuguuaaagaaucugggguaucucggauacacauccggcuuuucacuuagcugcaugguguucuuccugaucgucgugauuuauaaaaaguuucagauccccuguaucgugccugaguugaacaguacuauuucugccaauuccaccaacgcugauacaugcaccccaaaguacgucacguucaacagcaaaacuguuuacgcacuacccacaauagccuuugcuuucgugugucacccuucgguacugccaaucuauucugaacucaaggaccgaucccagaaaaagaugcaaauggugucaaauauuagcuuuuucgccauguuugucauguacuuccugaccgcgaucuuugguuaucuuacuuucuacgauaacgugcagagugaccuguugcauaaauaucaguccaaggaugacauacucauucugacaguucguuuagcagugaucgucgccgugauccugaccguacccguucuauuuuucacggugagaucuagccucuuugagcuggcuaaaaagaccaaguucaaucuuugcaggcacacagucgugacuuguauuuugcuggucgugaucaaccuccugguuauuuucauaccuucaaugaaagauaucuuuggggugguaggagucaccagugccaauaugcuuauuuucauccugccauccagcuuguaccucaagaucacagaccaagacggcgauaaaggcacucagcggauuugggcagcucuguuuuuagggcugggagugcuauucucucucguuucaauaccgcuggugaucuaugacugggccugcaguagcuccucugaugaaggucauuga

SEQ ID NO: 62740 - RNA, 1521 nt, Artificial Sequence
  derived and/or modified sequence opt3 from SLC38A2__Homo_sapiens__NP_061849
augaagaaagccgagaugggcagauucagcaucucccccgacgaagauucuucaaguuacagcuccaacucugacuuuaauuauucguacccuaccaagcaggcugcacugaaaucacacuaugccgauguggacccagagaaccaaaauuuccuccuugaaagcaaccuggggaagaaaaaguacgagacagaauuucauccgggaacuacgaguuucgguauguccgucuuuaauuugucuaacgcgauuguuggcagcgggauauuaggacuguccuaugcuauggccaauaccggcaucgcacuauucauuauccuccugacauuugugucaauuuucagucuuuacagcguacaccuguugcucaagacugccaacgagggugggucucugcuguaugagcagcucggauacaaggcuuuuggcuuagugggcaagcuggcagccuccgggucaaucaccaugcagaauauaggagcuaugagcaguuaccuuuucaucgucaaauaugaauugccccuggugauucaggcccuaacaaacaucgaggauaagaccggucucugguaccugaauggcaacuaucuuguucuguuggugucucucgucgugauucugccuuuaucccuguuuaggaaucucggguaccuuggauauacuagcggccugucguugcuaugcaugguauucuuucugaucguugugauauguaaaaaguuccaagucccaugccccguggaagcggcacucauuaucaacgagacaauuaauaccacgcugacucagccuaccgcccuugugccagcucugucucauaacgucacagagaacgacuccugucggccccacuacuucaucuuuaauucacagacuguuuaugccgugccuaucuugauuuucaguuuuguaugccauccagcagugcucccgauauacgaggaacugaaggaucgcagccgacguagaaugaugaacgucuccaaaaucucuuucuuugcuauguucuuaauguaccugcuagccgcgcucuuugguuaucugaccuucuacgaacacguggagagcgaacuuuugcacacauauucaaguauucuggggaccgacauccuccugcuuauaguuaggcuggccguguugauggcagucacgcucacugugcccguaguuauuuuuccuauccgguccagcgugacacaucuguuaugugcuucuaaggauuucucaugguggcgccacagucugaucaccgucagcauucuagccuuuacuaaucuccuggugaucuucgucccaacaauuagagacauauuuggauucaucggcgcuuccgccgcaucuaugcuuauuuucaucuugcccucggccuuuuacaucaaacuggugaagaaagagccuaugaaaagcguucagaaaauuggcgcucucuucuuucuguuauccggggugcugguaaugaccggaucaauggcgcuuauagucuuggauugggugcauaacgcaccagguggcgggcacuga

SEQ ID NO: 62741 - RNA, 1644 nt, Artificial Sequence
  derived and/or modified sequence opt3 from SLC38A4__Homo_sapiens__NP_001137296
auggaccccauggagcugagaaacgugaauaucgaaccugaugacgagagcuccucuggcgaaucagccccagauaguuacauugggauaggaaacagcgagaaggcugcaauguccucucaguucgccaaugaagacaccgagucgcaaaaauuucucacaaacgguuuccuuggcaagaaaaagcuggcggauuaugcugacgagcaccauccggggacuacgucauuuggaaugagcaguuucaauuuguccaacgccaucaugggcucugguauuuuagggcugagcuacgcaauggccaauaccggaaucauucuauuuaucauaaugcuccuggcugucgcaauccuuucccuguauucaguucacuugcuccugaaaacagccaaggaaggcggcagucugauuuacgagaagcucggggaaaaggcuuucggauggcccgguaaaaucggcgccuuugugagcauuacuaugcagaacaucggggcgaugucuuccuauuuauucauaauuaaauacgagcugccugagguaaucagggcauuuaugggacuugaagagaauaccggcgaaugguauuugaacgguaauuaccugauuaucuucgugucagucgggaucauucuaccacucagccugcuuaagaaccugggauacuugggcuauacaaguggcuuuucucugaccugcaugguguucuuuguuuccguggucauauacaaaaaguuccagauccccuguccucucccaguguuagaucauagcguagggaaucugucguucaacaauacucuccccaugcacguugugaugcuuccuaacaacucugaguccucagacgucaauuuuaugauggauuauacacaucggaacccagccggacuggacgaaaaucaggcuaaggguaguuugcacgauagcggcguggaguacgaggcccacuccgacgauaaaugcgaaccgaaguauuucguguuuaacucucgcaccgcauacgcuauucccauccuagucuucgccuuuguuugucauccugaggugcugccaauauauagcgaacucaaagaccgaucacguagaaagaugcaaacgguaaguaauauuuccaucacugggaugcuggugauguaccuucuggcggccuuguucggauaccucaccuuuuauggcgaggucgaagacgagcuguuacacgcauacagcaaaguguauacacuggauaucccccuacucaugguuaggcuggcugugcuugucgccgugacuuugaccguaccuauuguucuguucccaauccggacaucugugauuacccuccuguuucccaagcgcccguucucauggauaagacauuuucuuaucgcugccguccugauugcauugaacaaugugcucgucauccuggugccuacgaucaaauacauuuucgguuuuauaggggccaguagcgcuacuauguuaaucuucauucugcccgcgguuuucuaucuaaagcucgugaagaaagagacauuuagguccccacagaagguaggcgcacugaucuuccuugucgugggaaucuuuuucaugauuggcucuauggccuugauaaucauugacuggaucuacgauccucccaacucgaaacaccacuga

SEQ ID NO: 62742 - RNA, 1419 nt, Artificial Sequence
  derived and/or modified sequence opt3 from SLC38A5__Homo_sapiens__NP_277053
auggagcugcaggaccccaagaugaacggcgcccucccuagcgaugcugugggguacagacaagaaagggagggauuccuuccaucccgggguccggcacccggcucuaaaccuguccaguuuauggacuucgaagggaagaccucauuuggaaugaguguuuucaaucugagcaacgccaucaugggcuccgguauuuugggguuagcguaugcuauggcccacacaggagugauauuuuuccuggcacuacuccugugcaucgcccuucugucuucguacucaauucauuugcuccugacuugugcuggcaucgcaggcauucgcgccuaugagcagcuggggcagcgagcuuuuggaccagccgguaaaguaguggucgcgacggugaucugccuccacaauguuggcgcaaugagcaguuacuuauucauaaucaaguccgaacugccccuugugauugggaccuuuuuguauauggauccugagggagacugguuccugaaaggcaaccuacucaucauuaucgucucugugcugauaauucuuccacuggccuugaugaagcaucucgguuaccugggguauacaagcggauuaucccugacuuguaugcucuuuuuccuuguaucaguuaucuacaagaaauuucaacugggcugcgcuauuggccacaaugagaccgccauggaaagugaggcauugguggggcuacccagccagggacugaacucuuccugugaagcucagauguucacagucgauucacagaugagcuacaccgugccuaucauggccuucgcguuugugugccauccagagguccucccgaucuauacugagcugugucgucccaguaagagaaggaugcaagccguugcaaaugugucuauuggugcuauguucugcauguacggccuuacagccaccuuuggguaucugacguucuacuccagcguaaaagcugaaauguugcacauguauucgcagaaggacccucucauacugugugugcgguuagccguccugcuagcagugacucucaccguuccagugguccuguuucccauccgcagagcccuucagcaguugcuguucccuggaaaggcuuuuucuuggccaaggcacguggcgauugcacucauccugcuuguacugguuaacguguuggucauaugcgugcccacaauucgggauaucuucggcgucaucgguuccacuucagccccgagucucauuuuuauccugccuagcauuuucuacuuacgcauagugcccuccgagguugaaccauuucugucuuggccuaaaauccaagcucuauguuucggggugcucggcguacuguuuauggccgucagccuuggauucauguucgcaaauugggccaccggccagucacgaaugagugggcauuga

SEQ ID NO: 62743 - RNA, 1566 nt, Artificial Sequence
  derived and/or modified sequence opt3 from SLC38A6__Homo_sapiens__NP_001166173
auggaggccagcuggggcuccuucaacgcugaaagagggugguacgugucuguccagcaacccgaggaagcagaggccgaggaacugucaccucuccuuaguaaugagcugcacaggcagcggagcccaggaguuuccuuugguuugucuguguucaacuuaaugaaugcgaucaugggcucggggauucugggacuagcuuauguacucgccaacaccggcguguuugguuucucauuucugcuucugacagucgcauugcucgccagcuacagugugcaucugcugcucuccaugugcauacagacugcuguuacgucuuaugaagacuuagggcuguucgcauuuggacuuccgggcaaguugguggucgccggcaccaucauuauccagaauauuggggcuaugagcuccuaccugcuaaucauaaaaacagagcuccccgccgcgaucgcagaauuucugacuggagauuauucacgcuacugguaucuugacggucaaacccuguugauuaucauuugugugggcaucguauuuccucucgcccuguuaccaaagauaggguuccugggauacacaaguagccucucuuucuucuuuaugauguucuucgcucuuguugugauuaucaaaaagugguccauucccugcccucugaccuugaacuacgucgagaaaggcuuucagaucucaaaugugacugaugacuguaagccaaagcuauuccacuuuagcaaagagagugccuaugcacugcccacaauggcuuucucuuuucucugccauaccuccauccugccuauuuacugugaacuucagagcccaucgaagaaacgaaugcagaacgugacgaauacugccauagcgcugucuuucuugaucuauuuuauuuccgcccucuucgguuaccugaccuuuuaugauaaggucgagucagaauuacugaaaggguacaguaaguaucuaagccacgacguugugguaaugacagugaagcucugcauccuguucgcaguccuuuugacugugccgcugauacauuuucccgcucguaaagccguuaccaugauguucuuuuccaacuucccuuucucuuggauuagacacuuucucaucacacuggcucuuaauaucauuaucgugcuguuggccauuuacgucccagauauaaggaacguguucggaguaguuggcgcaagcaccucaacgugucucaucuuuauuuuccccggccuguuuuacuuaaagcugagucgggaggacuuccuauccuggaaaaagcucgggggacugauccuuagccaccgcuuggccugcucuggugugaucucagcucauuguaaucugugccucccugauaguagcaacccacccacuuccgcgucuagagucgcagaaacaaccggcagggacacuauggagauguguacacaacggaaagggcacgcccgcacccagcaggagggaaauugccugcaggcuaagggccgagguuuaagaaggacgaaacgggugcauacccugauucuucacuuuccgacaucgcguacugucagcaaguga

SEQ ID NO: 62744 - RNA, 1389 nt, Artificial Sequence
  derived and/or modified sequence opt3 from SLC38A7__Homo_sapiens__NP_060701
auggcccaggugagcaucaacaaugacuacuccgagugggaucugucuaccgacgcuggcgaaagagcaaggcuccuucaaucacccugcgucgauacagccccuaagagugagugggaagcgagcccagggggacuggaccgggguacuacguccaccuugggcgcuauuuucauaguugugaacgccuguuuaggggcaggacugcuaaauuuuccggccgcuuucucuacagcaggcgguguagccgcugggaucgcccuccagaugggaaugcugguguuuauuaucucgggccuugucauucuggcguauugcucacaggcaagcaacgagcgcacuuaccaggaagugguuugggccguguguggcaaauugaccgggguccucugcgagguggcuaucgccguauauacauucggaaccuguauagcauuucugaucauuaucggugaucaacaggacaagauuaucgcuguuauggccaaagagcccgaaggcgcgagugggccuugguacacugaucgaaaguucacaauaucccugaccgccuuucucuucauuuuaccacugucuaucccccgugagauuggauuucagaaauaugcaaguuuccuuuccguggucggcacgugguacgugacugcuaucgugaucauuaaguauauauggccugacaaggaaaugaccccagguaauaucuugacaagacccgccucauggauggcugucuuuaacgccaugccuacuauuugcuucggguuucagugucacguuaguagcgugccaguauucaauucuaugcaacagccggaggugaaaaccuggggaggcgucgugacagcagccaugguuaucgcucuggcgguguacaugggcaccgggauaugcggauuccuaacguuuggugcagccgucgaucccgacgugcuccuguccuacccuucagaggauauggcuguagccguugcaagggccuucauuauccuuagcgugcugacuagcuauccaaucuugcauuuuuguggccgggcugucguggaagggcucuggcugcgcuaccagggaguccccguggaggaagacguuggcagagagaggcggcgccgaguguuacagacacugguaugguuccuccuuacccuguugcuagcccuguuuauuccugauaucgguaaggucauuucugugauagggggccucgcagcgugcuucaucuuuguuuucccaggacugugucuuauucaagcuaaacuguccgaaauggaggaggugaagcccgccagcuggugggucuuggugucguauggcguacuccuggugacuuuaggggcauuuaucuucggacagacaaccgccaacgcuaucuuuguugaccugcuagccuga

SEQ ID NO: 62745 - RNA, 1308 nt, Artificial Sequence
  derived and/or modified sequence opt3 from SLC38A8__Homo_sapiens__NP_001073911
auggagggccagacccccgggagcagaggacugccugaaaagccacacccggccacagcugcagccacucucuccucuaugggugcgguguucauccuuaugaaaucagcucugggcgccggguuguuaaacuuucccugggcauucaguaaggccggaggcgucguuccugcuuuucugguggagcuaguaagccucguguuccugauuuccggucuugucauacugggguacgcagccgcugugucuggacaagccacguaucagggcguugugaggggcuugugcgggccagcgaucggaaaacucugugaagcaugcuuucugcugaaucucuuaaugauuucggucgccuuccugcgggugaucggugaccagcuugagaaguugugugauucacugcuaagcggcacacccccugcuccacagcccugguacgccgaccaacgcuuuacccucccucugcuuaguguacugguuauuuugccacucuccgcaccgcgagaaaucgcuuuccagaaauauacuucuauacuggggaccuuagccgcgugcuaccuggcccucgugaucacaguccaguauuaccuuuggccccagggacuggugcgugagagccauccuuccuugucaccagcaaguuggaccagcguguuuucugucuuccccacuauuuguuuuggcuuccaaugccacgaggcugccguuuccaucuauuguucaaugagaaagaggagccuaagucauugggcucuggugucuguacucucccugcuugccugcugucugauuuacagcuugacagguguguacggguuucucaccuucggaacggaagucucggcagaugugcugaugucuuauccuggcaacgacaugguuaucauaguggcccgggucuuauucgcuguguccauuguaacuguuuacccaaucgugcuguuucuaggccgcucagucaugcaggauuucuggagaaggaguugccucgggggauggggucccagcgcgcuggcagacccguccggccuuugggugcggaugccuuugaccauucugugggucacagugacucucgccauggcucuguuuaugcccgaucuuucugagaucguuagcaucauugggggaauaucaaguuucuuuaucuucauuuuuccaggccuguguuugaucugcgccauggguguggaaccuauagggccccgcguaaagugcugucucgaggucuggggcgugguuuccgugcuggucggaaccuucauuuuuggccagagcacagcagccgcugugugggagauguucuga

SEQ ID NO: 62746 - RNA, 1497 nt, Artificial Sequence
  derived and/or modified sequence opt3 from SLC38A9__Homo_sapiens__NP_001245215
augaacaagagaauccacuacuauagcaggcugaccacacccgccgacaaagcucucauugcaccugaucauguggucccagccccggaggaaugcuacguuuauucuccccuuggcuccgcguacaagcugcagucauauacugagggguacgguaaaaauacgaguuuggugaccauauucaugaucuggaacacaaugaugggaacuagcauuuuauccaucccuuggggcauuaagcaagcuggguuuaccacaggaauguguguaaucauacugaugggccuacucacccuguauugcuguuaccggguggucaaaucucgcacuaugauguucucgcuugacacaaccucaugggaauacccagaugugugccgacacuauuuugguagcuucgggcaguggaguucccuguuguuuucucucguuagccugaucggagccaugauuguguacuggguccugauguccaauuuccucuuuaacacgggcaaguucaucuuuaauuucauucaucacaucaacgacacugauaccauauuaucaacaaauaacaguaaucccgugauuuguccuagcgcaggcucugggggacauccagacaacuccucaaugaucuuuuaugccaaugauacuggugcucagcaguucgagaaguggugggacaaaagccguaccguacccuuuuaccugguuggccuuuugcugccucuacucaacuucaagaguccaucuuucuuuuccaaauucaauauucuggggacagugagcguccuuuaucugaucuuuuuggugaccuucaaggcagugagacucggauuucaccuggaguuccacugguuuaucccgacggaguucuuuguccccgagauuagguuccaauuuccucaguuaacuggcguucugacacucgccuucuuuauacauaacugcaucauuacccuucugaaaaauaacaagaagcaggaaaacaaugugcgggauuuguguaucgcuuacaugcuaguaacucugacauaucucuacauaggugugcuggucuucgccucguucccaucucccccucuuuccaaagacugcauugagcagaacuuucuggauaauuucccaucaagugacaccuugagcuuuaucgcgcgcaucuuccuccuguuucaaaugaugacgguguaccccuuacugggguaucuagcaagaguucagcuccugggacacauuuucggcgauaucuacccguccauuuuucaugugcuuauauugaaccugaucauugucggcgccggggugaucauggcuuguuucuauccuaauaucggagguauuauaagguacucuggcgccgcaugcgggcucgcuuuuguauucaucuaucccagccugauuuacaucauuucacuucaccaggaagaacggcugaccuggccaaaguugaucuuucacguuuucauaaucauucucggaguggccaaccugaucguccaguuuuucauguga

SEQ ID NO: 62747 - RNA, 2496 nt, Artificial Sequence
  derived and/or modified sequence opt3 from SLC39A10__Homo_sapiens__NP_001120729
augaaggugcacaugcauaccaaauucugccugaucugucuccuuacauuuauuuuccaccauugcaaccacugucaugaggaacacgaccacggccccgaggcccugcauagacagcacagggggaugacugaauuggagccuagcaaguuuuccaaacaagcugcagaaaaugagaagaaauacuauauagagaaguuauucgaacgguacggagagaacggucgccugucauuuuucggccuagaaaagcuccugacgaaucuugggcugggagagcgaaaagucguugagaucaaccaugaagauuugggccacgaccacgugucucaucucgauauucuggccguacaggaggguaagcacuuucauagucacaaucaucagcacagccacaaccaucuuaauuccgaaaaccagaccgugacaucugucucgacuaaacguaaucacaagugcgacccagagaaagaaaccguggagguuucagugaaaagcgaugacaagcauaugcacgaucacaaccauagacucaggcaccaucaccgguuacaucaccaccuggaccauaauaacacacaccauuuccacaaugauaguaucaccccguccgagcgcggggaacccucuaacgagccuagcacugaaacaaauaaaacccaagagcaguccgacgucaagcugccaaaaggaaagagaaagaagaaaggcaggaagucaaacgaaaacagugaggugauuacgcccggcuuuccuccaaaucaugaucagggggagcaguaugaacacaaccggguacacaagcccgaccgcguucauaauccuggacacagccaugugcacuugccagagcgaaacggucacgauccgggcagagggcaucaagaccuggaccccgauaaugaaggagagcuaaggcacacucggaaacgugaagcgccucaugucaagaacaaugcuaucauaucucuccgcaaagaccugaacgaggaugaccaccaucacgagugucuuaaugugacccagcuguugaaguacuauggccacggugccaacuccccaaucucaacagaucucuucacuuaccugugccccgcauuacuguaucagauugacagcagacucuguaucgaacauuuugauaaacuucugguggaggacauuaauaaggauaagaacuuggucccugaagacgaggccaauaucggggcuagugcauggauaugcggaauuaucucuauuaccguuaucucccuacugagccuccugggcgugauccuuguaccaauuauaaaccagggcuguuucaaauuucuguugacauuccucguggcccuggcugucgggaccaugucgggagaugccuuacugcaccuacucccccauucucaagguggccacgaccacucccaucagcacgcgcaugggcacggacauucacacggccacgagaguaauaaguuccuggaagaguacgacgcagugcuuaaagguuugguugcccucgggggcaucuaccugcuguuuauuaucgaacauugcauaaggauguucaagcacuauaaacagcaacggggaaagcagaagugguuuaugaaacagaacacggaggaaagcacuauuggccgaaaacuuuccgaucauaaacugaacaauacaccggacucugauugguugcagcucaagccucuggcugggaccgacgauagcguggucucagaggaccgcuuaaacgagacugaacugacagaucuagagggacaacaggaaagucccccaaagaauuaccucuguaucgaggaagagaagaucauugaccacucccacagcgauggucugcauaccauccacgagcaugaccuucacgccgcagcucauaaccaccacggcgaaaauaagacgguguugagaaaacauaaccaccaguggcaucacaagcauucucaccacucacaugggccuugccacaguggaagcgaucugaaagagaccggcauugccaauauagcguggaugguaaucaugggugacgggauucauaacuucuccgauggccucgccaucggagcagcuuuuucugccggccugacagggggaaucucgacuagcauugcuguuuucugccacgaauuaccccacgagcugggugacuuugccgugcuuuugaaggcaggcaugaccgucaaacaggccauaguguauaaucuccuguccgcuaugauggcguacaucgggaugcuaauuggaacagcagucggccaauaugccaacaauaucacucuguggauuuucgcugugaccgccgguauguuucucuacguugcacugguggacaugcuuccagaaauguugcauggggauggcgacaacgaggagcacggauucugucccguaggccaguuuauccugcagaauuuagggcuccuguucggauuugccauaaugcuugucaucgcucuguaugaagauaagauuguguucgacauccaguucuga

SEQ ID NO: 62748 - RNA, 1029 nt, Artificial Sequence
  derived and/or modified sequence opt3 from SLC39A11__Homo_sapiens__NP_001153242
augcugcagggccacagcuccguguuccaagcccuccuugggaccuuuuucacauggggaaugacugcugccggugcagcgcuggucuuuguuuucucuucaggccagagaaggaucuuggacgggaguuuaggauuugcugccggcgugaugcuggcagccagcuacuggucccuacucgcucccgcaguagagauggccacgucuucggguggguucggagcuuuugccuucuuuccuguggcggucggcuucacccugggcgcagccuuuguguaucuugcugaucuguugaugccacaucucggggccgcagaagacccgcagacaacucuggcucugaacuucggaucaacccucaugaagaaaaagagcgaucccgaggguccugccuuacuguuuccagaaagugagcuuuccauucggauaggccgcgcgggguugcugucugacaaaagcgaaaauggagaggccuaccagcgaaagaaagcagcugccacaggccuacccgaggguccugcuguuccagugcccucccgugggaaccucgcccaaccuggaggcucaaguuggagaaggaucgcacugcuuauucuggccaucaccauucacaaugucccagaaggcuuggcuguggggguaggauucggugcgaucgagaagacugcaagcgccacauucgaaucugcucggaaccucgccauaggcaucgggauucagaauuuuccggagggacuggcaguuuccuuaccccugcgcggcgccgguuucucaaccuggagagcuuuuugguaugggcagcucagcggcaugguggagccucuugccggagucuucggcgcauuugcgguggugcuggcugaaccaaucuugcccuacgcccuagcauucgccgcuggggccauggucuauguugugauggaugacauuaucccugaggcacagauaaguggaaacgguaagcuggcuucuugggccuccauucucggcuuuguagugaugaugagccuggaugucgggcuuggauga

SEQ ID NO: 62749 - RNA, 2076 nt, Artificial Sequence
  derived and/or modified sequence opt3 from SLC39A12__Homo_sapiens__NP_001138667
augugcuucagaaccaagcugagcguguccugggucccccucuuucuucuguugucuaggguuuucucaacagagacugacaaaccuagugcccaggauagccggucccgcgggucuucggggcaaccagcugacuuacuccaggugcuaucagcaggagaucacccgccccauaaccacagccgaagucucaucaagacgcugcuugagaaaaccgguuguccucguagaaggaauggcaugcagggggacugcaaccuguguuuugaaccagaugccuugcuccugauugcgggaggcaauuucgaagaccagcugcgggaggaaguagugcaacgcgucucccucuuacugcuuuacuauauaauccaucaggaggagauuugcucuagcaaguugaacauguccaauaaagaauacaaguuuuaucugcacucacuacucagucugagacaggaugaggacagcucuuuccuuucccagaacgaaacagaggauauccuggcuuuuacuaggcaauacuucgacaccucacagagccaguguauggagacaaagaccuugcagaaaaagagugguauugugucuuccgaaggggccaaugagagcacucucccccaacuggcagccaugaucauaacauuaucgcugcagggaguuugccucggccagggcaaccuuccuucuccagauuauuuuaccgaauacaucuucuccucacugaaucggacgaacacuuugcgccuaagugagcuggaccaacuccugaauacccuuuggacacgaagcacuuguauuaaaaacgaaaagauccaucaguuucagagaaaacagaauaacauuaucacccacgaucaagacuauuccaauuucucuagcucaauggagaaggagagugaagacgggcccguguccugggaucagacaugcuuuagcgcuaggcagcuggucgagauauucuugcagaagggacucucucugauuucaaaagaagacuucaagcaaaugaguccugguaucauucagcaguuacugagcuguuccugccaccuaccaaaagaucagcaagcaaagcucccgcccaccacgcuggagaaauacggcuacucuacuguggccguaacacuuuugacccuggggucgaugcucggaacugcucugguucuuuuucauagcugugaagagaacuaucggcugaucuugcagcuguucgugggccuggccgucgguacauuauccggggacgcgcugcuacaccucaucccucaggugcugggacuucauaagcaggaggcaccagaauuuggccacuuccacgagucaaaaggccauauuuggaaguugauggggcugauaggagguauccacggcuuuuuccucauugaaaagugcuuuauccuguuagugagucccaacgauaaacaagggcugucucuugucaauggacauguuggccacagccaucacuuggcccucaacuccgagcugucagaccaggcuggucguggcaagagcgccucuaccauacagcuaaaauccccugaagauagucaagcagcugagaugccaauuggcagcaugacggccucuaaucgcaagugcaaagcgaucucccugcucgccaucaugauucuggugggagacucacuucacaacuucgcagauggcuuggcuaucggggccgcuuuuaguagcucguccgagucuggaguaaccacaacuauugccauacugugucaugaaaucccccacgagaugggugacuucgcaguguuacucagcucaggccugaguaugaagaccgccauucuuaugaauuuuaucuccucucugacagcuuucaugggguuguacaucggacucagcgucuccgcggauccgugcgugcaggacuggauuuuuacuguuaccgcaggcauguuccuguaucuaucacugguggaaaugcucccugagaugacacauguccagacccagagacccuggaugauguuccugcuucaaaacuuugguuugauacuggggugguuaagccuccugcuucuggccaucuacgagcagaauauuaagaucuga

SEQ ID NO: 62750 - RNA, 1116 nt, Artificial Sequence
  derived and/or modified sequence opt3 from SLC39A13__Homo_sapiens__NP_001121697
augcccggcugcccuuguccagggugcggaauggccgguccgagacugcuguuccuuaccgcucuggcauuggaguuacugggcagggccgggggaagccagcccgcgcuacggucccgcggcacagcuacugccugucgacucgacaacaaggaaucugagucauggggugcacugcuuaguggggaacgucuggauacguggaucugcagcuugcucggaucccugauggugggccugucuggcgucuuuccucucuuaguuauuccacuggagauggggaccaugcuuagaucggaagccggagcuuggagguugaaacaacugcuaucauucgcacucgguggccugcuugggaauguguuucugcacuugcuccccgaggccugggcuuacacauguagcgccaguccuggaggcgagggucagucccugcagcagcaacagcaguuagggcuguggguaauagcgggaauccucacuuuccuugcacuggaaaagauguuuuuggacucuaaagaggaaggcaccagccaggccccaaacaaggaucccacagcugccgcagcugcccuaaauggcgggcauugccuggcgcaaccugccgcagagccaggacucggugcugugguccgguccauuaaagugucaggcuaucugaaccuucuggccaauaccaucgacaacuucacucacggguuggcuguugccgcaaguuuucucgugagcaagaagauuggacuguuaacaaccauggccauccugcuacaugagauaccgcacgaagucggcgauuucgcuauccuccugcgcgcggguuuugacagauggucugcagccaaacuucaguuguccacggcucucgggggccuccugggagccggcuucgcaauuuguacucagucacccaagggggugguaggaugcagcccugccgcugaggaaaccgccgcauggguucuuccauuuacaagugguggcuuccuguacaucgcguuggugaauguccuccccgaucuguuagaggaagaggacccuuggaggucucugcagcaacuacuccugcuuugugcugggauuguggugauggucuuguuuucccuguucguugauuga

SEQ ID NO: 62751 - RNA, 1479 nt, Artificial Sequence
  derived and/or modified sequence opt3 from SLC39A14__Homo_sapiens__NP_001121903
augaagcugcuccuucugcaccccgccuuccagagcugcuuguuacugacccuacucggccuguggagaacaacuccugaggcucaugcauccucucuuggggccccagcgaucucagcugccaguuuucugcaagacuugauucacagguacggagaaggugauagccucacgcugcagcagcugaaagcacucuuaaaccaucuggacgugggcgucgggcggggaaauguuacccagcacgugcaaggccaucgcaaccuuuccacauguuucucuucgggugauuuguuuacugcccacaauuucucagagcagagccgaauagggaguuccgaacugcaggaguuuugcccgaccauccuacagcaacucgacucucgugcuuguacaagcgaaaaccaggagaaugaggaaaacgagcagaccgaagagggaagacccuccgcaguagagguguggggcuauggccugcuuugcgucacugugauuucacuguguaguuugcucggggccagcguugugccuuucaugaagaaaacauuuuacaagaggcuguuacuguauuucaucgcucucgccauuggaacccuuuacucuaaugcgcuguuucaguugaucccagaagcauucgguuuuaacccccuagaggauuauuacgucuccaaaucagccgugguauucggcggguuuuaucuguucuucuuuacggaaaagauacucaagauccugcuuaaacaaaagaaugagcaccaucacggacauagccacuacgcuagugaaucucugccuuccaaaaaggaccaggaggagggcguuauggaaaaauugcagaacggugaucucgaccacaugauuccacaacauugcagcucggagcuggaugggaaggcccccaugguggacgaaaaggucaucgugggaucuuuauccgugcaggaucugcaggcaucacagagugcuuguuacuggcuaaaaggcguccgguauagcgacauuggcacucucgccuggaugaucacccuguccgaugggcuucacaauuucauagacggauuggcgauuggugccucuuuuacaguuagcguguuccaaggcaucucaaccaguguagcaauucugugcgaggaauuuccucaugagcucggggacuucgugauccugcuuaacgcuggaauguccauccagcaggcccuguuuuucaacuuuuugagcgcuuguugcuguuaccucggccuggccuucgguauuuuagcagggucucacuuuucagccaauuggauauucgcucuggcgggcggaauguuucuauauaucagucucgcagauauguucccagagaugaaugaagucugccaggaggacgaacgcaagggcagcauucugaucccguucauaauucaaaaccuuggguugcugacuggauuuacaaucauggugguucucaccauguacuccggucagauccagauuggcuga

SEQ ID NO: 62752 - RNA, 975 nt, Artificial Sequence
  derived and/or modified sequence opt3 from SLC39A1__Homo_sapiens__NP_001258888
augggccccuggggagagccugaacugcucguguggagaccagaggccgucgcuagcgaaccgcccguuccugugggacuugagguaaagcugggugcauugguguuacugcuaguccucacccugcuuugcucccuggugccaaucuguguuuugaggcggcccggcgccaaccacgaagggucugcgucacgccagaaagcucucagucuggugagcugcuucgccggaggcgucuuucuggcaacaugucucuuagaccugcuuccugauuacuuggccgcuauugacgaggcacuggccgcucuacaugugacucuccaauucccacugcaggaguuuauacuugccauggguuucuuucugguauugguuauggaacagaucacgcucgcguauaaggagcaguccgggcccucuccucuggaagagacccgagcauuacugggaacagugaauggcggcccacaacacuggcaugaugggccgggagucccccaggccucgggugcuccugccacuccaucagcacuccgugcuugcgugcuuguguucagccuggccuugcacagugucuuugagggccuagcgguugggcugcagagagacagggcccgggcaauggaacucugucuggcccuucuguugcauaaagggauucucgcugugucccugucuuuacgccugcuacagagccaccucagagcucaaguaguggccggcugcgguauccuguucuccuguaugacaccccuugggauuggauugggcgcagcccuggcugagucagcgggcccucuccaccagcuggcacagaguguccuugaagggauggccgcuggaaccuuucuguacaucaccuucuuggagauacucccacaggaacuggccagcucugagcaaaggaucuuaaaggugauucugcuacucgcagguuuugcccugcuuacuggcuugcuguucauccagauuuga

SEQ ID NO: 62753 - RNA, 930 nt, Artificial Sequence
  derived and/or modified sequence opt3 from SLC39A2__Homo_sapiens__NP_055394
auggagcagcugcucggcaucaagcuggggugccuguucgccuuguuagcucugacccuaggauguggucucacacccauuugcuuuaaaugguuccaaauagacgcagccagaggccaccauaggcuggugcuucggcuguugggguguaucagcgcgggagucuuucucggcgcugguuucaugcacaugacugccgaagcacuggaggaaauugagucccagauccagaaguuuaugguucagaaccgcucugccucagaacgaaauaguagcggggaugcugacuccgcacauauggaguacccuuauggagagcugauuaucucucucggcuucuuuuucguguuuuucuuagaaucgcuggcccuucaaugcuguccaggcgcugccgggggaucaacgguacaggaugaggaaugggguggcgcgcacauauuugaguugcauagccacgggcaccuuccgagucccuccaaaggaccucuacgugcacucgugcugcuucugucuuugagcuuccauuccgucuuugagggccucgccgugggucugcagccaaccguugcugccacagugcaguuaugccuggcaguccucgcucacaaggggcuugugguauucggaguuggcaugagacuggugcauuugggcacuucaaguaggugggccgucuucagcauccuacugcucgcgcugaugucuccccuugggcuggccgugggauuggcagugaccgguggcgacuccgaagggggacggggccucgcucaagccguccuggaggguguugcugccgggacauuuuuauacgugaccuuccuggaaauucuaccucgcgagcucgcaucaccagaagcuccccuggccaaauggagcuguguagcggcaggcuuugccuucauggcuuuuaucgcccuuugggcauga

SEQ ID NO: 62754 - RNA, 945 nt, Artificial Sequence
  derived and/or modified sequence opt3 from SLC39A3__Homo_sapiens__NP_653165
auggugaagcugcucgucgccaaaauccuuugcaugguuggcguguucuuuuucaugcuguuggggagcuuacugcccguaaagauuauagagaccgacuuugaaaaagcucacagauccaagaaaauccuaucucucuguaacacauucggagguggcguguuucuggcaacuugcuucaaugcccuucugccugcggucagggagaaguugcagaaggugcucucacuggggcauauuaguacggauuacccacuggcugaaaccauccucuuacugggauuuuucaugacaguuuuucuugagcaauugauucugacuuuccggaaagaaaagccgagcuuuaucgaccuagagaccuucaacgccggcuccgauguggguucugacucggaguaugaaucacccuuuaugggaggggcacgcggccacgcccucuacgucgagccucauggccacgggccaagccugagugugcagggacuuucccgagcuucucccguacgucuguugagccucgcauucgcccuguccgcucauucaguuuucgaagguuuagcccugggccuccaggaggagggggaaaaaguggucagucuuuuugugggaguggcgguccacgagacacugguugcaguggccuugggcauaagcauggcuagaucugccaugccucuaagggaugcagcuaagcuggccguaaccguguccgcgaugaucccacucgguauugggcugggacuuggcaucgaaucagcccagggcguccccgggagcguggcaaguguucuguugcaaggacucgcugguggcacuuuccuguuuauuacauucuuagagauccuggccaaagaacuagaggagaagucugaccggcuccugaagguguuguuucuuguccugggguauaccgugcucgcuggaaugguauuccugaaaugguga

SEQ ID NO: 62755 - RNA, 1869 nt, Artificial Sequence
  derived and/or modified sequence opt3 from SLC39A4__Homo_sapiens__NP_060237
augguggacgucguuggccuggagagagaaaccgggcccaggggaagcccuuggccaggucucccgcuucccucccuggugggcccugccccauuguuaacaugccuguguccccagugccuaucuguagaggaugcucucgggcugggagaaccugagggcucaggucuuccacccgggccugugcuggaagcacgguacgucgcccgcuugagugcggcugccgugcucuaucugagcaacccagagggaacuugugaggacgcacgagccggccugugggcuucccacgcagaucaucucuuagcccugcuugaaucuccgaaggcuuugacgcccggccugucguggcuacuccaacguaugcaggccagagcggcagggcagaccccuaaaacagccugcguugacaucccacagcugcuugaggaagcugugggagccggugcacccggcucagcugggggaguccuggccgcguugcucgaucacgugaggagcggcaguuguuuccaugcccugccuuccccacaauacuuuguagacuucguuuuucagcagcacucuagcgaggugcccaugacuuuagcagagcuguccgcucucaugcagcggcuuggugucgggcgcgaagcccauucagaucacagucacagacauaggggagcuagcucucgggacccggugccucugauuuccucaagcaauaguucuuccgugugggauaccgucugcuugagcgcccgcgacguuauggcagccuauggccuaucggagcaagcuggcgugacacccgaagcgugggcacagcugucuccagcccuccugcagcagcaacuuuccggggcuuguaccucacagagucgaccucccguacaggaucaacugagccaguccgagagauacuuguauggaucucucgccacucuguuaauaugccugugugcaguguucggucuacuccugcuuacaugcaccggcuguaggggagucacgcacuacaucuugcagacuuuucugagccucgccgugggggcucugaccggcgacgccguucuucaucugacaccaaagguguugggucuccacacucacucagaagaggggcugaguccccagccuaccuggcgguuacuggcaaugcuagcgggccucuaugcuuucuuucuguucgagaaccuuuuuaauuugcugcucccacgugauccggaagaccuggaggacggacccugcggccauuccagccacucucaugggggacacucacauggugucaguuuacaacuggccccuagcgaacuucgccagccaaaacccccucacgagggcuccagagcagauuugguggccgaagagucuccagagcuccugaaccccgaaccgaggcggcuaucgccugagcugcgacuccugccauacaugauuacacuuggggacgcuguacacaauuucgccgauggauuggcaguuggcgcugccuuugcgagcuccuggaagaccggucuggccacgucauuagcuguguucugccaugaacucccccacgagcugggggacuuugcagcccuucugcaugcuggcuugaguguccgccaggcccuccugcuaaaccuggcaucugcgcucacugccuucgcuggacuguacguggcccuugcagucggcgugagcgaagaguccgaggcuuggaucuuggccguugcaacagggcuguucuuauauguggcccucugugauaugcugccugcuaugcuuaaaguaagagaccccaggccauggcugcuauuucuccugcacaaugucggauugcuggguggcuggaccguguuacuccugcuuucacuguacgaagaugacauuacuuucuga

SEQ ID NO: 62756 - RNA, 1302 nt, Artificial Sequence
  derived and/or modified sequence opt3 from SLC39A6__Homo_sapiens__NP_001092876
augggcauccaggugccccugaacgccaccgaguucaauuaccucugcccugcuauuauaaaccaaaucgacgcaagaagcugucuuauucacacauccgaaaagaaagccgagaucccaccgaagacuuauucucugcagauugcgugggucgggggauuuaucgcuauaucaaucauuaguuucuugagcuuacuggguguuauccuagugccccucaugaauaggguauuuuucaaauuucugcuuuccuuccugguggccuuggcagucggcacgcucucuggggaugccuuucugcaucugcucccucacucgcaugcuucacaccaucacagccacagucaugaagaaccagcaauggaaaugaagcggggacccuuauucucccaccugucuagccagaacauugaggaguccgccuacuuugacucaaccuggaaaggccuuacagcuuugggugggcuguauuucauguuucuaguggaacauguucucacucugaucaagcaguucaaggauaaaaagaaaaagaaucagaaaaagccugagaacgacgaugacguggaaauaaagaaacaacuuaguaaguacgagagccagcugucuaccaaugaggaaaaagucgauacagacgaucgcaccgagggauauuugcgagccgacucccaggaaccaucacacuuugauagccaacagcccgcggugcucgaggaagaggagguaaugauugcacacgcccauccucaggaaguuuacaacgaguaugugccacguggcugcaagaauaaaugucacagucauuuccacgacacucugggccagucugaugacuuaauccaucaccaccaugacuaccaccauauucugcaccaccaucaccaucaaaaccaccauccgcacucccacagccagagauacucgagggaggagcucaaggaugcuggggucgccacacuugcauggauggugaucaugggagacggucugcauaauuucucugauggcuuggcuaucggggccgcguuuaccgaaggacuauccucaggccugaguacgagcguggccgucuucugccacgagcucccccaugagcugggugacuuugcaguucuucugaaagcugggaugacugugaagcaggccguauuguauaacgcucucuccgccaugcuggcauacuuaggaauggccaccggcauuuucauaggccacuaugcugaaaaugugucuauguggaucuuugcgcugacagcagggcuauucauguacgucgcccucguggauaugguuagcuuuuga

SEQ ID NO: 62757 - RNA, 1410 nt, Artificial Sequence
  derived and/or modified sequence opt3 from SLC39A7__Homo_sapiens__NP_001070984
auggccagaggccugggggcuccccacuggguggcagucggacuccuuaccugggccacacuggguuuguuaguugcgggccuagggggacaugacgaucugcacgacgaucuccaggaggacuuccauggccacagccauaggcacucccacgaagauuuucaucacggucauucucacgcucacgggcauggacacacucaugagucaaucuggcacggccauacgcacgaccacgaucauggccacagucaugaagaccugcaccacgggcauagccacggauacucccaugagucucuuuaucaccggggucauggccacgaucacgaacauucgcacgggggauacggcgagucaggugccccugggauuaagcaagaccuggaugcagugaccuugugggccuaugcucucggagcaacaguacugauaagcgccgcuccauucuuugugcuguuccucaucccggucgagaguaacucccccaggcaucgaucuuuacugcagauucuuuugagcuuugccuccggcggccugcuaggggacgcguuccuccaccugaucccucaugcacuugaaccacacucacaccauacucuggagcagcccggacacggucauagucacagcggccaggggccuauuuugucugugggacucuggguucuguccggcaucguggccuuuuuagucguggaaaaauucguacgucacguuaagggugggcauggccacucacauggacacggccaugcucacagccacaccagagggagucauggacacgguaggcaagagcggucuacaaaagagaagcaguccagcgaagaggaagagaaagaaacccgcggcgugcagaagagacgcgggggaucgacugucccaaaggauggccccgugcggccucagaaugccgaggaggaaaaacgcggucuggaccuccgagugucuggguaccuuaaccuggcagcugacuuggcccauaauuuuacagauggccuagcgauaggagccuccuucagaggcgggaggggacuggguauccucaccacgaugacuguccugcuucacgagguuccacacgaagugggcgacuuugcaauucugguacaaucagggugcaguaagaaacaggcuaugcgguugcagcuccugaccgccgugggagcuuuagccggcacagcaugugcccugcuaacugaggguggggcugucggcagcgaaaucgcgggaggcgcagggccgggaugggugcuccccuucaccgccggcgguuuuauuuauguugcuacaguguccguccugccugagcuuuugcgugaggccucuccacugcagagccuccuggaagugcuugggcuguugggaggcguaaucaugaugguucucauagcacaucuggaguga

SEQ ID NO: 62758 - RNA, 1383 nt, Artificial Sequence
  derived and/or modified sequence opt3 from SLC39A8__Homo_sapiens__NP_001128618
auggcccccggcagagcuguggcagggcugcuccuucuggccgcggcuggauuggguggcgucgccgaggggccuggauuagcauucagcgaagacguucuguccguguuuggcgccaaccuaucucucucagcugcacagcugcaacaccuucuggagcagaugggugccgcuaguaggguaggggugccagaaccgggacaguugcauuucaaucagugccucaccgccgaggaaaucuuuagccugcacggcuucuccaacgcgacacaaauuacuucuucgaaguuuucagucauaugucccgcagugcugcagcagcucaauuuccauccuugcgaggaucggccaaaacacaagacgcgccccagccauagugagguuuggggcuacggguuuuuauccgugaccaucauuaaccuggccucucuuuugggacugauccuaacaccucucauuaaaaagagcuauuucccaaaaauccugaccuuuuucgucggucuugcuauaggcacucuguuuuccaaugccaucuuccaguugauucccgaagcauuuggguucgacccuaagguggauucauacguagagaaggcuguugccguguucggaggcuuuuaucuccuguucuuuuucgaacgaauguuaaaaaugcugcucaagacauacggucaaaacgggcacacccacuuuggaaaugacaacuucggcccacaggagaaaacucaucagccgaaggcgcuucccgccaucaauggcgucacauguuaugcaaacccugcugugaccgaggccaaugggcacauucauuuugauaacgugagugucguuagccugcaggacgguaaaaaggaaccaucuuccugcacguguuugaagggacccaaacuaucagagaucggcacuauagcuuggaugauuacccugugcgaugcccuccacaauuucaucgacgggcuggcaauuggagccagcuguacacuuagucuguugcaaggccucucuacuuccaucgcuauccugugcgaagaguuuccucacgaauuaggugauuucgugauucugcuaaacgcggggaugagcacccgucaggcacuccuguuuaauuuccuuucggccuguucuugcuacguaggcuuggcuuuuggaauacuggugggcaacaacuucgccccaaauaucauuuucgcacucgccgggggaauguuucuguauaucucccuugcugacauguuccccgagaugaacgauaugcugagagagaaggucacagguaggaaaaccgacuuuacguucuuuaugauacagaaugccggcauguugacuggguucacagcaauucuccugaucaccuuauacgcgggagaaaucgagcuggaauga

SEQ ID NO: 62759 - RNA, 699 nt, Artificial Sequence
  derived and/or modified sequence opt3 from SLC39A9__Homo_sapiens__NP_001239079
auggacgauuucaucagcauuucccugcucucucuugccaugcuggugggcugcuacgucgcugggauaauccccuuggcaguuaacuuuucagaggaaagauuaaagcuggugaccguacuaggagccggucuccuguguggcacagcgcuugcugugauugucccugagggggugcacgcccuguaugaagacaucuuggagggaaaacaucaccaggcaagugaaacucauaauguuauugccagcgauaaggcugcagagaaauccgugguccacgagcaugaacacucucacgaccauacgcaacuccacgccuacaucggcgugucgcugguacuggguuucguuuuuaugcucuuaguggaucagauagggaacucacauguccacagcaccgacgauccagaggcugccaggaguuccaauucuaagaucacaacuacccugggacuuguggugcacgcggcagccgacggcgucgcuuugggcgccgcagcuagcacaucccagaccucaguucagcugauuguguucguagccaucaugcuacauaaagcgccggccgcauuugggcucgugaguuuccugaugcacgcuggacuugaacggaaccgcauucgaaagcaucuguuggucuuugcccucgcugcccccgugaugagcaugguuacuuaucuggguuuaucuaaggauuga

SEQ ID NO: 62760 - RNA, 2058 nt, Artificial Sequence
  derived and/or modified sequence opt3 from SLC3A1__Homo_sapiens__NP_000332
auggccgaggacaagagcaaaagagauuccaucgaaaugucuaugaagggcugccagaccaacaauggguucgugcacaacgaggacauucuggaacaaacacccgauccuggaucaaguacugacaaucucaaacauagcacgagggguauacuuggcucccaggagccagauuuuaaggggguccagccguacgcuggaaugcccaaagaaguucuguuccaguuuucuggccaagcacgguaucgcaucccucgagagauuuuguucugguuaaccguggccucgguacuggugcuaaucgcggcuacaauugccaucauagcacucucaccaaagugucuggacugguggcaggagggucccauguaccagaucuauccucguagcuuuaaggauaguaacaaagacgggaauggagaucuuaagggcauucaggacaaacuggauuacaucacugccuugaacauuaagaccgucuggaucacauccuucuauaaaucuagccucaaggacuuuagauacggcguggaagauuucagggagguugacccaauauuugggaccauggaagacuucgagaaucugguggcugcaauucacgauaagggacugaaacucaucauugacuuuauccccaaccauacuuccgauaagcacaucugguuccaauuaucacggacacgcaccgguaaauauacggacuacuacauuuggcaugauugcacucacgagaauggcaagaccauaccuccaaacaauuggcugagugucuaugggaacagcucuuggcacuuugacgaagugagaaaucaguguuacuuccaucaguucaugaaagagcagccggaucuuaacuuuaggaaucccgacguacaagaagagaucaaggaaauuuugcgguucuggcugacaaaaggaguugauggcuuuucccuagacgccgugaaguuccuccuggaggcuaagcaccuucgcgaugagauccaggucaacaaaacucagauaccugacaccgugacacaauauucagaacuguaccaugacuuuaccacgacucagguggguaugcacgauauuguccgaaguuucagacagacaauggaccaguauagcaccgagccagggagguaccgguuuaugggaacugaagccuaugcggagucuaucgaucguacaguuauguacuacggcuugcccuucauccaagaagcagacuuuccuuucaacaauuaucucuccaugcuggauaccgugagcggcaacucgguauacgaggugauuacgucuuggauggagaauaugccagaagggaaguggcccaacuggaugaucggagguccggacuccucacgcuuaaccaguagacugggcaaucaguaugucaacgugaugaauaugcuccuuuuuacacugccugggacucccauuaccuacuauggagaggaaauaggcauggguaacaucguugccgcuaauuugaacgagagcuacgauauuaauacacuaagguccaaaucuccaaugcagugggacaacagcucaaaugccggguucagugaagcauccaacacuuggcugccuaccaauagcgauuaucacacagugaacgucgacgugcagaagacccaaccccggucugcucucaaacuguaccaggaucuuucacuguugcaugccaacgagcuccuguuaaaucgaggcugguuuugccaucugcgcaacgacagucacuacguaguuuauacuagagagcuagauggaaucgacaggaucuucauugugguccucaauuucggcgaaagcacgcugcuuaacuugcacaauaugauauccgggcugccagcgaagaugcggauccgccucucuacaaacucggccgacaagggaagcaaaguggauaccuccgguauuuuucuggacaagggcgaggggcuuaucuucgaacauaauacuaaaaaccuguugcacagacagaccgcauuuagggaucguuguuucgucucaaaucgggcuugcuacaguucugugcucaacauucuguauacaagcuguuga

SEQ ID NO: 62761 - RNA, 1896 nt, Artificial Sequence
  derived and/or modified sequence opt3 from SLC3A2__Homo_sapiens__NP_001012680
auggagcugcagcccccugaagccagcaucgcuguggucuccauuccaagacaacucccgggcucucacucagaggcagggguucagggacuuagugccggugacgauagcgaaaccggcuccgacugcgugacacaggcggggcugcaguuguuagcuucuucggaucccccugcccuggcaucaaagaacgccgagguaacuguggaaacgggauuccaucacgucagccaagcugacauagaguuucuaaccaguaucgauccaacagcauccgccucuggcagcgcugguauuacugggaccaugucccaggacacagagguggauaugaaagaaguugagcucaaugaacuggagcccgagaagcagccuaugaacgccgcgucaggagcagccaugagucuugcuggcgccgagaaaaauggccuggugaagaucaaagucgcagaggacgaagcugaggccgcggccgcagcuaaguucaccggguugagcaaggaagaacuccugaaaguggccggaucuccagguuggguaaggacucggugggcucugcucuuacuguuuuggcuuggcugguuggggaugcuggccggagcaguugugauuaucguccgcgcuccccgaugucgugagcuaccugcccagaagugguggcauacaggcgcgcucuacagaauaggugaucugcaagcauuccaggggcacggagccggcaaccuugcuggccugaaagggagguuggacuaucucuccucacugaaggugaaaggauuagugcuggguccaauccauaagaaucagaaggaugacgucgcccagaccgaucuccuucaaauugacccgaacuuuggcagcaaagaagacuucgauagucuguugcagucugcaaagaaaaaguccauccggguuauucuagaccugacgcccaauuaccgcggggagaacagcugguuuucgacucagguggauaccguagccacaaaagugaaggacgcucucgaguucuggcugcaagccggagucgauggcuuucaggugagagacaucgaaaaucuuaaagaugcaucuuccuuccuggcggaauggcagaacauaacuaaggguuuuucagaggacagguugcucauugcugggaccaauaguagcgaucugcagcaaaucuuaucccugcuagagucuaacaaggaccuccugcuuacaagcucauauuugagugauuccggcagcaccggagaacacacgaaaucucugguuacucaguaccucaaugccacaggcaaccgguggugcucauggagucugagccaggcacgccuucugaccuccuucuugccugcccagcuccugcgauuauaucaacugaugcuauuuacucucccagggacacccguguucucuuacggagacgagauuggucuggacgcugccgcacuuccuggccagccaauggaagcucccgucauguugugggaugagucgagcuucccggacaucccuggggccguguccgcgaauaugaccguaaagggacagucagaagaucccggcagucugcucucucuguuuagaagguuaagcgaccagcgguccaaagagcguucacugcuucacggugauuuccaugccuuuagcgcugggccaggcuuguucucuuauauccgccacugggaccaaaacgagagauuucucguugugcugaacuucggagaugucggccuauccgcagggcugcaggccagugaccucccugcuagcgccucucugcccgcaaaggcggaucuuuugcuguccacgcagccaggaagggaagaggguucacccuuagaacucgagcggcugaaacuugagccucaugaaggccuguugcuccgauuuccauacgccgcuuga

SEQ ID NO: 62762 - RNA, 1716 nt, Artificial Sequence
  derived and/or modified sequence opt3 from SLC40A1__Homo_sapiens__NP_055400
augaccagagccggcgaccacaacaggcagcgggggugcuguggaagccuggcugauuaccucacauccgcaaaguuccuucuguauuugggucauucuuuaucaacuuggggcgaccgcauguggcacuuugccgugagugucuuccugguugagcuauacgggaauagccuccugcuuacggcgguguauggacugguaguggcuggcuccgucuuggugcucggugccaucauuggggauuggguugacaaaaacgcacgacugaagguggcccaaaccucucuggucgugcagaauguaucgguuauacucugcggaaucauuuuaaugaugguguuucugcauaaacacgaacuuuugacaauguaccauggcuggguccugacuucauguuauauccuaauuaucaccauagcuaacaucgcaaaucucgccagcacagcuaccgccauuacuauccagcgugauuggauugugguggucgcgggcgaggacagaaguaagcuggcaaacaugaaugccacaaucaggcggauagaucagcuuaccaacauucuggcucccauggccguugggcaaaucaugacguucggauccccugugauugguugcggcuuuaucucuggguggaauuugguaagcauguguguggaauacguccuccuguggaaaguguaucagaagacuccagcauuagcuguuaaggccggacugaaagaggaagagaccgagcucaagcagcuuaaccugcacaaagacacagaaccgaagcccuuggagggcacucaccuaaugggugugaaagauuccaauauccaugaacuggagcacgagcaggaaccuaccugcgcgucacaaauggccgagccauuccgcacauuuagagacgggugggucaguuacuacaaccagcccguguuccucgcaggaaugggccuggcuuuucuuuauaugaccguacugggcuucgauuguauuacgacuggguacgccuauacacagggauugagcgguucuauacucuccauccugaugggcgcuucagccauuaccgggaucaugggaacuguugcauuuacaugguuaaggcggaagugcggccuggugcgcaccggucuaauaagcgggcucgcccagcugaguugucuuauuuugugcgucaucucuguguucaugccuggcuccccacuggaccucagcgucucgcccuuugaagauauccgaucuagauucauucaaggagaguccaucacgccuaccaagauuccagaaauaacaacugagaucuacaugucaaauggcaguaacagcgcuaauauugugccggagaccucccccgaaucuguuccuaucaucagcgugucacugcuuuucgcggggguaauugcagccaggauaggacuguggaguuuugacuugacagucacucagcuccugcaggagaacgugaucgaauccgagcgggguauuaucaacggcguucaaaauagcaugaacuauuuacuggaccuacuccauuucauuauggugauccuggcuccaaaucccgaagccuuugggcuuuugguccugauaucugugucauucguagcaaugggacacaucauguacuuucguuucgcccagaacacccucggcaauaaacuguuugcuugugguccugaugccaaggaggugcgcaaagagaaccaggcaaauacaaguguugucuga

SEQ ID NO: 62763 - RNA, 1542 nt, Artificial Sequence
  derived and/or modified sequence opt3 from SLC41A1__Homo_sapiens__XP_005245126
augagcuccaagcccgagccuaaagacgugcaccagcugaacggcaccgggccaucugccucaccgugcaguagcgauggacccgguagagaaccucucgcuggcacauccgaguuccuugggccagacggagcaggcgucgaaguugugaucgagucuagggccaaugcgaaggguguacgggaagaggaugcucuguuggagaacgggucgcaaucaaaugaaagcgacgaugugaguacugaccgcggacccgccccuccaucccccuuaaaagagacgucuuuuagcauuggccugcagguccuauucccuuuucuccuggcaggcuucgggaccguggccgcuggaaugguucuugauauagugcagcauugggaagucuuucagaaggugacagagguauucauccugguuccagcauugcucggucugaaaggcaaccuggagaugacucucgccucccgauuaucaaccgcugccaauauugggcacauggacacaccgaaggaacuguggcguaugaucaccggaaacauggcgcuuauucaagugcaggcaacugucgugggcuuuuuggccaguaucgcugccguggucuucgguuggauacccgaugggcauuuuagcaucccucacgcauuccugcuaugugcuucuuccguugccacagcguuuauugccucacucgugcugggaaugaucaugauuggcguaaucauaggcagcagaaagauugggaucaauccagacaacguggcaacccccauugcugccagucuuggagaucugaucacguuggcucuccugucugguaucuccuggggcuuauaccuggagcucaaucauuggagguauauuuacccucuugucugcgccuucuuuguggcacuguugccaguuugggugguccuagcccggcgcagccccgcuacuagagaagugcuguauucggggugggagccgguaauaaucgcgauggcaauuucuuccguuggaggccucauccuggacaaaaccgugucagauccuaacuucgccgguauggcugucuucacacccgugauaaauggggucggcggaaaccuuguggccguucaggcaaguaggauuagcacuuuucugcacaugaauggcaugccaggggaaaacuccgagcaggccccucggcgcugucccucuccaugcaccacauucuuuagccccgacguaaauucacgaagugcuagaguguuguuccuccuggucgugccuggacacuuaguuuuucuguacaccaucuccuguaugcaagguggccauacgacucuaacacucaucuucauuaucuuuuauaugaccgccgcacugcuucagguguugauucugcucuacauagcggacuggaugguccacuggaugugggggaggggacuggauccagacaacuucagcaucccguaucuuacugcucugggcgauuugcucgguacagggcuguuagcccugucuuuucaugugcuauggcucauuggcgaccgggauaccgacguaggagauuga

SEQ ID NO: 62764 - RNA, 1680 nt, Artificial Sequence
  derived and/or modified sequence opt3 from SLC43A1__Homo_sapiens__NP_001185739
auggcccccacccugcagcaggcuuacagaaggcggugguggauggcaugcacagccgugcucgagaaccuuuucuuuagcgcgguccuguugggcuggggguccuuacugaucauucuaaagaaugaaggauucuauucuucaacuuguccugcugagaguagcacgaacaccacacaagacgaacagcgccgauggccagguugcgaucagcaagacgagaugcucaaucugggcuuuacuauaggguccuucguucuuucugccaccacacugccguugggaauccucauggaucguuuuggccccagaccugugaggcugguagguucggcauguuucaccgccucaugcacucugauggcucucgcaagccgggacguggaagccuuaaguccacugauuuuucuugcuuugucccugaacggguucggaggcaucugucuaacauuuaccucucucacgcugcccaauauguucggcaaccuucgcagcacucugauggccuugaugauuggguccuacgcgucaagugcaaucaccuuuccuggaauaaaacucaucuaugaugccggugucgcuuucgugguuauuauguuuacauggagcggccuggccugcuuaaucuuccugaauuguacucucaacuggccaauugaggcauuccccgcuccugaggaagugaauuacaccaagaaaaucaaacuuucugggcuggccuuggaccacaaggucacaggagaucuauuuuauacccaugugacgacuaugggccagagacugucccagaaggcgccaucacucgaggacgguagcgaugccuucaugaguccgcaggacguaagggggacaucugaaaaccugcccgagcgguccguuccucuucgcaagagccugugcucgccaaccuuuuuguggucucuccugacuaugggaaugacacaauuacgaauaauuuucuacauggcagcugugaauaaaaugcuggaguaucuagucaccggcggccaggaacacgagacgaacgaacagcagcaaaagguggccgagaccgugggguuuuacuccucagucuucggagcuaugcagcuccugugucuuuugacaugcccccugaucgguuacauuauggauuggagaaucaaagacuguguugaugccccuacucagggcaccgugcucggggacgcaagggacggaguagccacaaagaguauccggccacguuauugcaaaauucaaaagcugacuaaugcuauaagcgcguuuacccuuacaaaccuguugcucgugggcuucgguauuaccugccugaucaauaacuuacaucugcaguuugucacuuucgugcuacacacgaucguucgcggguuuuuccauuccgcauguggcucucucuacgccgcuguguuucccagcaaccacuucggaacacugaccggccuucagucauugauaagugccgucuucgcacugcuccagcaaccgcuguuuauggccaugguggggccuuuaaagggagaacccuucuggguaaaucugggucuuuugcucuuuucccugcuaggcuuccugcucccaagcuaucuguuuuacuauagagcuaggcuucagcaggaguacgccgcaaacgggaugggaccuuugaaaguucugucuggcucagaggugacugcguga

SEQ ID NO: 62765 - RNA, 1299 nt, Artificial Sequence
  derived and/or modified sequence opt3 from SLC43A2__Homo_sapiens__NP_001271428
augaccuacggcagcccccaggccaacgcuuccccuucugacgcaguggcccuggaucacggggaggucucaagaaggcaacagcaggaacucccaaauauguucggagaccuucggaguacauuuaucgcgcugaugauugguagcuaugcuuccucugccguuacuuucccgggcauaaaguugaucuacgaugcaggggugucguuuauuguaguguuagucgugugggccggaugcucaggccugguuuuccuaaacugcuuuuucaauuggccccucgagccuuuuccaggucccgaagacauggauuauagcgugaaaaucaaguucaguuggcugggguuugaccauaaaauuacgggaaagcaguucuacaaacaagucaccacagugggccgccgacuuuccguaggcucuagcaugcguuccgcuaaggagcagguugcacugcaggaagggcacaaguugugucucucaacuguggaucuggaggucaaaugucagccugacgccgcuguggccccaaguuuuaugcauagcguguucucucccauccugcucuuaucccuggucaccaugugcguuacacaacuuagauugauauuuuauaugggagcgaugaacaauauccugaaguuccuagugucaggugaucagaaaaccguaggccucuacacuagcauuuucggggugcugcagcuucuguguuugcucacagcaccugucaucggauauauuauggacuggaggcugaaggagugcgaagaugccagugaggaaccagaggagaaagacgcuaaccagggcgaaaagaagaaaaagaaacgggaucgccaaauccagaagauaaccaaugccaugagagcauuugcuuucacgaacuuacugcucguggguuuugggguuacuugucuuauuccgaaucugcccuugcagauccuaucuuucauucugcacaccaucgugaggggauuuauccauuccgccgucggcggccucuacgcggccguguacccuagcacacaauucgggucgcugacuggacuucagucucugauuuccgcauuguuugcucuccugcagcagccauuauuccuggccaugauggguccccuacaaggcgacccucucuggguaaacguugggcugcuuuugcugucacuccugggauuuugccuuccacuguauuugauauguuaccggcgccagcucgagcgacagcugcagcaaagacaggaagacgauaaauuauuccugaagaucaauggcaguagcaaccaggaggcuuuuguguga

SEQ ID NO: 62766 - RNA, 1515 nt, Artificial Sequence
  derived and/or modified sequence opt3 from SLC43A3__Homo_sapiens__NP_001265135
auggccggccaggggcugccccuccacguggcuacccuucugacaggauuguuagagugccuggguuucgcaggcguccuauuuggguggccuagccucguuuucguguuuaagaacgaagacuacuucaaagaucuguguggaccagacgccggcccgaucgguaaugcgacugggcaagcuggaagacuuggcugcaugggcgaucuguuuuccacgcccgacuguaaggcccaggaugagagguucucuuugauuuuuacccucgggucauucaugaacaauuuuaugacauucccuacuggauauauauuugaccgguucaaaaccacaguagcacgccugaucgccaucuuuuucuacaccacugcuacacugauuauugcauucaccagugccgguagcgcugugcucuuauuucuggccaugccaaugcuuacgaucggcgggauauuguuccugaucacuaaccuacagauuggaaaucucuuuggccagcaucgauccaccaucauuacacuguauaacggugcguucgauucuucgucagcagucuuucuuaucauaaagcuguuguacgaaaaagggauuagccuccgugccaguuucaucuuuauuuccgugugcucuacuuggcacguugcuagaaccuuccuguuaaugcccaggggacauaucccuuauccacugcccccuaauuacagcuauggccucuguccaggcaacgggacaaccaaggaggaaaaggagacggccgagcacgaaaaucgggagcuucaauccaaagaauuucugucagcaaaggaggagacuccgggagcuggucagaaacaggaauugcgcaguuucuggagcuacgccuuuucuagaagguucgcguggcaucuaguguggcuguccgucauccagcucuggcacuaccuguuuauuggcacacuuaacucacuguugaccaauauggccgggggagacauggcacgggugagcacuuauacaaacgcuuucgccuucacccaauuuggcguacucugcgcucccuggaauggucuguuaauggaucgccugaagcagaaauaccagaaggaggcccgaaagacggggaguucuacccuagcaguugcccucuguuccacagugccuagccuggcucuuacuucguugcugugccucggcuucgcgcugugugcaucugucccaauacuuccccugcaguauuugaccuuuauccuccaagugauuuccagaucauuccuguacggaaguaacgccgccuuuuuaacacuggcuuucccuagcgaacacuuuggcaaacuauucgggcucgugauggcacuguccgccgucguuucucuuuugcaguuuccaaucuucacucugauaaagggaagccuccagaaugaccccuuuuaugugaacguaauguucaugcuggcuauuuuacugaccuuuuuccauccguuccuuguguacagggagugccggacauggaaagaaucaccuagugccaucgcauga

SEQ ID NO: 62767 - RNA, 1959 nt, Artificial Sequence
  derived and/or modified sequence opt3 from SLC44A1__Homo_sapiens__NP_001273659
augggcugcuguagcuccgccucuucagcugcacagaguagcaagagagaguggaaaccccuggaagacagguccugcaccgauaucccuuggcuccuucuguucauuuuguuuuguauagggaugggauucaucugcgguuuuucuauugccacaggcgcggcugcccgguuagugucgggguacgacucauauggaaacaucuguggccaaaagaauacuaaacuggaggcaauuccaaacagcgguauggaucacacgcagcgcaaguacgucuucuuucuagacccgugcaaucucgaucugaucaaccgaaaaauaaagaguguugcccuuuguguggcugcaugcccccgucaggaacugaagaccuuguccgacguacagaaauucgccgagaucaaugggucugcucucuguagcuauaaccugaagccuuccgaauacacaacuucaccaaaaaguagcgugcugugccccaagcucccugucccagccucugcgcccauuccuuucuuccauagaugugcaccagugaauaucuccugcuaugccaaauuugcugaggccuuaauuaccuucguuucagauaacagcgugcugcacaggcuuaucaguggagucaugacaucuaaggagauaauuuugggccugugccuacucucccuggugcuuagcaugauccugaugguaauuauccgguacaucucgcgcguuuugguguggauucucaccauacuggucaucuuaggcucucucgggggaacuggugugcucugguggcuuuaugcaaagcaaagaagguccccgaaagaaacagugacccccgagcagcugcagauugcugaagacaauuugcgggcccuacugaucuacgcgauaucagccacggucuuuacuguuauucucuuccugaucaugcuugugaugcgcaagcgaguagcacugaccaucgcuuuguuucauguggccggcaaagucuucauucaccucccucuguuaguguuccagccauuuuggacauucuuugcucugguucuauucuggguguacuggaucaugacucuccuguuucuugggaccacaggaagucccguccaaaacgagcagggcuucguggaguuuaagauuagcgguccuuugcaguauauguggugguaccauguaguugggcugauauggaucuccgaauuuauucucgccugucagcaaaugaccguggcaggagccgucgugacguauuacuuuacuagagauaaaaggaaucugccauucacacccauccuugcuucugucaaccggcugauccguuaucacuugggcaccguggcgaagggcagcuuuauuauaacucucguuaaaaucccgcgcaugauucugauguacauccacucacaguuaaaggggaaggagaaugcaugcgccagaugugugcugaaaaguugcauuuguugccuauggugucucgaaaagugccugaacuaucuuaaucagaacgcuuacacagccaccgcaaucaacuccacgaauuucuguaccagcgccaaagacgcuuuuguaauauuggucgagaacgcccugaggguggcaacaaucaauacuguuggagauuucaugcuguuccuggguaagguguuaauugucugcucuaccggccuggcggggaucaugcuuuugaacuaccaacaggacuauacaguguggguacucccucugauuaucgugugucuauuugcuuuccugguugcccauugcuuucucucaauauacgaaauggucguggaugugcuguuccuuugcuuugcaauugacacuaaauauaaugacggaagucccggccgggaguucuacauggauaaggucuugauggaguuuguugaaaacagccgaaaggccaugaaagaggcugguaaagggggcguggccgacucccgcgaacugaagccaaugaucaaguga

SEQ ID NO: 62768 - RNA, 2115 nt, Artificial Sequence
  derived and/or modified sequence opt3 from SLC44A2__Homo_sapiens__NP_001138528
auggaggacgaaagaaagaacggcgccuacgggacuccccagaaauaugauccuacauucaagggaccaaucuacaauagggguugcacugacauuauauguugcguguuucugcuccuugcuaucgucggcuauguugcaguggggauuaucgccuggacgcacggagauccgcggaaaguaauuuaccccaccgacagccgcggcgaguucuguggucaaaaggggacaaagaacgaaaauaagccuuaucuguuuuacuucaacaucgugaagugcgcguccccauuggucuuacuggaguuucagugucccacuccucagauaugcguggaaaaauguccagaucgauaucuaaccuaccucaaugcucguucuucaagagacuucgaguacuauaagcaguuuugcguucccggauucaaaaacaauaagggcguggccgagguccugcaagauggcgacuguccugcagugcuuaucccaaguaaaccgcuggccaggcggugcuuucccgcuauucaugcauacaaggggguauugaugguuggaaacgaaacaaccuaugaggauggucacggcagccgcaagaauaucacugaccucguggaaggggccaaaaaggcuaacggaguccuggaggccagacagcuggcgaugaggauuuucgaggauuacacaguguccugguauuggaucauaauuggccucgugaucgcaauggccaugucuuuacuguuuauuauccuuuugcgguuccuggcugguaucauggucuggguuaugauuauaauggugauccuaguacucggguacggaauuuuucauuguuauauggaauacucgcgccugcgaggcgaggccggcucagacgugagccuugucgaucugggguuccagaccgacuucagaguguacuugcaccucaggcagacguggcuggcauuuaugaucauauuaaguauucuggaaguuaucaucauucuccuucugaucuucuugcggaaacguauucuaauagcuaucgcccugauuaaggaggcgucccgcgccgugggauaugucaugugcucucuccuguacccucuugugaccuuuuuccuguugugccucuguaucgcauauugggcuagcaccgccguauuucuguccacaucaaaugaagcuguuuacaaaaucuucgacgauaguccaugccccuuuacugccaagaccuguaacccugagacauucccaagcucuaaugaguccagacaaugccccaacgcaaggugucaguuugccuucuaugguggcgaaucaggguaccaucgggcuuuacugggacuacagauuuuuaaugcguucauguuuuucuggcucgcaaacuucgugcuggcccuuggccaggucaccuuggcuggugccuuugcaagcuauuacugggcccugcgaaaaccggacgaucucccugcuuucccccuguuuagugccuucgggcgcgcacuuagauaccacacgggcucucuggcguuuggagcuuugauacucgccaucgugcaaauuaucagggucauucuggaguauuuagaccagcggcugaaggcagccgaaaacaaguucgcuaaaugccuaaugacuugucucaagugcuguuuuuggugccuggagaaauucaucaaguuucuuaaucgcaacgccuacauaaugaucgcaauuuauggcacaaauuucuguaccuccgcuagaaacgccuuuuucuugcugaugaggaauaucauucguguggcgguucucgauaaagugacugacuuucuguucuuacuggggaaacuuuugaucguaggaagcgucgguauacucgccuucuuuuucuuuacacaccggauucgaaucgugcaggauaccgcuccaccucugaacuacuauuggguucccauucuaacggugaucgucggcucguaccugauagcacauggguucuuuucuguguauggaaugugcguagacacccucuuccugugcuuucuugaagauuuggagagaaaugacggcuccgccgagaggccauacuucaugucaaguacacugaagaaauuacucaacaagacuaauaaaaaggcugccgaaagcuga

SEQ ID NO: 62769 - RNA, 2007 nt, Artificial Sequence
  derived and/or modified sequence opt3 from SLC44A4__Homo_sapiens__NP_001171515
augggcgggaagcagagagacgaggaugacgaagccuacggaaaacccgugaaguaugauccuagcuucagggguccaaucaaaaaccgguccugcaccgacgucauuuguugcguucuguuucuccuuuucauacugggcuacaucgugguagggauuguggcuugguuguauggagauccgcgccaagucuuauacccccgaaauucuacaggcgcauauugugguaugggggagaacaaggacaaaccuuaccugcuauauuuuaauaucuucucaugcauucucaguagcaacaucauauccguggccgaaaauggacugcaguguccaacuccccagacgguuaucaccucucuucagcaagagcugugcccuucguuuuugcucccaucagcgcccgcucugggccguuguuucccuuggacaaacgugacuccaccggcccugcccggcauuaccaaugauacaaccauccagcaggggauuagcggacucaucgacaguuuaaacgcaagagauauauccgucaagauuuuugaagacuucgcccagucuugguacuggauccugguggcucuugguguagcauugguucugagccuacucuuuauucugcuucugagguugguggccggcccucucguccugguguuaauccugggggugcucggaguccuugcuuacggcaucuauuacugcugggaggaguaucggguucugcgcgauaagggugccuccauuucacaauugggguucacuacaaaucuaagugcguaccagagcgugcaggaaaccuggcuggcagcccucauaguacuggcugugcuugaggccauccuguugcucaugcugauuuuucuuagacagaggauccggauagcaauugcucugcuaaaagaagccucuaaggcggucggacaaaugauguccacgauguucuauccacucgugacuuuuguucugcuuuugaucuguaucgccuacugggcaaugaccgcucuguaucucgccacaucaggccagccccaguacgugcugugggcuagcaacauuaguucuccuggcugcgagaaagucccaaucaauacuuccuguaaccccaccgcccaccuugugaauagcucgugcccggggcugaugugcguauuccaaggauacucuuccaaggguuugauucagcgcucaguuuucaaccuccagauauauggcgugcugggguuauuuuggacacugaauuggguccuagcacucggacagugugugcuggccggcgcuuucgcgaguuuuuacugggcauuccauaaaccucaagacauccccaccuuuccacuuauuagcgccuucauccgaacguugagauaucacacugguucccuggcuuuuggggcccucauccugacauuaguccagauugcaagggugauacuggaguacaucgaucauaaguuacggggcguucagaacccuguggcccguugcauuauguguugcuucaaguguugcuuguggugucucgaaaaauuuaucaaguuccugaaccgcaaugcuuauauuaugaucgccauauacgguaaaaacuuuugcguaucugcaaagaaugcguucaugcuacugaugagaaacaucgucagggugguugugcucgacaaagucaccgaccugcuuuuguuuuucggcaagcuguuagugguagggggaguggguguucucagcuucuuuuucuuuucaggccggauucccgggcugggaaaagauuucaagaguccacaccuuaauuauuacuggcugcccaucaugacuuccauuuugggcgcuuacgucaucgccagcggauuuuucucuguguuugggauguguguggacacacucuuccugugcuuucuagaggaucuggaacgaaacaauggcucacucgaccgcccuuauuacaugaguaagagccugcuuaaaauauugggaaagaaaaacgaggcaccaccggauaauaagaaaagaaagaaguga

SEQ ID NO: 62770 - RNA, 2169 nt, Artificial Sequence
  derived and/or modified sequence opt3 from SLC44A5__Homo_sapiens__XP_011539285
augggccugcaggcccucagcgagaagcccgcugacaccccuuccgaagaggaagauuucggggacccaagaacauacgauccggacuuuaaaggacccguggcaaacaggucuugcacugauguccuuuguugcaugaucuuccuguuguguauuauagguuauaucguuuuaggccugguggccuggguacacggggacccucggcgcgcggcuuacccaacggauucacaaggacauuuuugcggccagaaggguacccccaaugagaacaaaacaauucuauucuauuuuaaucuccugcgauguaccaguccuagcgugcuucugaacuugcagugcccaacuacacagaucugugucuccaagugccccgaaaaauuccucaccuacguggagaugcaacugcuguauacuaaggacaagucuuacugggaggauuaucgucaguuuuguaaaacaaccgccaagccuguuaaaucgcucacgcaguuacugcuugacgaugacugcccaacugcaauuuucccgucaaagcccuuuuugcagagauguuucccugauuuuagcaccaaaaaugggacacugacuaucggaaguaagaugauguuccaagacggcaacggcgggaccagguccguggucgaacuaggaauagccgcuaaugguaucaacaagcuccuggacgcaaaaucucuuggccugaagguguuugaggauuacgcccggacaugguacuggauuuugaucgggcucaccauugcuaugguacugagcuggaucuucuuaauacugcuccgcuucauugccggaugccuguuuuggguuuucaugaucggcgugauugguaucaucggguauggaauuuggcacugcuaccagcaguauacgaaucuucaggaaagaccauccucagucuugacuauauacgacaucggcauucaaacaaacaucaguauguauuuugagcuacagcagaccugguucacuuuuaugauaauucuguguaucaucgaggugauugugauccucaugcugauuuuccuuaggaaucggauacgcgucgcgaucauucuguugaaagaaggcagcaaggcaaucggguacguucccucuacacucguguauccugcccugaccuuuaucuuacuguccauuugcauauguuacuggguagugacggcugucuuccuagccaccucaggagugccaguuuacaaagugaucgcacccgguggccauugcauucacgagaaccaaacaugugauccggaaaucuuuaauacuaccgagauugcuaaggccugcccuggggcgcucuguaacuucgccuuuuauggaggcaaaagccuguaccaucaguauauccccacauuccacgucuacaaucuuuuuguguucuuguggcugauaaacuucguaaucgcacucggucagugcgcucuggccggggcuuuugccacuuauuacugggcaaugaagaagccagacgauauuccucgauauccccuuuucaccgccuuuggcagagcuaucagguaccacacaggaagucuggcguucggcucuuugauuaucgcacucauacagauguuuaaaauuguucuggaauacuuagaccaucggcugaagcguacccaaaacacucuauccaaauuccuccaguguugccugcgcuguugcuuuuggugccuugagaaugccaucaaguucuugaacagaaaugcuuauauuaugaucgccauauacgggaggaacuuuugucggagcgcaaaagaugccuucaaucugcucaugcgaaacgugcugaaggucgcugugacggacgaggucacauauuuuguguuauuccugggaaaacuuuugguugccgguucgaucggcgugcucgcauuucuguucuucacccagcgccuaccaguaauugcgcaggggcccgcuucucugaauuacuauugggucccucuccugacugugaucuuuggauccuaccuuauugcccacggcuucuuuucaguuuaugcaaugugcguggaaaccaucuucauauguuuuugcgaggauuuggaaagaaacgacgguaguacagagaagccauacuucgucaccccgaaucugcaugggauuuuaaucaagaaacaacucgugccccagaagcagaaagaauga

SEQ ID NO: 62771 - RNA, 1383 nt, Artificial Sequence
  derived and/or modified sequence opt3 from SLC45A2__Homo_sapiens__NP_001012527
augggcagcaacuccgggcaggccggaagacacaucuacaagucucuggcugacgauggucccuucgacucaguggagccuccaaaaaggccgaccagucggcucauuaugcauagcauggcaauguuuggccgcgaguucugcuaugccgucgaagcggcuuacguuacacccgugcuucuguccguaggguugccuucuucguuauauucaauagugugguuucugagcccaauccuaggauuccuccugcaacccgucgugggcagugccuccgaucacugucgaucucguugggguagaaggcggccuuacauucuuacucuggggguuaugauguuggugggaauggcacucuaucugaauggcgccacggucguggcugcacugaucgccaacccacgcagaaagcucguaugggcuauuagcguuaccaugaucggcguggucuuauuugacuucgccgcggauuuuauagacgggcccaucaaagcauaccuguucgaugugugcucccaucaggacaaggaaaaaggacuucacuaucaugccuuguuuacagguuucggcggggcucugggauaccuacucggcgccauugauugggcacaccuggagcuugguaggcuguuggggacugaauuucaggugauguucuuuuucucagcucucguccugaccuuauguuucacaguucaccugugcaguaucagcgaggccccucucaccgagguggcgaaggggauuccaccgcagcaaacuccccaggacccuccacuuucuuccgauggcauguacgaauauggcucaaucgagaagguaaagaauggguacgugaaccccgaacuggccaugcagggagcaaagaauaaaaaccaugcugagcagacacggcgcgccaugaccuugaaaagccuacugcgagcucucgucaauaugccuccacacuauagauaccuguguauaagucaucuuauugguuggacggccuuucugucuaacauguuguucuuuacugacuucaugggccaaaucguguauaggggagaucccuacuccgcacacaauagcaccgaguuucucauuuaugaacggggaguugaggugggcugcugggguuucuguaucaacucggucuuuucuucccuguacucauacuuccagaaaguguuaguaaguuauaucgggcugaagggccuauacuuuacaggauaucuccuguucggccuugggacuggauuuauugguuuguucccgaauguuuacagcacccuggugcucugcucccuguuuggcgucaugucuagcacacuuuauaccgugccuuucaaccugauaacggaauaccaccgugaggaagagaaggaggucuguugccauuga

SEQ ID NO: 62772 - RNA, 1662 nt, Artificial Sequence
  derived and/or modified sequence opt3 from SLC45A3__Homo_sapiens__NP_149093
auggugcagagacugugggucagcaggcuccuucggcaccgcaaggcccaacuguuguuaguuaaccugcuaaccuucggccucgaggugugccuggcugcagggaucacauacguacccccucuucuguuggaagugggagucgaggaaaaauuuaugacuauggugcucgguauuggcccaguucuggggcuggugugugucccgcucuuaggauccgccucugaccauuggcgaggccguuaugguagaaggcggcccuucauaugggcgcugucacuugggaucuugcugagucuauuucucauuccucgcgcuggauggcuggccggccuucugugcccagaucccagaccuuuggagcucgcacuguuaauccugggcguggggcuccuugacuucuguggacagguaugcuuuacgccacuggaagccuugcuaagcgaucuguucagggaccccgaucacugucggcaggcuuacuccguuuaugcauuuaugauuucucucgguggcugccugggguaccuucugccugccaucgacugggauaccucggcuuuggccccauaucucggaacacaggaggagugucuguucggcuuacugacucuaauauuuuugaccugcguggcggcaacacugcuugucgccgaagaggcugccuuggguccgaccgaacccgcagaggggcugucagcuccuagccucaguccacauuguugccccugucgcgcccgacuggcguucagaaaucuuggagcccuguugccuaggcuccaccaacugugcugccggaugccacguacuuuacgcagacuguuuguggcagagcuauguuccuggauggcucucaugacauucacccuguuuuacacggacuucgugggcgaaggccuuuaucaggggguccccagggccgagccgggaacugaagcucggcgacauuacgaugaggguguucgcaugggcucuuuggggcuguuccuccagugcgccaucagccugguguuuuccuuaguaauggacagacuggugcagagguucggaacccgggcagucuaccuugccucaguggcugcguuuccuguugcagccggcgcuacauguuugagucacagcguggccgucgugacugcaucugccgcucucaccgguuucacauuuuccgcccugcaaauucuacccuauacccuggcaucacucuaccaccgcgaaaagcagguauuccugccaaaauauagaggggauacgggcggagcgagcagugaggacucucuuaugacuuccuuuuugccuggccccaagccaggggcucccuucccuaacggacauguuggugccggcgggagcggacuguuaccaccgcccccugcacucugcggcgccucggcuugugaugugucugucaggguggucgugggugagccaacagaagcccguguugugcccgggcggggcaucugccuggaccuugcaauucuggacuccgcuuuucuccucucacagguagccccuagucuguucaugggaagcaucguccagcuaucccaaucugugaccgcguacaugguuagcgccgcuggccuggggcucguggcaauauauuuugccacucaggucguguucgauaaaucagaccuggcuaaguacagugccuga

SEQ ID NO: 62773 - RNA, 2397 nt, Artificial Sequence
  derived and/or modified sequence opt3 from SLC45A4__Homo_sapiens__NP_001073900
augggcaaggccagccccgcuuccgggcugucuagaccuaaaacccucgugucaccacuuaggaguaaccaguggagccugcaaaagggauugccggagcaguacuauuccuuaacaugguuccugucucccauccuaggucucauuuuuacuccucugauaggcucggcaucagaccggugcacgcuuagcugggggcgccgacguccauucauccuggccuugugugucggaguucucuuuggcguggcgcuguuccugaaugguagugcuauugggcucgccuuaggagauguacccaacagacagccuaucggcauugugcugaccguccuuggcgugguuguguuggacuuuuccgcagaugccacagaagggccaaucagggcuuaccugcuagacgucguggauucugaggaacaggacauggcacucaauauacacgccuucagcgcuggacuggguggcgccaucggguauguacuuggaggccuggauuggacucaaaccuuuuuggguuccugguuccggacacagaaccagguucucuuuuucuuugcggcaauuaucuucaccgugucagucgcccugcauuuauuuaguauugacgaggaacaguacagcccccaacaggagcgcucugcugaggaaccuggggcccuggauggaggcgagccacacggcgugccggcauuccccgacgaagugcaguccgagcaugagcucgcucuugauuauccugacgucgauaucaugagaucaaaaagcgacagugcccugcacguuccagacacugcguuggaucuagaacccgagcugcuguuccugcaugacauagaaccuucuauuuuucacgaugccuccuacccagcaacacccaggagcaccucgcaggagcuugcuaagacgaaacugccgcgguuggccacuuuccucaaggaagcugccaaggaggacgagacccuguuagauaaucaccugaacgaagcaaaagugccuaaugggucuggaucccccacaaaggacgcccuagguggcuauacucgcguagauaccaaaccaucagcuacaaguagcuccaugcgaagaaggcggcaugcguuucgucgccaagcaucuagcaccuucucauacuacgggaagcucggaagucacugcuauagauacaggcgggccaacgcugugguccugaucaaaccuucccgaagcaugucugaccuuuaugauaugcagaagcgccagagacaacauaggcaccggaaucagucaggcgccacgacaaguagcggugacacugaguccgaagagggggaaggcgagaccacugugcgcuugcuguggcucucuaugcugaagaugcccagagagcuuaugaggcuguguuugugccaccuccugacaugguuuucgguuauugcagaagccguguucuacaccgauuuuaugggacaggucaucuucgagggcgacccaaaagcucccagcaacuccacggccuggcaggcauauaaugcgggggugaagaugggauguugggguuuaguaaucuacgcugccaccggcgcaauuugcucagcccugcuacaaaaauaucucgacaacuacgaucugaguguucgugugauauacguccuugggacauugggauuuucugugggcacugcugucauggccauguucccuaauguguauguugcaauggugaccaucagcacaauggguauuguauccaugucaaucagcuacuguccauaugcucugcucgggcaguaccaugacauaaagcaguauauucaccauucuccgggcaacuccaaacggggauuuggcaucgauugcgccauccugaguugucaggucuacauuagccaaaucuuaguggcgucugcccucgggggaguuguggacgcugucgguacugugcgaguaauucccaugguggcauccguuggcucauuccuuggguuuuugaccgccacauuccucgucauauauccuaaugugagugaagaggcuaaggaggaacagaaaggacugagcucgccacuagccggcgaggguagagcagggggcaacuccgaaaagcccaccgugcugaagcucacuaggaaagagggacugcagggcccugucgaaacggagcgccuucagguuuugacaucugugcggagcagacacaucggguggugcaggucauguuggcgcguguucuuuuucaugauuauccuggagaagaaauuuaguuucccacaaugcggauccuuacgacggaugaccuaccuccuguuucuuucugaacuggauacuuugugccccggccagccguguccuugggcggccaccgcucaucagagcugggaggaagccgguccagggggacucggccguagacaguga

SEQ ID NO: 62774 - RNA, 1296 nt, Artificial Sequence
  derived and/or modified sequence opt3 from SLC46A1__Homo_sapiens__NP_001229295
auggagggcagcgccucucccccugaaaagccaagagcuaggccggcagccgcggugcugugccgggggcccgucgagccucucguuuuccuugcuaacuuugcccugguguugcagggaccauuaaccacacaauaccuguggcaccgcuucuccgcagaccuagguuauaauggcacucgacagcgugggggauguucaaacagaagugccgaucccacgaugcaggaaguagagacccucacaagccauuggacucuguacaugaaugugggcgguuuucuugucgggcuguucuccucuaccuugcucggagcuuggucggacucagugggcaggcggccucugcugguucucgcgagcuuaggccugcuuuugcaggcccuggugagugucuuugugguacaacuacagcuccacguuggguauuucgugcugggacgcauccuuugcgcucuguugggugauuuuggcgggcuccuggccgcguccuucgcaucugucgccgacgugagcuccucaagaaguaggacauuucggauggcuuuacuggaagccagcauuggaguggcaggcaugcucgcuucucuucugggugggcauugguugcgcgcccagggauacgcgaacccauucuggcuagcccuggcacuccugauagcuaugacccuuuaugccgcuuuuuguuucggcgagacucugaaagagcccaaguccacacgauuguuuaccuucagacaccauaggucaaucguccagcucuacguugccccugcaccagagaaaagccggaagcaccuggccuuauauagucuggcuauuuucgugguaaucacggugcacuuuggcgcgcaagauauucuaacucucuacgaacugucuaccccgcuuugcugggacuccaaauugaucggguacggaagcgcagcccagcaucugcccuaucucacaucgcugcuugcucugaaguugcuccaguacugucuggccgaugcaugggucgccgaaauagguuuagcuuucaauauccugggcauggugguuuuugccuucgcaacuauuaccccucuaauguuuacaggggcacucuucucugcuguggccugcgucaacucccuggcaaugcuuaccgccucaggaaucuuuaauaguuuguauccagcuacgcugaacuucaugaagggcuuucccuuccuccugggugccggguuacugcuuauuccugcaguguugaucggcaugcucgagaaagcugacccacaccuggaguuucagcaauucccccagagcccguga

SEQ ID NO: 62775 - RNA, 1428 nt, Artificial Sequence
  derived and/or modified sequence opt3 from SLC46A2__Homo_sapiens__NP_149040
augagccccgaggugaccugcccuagaaggggccaucugccacgguuccacccgcgcacaugggucgaacccguuguggccuccucucagguagcugcaucacucuacgacgccgggcuucuguugguggucaaggcgaguuauggaacugguggcagcuccaaccacucugcuucgccuucaccacgaggggccuuagaggaucaacagcagcgugcaaucagcaauuuuuacauuauauauaaccuggugguuggacuaaguccccuccuguccgccuacggccuugguuggcugucugacagauaucauaggaaaaucagcauuuguauguccuugcucggguuccugcugucacggcucggauuacugcuuaagguguugcuggauuggccugucgaagugcuauacggcgcugcagcccucaauggccuguuugggggauucagugcuuuuuggagcgguguaauggcccuuggcucucugggguccucagagggacgcagaagcguuagguugauccucauugaccugauguuaggccuggcggguuucugcgggaguauggcaucuggacaccucuuuaaacagauggccggccauuccggccaagggcuuauccugacggcuuguagcgugucgugcgccucuuucgcauugcuauauucccugcucguccugaaggugccagaaucaguggcuaaacccagucaggagcuuccugccgucgauaccguuagcggaacaguggguacuuaccggacccuggacccagaucaguuggaccagcaauacgcgguaggccacccgcccuccccugggaaggccaagccacacaaaacaaccauagcacuccuguuugugggagcuaucauuuaugauuuagccgucgugggcacuguugacgugaucccccuguucguccuacgcgagccucucgguuggaaccaggugcagguaggguacggcauggcugccggauauacaauuuuuaucaccucuuuccugggcguucuuguguuuagccgauguuucagagauacgacuaugauaaugauugggauggucucauucggaaguggugcauugcugcucgccuuugugaaggaaaccuacauguucuauaucgcuagggcggucaugcuguuugcacuuauuccagugacaacuauccgguccgccaugagcaaacugaucaaggggucuucauacggcaaaguuuucgugauuuugcagcucagucuggcuuuaaccggaguagucacaagcacccuguauaauaagauauaccaacuaacgauggacauguuugugggcuccugcuucgcccucucuucguuucugagcuuccuugcaaucauucccaucuccauaguugccuacaaacaggugccguugucaccuuauggugauauuaucgagaaguga

SEQ ID NO: 62776 - RNA, 1713 nt, Artificial Sequence
  derived and/or modified sequence opt3 from SLC47A1__Homo_sapiens__NP_060712
auggaggcccccgaagaaccugcuccagugagaggcgggccggaagcaacccuggaggucaggggaagccggugccuccgccuuuccgccuuccgagaggagcugcgugcguuguuaguucuggcuggucccgccuuucuagugcagcucaugguauuccugaucucuuuuauuucaaguguguucuguggccaccuugggaagcuggaguuggacgcagucacacucgccauagcugugaucaacguuacuggagugagcgucggcuuuggucuguccucugcaugcgauacgcugauuucgcaaaccuacgggucacagaaucucaaacaugugggaguaaucuuacagagaagcgcccugguucuuuugcuguguugcuucccuuguugggcucuauuucucaacacacagcacauucugcuucuguucaggcaagacccagaugugagucgguugacucagaccuaugucacaaucuuuauacccgcccucccugcgaccuuccuguacauguuacaggugaaguaucugcucaaucagggcaucgugcuuccacaaauugucacuggcguugcagccaaccuggugaaugcuuuggccaacuaccuauuucugcaucagcuccaccuggggguaaucggauccgcacuugcuaaucugauuucucaguauacauuggcccuccuguuauuccuguacauccuagguaaaaagcuccaucaggcgaccuggggcggguggagccuggaaugccuucaagacugggccuccuuuuugcgccuggcaauacccucaaugcucaugcuguguauggaguggugggcuuaugaagugggaaguuuccuuagcggcauucuggguauggucgaguugggggcccagucuaucguguacgagcucgcuauuaucguuuacauggugccugccggauucuccgucgcagccucagugagaguaggcaacgcucugggcgcgggggauauggaacaggcaaggaaaagcaguacgguuucuuuacugaucacugugcuauuugccgucgcuuucuccgugcuccugcuuagcugcaaggaccacgucggauauauuuuuaccacagaucgggacauaaucaauuugguggcccaaguugugccaauuuacgcaguaucgcaccuguucgaggcccucgcuuguacuucugguggcguccugcgcggguccggaaaccagaaggugggcgccaucguuaauaccauagguuauuacguggucggguuaccgauuggcaucgcacugauguuugcgacaacccuuggagugaugggcuuguggucagggaucauuaucugcacgguauuccaggcuguguguuuucucggauucauuauacagcugaacuggaaaaaggccugccaacaggcacagguucaugccaaucuaaaagucaacaaugugccccgaagugguaacagcgcucugccucaggauccacuccaccccggcugcccugaaaaccuggaggggauccuuacuaaugacgugggaaagacaggcgaaccacaauccgaucagcagaugagacaggaggagcccuugccggaacauccucaagacggugccaaacugucuaggaagcaguuaguccuccggcgugggcugcuucuguugggcguuuuucucauucugcuagugggaauccuggugcgcuucuauguaagaauccaguga

SEQ ID NO: 62777 - RNA, 441 nt, Artificial Sequence
  derived and/or modified sequence opt3 from SLC48A1__Homo_sapiens__NP_060312
auggcccccagcagacugcagcucggccuuagggcugcauacuccgggaucucuucaguggccggauucaguauuuuucuggucuggaccguuguguaucggcaaccugguacagcggcuaugggcggguuggccggaguauuagcacugugggugcuagucacucacgugauguacaugcaggacuauuggcgcacguggcucaagggccugcgagguuucuuuuucguuggggugcuuuuuagcgccgucuccauagcugcauucugcaccuuucugguguuggccaucacacgucaucagucucucacugauccaaccucguacuaucugucaagcguauggaguuucauuuccuuuaaaugggcuuuccugcucucuuuauacgcccacagauauagggcggacuuugcagauaucagcauucuguccgacuucuga

SEQ ID NO: 62778 - RNA, 3357 nt, Artificial Sequence
  derived and/or modified sequence opt3 from SLC4A10__Homo_sapiens__NP_001171486
auggagaucaaggaccagggcgcccaaauggaaccccugcucccuaccagaaacgaugaggaagcuguggucgacaggggagggacacggagcauucuuaaaacucacuucgagaaggaagaucuggagggucaucgcacguuguuuauaggcguucacgugccauuagggggacgaaaaucccaucguagacacaggcaucggggccacaagcaccgcaaaagagacagggagcgggauucuggucuggaagacgggcgcgagucaccgaguuucgauacccccagccagcgaguacaguuuauccuaggaacagaagacgaugacgaggagcauauuccucacgaucucuucacugaacuggacgagaucugcuggagagaaggcgaggaugcagaauggagggagaccgcccgguggcuuaaguuugaggaagacguggaggacggcggggaacguugguccaagccauacgucgcgacacugucuuugcauucacucuucgagcugcgcucguguauucugaauggaaccgugcucuuagauaugcacgcuaacacucuggaagagaucgccgacaugguucuugaucagcaagugagcaguggucaguugaaugaggacgucagacacagggugcaugaagcacugaugaaacagcaccaucaccagaaccaaaagaaacuaacaaaucggauacccaucguacgauccuuugccgauauuggcaagaaacagucugagccuaacagcauggacaagaaugcugggcagguuguguccccacagucagcacccgccugcgucgaaaacaagaaugaugugagucgcgagaacagcaccguggacuucucuaaaggacucggcggucaacagaaggggcauacguccccuuguggaaugaaacagagacacgaaaagggcccaccgcaccaacaggagagggaggucgaucugcauuuuaugaaaaagauucccccuggcgcugaagccucaaauauccuuguuggggagcuggaguucuuggaccggacugugguagcguuugugcgccucagcccagcaguccuguuacagggacuggccgaagugcccaucccuaccagauuccucuuuauacuucuggguccauugggcaaagggcagcaauaucacgagauuggaaggaguaucgcuacacuaaugacugaugaaguuuuccaugacguggccuacaaggcaaaggaccguaacgaucuggucucuggcauugacgaguuccucgaucaggugaccguacugcccccgggugaaugggacccuuccauccggaucgagcccccuaaaaauguuccaagccaggaaaagcgaaaaauucccgcugugccaaacgggacagccgcgcacggcgaggccgagccccacggaggccauucggggccugaacuucagagaaccggaaggauauuugguggccugaucuuggauauuaagcgcaaagcaccauauuucuggucugacuuucgggaugcuuucucccuccaaugccuggccucauuuuuauuccuguacugugcuugcaugaguccggucaucacguuugggggacuacucggcgaggccacugaagguagaauaagcgcaauugagucccuguucggggccucuaugacaggcaucgcuuauagccuuuuuggaggccagcccuugaccauccuggggucaacuggaccugugcucgucuucgaaaagauucuguuuaaguucuguaaagaguacggucuuaguuaucuguccuugagggcgagcaucggccucuggacagcaacccugugcauuauauuaguggccacggacgcuucuucacugguuuguuacaucacccgcuuuacagaggaagccuucgcaagucuaauuugcaucaucuucauuuacgaggcccucgaaaagcuguuugagcuuagcgaggcuuauccaauaaauaugcacaacgauuuggaacugcucacucaguacuccuguaacugcguggagccccauaauccuucuaacgggacccugaaagaauggcgagagucgaauaucagcgccuccgacauuaucugggaaaacuuaacaguaucagagugcaagagucugcacggagaguaugucggccgggcauguggucaugaucacccauacgugcccgacguucuuuucuggucugugauuuuguuuuucagcacugucacccucuccgcgacacugaaacaguuuaagaccucacguuauuucccgacuaaggugagaagcaucguaucugauuuugcuguguuccuaacgauacugugcaugguucucaucgacuacgccauugggaucccuuccccaaaacugcaaguccccaguguguuuaagccuacaagggacgaucgcggcugguucgugacuccccuuggaccaaauccuugguggaccgucauugcagccaucauacccgcuuugcuguguaccauuuuaaucuuuauggaccagcagauuacagccguuaucauaaaccggaaagaacacaagcucaaaaagggcugcggguaucaucuggaucuucugaugguggcagugauguugggaguauguagcaucaugggccucccaugguucgucgcugccaccgugcugucuauuacucacguuaauucccuaaagcuggagucagaaugcagugcgccgggugagcagccuaaauuucucgggaucagagaacaaagggugacaggacugaugauuuucauccuuaugggcagcucggucuucaugacguccauauugaaguuuauucccaugccagugcuguacgguguuuucuuauacaugggcgccucuagccucaaagggauccaguuuuucgaccgaaucaagcuguuuuggaugcccgcuaaacaucagccugauuucauuuaucuucgccacgugccacugcggaagguacaucuauuuaccaucauucaaaugucaugucucggacuguuguggauaaucaaagucaguagagcagccauuguguuccccaugauggugcuggcuuuagucuuuguuaggaagcucauggaccugcuuuucacuaagcgugagcuguccugguuggaugaccucaugccugagucuaaaaagaaaaagcuggaagaugccgagaaagaagaggaacagagcaugcuagcaauggaggacgagggcacagugcagcugccgcuugaagggcacuaccgcgaugacccauccguaaucaacauuucagaugagaugagcaagaccgcgcucuggcggaaucuguugaucacagccgacaacaguaaggacaaagaaucuuccuuucccagcaagucgucaccuucuuga

SEQ ID NO: 62779 - RNA, 2628 nt, Artificial Sequence
  derived and/or modified sequence opt3 from SLC4A11__Homo_sapiens__NP_001167560
auggccgcugcaaccagaaggguguuccaucugcagcccugcgagaacagcccuacaaugucccaaaauggcuacuuugaagacucuucauauuacaagugugauacugacgauacguucgaggcccgggaagagauccucggggacgaagcguuugauaccgcuaacaguagcauugucuccggagagucuauacgcuucuuuguuaaugugaaccuugagaugcaggccacaaauacugaaaacgaggcaaccucggguggcugcguacuguugcacacaucacgaaaauauuuaaagcugaaaaauuucaaggaagagauccgugcccacagagaccuagauggguuucucgcucaggcaagcauugugcugaacgagaccgccacuucccuugacaauguccugaggacaauguugcggcgcuucgcuagagauccagacaacaaugaaccgaacuguaaucucgaucugcugauggccaugcucuuuaccgacgcgggagcacccaugaggggcaaagugcauuuacuguccgauacgauccaggguguuacugccaccgugacagggguccgguaccaacagucuuggcuuugcauuaucuguacuaugaaggcuuugcagaagcgccacgugugcauaagccgacugguaagaccucagaacuggggagaaaauuccugugaaguuagguucgugauccuaguccucgccccacccaaaaugaagucaaccaaaacagcaauggagguggcucggaccuuugccacgauguucagugacauugcguuucgucaaaagcugcuugaaacucgcacagaggaggaguucaaagaggcccuggugcaucagagacaguugcucaccauggucagccacggcccuguugcaccaaggacuaaggaacggucuacagugucccugcccgcucaccgacauccugagccaccgaagugcaaagacuucguacccuuuggcaaggggauccgcgaagauauugccagaagguucccuuuauauccacuggacuuuaccgauggaaucauagguaaaaacaaggcugugggcaaauacauuacgaccacacucuuccuuuauuuugccugucuguugcccacuaucgcauucgggucacuaaacgacgagaauaccgauggagccauugacguccagaagacaaucgcuggccaaagcaucggugggcugcucuacgcgcuguuuaguggacagccucuugugauucuguugacuaccgcaccacucgcccuguacauacagguuauccgggugauuugcgaugacuaugauuuagacuucaacucuuuuuacgcuuggacaggccuguggaauaguuucuuucuagcccucuaugcauucuuuaaccugagccuugucaugucguuguucaaacgcucuaccgaggaaaucauagcccuguucauuuccaucacuuuugugcucgaugcuguaaagggcacgguuaagaucuucuggaaauacuauuacgggcacuaucuggacgacuaccauacaaagagaaccucaagucuugugagccuguccggauugggugccucucucaaugcaagccugcacacugcguuaaacgcuucauuucuggccagucccaccgagcuaccguccgcaacacacagcggccaagccaccgcuguccucucucugcuuauuauguuggggacucuguggcucggauacacacuguaucaguucaaaaagucaccuuacuuacaucccugugugagggaaauccugagugauugcgcccuuccaauugcagucuuggcuuuuagccucauauccucucacggcuuccgugagaucgaaaugucgaaauuucgguauaauccuagcgagucccccuucgccauggcgcagauucagucacugagucuacgagccgugucuggugcuauggggcugggcuuucuccugagcaugcuuuucuuuaucgagcaaaacuugguugcagcccuggugaaugcuccagaaaacagauuaguaaagggaacggccuaccauugggaccuccugcuucuggcaaucauuaauaccggcuugucccucuucgggcugcccuggauacacgcggccuauccucauucaccacuacacgucagggcucuggcccucguggaggaacgcguugagaacggacacaucuacgauacuauugugaaugucaaggagacacggcugaccagccuuggugcaucuguguugguaggccuguccuuacuccugcuuccggugccccugcaguggaucccuaaaccaguucuauaugggcucuuucuguacauugcuuugacaagucuggacggaaaccaguuaguccagagaguggcccuccugcuuaaggaacaaacugcauaucccccuacccauuacaucaggcgcgugccacagcgaaaaauacacuacuucacgggccugcaggucuugcagcuccugcuacugugcgccuucgguaugagcucucuucccuauaugaagaugaucuuuccgcucauuaugaucgcuaugauuccuauccgguacauacuguugccacguauuaucgaggcgaaauaucuggauguuauggacgccgaacauagacccuga

SEQ ID NO: 62780 - RNA, 2391 nt, Artificial Sequence
  derived and/or modified sequence opt3 from SLC4A1AP__Homo_sapiens__NP_060628
augcuggcuccccucagaaacgccccuggcagggagggggcaaccagcccauccccgcccacagacgccacuggaucucuuggugaaugggauguggaccggaaugucaagacggagggcuggguuucaaaagaacgcaucaguaagcugcaccgauugcguauggcggauauuuuaagccaguccgagacccuggcuucucaagaccuaucgggggauuucaaaaagccugcccucccagugucacccgcagccagaagcaaagcuccugcaaguuccucuagcaacccagaagagguacagaaggagggacccacagcccugcaggacuccaauucaggcgaaccugauauaccaccgccccagccugacugcggugauuuuaggagucuucaagaggaacagagccggccacccacugcugugucuuccccugggggaccagcccgcgcgcccccguaccaggagccucccuggggcggcccagcaaccgccccuuauucacuggagacauugaaagggggaaccauccucgguacuagaagccugaaaggcacaaguuacugucuguucgggaggcucucuggaugcgacgucuguuuagaacaucccuccgugagccgguaucacgcuguucugcagcaucgcgccucgggcccagauggugagugcgacucuaacgggcccggauuuuaccuuuaugauuugggcuccacccacggcacguuccugaauaagacucgaaucccuccaagaaccuacuguagggugcaugucgggcacgugguacgguuuggagguucaacacgucuauucauucuccaaggcccggaagaggaccgcgaagcagagagugagcugacuguuacccagcuuaaagaacugagaaagcagcagcaaauuuugcucgagaaaaagaugcugggggaagacagcgaugaggaagaggagauggacacauccgaaaggaagaucaacgcuggaucucaggaugacgagaugggcugcaccugggguaugggggaagaugccguggaggacgaugcggaagagaaucccauagucuuagaguuucagcaagaacgggaggccuucuauaucaaagacccuaagaaagcacugcagggcuuuuucgaucgagaaggagaggagcucgaauacgaguuugacgaacagggccacagcacguggcuuugucgcgugagacugccaguggaugacucaacugggaagcaguuggucgcugaggccauucauaguggaaagaagaaagaagcuaugauccaaugcucccuagaggccuguaggauucuggacacacucggucugcuucggcaggaggcaguuagccgcaagagaaaggccaaaaacugggaagaugaggacuucuacgauucugacgaugacaccuuucuggauaggacuggcuugaucgaaaagaaacgucucaaucggaugaagaaagcugggaagauagacgagaagcccgaaacauucgagucacugguggcgaaauuaaacgaugcagagcgagaacugagugagauuagcgaaagacuaaaggccuccucucagguacucucggagagcccuucccaggacucacuggaugcuuucaugagugaaaugaaaucuggaagcacccuugacggcguguccaggaagaaauugcaucugcgcacguuugagcuccggaaggagcaacagagacugaagggucuuaucaaaauugucaagccagccgaaauccccgagcugaaaaagaccgaaacacagacuaccggggcagagaauaaagccaagaaguugacacucccgcuguucggcgcuaugaaaggaggcucaaaguuuaaauuaaagacugggaccgugggaaaacugccuccaaagaggcccgagcuaccucccacacucaugcgcaugaaagaugaaccagagguugaagaggaagaggaggaagaggaagaggaagagaaggagaaggaagaacacgagaaaaagaaacuggaggacgguagccuuucucgaccucagcccgaaaucgagccagaggccgcagugcaagaaaugcggccgccuaccgacuugacucacuucaaggagacgcagacacacgaaaacaugucccagcugagugaggaggaacagaauaaagauuaucaagacugcagcaagaccacuucucucugugcgggccccuccgcuucaaagaacgaguacgagaaaagucguggggaacugaagaaaaagaaaaccccaggacccggcaaguuaccuccaacacugagcucgaaguaucccgaagaugacccugauuacugcgucugggugccgccagagggucaguccggggacggcagaacccaucuuaaugauaaauauggauacuga

SEQ ID NO: 62781 - RNA, 2736 nt, Artificial Sequence
  derived and/or modified sequence opt3 from SLC4A1__Homo_sapiens__NP_000333
auggaggaacugcaggacgauuacgaggacaugauggaagagaaccucgaacaagaggaguaugaagaucccgacaucccugagagccagauggaggaaccagccgcucacgauaccgaggcaacagccacugacuaccauacgaccucccacccgggcacacauaagguguaugucgaacuucaggagcugguuauggaugaaaagaaucaggaguugagauggauggaagcggcuaggugggugcaauuagaggagaaccugggggaaaauggagccuggggucggccccaccuaucucaucucacuuucuggucacugcuugagcugcgccgaguauuuaccaagggcacaguguugcucgaccugcaggaaaccagucuggcaggggucgccaaccagcucuuagaucguuucauuuuugaggaccagauaagaccucaagauagggaggaacugcuucgggcuuugcugcuaaaacacagccacgcaggagagcucgaagcccugggcggugugaagccagcuguucuuacucgcuccggggaccccucucagccucuguugccacagcauucgucacucgagacacagcuguucugcgaacaaggagauggcggcaccgaggggcacagccccaguggaaucuuagagaaaauuccuccagacuccgaagccacgcuggugcucgucgguagagcggacuuucuugagcagccggugcugggcuucguaagguugcaggaagcagccgagcuagaagcuguugagcugcccgugccuauccgguuucucuucguccugcuugggccagaggcaccccauauugauuacacucaacugggacgcgccgcugccaccuugaugucugaacgaguguuuagaaucgacgcguauauggcccagagcaggggcgagcuccugcacuccuuagaagguuuccuggauuguagccuagugcucccuccaacagacgcacccagugagcaggcucugcuuagcuuggucccgguucagcgggaacugcuccgucgcagauaccaaucuuccccugccaagcccgauucaucauuuuauaaggggcuggaccuuaauggaggcccagaugacccucugcagcagacuggccaguuguucgggggacucgugagggauauacggcgacgcuaccccuacuaucugagugacaucaccgaugcuuuuucuccacaaguauuagccgcagugauuuucaucuacuucgccgcucugucccccgcgauuacauuugguggccuacucggggagaaaaccagaaaccagaugggagucagcgagcugcuuaucucgacggcagugcagggcauauuguucgcccugcucggugcucagccucuguuaguugugggguuuucuggcccacugcuugucuucgaagaggccuuuuucuccuuuugcgaaacuaauggauuggaguauauugugggcaggguauggaucggguucuggcucauucugcuaguugugcuggucguggcauuugaaggaucauuccucguccgguuuaucagucgcuacacacaagagaucuucagcuuucugauuucccuuauauucaucuaugagaccuucucuaaguugauuaaaaucuuucaggaccacccgcugcagaagacuuacaacuauaauguguuaaugguucccaaaccucaggguccacuccccaacacagcccugcuuagccugguguugauggcuggcaccuucuuuuucgccaugaugcucagaaaguuuaaaaauucaaguuacuucccugggaaacugaggcguguaauaggagacuuuggcgucccaauuuccauccuaaucauggugcugguugauuucuuuauucaagacacguacacccagaagcucagcgugcccgaugguuucaaagucucuaacucaagugcacgggggugggugauccauccgcugggccuucgaagcgaauuuccuauuuggaugauguucgcguccgcuuugccagcccuguuaguauuuauacucaucuuccuggagucucagauuacaacucuuaucgugucgaagcccgaaagaaaaaugguuaagggaagcggcuuccaccuggaccuacuccuggucguggggaugggagguguggcagccuuguuuggcaugccuuggcuguccgcuaccacagucaggucaguuacucaugccaaugcauuaaccgugauggggaaagcuaguacacccggagccgcggcccaaauccaggaggugaaggaacagcgcauuucuggccuccugguagcuguccuugugggucugagcauauugauggagccaauccucucccggauuccucuggcaguucuauucgggaucuuucuguauaugggcgugaccucacuuagcggcauucaacucuucgauagaauccuguugcuguuuaagcccccaaaauaccacccggacgucccuuaugugaagaggguuaaaacuuggcgcaugcauuuauucacgggaauacagaucauuugucucgccgugcuguggguagucaagucuacacccgcuucccuugcccugccauuuguguugauccucaccgugccccugcgacggguccuacugccucuuauuuuccguaacguugagcuccagugccuggaugcagacgaugcgaaagccacuuuugacgaagaggaagggagagaugaguacgacgagguggcuaugccaguauga

SEQ ID NO: 62782 - RNA, 3699 nt, Artificial Sequence
  derived and/or modified sequence opt3 from SLC4A2__Homo_sapiens__NP_001186622
auggacuuccugcucagaccccagccugagccagaaagccuuggcccggggacccccggauuuccugagcaagaagaggaugaacugcacaggacauuggguguggagcgguucgaggaaaucuuacaggaggccggcucccgcgggggagaggaaccaggccgaucuuacggugaggaagacuuugaguaucaucgucagucaagucaccauauucaccauccccugagcacucaccuaccuccagaugcuagaaggcggaagacgccccaggggccuggacgcaaaccaagaaggcggccgggcgcaucccccaccggcgaaacaccuacuauagaggaaggggaggaggacgaagaugaggccucugaagcggagggagcucgcgcccucacccaaccaucgcccgucucaacaccuagcaguguucaguucuuucugcaggaagacgauuccgcagaccgaaaggccgagagaaccucuccaagcucccccgcuccgcuuccucaccaggaggcaacucccagggccucaaaaggugcucaagccggcacacagguggaagaggcggaagcagaggccguagcuguggccagugggaccgcaggaggcgaugacgguggggcuagcggacggccacugccuaaggcccagcccggccaucguucuuacaacuugcaggaacgcagaaggaucggcuccaugacgggggcggagcaagcccuccugccacggguccccacugaugagauugaagcacagacccuggcuacagccgaccucgauuuaaugaaaucacaccgauucgaggacgugccuggaguucgcagacaucuggugaggaagaaugcuaaggguagcacucagaguggccgggaagggcgcgagccaggaccgacccccagagccaggccucgugcaccacacaaaccccacgaggucuuuguggaacuuaacgaguugcugcuagacaagaaucaagaaccucaguggcgggagacagcccgauggaucaaauucgaagaggauguagaggaagagaccgaaagauggggcaagccacauguugcuucucucuccuuuaggagccugcuugagcugcgccggacguuggcgcacggugcagugcuccuggacuuagaucagcagacucugcccggggucgcccaucaagugguggaacagauggucauuucggaccagaucaaagcugaggauagagccaacguucucagggcacuucuguugaagcacucucauccguccgacgagaaggauuucucauuuccucgcaauauaagugccggcagccuaggaucccugcucggccaccaccaugggcagggagcugaaucugacccacacgugacagagccccugauggguggcguaccugaaacccgacuugagguggaacgggagcgugagcugcccccuccagcucccccagcagggaucacuagaagcaaaucaaagcaugaauugaaacuccuggagaagauuccggaaaacgcggaggcuacagucguguuaguuggaugcguggaguuccugaguaggccuaccauggccuuuguccgccuacgggaagcaguggagcucgaugccguacuggaaguucccgugccagucagauuccuuuucuugcugcucggccccuccagcgcuaauauggacuaucacgagaucgguaggucuauuucaacgcugaugagugauaaacaauuucacgaagccgcauaccuugcugacgagcgagaggaccuguugaccgccaucaacgcguuccucgauuguagcgugguccugccuccauccgaagugcagggggaggaauuacugcgcucuguugcccauuuucagcggcagaugcuaaagaaaagagaggaacaaggcaggcuccugcccacaggagcuggccuugagccuaagucggcacaggacaaggccuugcugcagaugguggaggcugccggggcagcggaagaugacccgcuccgucgcacuggacggccauucgguggccugauaagagauguaaggcgacgguauccccacuacuuaagcgacuuucgcgaugcccuggacccucagugccuugcugccgucauuuucaucuauuuugcagcuuuguccccagccauuaccuucgggggacuccugggcgagaaaacacaagaucuaaucggugugucagaacugaucaugaguacugcacuccaggggguuguguuuugucugcuuggcgcccagcccuugcuggucauuggauucucuggcccuuuacucguguuugaggaagccuucuuuagcuucugcuccucaaaucaucuggaguaccuuguagggagaguguggauaggauucuggcugguuuuucuugcgcuccugauggucgcccuagagggcagcuuccuggugagguuugugucucgguucacccaagaaaucuuugcauuccucauuucccugaucuuuauauacgagacauucuauaaguuggucaaaauuuuucaggaacacccguugcaugguuguagugcuagcaacucuuccgagguugacgggggagagaauaugaccugggccggcgcccgacccacucuggguccaggcaacagaucauuagcugggcagaguggacagggcaagccucgcgggcaacccaauacggcacuccugagccuugugcugauggccggaacauucuuuaucgcguucuuucuaaggaaauucaagaacucgcguuucuuuccaggccggaucagaagggugauuggugauuucgggguaccuaucgcuauucucauaaugguccugguggacuacuccaucgaagauaccuauacucagaaguugucuguucccagcggauuuucagugaccgccccagagaaacgcggcugggucauuaauccgcugggugaaaagaguccuuuccccguguggaugaugguugcauccuuacucccagccauccugguguuuauccuuauuuucauggagacacagauaaccacucugaucauuucuaaaaaggaacgaauguugcagaaaggcagcggguuucaccucgaccugcuacugaucguagcuaugggaggcauuugcgcacuuuucgggcuccccuggcuggccgcggcuacagucagauccgugacgcacgccaacgcauugaccgugaugucaaaggccgucgcuccuggagacaagccaaaaauccaagagguuaaggagcagcgggugacuggccuguuaguagcccuccuggugggucuuagcauagucaucggggaucuguugaggcagauuccccucgcagugcuguuuggaaucuuccuauacaugggcguuacaagucugaacgguauucaguuuuaugaacgccuucaucuccuguugaugccuccgaaacaccauccagacgugaccuacgucaagaaagugcguacauuaagaaugcaccuguucacugcucuccaacugcuuugucuggccuugcuaugggcgguuaugucuaccgccgcaucccuggcuuuccccuuuauccucauacugacggugccucuucggauggucguauuaaccaggauuuucacagaucgcgagaugaagugccuggacgccaaugaagcugagcccguguuugaugaacgagagggcguugacgaguauaacgaaaugccaaugccuguguga

SEQ ID NO: 62783 - RNA, 3699 nt, Artificial Sequence
  derived and/or modified sequence opt3 from SLC4A3__Homo_sapiens__NP_005061
auggccaacggcgugauucccccuccagggggagcuagcccgcugccccaggucagaguuccucucgaggaaccaccccuuuccccugacguggaggaagaggaugacgaucuggguaagaccuuggcaguaucuagguucggcgacuuaauuucaaaaccacccgccugggauccugaaaagccaagucggagcuacuccgagcgcgacuuugaguuccaccgacauacaucucaccauacucaccauccgcugucggcgcgucuacccccuccacacaaacucagaaggcugcccccuacgucagcucggcacacccgcagaaagaggaaaaaggaaaagacaagcgccccacccagugaggggacuccgccuauacaagaagagggaggcgcugguguggaugaggaagaggaagaggaagaggaggaagagggggaauccgaggccgaacccgucgagccaccucccucuggaaccccacagaaagcuaaguuuagcaucggcuccgacgaggaugacucacccggccuuccugggcgggcagccgugacaaaaccacugccgaguguuggaccccauaccgauaagagcccucagcacucuuccucaagcccaaguccccgcgcucgagccucuagauuggcgggugaaaaauccaggccuuggagcccaucggcaucuuaugaccuccgggagcgucugugccccggcuccgcccuggggaauccgggaggcccugaacagcaagugccaacugaugaggcugaagcccagaugcucgguucagcagacuuagacgauaugaagagucaucgccuggaggacaaccccggggucagaaggcaccuugugaagaaaccuagccggacacagggaggccgaggcucccccucuggguuggcuccaauucugcgcagaaagaaaaagaaaaagaaacuagauaggcggccucacgagguauucguugaacucaaugagcugaugcuugaccgcagccaggaaccccauuggagagagaccgccagguggaucaaguuugaggaagauguggaggaagagacggaacguuggggaaagccacacgucgcgucacugaguuuccgguccuugcucgagcugcgaagaacuauugcccauggugcagcuuuacuggaccucgagcaaaccacacuuccgggcaucgcccaccuggugguggaaacuaugauagucagcgaucagaucaggccugaggaccgcgcuucuguuuugcggacccuacugcucaaacauucacaccccaacgaugacaaggauaguggguuuuucccaagaaaucccagcuccucuucgaugaacagcgugcugggaaaucaccauccuacaccaucccacggccccgacggugccguaccuaccauggcagacgaucuuggggaaccggccccacuguggccccaugacccugaugcuaaagagaagccauugcacaugcccggcggagacggccacagggggaaaucacucaagcuguuagaaaagauuccugaggaugcggaggcaacggugguccuggugggauguguuccguuucuagaacagcccgccgcugccuucgugcgccucaacgaggcaguccugcuugaaaguguguuggagguaccaguuccugugcgauuucuguucgucaugcucggucccucucauacuagcacagacuaccacgaacugggccgguccaucgccacccuuaugucagauaaacuguuucaugaggcugccuaucaggcagacgaucgucaagacuugcucagcgcgauuucugaguuccuggauggguccaucgugauaccaccuagugaagucgagggaagagacuuacugaggagcguggcugccuuccagcgcgaacuacuccggaagagaagggagcgagagcagacuaaaguugaaaugacaacccgcggcgguuacacggcacccgggaaggagcugucucuugaauugggcggauccgaggccaccccagaagaugacccgcugcuccggacaggcucaguguuugggggacugguaagagacgucaggcgucgcuauccucacuaccccagugauuuacgggacgcucugcauagccaaugcguggccgcaguucuuuucauuuauuuugcugccuugucgccagcgaucacuuucgguggccuccugggggagaaaaccgagggacuaaugggcguguccgaacugauugucucuacagccgugcucgguguacuguuuagccuuuugggggcucagccccuguuagugguuggcuucucaggaccucuccuggucuuugaggaagcauucuuuaaguucuguagagcccaggaucuugaguaccugacuggcagggugugggugggguuguggcucgucguuuuugugcuggcucuaguggccgcagaaggaaguuuccugguacgauacaucuccccauuuacccaggagaucuucgcguuccucauuucucugauauuuaucuaugagacauucuacaaacuuuauaaggucuuuaccgaacaccccuugcugccuuucuacccgccagagggcgccuuagaagguagccucgacgcugggcuggagcccaauggauccgcccuuccucccacugaaggcccaccuucaccccggaaccaaccaaauacggcacugcuaagccucauucugauguuggguacauuuuucaucgcauuuuuccugcgcaaguuuagaaacaguagguucuuaggcgggaaagcccggcgaauaauuggagauuuuggcaucccuaucucuauucucgugaugguucugguggacuauuccaucaccgauacuuacacccagaaacuuacagucccgaccgggcugagcgugacuucgcccgacaagagaucaugguucauuccaccuuugggaucugcacgccccuuuccaccuuggaugaugguugccgcugcggugcccgcccuccugguacuaauacugaucuucauggagacacagauuacggcacuuaucgucagucagaaggcuaggcgucuccugaagggcuccgguuuccacuuggaucuguuacucaucgggagccugggaggccuuugcggucuguuuggcuugccguggcucaccgccgccacugugcggucugugacacaugucaaugcucugaccguuaugagaacagcaauugccccaggggacaaaccucaaauacaggaggugagggaacagcgcguaacuggagugcuaaucgcgagccuggucggccuuuccauugugaugggggcuguucuccgaagaaucccccuggccguguuguucggaaucuuuuuauauaugggcgucaccucacugagugguauccagcucagccaacggcugcuucugauauugaugccagcaaagcaccaucccgagcagccuuacgugacgaaaguuaagaccuggaggaugcaccuauucacauguauccagcuggggugcauugcccuccuguggguggucaaaucuacugcugcaucccuugccuuuccguucuuacugcucuugaccguaccccugcgccauugucuccugccacgucuuuuucaggauagagaacugcaagcguuggacucagaggaugcugagccuaacuucgacgaagacggacaggaugaguacaaugaacuacacaugcccguguga

SEQ ID NO: 62784 - RNA, 3240 nt, Artificial Sequence
  derived and/or modified sequence opt3 from SLC4A4__Homo_sapiens__NP_001091954
auggaggacgaagccgugcuggauagaggcgcuagcuuccucaagcacgucugcgacgaggaagagguugaagggcaucacaccaucuacauuggagugcauguacccaaauccuauaggcggcgccgacgucacaagagaaaaacaggucauaaggagaaaaaggagaaggaaaggauaucugagaacuacucagauaaaagugacaucgaaaaugcagaugagagcuccucuucgauucuuaagccucugaucucaccagccgcggagcggauucgcuuuaucuugggcgaagaggacgauagcccggcucccccucaguuauucacugaacuggacgagcuacucgccguggaugggcaagaaauggaguggaaagagacggcaagauggauaaaguuugaagagaaagucgaacagggaggcgagagguggaguaagccacacguggccacccugucccuucacucucuguucgaauugcggacauguauggagaaggguagcaucaugcucgaccgcgaggcuuccucacugccccagcugguugaaaugauuguggaucaucagaucgagacugggcucuuaaaaccugaacugaaggacaaagucaccuauacacuuuugcgaaagcacagacaucaaaccaaaaagaguaaccugaggagccuagcagauauuggaaaaacugugucuuccgccucacggauguuuacaaauccagacaacggcagccccgcuaugacccaccguaaucucacgaguucuucccugaacgacaucagcgauaagccugagaaggaccagcuuaaaaauaaguucaugaaaaagcugccacgcgaugccgaagcgucgaacguauugguuggcgagguggacuuucucgauacuccguucauagcauuugucagacugcagcaggccgugauguuaggggcucugaccgaggugcccgucccuacaagguuccucuuuauucuucugggaccaaaagguaaggccaagucuuaccacgaaaucggccgggcaauugcuacuuugauguccgacgagguuuuccaugauaucgccuauaaagcgaaggaccgacacgaucuaaucgccgggauugacgaauuucuggaugaggugauaguauugcccccuggagagugggacccagcaauccgcauugaacccccgaaaucacugccuaguagcgacaagaggaaaaauauguacuccggcggugagaacgugcaaaugaauggggauacaccccaugacggaggccacggcgggggaggucauggcgauugcgaggaacuucagagaaccgggcgguucuguggaggccugaucaaggacauaaagcgcaaagcuccauucuuugccucugauuucuaugacgcuuugaacauucaggcccucagcgcaauccuguuuaucuacuuagccaccgucacgaaugcuauuacuuucggugggcugcuaggcgaugcgacagacaacaugcagggagugcucgaaucauuucugggcaccgcaguuaguggggccaucuucugccuuuuugcuggacaaccuuugacuauucuguccagcacaggucccgugcucgucuucgagagacugcuuuuuaauuucucuaaggauaacaacuuugacuaccuggaguucagguuguggauaggccucuggucagccuuucuguguuuaauccugguggcaaccgaugccaguuuccuaguacaguauuucacgcguuuuaccgaagagggguucagcucccucauuucuuuuaucuucaucuacgacgcuuuuaaaaagaugauuaaacuggccgauuauuacccaauaaauucgaacuucaagguuggauauaauacacuuuuuagcugcacuugugugcccccugacccagcaaacaucuccauuucaaaugacaccacauuggcgccggaauaccugcccacuaugaguucuaccgauauguaucacaacacaaccuucgacugggcuuuucucagcaagaaagagugcuccaaguacggcgguaaucuggucgggaacaauuguaacuucgugccugauaucacuuuaaugucauuuauucuguuccuuggcacguacacaagcucuauggccuugaaaaaguuuaaaaccuccccauauuuccccacuaccgcacggaagcucaucagugacuucgccauaauccugagcauucuaaucuuuugcgucauugaugcucuggugggaguugacacaccuaaacucaucgugccaucugaauuuaagcccaccuccccgaaucgaggcugguuuguaccuccauucggggagaaccccuggugggucugucuggccgcagcuauaccugcccuuuuggugacuauucugaucuuuauggaucagcaaauuacagcgguuaucgugaauagaaaggagcacaaauuaaagaaaggagccgguuaccaucucgaccuguucugggucgcuauacuuauggugaucugcucacugauggcauugcccugguauguagccgcuacggugauuaguaucgcccacauugauagccucaagauggaaaccgagacuucggcaccaggcgaacagccuaaauuucuggggguuagggagcagcgcgucacaggaacccuaguguucauccugacaggccucuccguguuuauggcgcccauacugaaguucauuccaaugccgguccuuuacgguguuuucuuguauauggggguggccucucugaacggcgugcaguucauggaccgguuaaagcuccugcuuaugccucugaaacaucaacccgauuucaucuaccuaagacacguaccacucaggcgcguccaccuguuuacuuuccuccaggugcugugcuuagcucuccuguggauccuuaagagcaccguugccgcaauuaucuuucccgugaugauucuggcuuuggucgccgugcgaaaaggaauggacuaucucuucucacagcaugaucugaguuuucuagacgacguuauaccugaaaaggauaaaaagaagaaagaggacgagaagaaaaagaaaaagaagaaaggcucccuggauucugacaaugaugacagcgauuguccauacuccgaaaaggugcccucaaucaaaauuccuauggacaucauggagcagcaaccguuccuuagcgauaguaagccaucugaccgggaacguucccccacguuucucgagagacacaccagcugcuga

SEQ ID NO: 62785 - RNA, 3414 nt, Artificial Sequence
  derived and/or modified sequence opt3 from SLC4A5__Homo_sapiens__NP_067019
augaaggugaaagaggaaaaggccggcgucgggaaacuggaccacaccaaccauagaaggcgguuccccgaucagaaggagugcccuccaauccacauuggacucccgguucccacauacccucaacgcaaaacugaccagaagggucaucuuagcggccugcagaaggugcacuggggguugcgaccagaucagccccaacaggaauuaacgggaccuggcuccggugcuucuucacaggacaguagcauggaucugauaucccguaccagaucuccagcagccgagcagcuacaagacauccucggggaagaggaugaggcgcccaauccuacacuguuuacugaaauggacacccuucagcaugauggagaccagauggaguggaaagaaucggcuagguggauuaaguucgaggagaaaguagaagagggcggcgaacgguggucaaagccacacgugagcacacugaguuugcacucccucuuugagcugcgcaccugucugcagacugggacaguccucuuagaucuggacucuggaagccuuccgcaaaucauugaugacgugaucgaaaaacagauagaggacgguuugcugagacccgagcuaagggaacggguuuccuaugugcuccugcgccgacauagacaccagaccaagaagccuauccauaggucacuugccgauauuggcaaaagugucagcacgacuaaccggucuccagcacguucccccggggccggaccuucacugcaccacagcaccgaggacuugcgcaugagacaaagugcuaauuacggcaggcucugccaugcacagucucgguccaugaacgauaucagccugacaccaaauacugaccagcgaaagaacaaauucaugaagaaaauucccaaggauucggaagccucuaauguguuaguaggugagguugacuuucuggaucagccguucaucgcuuuugugcgccucauacaauccgccaugcuugggggagucaccgaagugccugugcccacaagauuccuguuuauuuugcuaggcccaucaggcagggcgaaaaguuauaacgagaucgggcgggcaauugccacccugauggucgacgaucucuucagcgacguugcuuacaaggcccgcaauagagaggaucugaucgcaggaaucgacgaauuucuugacgaggugauuguacugccucccggugaaugggauccaaacauaaggaucgagcccccuaagaaagugccauccgcugacaagcguaaaucugucuucagcuuggccgaacucggccagaugaaugggucagugggaggcggugggggcgcgccgggaggcgggaacggagguggcgggggaggcgguagugggggcggagccggcuccgggggagcaggaggcacgagcucuggggaugacggagagaugcccgcuaugcacgagauuggcgaagaacugaucuggacuggucgguuuuucgggggcuuaugucuggauauaaagcgaaaacuaccuugguucccaucagacuuuuaugauggauuccauauucagaguaucagcgccauccucuuuauuuaccugggcugcaucacaaaugcuauuaccuucgggggacuuuugggcgacgccacugauaacuaucaggguguuauggaauccuuucuggggacagcaauggccggaucucucuucugucuguuuucgggccaaccccuuauaauccugagcuccaccgguccuauuuugaucuucgagaagcuccuguuugacuucucaaagggcaauggguuagauuacauggaguuuagacuguggaucggacuacacagugcugugcagugccucauucuggucgcgacggacgcaucuuucauaaucaaauacauuaccagguuuacagaagagggcuucagcacucuuaucuccuucauuuuuaucuaugaugccauaaagaaaaugaucggggcuuucaaguacuauccaauuaacauggacuuuaaacccaacuucaucaccacauacaagugugaaugcguggccccggacacuguaaauaccacaguuuuuaacgcaucagccccuuuggcuccagauaccaaugccagccuguauaaccuccugaauuuaacugcacuggacuggucucuuuuguccaagaaagagugucucaguuacggaggccgccugcuagguaacagcugcaaguucauucccgaucuggcgcucaugucuuuuauccuguucuuugggacguauuccaugacacuuaccuugaaaaaguucaaauuuucacgguacuucccuacuaaggugagagcucuggucgccgacuuuaguauaguguucagcauuuuaauguucuguggaaucgaugcaugcuuuggccucgaaacccccaagcugcaugucccaucggugauuaaaccuacaaggcccgaccgcgguugguucguugccccauuuggcaagaauccgugguggguguacccugcuuccauccuucccgcccuguugguaaccauacucaucuucauggaucagcagauuacugcagucaucgugaaccgaaaagagaauaagcugaaaaaggcugccggguaucaccuagaccuguuuuggguugguauucucauggcgcugugcucuuucaugggccuuccaugguacguggccgcuacagucaucagcauagcacacauugauucauugaaaauggagacggaaaccagugcccccggggagcaaccucaguuucugggagugcgggaacagcguguaacuggcaucaucguguucauuuuaacagguaucuccguuuuucucgcuccaauucugaaguguauaccccuuccuguccuguaugggguguuccuauacaugggaguggccucucucaacggcauccagauggguaccggcgggagcgaguuuaagauucagaaaaagcugacaccguucugggaaagaugcaaauuguuccugaugccagcaaagcaucaacccgaccacgcguuuuuaaggcaugucccucuccgccggauccaccuguucacucuuguucagauucuguguuuggccgugcucuggauccugaaauccaccguggcugccauaaucuuuccaguaaugauucuaggacugaucauugucagaaggcuucucgauuucaucuuuucacaacacgaccuggcauggauagauaauauuuugcccgagaaggagaagaaagaaacggacaagaaacgaaagcgcaaaaagggcgcucaugaggacugcgaugaggagccucaguucccgcccccaagcgugaucaagaucccuauggaaaguguucagucugacccccagaacgggauucacuguauagcccggaaaagauccagcucguggucauauucucuguga

SEQ ID NO: 62786 - RNA, 3396 nt, Artificial Sequence
  derived and/or modified sequence opt3 from SLC4A7__Homo_sapiens__NP_001245308
auggaggccgacggcgcuggggaacagaugagaccccugcucaccaggggaccugaugaggaagcaguggucgaccuugguaagacaagcuccacuguuaacacgaaauucgagaaggaagaacuggagucucaccgggccguguacaucggcguacaugugccauuuucaaaagaaagucgccgacgucacagacauagggggcacaagcaucaccaccggcgcagaaaagauaaggagagcgacaaggaagauggaagggaguccccgucuuaugacacccccucgcaacggguccaguucauuuugggcacagaggaugacgaugaggagcauauaccucacgacuuauuuacugaaauggaugagcugugcuaccgcgacggugaagaguaugaguggaaagaaaccgcgcgauggcuaaaguucgaggaagauguggaggacgggggagacagauggucaaaaccauacguugcuacacucagccugcauagucuuuuugaacugagguccuguaucuugaauggcaccgugaugcucgauaugcgggccucuacucuggacgagauugcagauaugguccuggacaacaugaucgccagcggccagcucgaugaguccauucgugaaaaugugcgcgaggcuuuacugaagagacaccaccaucagaacgagaaaagguucacaucacggaucccccuuguacgaaguuuugcagacauagggaagaagcacagcgauccucauuugcuggagcgcaauggaauccuagccucuccacaauccgcucccgguaaccucgacaauucaaaaagcggcgaaauuaaggggaacggaaguggcgguucuagagaaaauuccaccguugauuucagcaaaguggacaugaacuuuaugaggaagaucccuacgggggccgaggcgucgaauguccuggugggagaaguggauuuccuugagcggccaauuaucgcauuuguccgccuggccccggcuguuuugcucacuggccugaccgaagugcccguaccuacaagauucuuauuucugcuccuuggcccagccgggaaagcaccccaguaucacgagauaggaaggucuauugcuacucugaugaccgacgagaucuuccaugacguggccuacaaggcgaaagaucguaacgacuugcuauccgguauugaugaguuccuggaccaggucacagugcucccuccaggcgaaugggaucccucaauccggaucgaaccgccuaagaguguucccagccaggagaagcgaaaaauuccaguguuucacaauggguccaccccuacgcugggagaaacucccaaggaggccgcacaccaugcuggcccagagcuucaaagaacagguaggcuguucgggggcuugauacucgacaucaaacgcaaggcccccuuuuuccugucugauuuuaaagacgcuuuaagccugcagugccuagccucaauucucuuccuguauugugcaugcaugaguccugucaucaccuuuggaggccuuuugggggaagccacugagggacggauauccgcuauugaaagccuguucggugcgucucucacaggcaucgcauacucacuguuugccgggcagccacuuaccauccugggaaguacgggcccgguguugguauucgagaagauucucuacaaguuuuguagagauuaucagcugagcuacuuaucccugaggaccucuaucggucuauggacaucguuccucugcauuguucugguggcuacugacgccagcucccuugucuguuauauaacccgcuuuacagaagaggcauucgccgcuuugaucugcauuaucuucaucuacgaggcccuggaaaaacucuuugaucugggggagacuuaugcauucaacaugcacaauaacuuagacaagcugaccucauacaguugugugugcacagaacccccuaacccaucuaaugagacccuugcgcaauggaaaaaggauaacauuacugcucauaauauaagcuggcgaaacuugacggucuccgaauguaaaaagcuccggggcguguuucugggaucagccugcggccaccacgggcccuauaucccugacguucuauucuggugcgugauucuguuuuucacaaccuuuuuccucagcucuuuucugaagcaguucaaaacuaagcguuacuuuccaaccaaaguaagauccacaaucagugacuucgcagucuuucuuaccauugugaucaugguuacuauagauuacuuggugggaguccccagcccgaagcugcaugugccugagaaauucgagccaacacaccccgaaagggguuggaucauuucuccuuuaggcgacaaucccugguggacgcuccugaucgccgcuauuccagcccuucuguguaccaucuugauauucauggaucagcaaauuacugcaguaaucauuaaccgcaaggagcauaagcucaaaaagggggcuggauaucaccuggaccuacugauggugggcguuaugcucggugucugcuccgugauggggcugccuugguuuguggccgcgacaguccuuucaaucagucauguuaauagcuugaaaguggaaucggaguguuccgcccccggcgagcagccaaaguuccugggaauacgggaacagagagugaccggcuuaaugaucuuuauucucauggggcugucuguauucaugacaagcguccuuaaauuuaucccgaugccugugcuguacggaguuuuccuauauaugggcgugucaagucucaaggguauucagcuguuugauaggaucaaauuguucgggaugcccgcuaagcaccaaccagaccugauauacuuacgauaugucccccucuggaaggugcacauuuuuacuguuauccagcugaccugccuugugcuguuguggguaaucaaagucuccgcagccgcugugguguucccuaugaugguccucgcccugguuuuugugcgcaagcuaauggaucuguguuucacgaaacgggagcuuucuuggcucgacgaucugaugccagaaagcaagaaaaagaaggaggacgauaaaaagaaaaaggaaaaagaggaggcagaaagaauguugcaggacgaugacgacaccguacaucugcccuucgagggaggcuccuuacuccagauuccugugaaggcgcugaaguacucagucgauccgagcaucgugaacauuagugacgaaauggccaaaacagcucaauggaaggcccuuucuaugaauacugagaacgcaaaaguuaccagguccaauaugagcccagauaagcccgugucggucaaaauaucauuugaagacgagccucguaagaaguauguggaugcugagacaucucuguga

SEQ ID NO: 62787 - RNA, 2838 nt, Artificial Sequence
  derived and/or modified sequence opt3 from SLC4A9__Homo_sapiens__NP_001245355
auggagaugaagcugcccggccaggaaggguucgaggccagcuccgcuccuagaaacaucccaucuggagaacucgacucaaauccggaucccgguaccggcccuaguccagacgggcccagcgauacagaguccaaagaacuuggagugccuaaggacccacuguuguuuauucaauuaaacgagcugcuaggcuggccccaggcacucgaguggagggaaacuggucgguggguccuguucgaggaaaaacuugagguugccgcggggcgcuggucugcuccucacgugccaacgcuggccuugccgucgcuccagaagcugcgaucacugcucgcagagggauuaguacugcuugauugccccgcccagagcuugcuggagcuaguggaacaagucacccguguggaaagucucuccccugagcugagaggccagcuucaggcucuguugcuccagaggccacaacauuacaaucagacaacuggcacccggcccuguugggggucuacacacccucgcaaagcaagcgacaacgaagaggccccacugagagagcagugccagaaucccuuaaggcaaaagcugccgccuggagcugaagccgguaccguucucgcgggcgagcuuggguuucuggcacagcccuugggagccuucgugcggcuacgcaacccagucgugcugggcucccucacugaaguaucacugccuagucgauuuuucugucuucuguugggucccugcaugcucgggaagggauaucaugagaugggcagagcugccgcaguucuguuaagcgauccacaguuucaauggucugugaggcgggcuuccaaucugcacgaccuacucgccgcgcuggaugccuuccuugaagaggucacaguguugcccccuggccguugggacccaaccgcacgcauaccgcccccuaaaugucugccaucacagcauaagagacuccccagccagcagagggagauccgggggccugcugugccacgacugacgagugccgaagaucgccacagacacggaccccaugcucacucuccggagcuucaaaggacuggucggaaagucccuugguacccauccgacuuucuggaugccuugcaucuccagugcuucagcgcaguucuguauauuuacuuagccaccgugacaaacgcuaucacuuuuggcgggcugcuaggagacgcgaccgacggcgcacaggguguacucgaaucguuccuggggacagccguggcuggcgccgcauuuugucuuauggccggacagcccuugaccauucugucuuccacgggcccuguccucguguucgagcgccuguuauucucauuuaguagagauuauagccuggacuaccuucccuucagguuguggguugggaucuggguggcuacuuuuugccucguccugguggccacagaagcauccguucuaguacguuauuucacccgguuuacugaggagggauucugugcgcugauaucucucaucuuuauuuacgaugcuguggguaagaugcugaaucuuacacacaccuacccaauccaaaaaccuggcagcucagccuaugggugcuugugucaguaccccggaccaggcgguaacgaaagucaguggauucgaacgagaccgaaggacagggaugacaucgaucugggguuaauaaaugcaucccuccugccucccccagagugcacccgccagggcggacacccccggggcccugggugccauacagucccagacauugccuucuuuagccuucuguuguuccucacuucauuuuucuuugcuauggcccugaagugugugaaaaccucuagauucuuccccagugucgugaggaagggacuaagcgauuuuuccucuguucuggcaauccuccuggguugcggccuugacgcuuucuuggggcuggccacaccuaaauuaauggugccgcgcgaauuuaagccaacucuccccggacgaggcuggcugguaucgccuuucggugcgaacccauggugguggagcgucgccgcugcacuucccgcccugcuacucuccauucugaucuuuauggaucaacagaucaccgcugugauuuugaaucggauggaguaucgucugcagaaaggggccggcuuccacuuagaccucuuuuguguugcagugcugaugcuucugacaucagcguugggacucccuugguacgucagugccaccgugauaucucuggcucauauggacagccuaagaagggagucccgcgccugcgcaccgggcgaacggcccaacuuccuggggaucagagagcagaggcuuacuggacucguaguguuuauucugacgggcgcuucaaucuucuuggccccaguucugaaguuuauaccuaugcccgucuuauaugguauuuuccucuacauggggguggcagcccugagcucuauccaauuuacaaaucgagugaaacuucuguugaugccagcuaagcaccagccugaucuccugcuacugcgccaugucccccuuacccggguucaccucuucacugcgauccagcuggccuguuugggauuacuguggauuaucaaguccaccccagcagcuauuauauucccgcucaugcugcuuggccuggugggugugagaaaagccuuggaaaggguauuuaguccucaagagcuacuguggcucgacgaacugaugcccgaggaggaacguagcaucccagagaagggccuugaacccgagcacucuuucuccgggucagauagugaagacagcgaguuaauguaucagccuaaagccccagagauuaacaucucggucaacuga

SEQ ID NO: 62788 - RNA, 501 nt, Artificial Sequence
  derived and/or modified sequence opt3 from SLC50A1__Homo_sapiens__NP_001116309
augagaggccugcaccccuggcaugugcucaggcggccucuugggccacaggcccacgcuaacgacccggagugcggacaacgccccgucccugcacugagccaucacgguucccagcgaguuguguuguuacagaccgccacacugcuaggcguacuccugcuuggguacggauauuucuggcuguuggugccaaaucccgaagcgcgucuccagcaacugggccuguuuuguucugucuucacuaucucaauguaccucaguccuuuagcugaucuggccaaggugauucagacgaaaagcacccagugccuuuccuauccauugacaauagcaacucugcuaaccucugccucguggugucucuacgguuuuagacugagggaccccuauaucaugguuucaaacuucccugggauugugaccagcuuuauccgguucuggcuguuuuggaaguacccacaggagcaagaucgcaauuauuggcuuuugcagacauga

SEQ ID NO: 62789 - RNA, 1023 nt, Artificial Sequence
  derived and/or modified sequence opt3 from SLC51A__Homo_sapiens__NP_689885
auggagcccggcagaacccagaucaagcuggacccuagguacacagccgaucuccuugaagugcugaaaacuaacuaugggauuccaagcgcuugcuucucccaaccgcccacggcagcccaguuguuacgggcgcugggaccugucgagcuagcucucaccucuauacugacacuucuggccuuggguucaaucgcaauuuuucucgaagacgccguuuaccuguauaagaauacucuguguccaaucaaacgccgaacccucuuauggaagaguagcgcucccacagugguauccgugcugugcuguuucggccuuuggauuccucguucuuugguccugguggagaugaccaucacuucguuuuacgcaguuugcuucuaucuacucaugcuggugauggucgaaggguuuggaggcaaagaggccgugcuuagaacacugagggauaccccaaugaugguacacacgggucccuguugcuguugcuguccuugcuguccacgguugcuccugacucgcaagaaguuacagcugcucaugcuugggccguuccaguacgcuuuucugaaaauaaccuugacucuaguuggacuguuccucgugcccgacggcaucuaugauccugccgacauuucagagggcagcacagcgcuguggaucaacaccuuucuuggggucaguacacuguuggcacucuggacccugggaauuaucuccagacaagccagguuacaucugggugaacagaauaugggcgcuaaguucgcccuauuucaggugcuccugauacuuacggcauugcagccaucuauuuucagcgugcuggcuaacgggggacaaaucgccugcucacccccuuacuccaguaaaacucggagccaggucaugaauugccaccuccugauucuugagacauuucugaugaccguuuugacucgcauguacuaucgaagaaaggaucauaaagugggcuacgaaacauucucuuccccagaccucgaucugaacuuaaaggcguga

SEQ ID NO: 62790 - RNA, 387 nt, Artificial Sequence
  derived and/or modified sequence opt3 from SLC51B__Homo_sapiens__NP_849190
auggagcacagcgaaggcgcccccggggacccugcuggaaccguggucccacaggagcugcucgaagagaugcuuugguucuuuagaguugaagaugcauccccguggaaccauucuauccuggccuuggcggcugugguagugauuauaucaauggucuuacuggguaggaguauccaagccagccggaaggagaaaaugcagcccccugagaaggaaacaccagaggugcuacaccucgacgaagcaaaagaucauaauucccugaacaaucuucgcgagacucuguugucugagaagcccaaccucgcccagguugaacuggagcugaaagaacgagacgugcucucggucuucuuaccugaugugccagagacggaaucauga

SEQ ID NO: 62791 - RNA, 1347 nt, Artificial Sequence
  derived and/or modified sequence opt3 from SLC52A1__Homo_sapiens__NP_060456
auggccgcucccacccugggcagacucgugcuuacacaccuguuggucgcauuauucgggaugggaagcugggccgcgguuaacgguaucuggguggagcugccuguaguggucaaggaccuaccagaaggcuggucccucccgucuuaccugucagugguuguggcucuugggaaucugggauugcucgucgugacucuguggaggcagcuggcccccggcaaaggugagcaaguaccuauucagguugugcagguccucagugugguggggacggcauuacuggccccacuuuggcaucacgucgcucccguugcaggacaguugcauagcguggccuuucugacccuagcucucguacuggccauggcgugcuguacauccaacgugacuuuccuuccuuuucugucucacuugccacccccuuuccuccggucguuuuuccugggccaaggcuuaucagcacugcucccaugcguccuugcccuggugcaggggguuggacgcuuggaauguccgcccgcuccuaccaaugguacaagcggcccaccccuagauuuuccugagcgauucccagccaguaccuuuuucugggcacugacugcucuccuggugacauccgccgcggccuuucgugggcuucuguugcuccugcccucuuuaccgagcgucaccacgggaggcuccgguccugaacugcagcuagggucacccggagcagaggaggaagagaaggaagaggaggaagcucucccacugcaggagccucccagucaagccgcuggcacuauaccaggccccgacccugaagcccaucagcuuuucagcgcacacggggccuuuuugcugggacucauggcuuucaccucugcggugacaaacgguguacugccauccguucagucauucagcugccuuccguauggcagacuggcauaccacuuggccgugguccucgggagugcugccaauccccuggcaugcuuuuuagccaugggagugcuguguaggucucuagcuggccucgucggucugucccuuuuggggaugcuguucggcgccuaucucauggcacuggcgaucuuaagcccuuguccaccccuggugggaacuaccgcuggcguugugcuuguagucuugucgugggugcucugccuguguguguuuucuuacguuaaagucgccgcauccucacuacugcaugggggaggucggccugcccuccuggcugccggcguggcaauucagguagggagucuuuugggagcuggcgccauguucccacccacaagcaucuaucacguguuucaaucccgcaaggauugcguugacccgugugguccuuga

SEQ ID NO: 62792 - RNA, 1338 nt, Artificial Sequence
  derived and/or modified sequence opt3 from SLC52A2__Homo_sapiens__NP_001240745
auggccgcucccaccccugcaagaccagugcugacacaccuccuugucgcccuguucggcauggggagcugggcggcuguuaacggaaucuggguggaguugccgguaguggucaaggaauuacccgaggguuggucccugccuucuuacgugucaguucuaguggcccucggcaaucuggggcuucuggucgugacuuuguggaggcggcucgcaccaggaaaagacgaacagguacccauucgcguugugcaaguccugggcaugguggguacggcccugcucgcuaguuuauggcaucacguggcaccugucgccgggcagcugcauagcguugcuuuucuugccuuggcguucgugcuggcacuagccugcugugcuuccaacguaaccuuucucccauuccugucucaccuucccccucgauuucugcguucguucuuuuugggacagggccucucagcccuguuaccaugcgugcuggcacucguccagggcguggggagacuugaguguccgcccgcuccuauaaauggaacaccaggucccccucuggauuucuuggaaagguuuccagccagcacuuucuuuugggcgcuaaccgcccugcucguugcaagugcugccgcuuuccaaggccugcuucuguugcugcccccgccucccuccgugccaacaggggagcucggaucuggcuuacaggucggugccccuggggcagaggaagagguggaagagagcaguccccugcaggagccacccucacaggccgcuggaaccacuccuggcccagacccgaaggcguaucaacuacucagugcacggagcgccugccugcuuggcuugcuggcugccacaaacgcacucaccaaugggguacugcccgccguucagucuuuuuccugucuuccuuacggacgccuggcuuaucauuuggccgugguccucgguucagcagcgaacccacuggcuugcuucuuagccaugggcgugcuguguagaagccuagcagggcucggaggccugagucuuuugggugucuucugcgggggcuaccugauggcccucgcugugcugucucccuguccuccauuaguuggaacguccgccggcgugguacuggucgugcuuagcuggguuuugugccucgggguguuuucguaugucaaaguggcagcuucuucccugcuacacggagguggcaggcccgcccugcucgcggccgggguagcuauccaggugggaucacugcuuggcgcaguugccauguucccgccuacuuccauuuaccacgucuuucauagccggaaggauugugcugacccaugcgauuccuga

SEQ ID NO: 62793 - RNA, 1410 nt, Artificial Sequence
  derived and/or modified sequence opt3 from SLC52A3__Homo_sapiens__XP_011527450
auggccuuccugaugcaccuccuugugugcgucuuuggcauggggagcuggguuaccaucaacggacuguggguggaguugcccuuacugguaauggaacuaccugaggguugguaccucccauccuaucugacaguggucauucagcuugcuaauauaggcccgcuguuggugacucuccugcaucacuucagacccucuugucugucagaaguuccuaucauuuuuacgcucuuaggggugggaaccgucacaugcaucauuuucgcauuucuguggaacaugacuagcugggugcuugacggccaucacaguaucgccuucuugguacugaccuuuuuccuagcgcucguugauuguacauccucugugaccuuucugccauucaugucgaggcuucccacuuacuaucugacaaccuuuuucgucggugagggguugucaggacuccugccugcuuuaguggcccuggcacaaggcagcggccucacgacuugcgugaaugucaccgaaauaagugacuccguuccaucucccgugccuacacgggagacugauaucgcccaggggguaccacgcgcucuugugagcgcacugccgggaauggaggcccccuugucccaucuagaaucacgauaccugccugcucacuuuaguccacucgucuucuuccugcuucugagcauuaugauggccuguugcuugguggcguuuuucguucuccagcgucagcccagauguugggaggcaucuguggaagaccuguuaaacgaucaagucacccugcacuccaucaggccucgggaggagaaugaccuagguccagccggcacaguggauucaagccaggggcagggauaucucgaagagaaggcugcccccugcuguccggcacaucuggcuuuuauuuacacccuuguagccuucguuaacgcguugacgaauggcaugcugccuagugugcagacuuauucuugccucuccuacggucccgucgccuaccaccuggcagcuacacuuagcaucguggccaacccacuggcuucguuggucucuauguuucucccuaaucgcucccuguuauuccugggggugcuaucaguucucggaaccuguuuuggcggcuauaacauggccauggcagugaugagucccugcccacugcuucaagggcauuggggaggugaaguauugauagucgccagcugggugcuguucuccggcugccucucuuacguuaaagugaugcugggggucguguuaagagaccugagcaggucagcucuuuugugguguggagcggcaguacagcucggcagucugcuaggugcccugcucauguuuccccuggugaauguucuucgguuguucuccagcgcugauuuuugcaaccugcacuguccugccuga

SEQ ID NO: 62794 - RNA, 1923 nt, Artificial Sequence
  derived and/or modified sequence opt3 from SLC5A11__Homo_sapiens__NP_001245340
auggagagcggcaccuccucuccccagccuccacaacuggacccgcucgaugccuucccccagaaggggcuugaaccuggagacaucgcugugcuggucuuguacuuuuuauucguucuggcagugggucuauggucaacaguaaaaacuaagagagauacggugaaaggcuauuuucucgccgggggagacauggucugguggccagugggcgcgagucuguucgcuagcaacguugguuccgggcacuuuauuggacuugccggcucuggcgcagccaccgggauaucggugucagcuuacgagcugaauggauuguucagcguccucaugcuggcauggaucuuucugcccauuuauaucgccggucagguggauauguacgcuggcgccauuuucauccagcaaagucuccauuuagaccuguaucuugcgauaguaggguugcuggcaaucacagccguuuacacuguggcuggaggccuagccgcagucauuuauaccgaugcucuccagacacugaucaugcuuauuggugcccugaccuugaugggguacuccuuugcggccgugggaggcauggaaggccucaaggagaaauacuuccuggcauuagcuucuaacaggagcgaaaauuccucaugcgggcugccucgggaggacgccuuucacaucuuccgcgauccacucacaagugaccuucccuggccuggagugcuguuugguaugagcauaccaucuuugugguauugguguacugaucaggucauuguucagcgaacccuagcugccaagaaccugucccaugcaaagggcggggcccucauggcugcguaccugaaagugcuuccgcuguucaucaugguauuccccggaauggugucacguauuuuguuuccugaccaagucgcaugcgccgauccagagaucugucagaagaucugcagcaaucccaguggcuguucugacauugcuuauccuaaacucgugcuggaauuacugccaacgggucuaagagggcucaugauggccguuaugguggcagcccugauguccagccuuacuucgauauucaacucugcuuccaccaucuuuacaauggacuuguggaaucaccugaggccccgggccucagagaaggaacucaugauugucggccgcguguucguacugcuucugguuuuggugaguauccucuggauaccggucgugcaggcaagccagggaggccaacuguuuauuuacauccaguccaucucuagcuauuuacagccucccgucgcggugguuuucauuauggggugcuuuuggaaaagaacuaacgagaagggagcuuucuggggucugaucucaggccuacuccuggggcuugugagguugguacuggauuuuauuuacguccaaccacggugugaccagccugaugagcgccccgugcucguuaagaguauacauuaucuguacuucuccaugaucuuaagcaccgugacacugauuaccgucucuacggugucaugguuuacugaaccacccaguaaagagaugguaagccaccuuacaugguucacccgacacgacccugugguucagaaggaacaggccccaccggcagcccccuugucccucacucugucucaaaauggaaugccugaggcuucgagcuccucaaguguccaguuugaaauggugcaggagaacacaucuaaaacccauagcugcgauaugacgccaaagcaguccaaaguggucaaggccauccuauggcuguguggcauccaagagaaagguaaggaggaacuccccgcaagagcugaagccauuauaguuucacuggaggaaaauccucuugugaagaccuugcuggacgugaacuuaaucuucugcguaagcugugcgauuuucaucuggggguacuuugccuga

SEQ ID NO: 62795 - RNA, 1857 nt, Artificial Sequence
  derived and/or modified sequence opt3 from SLC5A12__Homo_sapiens__NP_848593
auggaggugaagaacuucgccgucugggacuacguuguguuugcugcacuguucuuuaucagcuccggcauugggguauucuuugccauaaaagaaagaaagaaagcgaccucuagggaguuccucgugggaggucggcagaugucauuuggccccgucgggcuuagucugacagcuagcuucauguccgccgugacuguuuugggaacgccuucugaaguguaucgcuuuggcgcaucguucuuagucuuuuucaucgccuaccuguuugugauucuacucaccucagagcuguuccuuccaguauucuaucgaagcgguaucacaaguacuuacgaauaucugcaauugcguuuuaauaagccgguuagauacgcugcaaccgugauuuauaucguccagacaauacucuacaccggggugguggucuacgcccccgcucuggcccugaaccagguuacuggauucgaucucuggggcuccguguuugcgacaggcaucguaugcaccuucuauuguacguuagggggacugaaagcaguggucuggacugacgccuuucagauggugguuaugauuguggguuuccuuaccgucuugauccaaggcucuacacacgcugggggauuucauaaugugcuggagcagagcacuaacggcuccaggcuacacauuuucgauuuugacguagauccucuccggcgccauaccuucuggacaaucaccguuggugggacguuuacuuggcugggaauauacggcgugaaucagucaacaauucagagaugcaucaguuguaagaccgagaagcacgccaaacuugcacuguauuucaacuugcucggccuguggauuaucuuagucugcgcuguguuuagcgggcugaucauguacucucauuucaaggacugugauccauggacuuccggaauuauaucagcccccgaccaacucaugccuuauuucgucauggaaaucuuugcgacaaugccaggucuucccggccuguucguggccugcgcauuuagcgggaccuugaguacgguugcuucuuccauuaaugcccuagcuaccgugacauucgaggauuuuguaaaaagcuguuucccucaccugucggacaagcucucuacuuggaucuccaaaggacugugccuucuguuuggcgucauguguaccucaauggccguggcagccaguguuauggguggggugguccaggcuagcuuguccauacacggcaugugcggaggcccaaugcucgggcuguucucuuuaggaauuguguuuccguucguaaacuggaagggugcgcugggcgggcuacucacaggaaucacucugagcuuuuggguggcaaucggcgccuucauuuaccccgcuccugccucaaagaccuggccacuucccuugaguacagaucaguguaucaaauccaauguuaccgcaacugguccuccaguccugagcucuaggcccgggauugccgacacgugguauucaauaaguuaccucuacuauagcgcugugggcugccugggaugcaucguggccggcgucauuaucucccuuaucacagggcggcagcgcggagaagauauucaaccgcuguugauacgaccuguuuguaaccucuuuugcuucuggucuaagaaauacaagacccuguguuggugcggugugcagcaugacucgggcacugagcaggagaauuuagaaaacgggagcgcaagaaaacaaggagcggaguccgugcugcagaauggccuaaggcgggaaucacucguacacguccccgguuaugacccaaaggauaaaaguuacaacaauauggcuuucgagaccacacauuuuuga

SEQ ID NO: 62796 - RNA, 1995 nt, Artificial Sequence
  derived and/or modified sequence opt3 from SLC5A1__Homo_sapiens__NP_000334
auggacagcuccaccuggucucccaagacaacugccgugacgagaccugucgagacccacgaacugaucaggaacgcugcagauauuucaauaaucguuauuuacuucgugguagugauggccgucggccucugggcgauguuuaguacaaaucgggggacugugggagguuucuuucuugcuggccgcagcaugguuugguggccaaucggggccucccuguucgcaucuaacauuggaucgggccauuuuguggguuuggccgggaccggagcugcaucaggcaucgccauaggcggguucgaguggaaugcuuuaguccuggugguaguucuaggauggcucuuugugccgaucuauauuaaagccggugucgugacaaugcccgaauaccugcgaaagcguuucggcgggcagagaauccaaguguaucuuagccuguugagucuccugcuguacauuuuuaccaaaaucuccgcggacauauucucuggagcaauuuuuaucaaccucgccuuaggccugaaucuuuauuuggcuauuuuccugcuacucgccaucacugcacuguacacaaucaccggugggcuugcugccgucauuuauacggauacucugcagaccguuauaauguuggugggaagccucauccugacaggcuuugcguuccacgagguaggcggguacgacgccuucauggaaaaguacaugaaagcaauuccuacuaucguguccgauggaaacaccacauuucaggagaagugcuauaccccaagggcugacucauuccauauauuucgggaucccuuaacgggugaccugccuuggccaggcuucauuuuugggaugaguauccucacucuuugguacugguguacagaucaggucaucgugcaacgcugccugagcgccaagaauaugucucacguuaaaggaggcuguauuuugugcgguuaucuaaagcugaugcccauguucaucauggugaugccugggaugauuuccagaauacucuacaccgagaaaaucgcuugugucgugccaucagaaugcgagaaguauuguggcacuaaaguaggaugcacaaacauugccuacccgacccugguuguggaacuuaugcccaauggccugaggggguugaugcucagcgucaugcuggcaaguuuaaugucuucccugacgagcaucuuuaacucggccucuacccuauucacaauggacaucuaugcuaaggugcggaagcgcgcguccgagaaagagcucaugauugcaggacgacuguuuauacuugucuugaucgguauuucaaucgccugggugccuauuguucagagugcucagagcggccagcuguucgauuacauccaauccauaacuucuuaccucgggccacccaucgccgcaguguuucugcuugccauuuucuggaagagaguaaaugaaccuggagcuuuuuggggccugaucuugggucuccugauugggaucagcaggaugauaaccgaguucgccuauggcacaggaucauguauggaaccaaguaacugccccacuauuaucuguggcguccauuacuuauauuucgcaauuauccuguuugcgauauccuucaucaccauugugguuaucagccuacucacaaaaccgauuccugacgugcaccuguaccggcuuugcuggucuuugcguaauucaaaggaggaacgcaucgaucuggacgcugaggaggaaaacauacaggaggggcccaaagaaaccauugagaucgaaacucaggucccagagaagaaaaagggaaucuuuagaagggccuaugaccucuucugcggucuggagcagcacggcgcaccuaagaugacggaagaggaagagaaagccaugaagaugaaaaugacagauaccagugaaaagcccuuauggcggacugugcugaauguaaacgggauuauccuugugaccguugcugucuuuugucaugccuacuucgcauga

SEQ ID NO: 62797 - RNA, 2019 nt, Artificial Sequence
  derived and/or modified sequence opt3 from SLC5A2__Homo_sapiens__NP_003032
auggaggaacacaccgaggccggcagcgcucccgaaaugggggcacagaaggcccugaucgacaacccugcggauauucucgugauagcugccuacuuccuucuggucaucggaguugguuugugguccaugugcagaacaaauaggggcacuguagggggauacuuuuuagcaggccggucuauggugugguggccagugggugccucacuguucgcuaguaacauugggagcggacauuuugucggccuagcaggcacgggggccgcuuccggacucgccguggcggguuucgaguggaaugcacuguuuguugugcuucuguugggcuggcuguucgccccggucuaucugaccgcuggggugaucacaaugccccaauaucugcgcaaacgauuuggaggccguagaauuaggcucuacuuaucuguacugucgcuuuucuuguauaucuuuacuaagauaucaguugacauguucagcggugccguguuuauccagcaggcacugggguggaacauuuacgcuagugucaucgcccuacucggaauuaccaugaucuauacagugaccggcggccuggcggcccuuauguacacugauacagugcagaccuucgucauacucgggggagcauguauuuugauggguuacgcuuuucacgaaguuggcggguauuccggacucuucgacaaauaccugggcgccgcuacgucuuuaacugugagcgaggauccugccguagguaauaucuccucauucugcuaucggccacgccccgacaguuaccaucugcucagacacccugugaccggggaucuuccauggcccgcacuguugcuaggccugacaauugucagcggaugguauugguguucugaccaagugaucguucagaggugccucgccggcaagucccugacucauaucaaagcuggguguauucuuugcggauaccugaaguugaccccuauguuucucauggugaugccagguaugauaucacggauccuguauccggaugaggucgcgugugugguacccgaaguuugccgccgaguguguggcacagaggucgggugcagcaacauugcauacccuagauuaguggucaagcugaugccaaauggacuaaggggccucaugcuggccgugaugcuugcugccuugaugaguucucuggcauccaucuucaacagcucgucuacccucuuuacgauggacauauacacucggcugcguccccgcgccggugauagagaacuucuguugguugggaggcucugggugguauucauugucgugguuuccguggcuuggcugccugucgugcaggccgcacagggcggacaauuauuugacuauauccaggcgguaucaaguuaccuggcuccacccgugagcgccguuuucguccuagcacucuuugugccgcgggugaaugagcagggcgccuucugggggcugaucggaggucuuuugaugggccuggcucgacucauuccugaguuuuccuucgggucuggaagcuguguccagcccucagccugcccagcauuucugugcggcguucacuauuuauacuucgcuaucgugcuguuuuucuguaguggucuuuugacacucaccgugucccugugcacugccccuauuccccgcaaacaccuacauagacugguauucagccucaggcacucuaaggaggaacgggaagaucuggacgcggacgagcaacaggggucaagucuuccaguccagaacggcugucccgaaagcgccauggagaugaaugagccucaagcuccagcaccguccuuguuucgccagugccuguuaugguucuguggaaugucuagaggcggggugggaucgcccccuccacucacacaggaagaggccgcugccgcagcgaggcgucuggaagauauaagcgaggaccccuccugggcccggguugugaaccuuaaugcucuguugaugauggccgucgcaguguuucucuggggcuucuaugcuuga

SEQ ID NO: 62798 - RNA, 2157 nt, Artificial Sequence
  derived and/or modified sequence opt3 from SLC5A3__Homo_sapiens__NP_008864
augagagccgugcuggacaccgcugauaucgcaauugucgcccucuacuucauacuuguuaugugcaucggcuuuuucgcgauguggaaaagcaacagguccacagugucuggguauuuucuggcuggacggucaaugacuuggguagccauuggugcaaguuuguucgugagcaauaucggcuccgagcacuuuauuggguuagccggaucuggcgcugcaucggguuucgccgucggggcuugggaauuuaacgcccugcuacuccugcagcuucugggauggguguucauccccauauacauccgcucaggcguuuauacgaugccugaguacuugagcaagcgauuuggcgggcaucguauucaaguguauuucgcggcacucagucugauccuguacauuuuuaccaagcucuccgucgacuuauauucuggagcccuguucauccaggaaagccuugguuggaauuuguacguguccguaauacugcuaauuggcaugacagcucuccugacuguuaccgggggacuuguggccgucaucuacacagauacccugcaggcauugcucaugauuaucggcgcucugacuuuaaugaucauuucaauaauggagaucgguggguuugaagaggugaaaagaagguauaugcuggccaguccagacgugacaagcauucuccuuaccuacaaccugucuaauacgaacuccuguaaugucucaccgaagaaagaggcguugaagaugcuacggaaccccacugaugaagacguuccuuggccaggauucauccugggccagacccccgccagcgugugguauuggugcgcagaucaaguaauagugcagcgcguccucgcugccaagaauauugcucacgccaaaggcaguacacugauggcaggguuccuuaagcuguugccuauguuuaucaucgugguuccaggaaugauuucuagaauccucuucacugacgauauugccuguauaaaccccgagcauugcaugcuggugugugguuccagggcuggcugcagcaauaucgcguacccucgguuagucaugaaacuggugccaguagggcuacgcggacucaugauggcaguuaugauugccgcucugaugucggaccuugauucuaucuuuaacuccgccucaaccaucuucacauuggacguguauaagcugauucgaaaaagugcaagcuccagagaacucaugauagucggcaggaucuuuguggccuucauggucgugauuucuaucgcuuggguuccgauuaucguggagaugcagggugggcagauguaccuguauauacaagagguagccgauuaccuuacgcccccugucgcagcgcuguuuuugcucgcuaucuucuggaagcgguguaaugaacagggcgccuuuuacggaggcauggcaggguucgugcugggagccguucguuuaauucuggcuuuugccuaucgcgcaccagagugcgaccagcccgacaacagaccugguuucaucaaggauauucacuacauguauguggcuaccggccuauuuugggucacugggcucaucacagugauaguaagccugcuuaccccacccccgacuaaagaacagauuaggacaaccacguucuggucaaagaaaaauuuggugguuaaggagaacuguaguccuaaagaggaacccuacaagaugcaagagaaauccauccugcggugcagcgaaaacaaugagaccauuaaccauaucauaccaaauggaaagucugaagacucaaucaagggccuccagccugaggaugucaaccuguuagugacaugucgagaagaggguaaucccguggccagucuggggcacagcgaggcggaaacuccagucgacgccuauuccaacggccaggcugcacuuaugggagagaaagaacgcaagaaagagaccgaugacggcgggagauacuggaaguucauugauugguuuugcggauucaaaucuaagucguugagcaagaggucccuccgggaccugauggaagaggaggccguuugccuacaaaugcuggaagagacacgccaggugaaagugauccucaauauuggucuguuugcuguauguucacuuggcaucuucauguuugucuauuucaguuuguga

SEQ ID NO: 62799 - RNA, 1980 nt, Artificial Sequence
  derived and/or modified sequence opt3 from SLC5A4__Homo_sapiens__NP_055042
auggccagcaccgugucccccucuacaaucgcugagacuccugaaccaccgccccugucagaccacauuagaaacgcagccgauauaagugucaucguuauuuacuuccucgugguaauggcggugggccuuugggcuaugcugaagacgaauagggggaccaucggaggguuuuucuuggccggccgggacauggcaugguggccuaugggggccagcuuauuugcuuccaacauuggaucuaaucauuaugucggccuggcagguacaggggccgcuucgggaguggccacuguuaccuucgaguggacaucaagcgugaugcuacucauccugggcuggauauuugucccaaucuacauuaaaaguggcgugaugaccaugcccgaauaucuuaagaaacgcuucgggggagagcgacugcagguauacuuguccauccucucucuguuuauuugcguugugcugcucaucagcgcggauauauucgcaggggccauuuuuaucaaguuagcucugggccuugacuuguaucuggccauuuucauccuacucgcaaugacugcugucuacacaaccacggguggacuggccuccgugaucuauacugauacccuucaaacaauuauaaugcugaucggcucauuuauuuugauggguuucgcguuuaacgaaguggguggauacgagaguuucacugagaaauacgucaaugccaccccuagcguuguggaaggcgacaaccucacaaucucugcauccuguuauaccccacgugcugauucauuccacauauuuagagacgccguaacgggcgauauucccuggccugggaucaucuucggaaugccaauuacugcucugugguacuggugcacaaaucaggugaucguccagagguguuuaugcgguaaggacaugagccaugugaaggccgcauguauuaugugcgccuaucugaaacuccuuccgauguuucugaugguuaugcccggcaugauaagucggaucuuguacaccgauaugguggcuugugucgugccuucugagugcguaaagcacugugggguugacgugggaugcacuaacuaugcguacccaacaaugguccuagaacugaugccccagggccuccgcggucugaugcuuuccgugaugcuggccagcuugaugucgucucucaccuccauuuucaauucagcaaguacgcuguuuaccaucgauuuauauacaaaaaugagaaagcaagcuagcgagaaagagcugcuaaucgccgggaggauuuucguccuccugcuuacugugguuuccauaguguggguaccuuugguccaggugucucagaacggccagcugauccauuacaccgaaagcauuucaaguuaccucggaccacccaucgcagccguuuuugugcuggcuauuuucuguaagcgggucaaugagcaaggcgccuuuugggggcuuauggugggacuggcaauggguuugauccgcaugauaacagaguucgcguauggcacuggguccugccucgcuccgagcaacugcccuaagaucauuuguggaguacacuaccuguauuuuucuaucguguuauucuuuggcucaaugcugguuacccuagguauuagucuccugacaaaacccaucccagacguccaccuuuaccgauugugcugggugcugagaaauagcaccgaagaaaggauagacauugaugccgaggagaagucccaggaagagacugacgaugggguggaagaggacuauccugaaaaaucucggggcugucucaagaaagcauacgaucuguucugcggauuacagaagggccccaaacugacgaaggaggaggaagaggcccuuucgaagaaauugacagacaccagcgaacguccauccuggcgcacuaucgucaacauuaaugcuauccuccugcuagccguugugguguucauacauggguauuacgcauga

SEQ ID NO: 62800 - RNA, 1932 nt, Artificial Sequence
  derived and/or modified sequence opt3 from SLC5A5__Homo_sapiens__NP_000444
auggaggccguggaaaccggcgagagacccacauucggggcuugggacuacggagucuuugcacugaugcuccuuguuagcacugguaucggccugugggugggguuggccaggggaggccagcgguccgcggaagauuucuuuacgggugggcgccgauuagcugcccugccuguaggacuaucucucucagcaaguuucaugagcgccgugcaaguccugggcgugccauccgaggcuuaucguuacggccuuaaguuucuguggaugugcuuggggcagcuccugaacucuguucugaccgcacucuuauucaugccgguguuuuauagacugggacuuacaucgacuuacgaauauuuggagaugagguucucacgggccguccgccugugugguacccuacaguacauuguggcuacaaugcucuauaccggcauaguaaucuacgcccccgcgcugauucuuaaucagguuacugggcuggacaucugggcaagccuccucaguacaggaauuaucugcaccuuuuacacggccgugggcgguaugaaagcugucguguggacugauguguuccaagucguugugaugcuguccggguuuuggguaguguuagccagaggagucaugcuggugggcggcccuaggcagguucucacccuugcacagaaccacucucggauaaaucugauggacuucaacccagauccccgcagccgauauacauuuuggacuuucguggucgggggaaccuugguguggcuauccauguacgguguaaaucaggcucaaguucagagauauguggccuguaggacagagaagcaggcgaaacuggcccuccugaucaaccaggucggccuuuuccugauugugucaagugcagcuugcugugggaucgucauguuuguguucuacaccgacugcgauccuuugcuccugggacggauuagcgccccagaccaauauaugcccuuacugguucuagauaucuuugaagaccucccuggcgugccaggucuguuccuugcuugugccuacucugggacguuguccacugcaucaacaagcauaaaugccauggcugcgguaaccgucgaggaucugauuaagccgcgucuccgcagucuggcacccagaaaacuugugaucauuucuaagggccuguccuugaucuauggaagcgccugccucacuguugcugcccugucgucuuuacugggcgggggagugcuacaggguuccuuuacagucaugggcgugaucucagggccucuccugggagcauucauucuuggcauguuuuugccagccuguaacacccccgguguacuggcugggcucggcgccggacuggcauuaagucuguggguggcgcuuggcgcuacguuguacccuccaagcgaacagaccaugaggguucuccccuccucugccgcacggugcgucgcccugagcgugaaugcuucagggcuacuggacccggcccuccugccugcaaacgauaguucccgagcucccagcucuggaauggacgccucacgcccagcgcuugccgacaguuucuacgcuauaagcuauuuguacuauggugcacugggcacauuaacuaccgugcucuguggggcccugaucuccugccuuacaggaccuacuaagagaucuacccuggcucccggcuugcucuggugggaucuggccaggcaaacagcaucggucgcgccaaaagaggagguugccauucuagacgauaaucuggugaagggucccgaagaguugccuaccgggaacaaaaagccaccgggcuuucugcccacuaaugaagaccggcuuuucuuuuugggacagaaagagcuggaaggcgcugggagcuggacgccuugcgugggacaugauggcggucgcgaccagcaggagacaaacuuauga

SEQ ID NO: 62801 - RNA, 1908 nt, Artificial Sequence
  derived and/or modified sequence opt3 from SLC5A6__Homo_sapiens__XP_006712193
augagcgugggcgucuccaccucugcuccccugucaccuacaagugggacuagcguuggaauguccacguucucuaucauggacuacgugguauuugugcuccuucuggucuugucguuagccauuggucuguaucacgcaugcagaggcugggggaggcauaccgugggagagcuacucauggccgaucggaagaugggcugucugccaguugcgcuuucacuguuggcuacauuccagagcgccguggcaauacucggugucccgagugaaaucuaccgcuuugggacucaauauugguuccugggaugcuguuacuuucugggccucuuaauucccgcccacaucuucauuccuguguuuuaucgacugcaucuuaccuccgcuuacgaguauuuggaacugcguuucaacaaaacaguaagaguuugcggcaccgugacuuuuaucuuccagauggucauauacauggggguggugcuauacgcaccaucucucgcccugaaugcugucacaggauuugaccuuuggcugagcguuuuggcccucgguaucguguguaccguauauacggcgcugggcggguuaaaggcagugauuuggacugaugucuuccagacccuggugauguuucucggacagcuugccguuaucauugugggcuccgcuaaagucggugggcugggaagggugugggccguagcaucacaacacggccggaucaguggcuucgaguuggaccccgauccuuucguucgccauacauuuuggacucuagcuuucgggggaguguuuaugaugcugagccucuacggugucaaccaggcccaggugcagagauaucugucuuccaggaccgaaaaggcggccguccuuucaugcuacgcaguguucccauuucaacagguuagccugugugugggcugcuugauagggcucguaauguucgcuuauuaccaggaguaucccaugaguauucagcaagcccaggcugccccugaccaguuuguccuguacuucgugauggauuuacugaaaggacuaccaggccucccgggucuguuuaucgcaugucuuuucucuggguccuugagcacaauuucgucugccuuuaauucccuggcuaccguuacgauggaggaccucauccggcccugguucccugaauuuucagaggcgcgcgcaaucaugcugagucgaggccuugccuucggauacggccuguugugccucgggauggcuuauauuagcucccaaaugggaccagugcugcaggccgcaauaucuaucuucgguauggucggcgggcccuuacugggacuauuuugucucggcauguucuuuccuugcgccaacccacccggugcugugguagggcugcuugccggcuuggugauggcauucuggauuggaaucggcagcauaguuacuucaauggggaguuccaugccgccuagccccucuaauggaucaaguuuuagccugccaacaaaccucaccgucgcgacugugacaacccugaugccuuuaacgaccuucuccaagcccacaggucugcagagauuuuacucucuuucguauuugugguacagcgcucacaauuccacuaccgugauugucguuggccucaucgugucacugcuaacagggaggaugcggggacguagucugaacccagccacuaucuaucccgugcucccuaagcugcuuucuuugcugccauuaagcugccagaaacgccuccacuguagauccuacggccaagaucaucuggacaccggucuuuucccggaaaagcccaggaaugggguacugggcgauucacgggacaaagaggcaauggccuuggauggaacagcuuaucagggcagcucuaguaccugcauucuccaggagacuucccuguga

SEQ ID NO: 62802 - RNA, 1743 nt, Artificial Sequence
  derived and/or modified sequence opt3 from SLC5A7__Homo_sapiens__NP_001291934
auggccuuccacguggagggccugaucgcuauuauagucuuuuaccuccuuauccuguugguugggauuugggcagccuggagaaccaagaacagcggauccgcggaagagaggucugaagcuaucauuguggguggccgggacaucggguuacugguaggaggcuucacaaugacugccacgugggugggugggggauauauaaauggcaccgcagaggccgucuacgugcccggcuaugggcuagcuugggcacaggccccuaucggauacucacucagucugauucuugguggccuguuuuucgcuaaaccaaugcgcagcaagggguauguuacaauguuggauccguuucaacagaucuacggaaaacgaaugggcggucuccuguucauucccgcccugaugggggaaauguuuugggcggcagccaucuucuccgcucucggagccacuauaucugugauuaucgacgucgauaugcauauuucggugaucaucucagcauuaauugcuacccuguauacacuuguaggcggcuuguacagcguugccuacaccgacgugguccagcuguuuugcauauucguggggcuauggaucagugugccuuuugcgcucucccacccagccgucgcagauauuggauucacugcuguucaugccaaguaucagaaacccuggcuggguacaguggacucuagcgagguauacuccuggcuugauucauuucuguugcucaugcugggcgggaucccuuggcaggcuuauuuccaacguguguuaaguucuagcuccgccaccuacgcacagguccugucauuccucgccgcuuuuggaugucuugugauggcgauaccagcaauucugaucggcgccaucggugcuagcacggacuggaaccagacugccuauggguugcccgauccuaagaccacagaggaagcagacaugauucuaccaaucguucugcaauaccucugcccgguguauauuaguuucuuuggccugggagccgucucugcugccgugauguccagcgcagauucgucuauacuuuccgcgucaaguauguucgcuagaaauaucuaccagcugagcuuuaggcagaacgccuccgacaaggagauuguauggguuaugcggaucacuguguucgucuuuggcgcaucugccaccgcuauggccuugcucacaaaaaccguguacgggcugugguauuuaagcucagaucuggucuacaucgugauuuucccccagcuacucuguguucuguuugugaagggaacgaauacuuauggugcaguagcuggcuacgucagugggcuuuucuugcgcauaacaggaggcgaaccuuaucuguaccuccaaccacugaucuuuuaucccgguuacuacccugacgacaacgggauuuauaaucagaaauucccauuuaagacccuugccauggugacuuccuuccugacaaacaucugcauuagcuacuuggcgaaauaucucuucgagucuggcacccugcccccgaaguuagauguuuuugacgccguggucgcuagacacucagaggaaaauauggauaagacgauccuggugaaaaacgagaauauaaagcuagacgaacucgcacugguaaaaccuaggcagaguaugacccuuagcuccacauucacuaacaaggaggccuuuuuggauguggacucuucgcccgaaggaagcggcaccgaggauaaucugcaauga

SEQ ID NO: 62803 - RNA, 1833 nt, Artificial Sequence
  derived and/or modified sequence opt3 from SLC5A8__Homo_sapiens__NP_666018
auggacacccccagaggcaucgggacauucguggucugggauuacguuguguuugccggaaugcugguaauuagcgcugcaauagguaucuauuacgccuucgcgggcgggggacagcaaacuuccaaggacuuucucaugggcgguaggcggaugacggcugugccugucgcccuuucucugaccgcaucauucaugagugccgugacaguuuuggggacuccaagcgagguguaucgcuuuggagcuauuuucuccaucuuugcauucaccuacuuuuucgucgugguaauuucugccgaaguuuuucugccgguguucuauaaacugggcaucacaucgaccuacgaguaucuagaacuccgauuuaacaagugcguccgucuguguggcacugugcuuuucauagugcagacaauccuguacaccgggauugucaucuacgcucccgccuuggcgcucaaucagguuacgggauucgaucuguggggugcagugguagccacuggcguggucugcaccuuuuauuguacauuagggggacucaaagcugugauuuggacugacguuuuccaggugggcaucauggucgccgguuuugcaucagugauaauucaagcuguaguuaugcaagggggaaucagcaccauuuuaaacgaugccuacgacggcggcagacugaauuucuggaacuuuaauccuaacccacuucagaggcacacauucuggaccaucaucauugggggaacguuuacuuggacaaguauauauggugugaaucagucccagguccagcgguacaucucuugcaagagccgcuuccaggcgaaauugucccuguauauuaaccuagugggccucugggccauccugaccuguucagucuuuugcgggcuugcacuguacaguagauaucaugauugugaccccuggacugcuaagaaggugagcgccccugaucaguugaugccauaccucguucuggacauauuacaagauuaccccggacugccuggccucuucguggcuugcgccuauucugguacacuuuccaccguaucaagcaguauuaaugcacuggccgcugucacgguggaggacuugaucaaaccauacuuuaggucucuauccgaacggagccugucguggaucucucaggggauguccguuguguauggcgcgcucuguauuggaauggcagcccuggcuucacuuaugggcgcccuguugcaggcagcccucagugucuucgggauggugggagguccgcugaugggcuuauuugcucuggggauccuaguacccuucgccaacagcauuggagcacucgugggccugauggcggguuucgcuauaucccuuuggguugggaucggcgcccaaauuuacccuccauugcccgagcgcacccugccucuccaccuggauauccagggaugcaauucuacauauaacgagacuaaucuuaugaccacaacugaaaugccauuuaccacaagcgucuuccagaucuacaacgugcagcgaacuccccugauggacaauugguauucauugaguuaccucuacuuuuccaccgugggcacgcuggucacauuacugguugggauucuagugagccucucuaccggagguagaaagcaaaaccuggacccgagguauauacuuacuaaagaggauuucuugucaaacuuugacaucuucaagaaaaagaagcaugugcugaguuacaaaagccacccuguagaagauggcgggaccgacaaucccgcauuuaaccauauugagcucaauuccgaucagucuggaaagucgaacggcacacggcuguga

SEQ ID NO: 62804 - RNA, 1899 nt, Artificial Sequence
  derived and/or modified sequence opt3 from SLC6A11__Homo_sapiens__NP_055044
augaccgccgagaaggcucugccccucggcaacgggaaagcagccgaagaggcgagagaaagcgaggcuccuggagguggcugcuccucugggggagccgcaccagccaggcacccgcgggugaagcgcgacaaagcuguccaugaacgaggccacuggaauaacaagguugaguucgugcuuucaguagcaggagagaucauugggcugggaaauguguggcguuuucccuacuuguguuauaaaaacggcggcggggccuucuuaauaccuuacgucguguuuuucaucugcugugguauuccaguguuuuuccuggaaacagcucuaggucaguuuacuuccgagggcgggaucacgugcuggagaaagguuuguccccucuucgaaggaauuggcuaugccacccaagucaucgaggcgcaucugaauguguacuauauaaucauucuugcaugggccaucuuuuaccugagcaacugcuucacaacugaguugccuugggcuaccuguggucacgaauggaauacagagaacugcguagaauuucagaagcucaauguuuccaacuauucucaugugucgcugcagaaugccaccucaccagucauggaguucugggaacacagggugcuggcaauuagcgaugggaucgagcacauaggaaaccuccggugggaguuagcucugugucuuuuggccgcguggacuauuugcuacuuuuguaucuggaaaggcacaaagaguaccggcaaaguggucuacguuacggccacuuuccccuauauuaugcugcuaauccuccugauccgcggggugacccuuccuggagcauccgaagguauuaaguucuaccuguauccagacuugucuagacucagcgauccgcagguauggguggacgcuggcacacaaauauuuuucuccuacgccaucugccuggggugcuuaacugcucugggaucauauaauaacuacaauaacaacuguuauagggauugcauuaugcucuguugccuuaauaguggcaccagcuuugucgccgguuucgcaaucuuuucugugcugggguucauggccuacgagcagggcguucccauagcugaaguggcggaguccggaccuggcuuggcauuuauugccuacccaaaagcugucacaaugaugccccuaucaccucugugggccacccucuucuuuaugaugcugaucuuccuugggcuggacagccaguuuguguguguagaaaguuugguuacggcaguggucgauauguauccaaagguguuccggcgcggauaccgaagagagcuccugaucuuagcccugucugucauuuccuauuuucuaggucucgugaugcugacugagggcgggauguacaucuuccagcuuuucgacagcuaugcugccucgggaaugugcuugcuguuuguugcaauuuucgaauguauaugcaucggcuggguguacgguucuaacagguuuuaugauaauauugaggacaugaucggguaccggcccccgucccucaucaagugguguuggaugauuaugacaccuggcauaugcgcgggaaucuucaucuuuuuccugauuaaauacaagccccuuaaauauaacaauauuuacaccuauccagcuuggggcuacgggaucggauggcugauggccuugucaaguaugcucuguauaccucuguggaucugcauuacuguauggaagacagaagguaccuuacccgagaaacugcaaaagcuaacgaccccaagcacagaucucaaaaugcguggcaagcugggggucaguccccgcauggugacuguuaacgacugcgaugcaaaacuuaagucugacggaaccaucgccgcuauuacagaaaaggagacucauuuuuga

SEQ ID NO: 62805 - RNA, 1845 nt, Artificial Sequence
  derived and/or modified sequence opt3 from SLC6A12__Homo_sapiens__XP_005253803
auggacggcaagguggccguccaggagugcgggcccccugcuguuagcugggugccagaagagggagaaaaacuggaucaagaggacgaagaucagguaaaggacagaggucaguggaccaacaaaauggaguucgugcucuccgucgcaggcgagaucauugggcuuggaaauguguggagguuuccguaccuguguuauaagaacggcgguggggccuucuuuauacccuacuucaucuuuuucuuuguuugcggcauuccuguguucuuuuuggaagucgcguuaggacaguauacaucucaaggcucagugacugcuuggcggaaaaucuguccacuguuccaggggauuggacuagccaguguaguuaucgagagcuaccucaauguguauuacauaaucauucuggcaugggcccuguuuuaucuuuucuccucuuuuacgucggaauugcccuggaccacaugcaacaauuucuggaacacugagcacuguaccgauuuccucaaucauucaggugcuggcacagucaccccuuuugagaacuucacuagcccagugauggaauuuugggagcgccgagugcuggggaucacaaguggcauucacgaccugggaucccuccguugggaauuagcacugugccuuuugcuggccugggucaucuguuacuucugcauauggaaggguguuaagucuaccgggaaagugguauacuuuacggcuacuuuccccuaucuaaugcucgugauucugcuuaucagaggagucacccugccuggcgccuaccagggcauuaucuauuacuugaagccagaucucuuuaggcugaaagacccccagguguggauggaugcggggacacaaaucuucuuuagcuucgcaauuugucagggaugcuuaacugcccuggguuccuauaauaaguaccauaacaauuguuauaaagacugcauagcucucugcuuucuuaacucagccaccaguuucguugcaggcuuuguggucuucagcauccugggguucaugucucaggagcagggagugcccauuuccgaaguagcugagucaggcccugguuuggccuuuaucgcguucccaaaggccguuacaaugaugccccuaagccaacuguggaguugucucuuuuucauaaugcugauuuuucuugggcuggauucucaguucgugugcgucgaguguuuggugaccgcauccaucgacauguuuccucggcagcuccgcaagagcggcagaagggaacuguuaauccugacgauugcugucaugugcuaccuaaucggacucuuccuggugacugagggcgggauguacauuuuucaacuuuucgauuauuacgccucgucuggaauauguuugcuguuucucucccuguucgaaguugugugcaucucauggguauauggugcugaccgguuuuacgacaauauugaggauaugaucggcuaucgcccauggccccuugucaaaaucaguuggcuguucuugacaccggggcucugucuggccaccuucuuauuuagccuguccaaguacacuccucuaaaauauaacaauguguacguuuacccgccauggggauauucuauuggcugguuccucgcacugagcucaauggugugcgucccucuuuuugugguaauaacauugcugaagacccgaggucccuucagaaaaaggcuccggcagcugaucacgccagacaguuccuuaccccagccuaagcagcacccaugucuggaugggagcgccggccguaacuuuggaccgucucccacccgcgaaggccuuauugcuggggagaaagagacacauuuguga

SEQ ID NO: 62806 - RNA, 1533 nt, Artificial Sequence
  derived and/or modified sequence opt3 from SLC6A13__Homo_sapiens__NP_001177926
auggacagcagaguguccggcaccacaucuaacggggagacuaagcccgucuacccuguuauggagaaaaaggaagaagauggaacgcuggagaggggucacuggaauaacaaaauggaauuugugcucucaguagccggcgagaucauugggcuuggaaauguguggcgguuuccauaucugugcuacaagaacggcggugagcauuguauggaguuccagaaaaccaaugggaguuugaacggaacaagcgaaaaugcuacuuccccggucauagaauuuugggagcgccgaguguuaaagaucucugacggcauucaacaccugggcgcacuacguugggagcucgcccugugccuucuguuggcguggguuaucuguuauuucugcauuuggaagggggugaaaucgaccggaaaggucguguacuuuacagcuaccuuccccuaucucaugcugguaguucugcucaucagaggugugacuuuaccuggcgccgcacaggggauacaguuuuaccuguauccaaaccuuacaagguugugggauccccaggucuggauggacgccggaacccaaaucuucuuuucauucgcuauuugucugggcugccuaacggcacucgguagcuacaauaaauaccauaacaauuguuaucgggauugcaucgcccuguguuuucuuaacagugggacuuccuucguggcuggauuugccauuuucucuauccugggcuucaugagccaggaacagggcgugccuauauccgaggucgcggaaucagggccaggauuggcauuuauugccuacccccgcgcuguugugaugcucccuuucaguccacugugggccugcuguuucuucuuuaugguaguguuacugggucucgacagccaguucgucugcguggagucucuuguuaccgcacugguggauauguauccgcacgucuuuagaaagaaaaauaggcgggaaguguugauccuaggcguauccguugugucauuccuggucgggcucauuaugcugacagagggaggcauguacguguuucaacuuuucgacuauuacgcugccagcgguaugugccuguuguuugucgcgaucuucgagagucucuguguggccuggguuuauggggcaaagcgcuuuuacgauaacaucgaagacaugauuggcuaccgacccuggccucugauaaaguauugcugguuauuccugacuccagcuguguguaccgccacauuccuauuuucucucaucaaauacacgccccugaccuauaauaagaaauacacuuauccuugguggggagaugcucuuggcugguugcuggcccucuccagcaugguaugcauuccagcauggucgcuguacagacuugggacacugaagggacccuucagggagcggauccgucaguugauguguccggccgaagaccucccucagcgcaaccccgcugguccaucugcgccugcaacccccagaacuucccuguuaaggcugacagagcuagaaucacauugcuga

SEQ ID NO: 62807 - RNA, 1929 nt, Artificial Sequence
  derived and/or modified sequence opt3 from SLC6A14__Homo_sapiens__NP_009162
auggacaagcugaaaugccccagcuucuuuaaguguagagagaaagaaaagguguccgccucuucagagaacuuccacgucggcgaaaaugaugagaaccaggacagggggaauuggaguaaaaagagcgauuaccuccuuuccaugaucggauaugcuguuggucugggcaacguguggcgguuuccuuacuugaccuauucuaaugggggaggcgcauucuuaauuccauacgccauaaugcuggcgcuagcuggucucccgcuguuuuuccuugaaugcucgcuggggcaauuugccucauugggacccguaagcguguggcgcauccucccucuguuccagggcgucggcauuacaauggugcugaucaguauuuuuguuacuaucuauuacaacgugauaaucgcauauucccucuacuacauguucgccucuuuucagagcgaguuaccauggaagaauuguuccucauggagugacaaaaacugcagccgaucucccauugucacgcauuguaauguguccaccguaaacaaggggauccaggagauuauccaaaugaauaaaucauggguugauauaaacaauuucacaugcauuaacggaagcgaaaucuaucagccuggucagcugccaagugagcaguacuggaauaagguggcacuucaacguucuuccggcaugaacgaaacuggggucauugugugguauuuggcucugugucuacuccuggccuggcuuaucgugggagcugcccuguuuaaaggcaucaagagcucggguaaggucguuuacuucaccgcguuguuccccuaugugguacuccugauuuuacuggugagaggggcaacacucgagggagccucuaaaggcauauccuacuauaucggcgcucagucaaacuuuaccaaacuuaaggaggccgaagucuggaaggacgcagcuacucagauuuucuacagucugagcguggccuggggaggguugguugcgcuauccucuuacaauaaauuuaagaacaauugcuucagcgaugccaucguggucugucugacaaacugccucaccucaguguuugcagguuucgcuauauuuaguauucugggccacauggcccauaucuccgggaaagagguaagccagguugugaagucuggauucgaccuugcuuuuaucgccuauccugaagcacuggcccaauugccaggcgguccguucuggucaauucucuuuuucuuuaugcuguuaacgcuggggcuagauagucaguucgcuagcaucgagacuauuaccacaacuauacaggaccucuuccccaaggucaugaaaaagaugagggugccuaucacccugggcuguugccuugucuuguuucugcucggacuggugugcguuacacaagcgggcauuuacugggugcaccuuaucgaucauuucugugcaggguggggaauccugauugccgcuauauuggaacucguagguaucauuuggaucuauggcgggaaucgguuuauugaggacaccgagaugaugaucggagccaaacgcuggauauucuggcugugguggagagcaugcugguuugucaucacgccaauuuuacugaucgccauuuucaucuggucccuagugcaguuucacaggcccaacuacggcgcuauaccuuauccagauugggguguugcccucgggugguguaugauuguguucugcaucauuuggauccccauaauggcaaucauuaagaucauucaggcgaaaggcaauaucuuucagcggcugauaucuuguugccgcccggcuucgaacuggggaccuuaccuugaacaacaccgaggcgagagauauaaggacauggucgaccccaagaaagaagccgaucaugagauuccaacugugagcggguccaggaagccugaauga

SEQ ID NO: 62808 - RNA, 870 nt, Artificial Sequence
  derived and/or modified sequence opt3 from SLC6A15__Homo_sapiens__NP_060527
augcccaagaacagcaaaguggucaagagagagcuggacgaugacguuaccgaauccgugaaagaucuccuuucuaaugaggacgccgcugaugacgcauucaagacaucagaacugaucguagauggccaggaggaaaaagacacugauguggaggaggggagugaagucgaggacgaaaggccugccuggaacagcaaguugcaauacauuuuagcucaggugggauuuuccguuggucugggcaauguguggcgguucccauaucuaugccagaagaacgggggaggcgcguaccuccugccguaucuuauacuguugauggucaucgguauuccccucuuuuuccuggagcugucuguggggcagcgcauccgacguggaucgauuggcguauggaauuacaucucaccuaaacucggcgggauaggauuugccagcuguguugugugcuauuucgucgcauuauacuauaacgugaucauugguuggagucuguuuuacuucucccaaucuuuucagcagccacuucccugggaucaguguccuuuggugaagaaugccagccacacguucgucgagccagaaugcgagcaauccucagcuaccacauacuauugguacagagaagcacugaacaucaguagcucuauuuccgagucaggcgggcuaaauuggaaaaugacuaucugucuccuggccgcuuggguuauggugugccuugccaugauaaagggcauucagagcaguggaaaaguaucuaugcuggaacccuuuuugauccuccugauuaccaucuccgguuucaucccuuuaagcaacucggugacagacuuuugugggcagauuacccauaauacuucuuucuga

SEQ ID NO: 62809 - RNA, 1887 nt, Artificial Sequence
  derived and/or modified sequence opt3 from SLC6A18__Homo_sapiens__NP_872438
auggcccacgcucccgagccugacccagcagccugcgaucugggcgacgaaagaccgaagugggauaacaaagcgcaguaccuccuuagcuguaccggguucgcugugggacuggguaauaucuggagguuucccuauuugugccaaacauacggcgggggagccuucuuaauuccuuaugucauagcacugguuuuugagggcaucccaauuuuccauguggaacuagccaucggucagcggcuccgcaagggguccguaggaguguggacugcuauuucucccuaccugucaggcgucggccuugggugugugacgcugaguuuucuuaucagccucuauuacaacaccauaguugcaugggugcugugguaucugcucaauuccuuccagcacccuuuaccauggucuucgugucccccugaccugaaccgaacaggauuugucgaggaaugccaggguucaagcgccgugaguuacuucugguaccgucaaacucuuaauaucaccgcugauauuaacgacuccggcucuauccaguggugguugcugauuugccuagccgcgagcugggcaguaguuuauaugugugugaucagagggauagagacaaccggaaaagucauuuacuuuacugcccucuucccauaucuggugcuuacaaucuuucugauuaggggcuugacccucccgggugcuacgaaggggcugaucuacuuauucacucccaauaugcauauccugcagaacccucggguguggcucgaugccgcaacccagauauuuuucucccuuucacuggcuuucggaggccacauugccuuugcgaguuauaauagcccacgcaacgacugccaaaaagaugccgucguuaucgcauuggugaauagaaugacaucucuauacgcuuccauugccguauucucagugcugggcuuuaaggcuacuaacgacuaugagcauugucucgauaggaauauccugagccuuauaaacgacuucgauuuucccgaacagaguauuucucgggacgacuacccugccguccugaugcacuugaaugcaaccuggccaaagcgcguggcccagcucccccugaaggcuugcuuacuggaggauuuccuagacaaauccgcgagcgggccgggacucgcauuuguuguguucacagaaaccgaucugcacaugccuggugcccccgucugggcuauguuguuuuucggcauguuguuuacgcuggggcucucgacuauguucggaacaguggaggccguaaucaccccacugcuugacguuggcgugcugccucgauggguccccaaagaggcauugacuggucucgugugucuggucugcuuuuuaucugccacaugcuucacccugcaguccgggaacuacuggcuagaaaucuucgauaacuuugcugccucaccaaaucuccugaugcuugcauucuuggaggugguuggcgugguauaugucuacggaaugaagagauuuugugacgauauugcguggaugacgggcaggcggcccaguccuuauuggcgucugaccuggcgcgugguuagcccacuccuguuaacaaucuucguggcuuacauuauacuguuguuuuggaaaccgcuuagauauaaggccuggaaccccaaguacgaacucuucccuuccaggcaagagaaacuguauccagggugggcacgggccgcuugcguccuacugucucuccugcccgugcuuuggguaccuguggccgcauuggcucagcuguuaacucgacgcagaaggaccuggcgggaccgcgaugccagaccagacacagauaugaggcccgacacugacacccguccggauacagacaugcggccugauaccgacaugcgauga

SEQ ID NO: 62810 - RNA, 1905 nt, Artificial Sequence
  derived and/or modified sequence opt3 from SLC6A19__Homo_sapiens__NP_001003841
auggugagacugguccuccccaacccuggccuugacgccaggaucccaagccuggcugaguuggaaaccauugagcaggaagaggcauccucucggccgaagugggauaauaaagcccaauacauguuaacaugccugggguucuguguuggacuagguaacguguggcgcuuucccuaucucugccagucacacggcgggggagcguucaugauaccuuuucugauccuucugguauuggaaggcauuccacuccuguaccuggaguucgcuaucggucagcgacuccguagagggaguuuaggaguguggagcuccauucaucccgcccugaagggccuuggcuuggcaucuaugcugacuucguuuauggucgggcuauauuacaauacgaucauaucauggaucaugugguaucucuucaacagcuuucaggagccucugccauggagugacuguccccuuaaugaaaaccaaaccggauacguggaugagugcgccagguccucuccuguugacuauuucugguaccgggaaacacugaauauuagcacuuccaucucagauagugguagcauucagugguggauguugcucugucuggcuugcgcauggucuguguuauacauguguaccauccgcggcauagagacaaccgggaaagccgucuauauuacuuccacacugccauacgugguacucaccaucuuucuuauuagaggacugacguugaagggcgcuacuaacgguaucguuuuccuauuuaccccgaaugugacagagcuggcccagcccgacacuuggcucgaugcgggggcacaggucuucuuuucauucagccuggccuucggaggccuuaucaguuuuucuuccuauaacagcgugcacaauaacugcgaaaaagacucggugauugucucuauaaucaauggcuucaccuccguuuacguggcuauuguaguguauucagucaucggguuuagggccacacaacgguacgaugacuguuucaguaccaacauacugacguugauuaauggauuugaucucccugaggguaacgugacucaggaaaacuucguugacaugcagcagcgcugcaaugcaagcgauccagcugccuaugcgcaacugguguuucagacaugugacaucaacgccuucuuauccgaggcagucgaaggcaccgggcuggcuuuuaucguguucacugaggccauuacaaagaugccccuaucuccucucuggagcguacuguuuuucaucaugcuuuucugcuugggacugucaaguauguucggcaauauggaggguguuguggucccacuccaggaccugcgagugauucccccgaaguggccuaaagaaguccuuaccgggcugauaugcuugggcacguuccucaucggauuuauuuucacccugaacuccggccaauacugguuaagccugcuagauucuuacgcugggucaaucccccuccugaucauugccuuuugugagauguucagugugguuuauguguacggaguagacagauuuaauaaggauauagaauuuaugaucggucauaaaccaaacaucuuuuggcaggucacauggagggugguuagcccucuuuugaugcugauuauuuuccucuuuuucuuuguggucgaggugucccaggaacugacuuauucuaucugggaccccggcuacgaggaguucccaaagucgcagaaaauaagcuaucccaauuggguauacgugguugucgugaucguggcaggggucccuuccuuaaccauuccaggauaugccaucuacaagcugauucggaaccacugccaaaagccgggcgaucaucagggucuuguuucaacauugaguacugcuucuaugaauggggaccucaaauacuga

SEQ ID NO: 62811 - RNA, 1800 nt, Artificial Sequence
  derived and/or modified sequence opt3 from SLC6A1__Homo_sapiens__NP_003033
auggccaccaacggcagcaagguggcugacgggcagaucuccacagaggucucugaagcacccguugccaaugauaaaccuaagacucuggugguaaaagugcaaaagaaagcggcugaccucccagauagagacacguggaagggaagguucgauuuucuuaugucaugcgucgguuacgccauuggccuggggaacguguggcgguucccguauuuguguggaaagaauggcgguggggcauuuuuaauacccuacuuccugacccuaaucuuugccggaguuccucucuuccugcuugagugcagucugggccaguauacaagcauuggcggguugggaguguggaaacucgcuccaauguuuaagggugucggccuggcagccgcugugcuguccuucuggcucaacaucuacuauauuguaaucauaucuugggccaucuacuauuuauacaauucguuuacuaccacacugcccuggaaacagugugacaacccuuggaauaccgaucgcugcuucucaaacuacagcaugguuaauacuacaaacaugaccagugcgguggucgaauuuugggagcgaaauaugcaccagaugacggacgggcuugauaagccaggacaaauucguuggcccuuggcaaucacucuggccauugcuuggauccuaguguauuucuguauauggaaaggcguggguuggaccgggaaggucguuuacuuuuccgccacauauccuuacauuaugcucaucauucuguucuucagaggagugacucuuccaggcgcaaaggaaggcauccuguuuuauaucaccccgaacuucaggaaauugucugacagcgagguauggcucgaugcugccacacagauauuuuucuccuacgggcugggauuagguucacugauugcgcucggcaguuauaauagcuuucauaacaauguguaccgggacucuaucauugucugcuguaucaacuccugcaccucaauguucgccggguuugugauauucagcauuguuggauuuauggcacacgugacgaagcgcaguaucgcugaugucgccgcuucuggccccggucuugccuuccuggcauacccugaggccgugacucaguugccaaucagcccccuaugggcuauucuguuuuucuccaugcuccugaugcuugggaucgacucgcaguuuuguacaguagaaggcuucauuaccgcgcugguugacgaguauccuagauugcucaggaaccggcgcgaacuguucauagcagccgugugcaucauuucuuacuuaaucggacuguccaauaucacucaaggcgggauuuaugucuuuaaacuauucgauuacuauucagcuaguggaaugagccuccuguuucuuguguucuuugagugugucuccauaucuugguucuacggugugaaccgauuuuaugacaauauccaggagaugguuggcagcagaccaugcauuugguggaaguugugcuggucauucuuuacacccaucauuguggccgggguauucaucuuuagugcaguccagaugaccccgcugacgaugggaaacuacguguucccuaaauggggccaggguguuggguggcucauggcccuguccagcauggugcuuauacccggcuacauggcuuauauguuucugaccuugaagggaucucucaaacaaaggauccaggucauggugcagccaucagaagauauuguacggccugagaauggccccgaacaaccacaggccgggaguagcacauccaaggaggcauacaucuga

SEQ ID NO: 62812 - RNA, 1779 nt, Artificial Sequence
  derived and/or modified sequence opt3 from SLC6A20__Homo_sapiens__NP_064593
auggagaaggccagaccccugugggcuaacagccuccaguucguguuugcaugcaucuccuacgccgucggccuugggaauguuuggagguucccuuaucugugucaaauguacggagguggcucuuuucuggugccauauauuauaauguuaaucguagaagggaugccgcugcuauaccucgagcuggcggugggacagcggaugcgccagggcucaauuggugcuuggcgaaccaucagucccuaucuuagcggggucggaguggccuccguuguggucucuuucuuucugucgauguacuauaacgugauuaaugcaugggccuucugguacuuguuucacucauuccaggacccucucccauggagcguaugcccccugaacggcaaucauacaggcuacgaugaagagugugaaaaagcuaguuccacucaauauuuuugguaccguaagacgcugaacaucucuccuagccuccaggagaaugggggaguucagugggagccagcauuaugccugcuuuuggccuggcugguggucuaucuauguauacucagagguaccgaauccacaggcaaagugguguacuucacugcuucacugcccuauugcguccuuaucauuuaccugaucaggggguugacccuccacggagccacaaacggccugauguauauguuuaccccuaagauugagcaguuagcgaauccaaaagcauggaucaacgccgcuacucaaauauucuuuagucugggucucggguucggaagccuuauugccuucgcaucuuacaaugaaccguccaacaauugucagaagcaugcuaucauuguuucacugaucaacagcuuuacaaguaucuucgccucuauugugaccuuuuccauauacggcuucaaggcgacguuuaauuaugagaacugcuugaaaaagguaagccuacugcucacuaacaccuucgaccuggaggauggcuuucuuacagccucgaaucuggaacaggugaaaggguacuuggcaucugcuuaucccuccaaguacucagagauguucccucagaucaaaaacuguagucucgaaagcgagcuggacacugccguccaaggaaccgguuuagcuuuuauuguguauacagaagccaucaagaauauggagguuucccagcuguggucugugcuauacuucuuuaugcuccugaugcuuggcauagggagcauguugggaaacaccgcagccauucugacgccacucacugauucaaagaucaucaguucccacuugcccaaagaggcuauuagcggccuugucugccuggugaauugugcgaucgguaugguauucacaauggaagcagggaacuauugguuugacauuuucaaugauuacgccgcuaccuugucucuccuguuaauaguucugguggagacuaucgccgucugcuacguguauggccuacggcgcuucgaaucagaccucaaggcaaugacaggcagagccgucaguugguacuggaaagugaugugggcuggaguuagcccucugcuuauuguguccuuguuuguauucuaucugucugauuacauccucaccgggacgcugaaguaucaggccugggacgcaucgcaaggacaguuagucaccaaagauuacccagcguaugcucuggccgugaucggucuuuugguugcaagcuccacaaugugcauuccccucgccgcucugggcacuuuugugcagaggcggcuaaagcgcggggacgccgauccggucgcauga

SEQ ID NO: 62813 - RNA, 1854 nt, Artificial Sequence
  derived and/or modified sequence opt3 from SLC6A2__Homo_sapiens__NP_001165972
augcugcucgccagaaugaacccccaggugcaaccugagaauaacggcgcugacaccgggccagaacagccgcuuagggcacggaagacagccgagcuguuggucguuaaagaacgcaauggagugcagugcuuacuggcgccccgagauggugacgcucagccucgugagacuuggggcaagaaaaucgauuuccuacucagcguagugggguuugccgucgaccuggcaaacguguggagauucccauaccuuuguuauaagaauggaggcggugccuuucugauucccuacacguuguuccucauaaucgcugggaugccucuguuuuauauggaacuggcacucggacaauacaacagggagggcgccgcuaccguuuggaaaauuugcccauucuuuaagggcgugggguaugccgucaucuuaauugcgcuguacgugggauucuauuacaauguaaucauagcauggucccuuuacuauuuguuuucuucauucacacugaaccuacccuggacugauuguggucacaccuggaauaguccuaacugcacagacccaaagcuccugaauggcagcguucuugggaaccauaccaaauacuccaaguauaaauuuacuccggccgcugaguucuacgaacggggagugcugcacuugcaugagucuucgggcauccacgauauuggucucccccaguggcagcuguuacugugucucauggucguggugaucguccuuuauuuuucacuguggaaggggguuaaaacaagcggaaaggugguauggauuaccgccacguugccuuacuucgugcuauucguccugcucgugcauggcguuacucugccaggcgcaaguaaugggaucaacgcuuaucuucacauagacuuuuaccgccugaaggaagccaccguguggauugaugcggccacacagaucuucuuuuccuugggagcagguuucggcguccucauugcuuuugccucuuacaauaaauucgacaacaacugcuauagagaugcucuguuaacuagcuccaucaauuguaucaccucauuugugaguggguucgccauuuuuagcauacugggauacauggcacacgagcauaagguaaacaucgaggacguugccacagaaggcgcuggucuaguguucauucucuaucccgaggcgaucucuacccuguccgggucaacguuuugggcagucguguucuuugucaugcuuuuggcccugggccucgauagcaguaugggaggcauggaagcugugauaacugggcuggccgacgacuuccaaguucuuaaaaggcaccggaagcuguucacauuuggagugaccuucucuacuuuucuccucgcacuguucugcauuacaaaagguggcaucuacguauuaacccugcuagauacguuugccgcugggaccuccauccucuucgccguccugauggaggcaauuggagugagcugguuuuauggcguugaccgcuucucgaaugauauccagcagaugauggguuuucgaccugggcuuuacuggagauuguguuggaaguucgugucuccagcguuucuguuguucgucgugguaguguccauuauaaacuuuaaaccccugacauaugacgauuacaucuucccgccuugggcuaauuggguuggcuggggaauugccuuaucaaguaugguccuggugcccaucuacgugaucuauaaguuccuuagcacucagggcuccuugugggaaaggcucgcauacgggauuaccccagagaacgagcaucaccuggucgcccaacgggacauacgucaguuucagcuacaacacuggcuggcuaucuga

SEQ ID NO: 62814 - RNA, 1893 nt, Artificial Sequence
  derived and/or modified sequence opt3 from SLC6A4__Homo_sapiens__NP_001036
auggagaccacaccccugaacagccagaagcaacucuccgccugcgaagacggcgaggauugucaggaaaauggggugcuucagaaagucguuccuacuccaggagacaagguggagucuggucagaucucaaacggcuacagugcuguaccgagccccggggcaggagaugacacgagacacuccauuccugccaccacaacuacccugguggcggaauugcaucaaggcgagagggagacaugggguaaaaaggucgauuucuuacugucugugauaggguaugcuguugaccuaggaaauguguggcgguuuccauacaucugcuaucagaacggcggcggggccuuccuccugcccuacaccauuauggcaaucuuuggagguauuccucuuuucuauauggaacuggccuugggccaguaccaccgcaauggguguaucucgauauggcgaaaaaucugcccaauuuuuaagggaaucggcuaugcuauuuguaucauagcauucuacauugccucauacuauaacacuaucauggcuugggcccucuacuaucugauuagcaguuuuacagaucagcugcccuggaccuccugcaaaaauucuuggaacacggguaauuguacuaacuacuucagcgaggacaauaucaccuggacacuccauuccacuucaccagcggaagaguuuuauacccgucacgucuuacaaauccauagaaguaaggggcugcaggaucuuggaggcauuagcuggcaguuggcacugugcauaaugcuaaucuucacagugauuuacuuuucuaucuggaagggcguaaaaaccuccgggaagguugugugggucacggccacuuucccuuauauaauucucucagugcugcuugugaggggagcuacacugccgggugccuggcggggcgucuuguuuuaccucaaacccaacuggcagaagcuguuagagaccgggguuuggaucgacgcagcugcccaaaucuucuucagccugggaccuggcuuuggugugcuccuugcguucgccaguuacaauaaguuuaacaauaacuguuaucaggaugcacugguaacuucuguggucaacugcaugacauccuucgugagcggguuuguuauuuucaccguguugggcuacauggcugaaaugcgcaaugaggacgucucggaaguggccaaagaugcuggaccaucucuacuguuuaucacguaugccgaggcaauugccaacaugcccgcuuccaccuucuuugcgauaaucuucuuucucaugcugauuacacuuggccuggacucaacuuucgcaggguuggaaggaguaaucaccgccguucucgacgaguuuccucacgugugggcuaagagaagggagcgguucguccuggccguggucaucacauguuucuuugguaguuuagugacucugaccuucggcggggcauacguugugaaacuacucgaagaguaugccacaggaccagcuguacugaccgucgcccuuauugaagcaguggcgguuagcugguuuuacggcauaacucaguucugccgcgaugugaaggagauguuggguuuuucccccgggugguucuggcgaaucugcugggucgcuauuucuccgcuguuucuccuguucaucauuuguagcuuucuuaugucaccuccccaacugagauuguuccaguauaauuacccauacuggaguaucauacucggcuauugcaucggaacguccagcuuuauuuguaucccuacauacauugccuauaggcugaucauaacccccggcacuuucaaagaacggauuaucaagucuauuaccccagagacacccaccgagaucccuugcggggacauacguuuaaacgcaguguga

SEQ ID NO: 62815 - RNA, 2394 nt, Artificial Sequence
  derived and/or modified sequence opt3 from SLC6A5__Homo_sapiens__XP_011518775
auggacugcagcgcccccaaggagaugaacaaacugccugcuaauuccccagaagcagccgcggcucagggccacccggaugggcccugugccccuagaaccucuccagagcaagaacuccccgcagccgcugcaccuccacccccuagggugccacggucagccaguacaggagcucagacuuuccagagcgccgacgcgcgcgcaugcgaggccgaacgaccgggugucggcuccuguaaacuuucuucgccccgugcucaggccgcaucagcugcccugagagauuugagggaggcgcaaggggcccaggcaagcccuccacccggaaguuccggcccugguaacgcuuuacauugcaagaucccauuucugcgggggcccgagggagacgccaauguuucugugggcaagggcacgcuagaacgcaacaauaccccgguaguggggugggucaacaugagccaguccacagugguucucgcuacugauggaauuaccucagugcugccugguagugucgccacaguggcaacccaggaggacgaacaaggcgaugagaauaaagccagagggaacuggagcucuaaacuugacuucauacuguccaugguaggauacgcuguuggcuuggguaauguguggagguuucccuaucucgcguuccagaacgggggaggcgcauuucugaucccauaccugaugaugcucgccuuagcuggccugccuauuuucuuucuugaggucucauuggggcaguucgccagccagggacccgugaguguguggaaggcaaucccagcccugcaagguuguggcauugcuaugcuaaucauaucuguccucaucgccauuuauuacaauguuaucauuugcuauacucuguuuuaccuuuucgcauccuuugugagcguacugcccugggggucguguaacaauccuuggaacacaccagaaugcaaggauaagaccaaauugcuccuggacucuugugugaucuccgaucacccgaagauacagauuaaaaauucaacguucugcaugacugcguaucccaacgucaccauggugaacuuuacaagucaggcuaauaagacuuucguuagcggauccgaggaauacuucaaguacuuuguguuaaaaaucucugccggcauugaguauccuggugaaauccgguggccacuggcacucugucuuuuccuggccugggucaucguguacgcuagcuuggccaaggggauuaaaaccucaggcaagguaguuuauuuuacagcaaccuuccccuacgugguccuagugauacugcucauccgcggagucacgcugccuggcgcuggggccggaauuugguauuuuaucacuccaaaaugggagaaacuuacagacgcgaccguguggaaggaugccgcuacucaaauauucuuuagucuguccgcagccugggguggcuugauuacacucagcucuuacaacaaguuccauaauaacugcuaucgagacacccugaucguuacgugcaccaauucagcuacaaguaucuuugccggguucgugauuuuuagcguaaucggauucauggcaaacgagagaaaggucaauauugaaaacguggcggaccagggccccgguauagccuuuguuguguacccggaggcuuuaacuaggcugccucuauccccauucugggccaucauuuucuuucucaugcugcuuaccuuggggcuggauacaauguucgcaacuaucgaaaccaucgucacaucuauuucggacgaguuucccaaauaccuccggacccacaagccuguguucacucugggcuguugcauaugcuuuuucaucaugggauuucccaugauuacgcagggcgggaucuauauguuccagcuuguagauacauacgcugccagcuaugcacuggugauuaucgccauauuugaauugguuggaaucuccuacgucuauggucuccaacguuucugugaggacauugagaugaugaucggcuuucagccaaauauuuucuggaaaguguguugggcuuuugugaccccuacuauccugaccuucauauuaugcuucucauuuuaccagugggaacccaugacauaugggaguuaccgcuacccaaacuggucuaugguccugggauggcuaaugcucgcguguagcguuauuuggaucccgauuauguucgugaucaagaugcaucuggccccuggcagauuuauagagaggcuuaaauuggugugcucaccccagccagauuggggucccuuccuggcacaacaccgaggggaacgguauaagaauaugaucgacccucucggcaccuccagccugggauuaaagcugccaguaaaagaucuugaguugggcacucaguguuga

SEQ ID NO: 62816 - RNA, 2166 nt, Artificial Sequence
  derived and/or modified sequence opt3 from SLC6A6__Homo_sapiens__NP_001127839
augggcgacgccgagagcugccugcucagacagcaaaccagggaagugcggaagaaaccccuuaucaacuaccgcuuccugcgagcugcagccaaugcggagccucgugggccacaggcucagagaacauccugugccaagagggaaugcggagcauuuacucagcggguccgcgagagagccgguaggcaaccgcccgcuggcgggacgcggcacucucgcgcagaacgaggaagaaggcggucacauccucguagucgcaccagaacaacugccuuguuaaggagcucccagaccaaagagauggcuacaaaggagaaacugcagugucuaaaggauuuccacaaggacauucucaaaccaucucccggcaagucgccugguacccggccagaagaugaggccgaagggaaacccccucagcgagagaaguggucaagcaaaauagacuuuguucugaguguggcgggaggcuucguaggccuugggaacguguggcgcuuuccauaucugugcuacaagaauggagguggcgcauucuugaucccguauuuuauuuuccucuuuggguccggacugcccgucuucuuucuggagaucauuaucggccaauacacuucugaaggugggauaacauguugggagaagaucugcccucucuucagcggaauuggcuaugccuccgugguuaucgugucauuacugaacgucuacuauauugugauccuugcuugggccaccuacuacuuguuucagaguuuccagaaagaacugccaugggcacauuguaaucacagcuggaacacgccccauugcauggaggauacuaugagaaagaauaaaucuguauggauaaccauuuccucaacaaacuucacuagcccuguuaucgaauuuugggagaggaaugugcuaagucucucuccaggcauugaccaccccgggucccugaagugggaucuugcucuguguuugcuccuggucugguuagugugcuucuuuuguaucuggaaaggagugcggagcaccgguaaggucguuuauuucacagccaccuuuccguucgcgaugcugcucgugcuucugguacgcggcuugacgcuaccuggggccggagcaggcaucaaauuuuaccuguaucccgacauuacuagacucgaggauccacagguguggauagacgcugguacacaaaucuucuuuucguacgccauuugccugggggcuaugaccucucuuggcuccuauaacaaguacaaguauaauucauacagggauugcaugcuguugggaugucucaacaguggcacuagcuucgucuccggguuugccaucuucucuauacugggauuuauggcacaggaacaggguguggacauugccgauguugcugagagcggcccuggguuagcguucaucgcauaccccaaagccgugacaaugaugccacugcccaccuucuggucaauccuauuuuucauuaugcuccugcuuuugggacuggacagucaauuugucgaaguggagggccagaucacgucccucguagaccuguauccuagcuuccuucguaaggguuaccggcgagaaauuuuuauagcuuucguuugcucuaucucauaucuguuggggcucaccauggugacagagggcggaauguacgucuuucagcuguucgauuauuacgccgcaaguggcguguguuuacugugggucgccuuuuucgagugcuuugugauugcuuggaucuaugggggagacaaucuauacgaugguaucgaagacaugauuggcuacagaccagggccguggaugaaauauagcugggccguuauaacucccgugcucuguguaggaugcuucaucuuuucccuggucaaguacgugccucuuaccuauaacaaaacauacguuuauccaaauugggcaauuggcuuggguuggucucuggcgcucucgagcaugcugugugugcccuuagucaucgugauuaggcugugccagacugaggggccuuuccuuguacgcgugaaguacuugcucaccccacgggaacccaacagaugggcuguugagagggaaggcgccacaccguauaacucccgcaccgucaugaauggagcacuggugaagccuacucacaucauaguggagacgaugauguga

SEQ ID NO: 62817 - RNA, 1911 nt, Artificial Sequence
  derived and/or modified sequence opt3 from SLC6A7__Homo_sapiens__NP_055043
augaagaaacugcagggcgcccaccucagaaagcccgugaccccugaccuucugaugacaccaagcgaucaaggggacgucgauuuggacguugauuucgcugcacauaggggaaacuggacugguaaauuagacuuucugcuauccugcaucggcuacuguguggggcucggaaauguauggcgguucccguaucgcgccuacacgaacggcgguggggcguuucuggugcccuauuuccuuaugcuggcuauuugcggaauaccuuuguuuuuccucgagcugucucugggccaguuuucaagucucggcccauuagccgucuggaagaucagcccccuguucaaaggggcaggagccgcuaugcuuuugauugugggucugguugcaaucuacuauaauaugauuaucgccuacgugcuauuuuaucucuucgcuucccugaccucugaucuuccuugggaacacuguggcaacugguggaauacagagcugugcuuggaacaucgagucucgaaggacgggaacggagcccucccacugaauuuaacuuguaccgugucacccagcgaggaauacuggagucguuacguacugcacauacagggcucccaggguaucgggucuccuggagagauuagauggaaccucugccuuugucuguugcuagcguggguuaucguguuucugugcauucucaagggcgucaaaagcuccggcaaggugguguauuucacagcaaccuuuccauaccugauccuucugauguugcucgucaggggaguuacucugccgggggccuggaaagguauacaauucuauuuaacaccccaguuccaucaucugcuaucaaguaagguguggauugaggcugcccuccagaucuuuuacagccugggcguaggguucggaggccuuuugaccuuugcaucuuauaauacguuccaccagaacauuuaccgggauacuuuuaucgugacccuggguaaugcuaucacauccauucucgccggguucgcgauauuuucaguccugggcuauaugagccaagaacuuggagugccuguugaccagguggccaaagcaggcccagggcuggcuuucgucguguacccccaggccaugacuauguugccucucaguccauuuuggucuuuccuguuuuucuuuauguuacugacccuaggacucgauucccaguucgcuuuccuggagacaaucguaaccgccguuacggacgaauuucccuacuaucuucgcccgaagaaggcaguguucagcgguuugauuugugucgccauguaccugaugggccucauccugacuacagaugggggaauguauugguuagugcugcuugacgacuacucggcuucuuuuggcuugauggucgugguuauaaccacuugccucgcggugacaagaguauaugguauucaaagguucugucgggauauccacaugaugcugggguuuaaaccuggccuauacuuccgcgcaugcuggcuguuucucucccccgccacccugcuugcuuugauggucuauucaaucgugaaguaccagccaagugaguacggaagcuaucgauucccucccugggccgagcuguuaggcauucucauggggcugcuuuccugccugaugaucccagcaggaauguugguugccgugcucagagaagaggguucucugugggaaaggcuacagcaagcuagccggcccgccauggacuggggcccuucacuggaggaaaaccguacggggauguacgucgcaacccucgcgggaagucaguccccaaaaccgcugauggugcacaugcgcaaguauggcgguauuacuagcuuugagaauacagcuauagagguagauagagaaaucgccgaggaagaggaaucuaugauguga

SEQ ID NO: 62818 - RNA, 1878 nt, Artificial Sequence
  derived and/or modified sequence opt3 from SLC6A8__Homo_sapiens__NP_001136277
auggccaagaaaagcgcugagaacggcaucuacuccgugucuggggacgaaaagaaaggaccccugauugcaccugguccagauggcgccccggcgaagggggacggacccgucggccucgguaccccugggggaagacuugcuguuccacccagggagacauggacucggcagauggauuucauaaugucaugcgugggcuuugccguaggccuggggaauguguggcgcuucccuuauuuguguuacaaaaacggagguggcgucuuuuuaaucccauaugugcugauugcccuaguugggggaauccccauuuucuuucucgaaaucagucugggccaauucaugaaggccgguagcauaaauguguggaacaucugcccucuuuuuaaggggcugggauacgcuuccauggucauuguguucuauuguaauacguacuauaucaugguauuggcauggggcuuuuacuaccucguuaaaucuuucaccacaacucugccaugggcaaccugcggccacacauggaacaccccggacuguguggagauuuuucgacaugaagauugcgcuaaugccucgcuggcgaaccucacuugugaccaguuagcagaucguagaucacccgucaucgaguucugggagaauaaggugcugaggcuuagcgggggauuggaagugccuggugcccugaacugggaggucacacuaugccuccuggcuuguuggguucuuguguauuuuugcguauggaaaggcgugaagaguaccgggaaaauagucuacuucacggccacuuucccauaugugguucugguggucuugcucgugcggggaguacuguuacccggcgcacuggacgguauuaucuacuaucucaagccugauugguccaaacuugggucuccacagguuuggauugacgcuggcacccagaucuuuuucagcuacgccaucggacugggcgcguugacagcccuaggguccuauaaucgcuuuaacaauaacuguuacaauggaacuucauucuuugcagguuucguggucuuuaguauucugggcuucauggcugccgaacaaggggugcacauaagcaaggucgcugagucuggacccggccucgccuuuaucgcauacccgagagccgugacccugaugccuguugcuccccuuugggcggcacuguucuuuuucauguugcuccuguuaggucuggauucccaguuuguggggguagagggcuucauuacaggacuacucgaccugcuuccagccucauauuacuucagguuucagcgggaaaucagcgucgcuuugugcugcgcccuguguuucgugauagaucucaguaugguuaccgacggcgggauguauguguuucagcuguucgacuacuauucugcauccggaacgacucuucuguggcaagccuuuugggagugcgucgugguagcuuggguguacggugccgaucgcuucauggacgauauugcauguaugaucggcuaucgaccuugccccuggaugaagugguguuggagcuuuuucacaccauugguuugcauggggaucuuuauuuucaacgucguguacuacgaaccccucguguauaacaauaccuacgucuauccuugguggggagaggcgaugggcugggcuuuugcccugucgucuauguuauguguuccacugcaucuacucgguugccugcuuagagcaaaagggacuauggccgaaagguggcagcacuugacacagccgaucuggggccugcaucaccucgaguaccgggcucaggacgccgaugugcguggacugaccacguuaacccccguguccgagucaaguaagguagucgugguugaaagcgugauguga

SEQ ID NO: 62819 - RNA, 1857 nt, Artificial Sequence
  derived and/or modified sequence opt3 from SLC6A9__Homo_sapiens__XP_011540319
augagcggcggggacaccagagccgcuaucgcaaggccccggauggccgcggcucacggaccuguggccccauccucuccggagcaggucacacugcuccccguucaacgcucauucuuucuuccuccauucaguggugcaacucccagcacgucccuggccgaaucuguguugaagguauggcauggcgcuuacaacucgggguuacugccucagcuaauggcacagcacucacucgccauggcucagaauggagccgugccaagcgaggcgaccaaacgagaucaaaaccugaagcguggcaauugggguaaccagauugaauuuguccuuacaagugugggguaugcaguuggacugggcaauguguggagauuccccuacuugugcuauaggaacggcgggggagccuuuauguucccuuacuuuauaaugcucaucuucugugguauuccacuguuuuucauggagcuguccuuuggccaguucgcuucucaggggugccucggagucuggcggaucagcccgauguuuaaaggcguggguuaugggaugaugguaguuuccacuuacauuggaaucuauuacaauguggucauauguaucgccuucuacuauuucuuuucaaguaugacccauguguuacccugggcauacugcaacaauccuuggaacacacacgacugugcuggcgugcuggaugccagcaaucuuaccaacggcucucgcccagcggccuugcccuccaaucugucacaucuacucaaccacagccugcaaagaacaaguccuucugaagaguauuggaggcuuuacguccugaaguuguccgacgauauugggaauuucggagagguucggcucccacuguuagguugccugggcgugagcuggcucguaguguuucuuugucugauccgcggggucaaaucgucuggaaaggugguuuauuucacugcaaccuuucccuacguggucuugacgauucuauucgugcgaggcguaacucuggaaggugcuuuugacgggaucauguauuaccucaccccgcagugggauaagauacuggaggccaaaguuuggggcgacgcugccucccagauuuucuacucacuuggaugcgcauggggcgggcugaucacaauggccaguuauaacaaguuucacaacaauuguuacagagauagcgugauuaucuccaucacuaacugcgcuaccucugucuaugcgggauucgugauuuuuagcauauuggguuucauggcaaaucaucucggcgucgacgugucaaggguugccgaucacgggccuggacuggcuuuuguggccuaccccgaagcauuaacacugcuaccaaucaguccucucuggucccugcuuuucuucuuuauguugauucugcucggccuggguacccaguucugucuucuggagacguugguaacugccaucgucgacgagguggggaacgaauggauacuccagaaaaagacauauguuacccugggcguggcugucgccggauuuuuacugggcauuccccuaacuagccaagcagggaucuacuggcuccugcuuauggauaauuaugcggcuucuuucucauuggugguaaucaguugcauuaugugcguggccaucauguacauuuacggacaucggaacuauuuucaggacauacaaaugaugcuggguuucccacccccucucuuuuuccagaucuguuggcguuuuguuagcccagcaauuaucuucucccugccgacacaccgcgcccccgcuccuggcccagccugcuuuuuccacgggcccgacgucgauucuuguccuugcucggcaccaaaugcuuuauuuuga

SEQ ID NO: 62820 - RNA, 1572 nt, Artificial Sequence
  derived and/or modified sequence opt3 from SLC7A10__Homo_sapiens__NP_062823
auggccggccacacccagcaacccagcgggagaggaaacccuaggccagcuccgucccccucuccugugccagguacaguccccggcgcaucagagcggguugcccugaagaaagaaaucgggcuccuuagugcgugcacuauuauaaucggaaauauuaucggcagcgguauuuucaucuccccuaagggggugcuggagcauucuggaucgguaggcuuggcuuuauuuguguggguccugggcgggggagugacggcccuagguucacucuguuacgcagaacugggcguugccauaccaaaaagcgggggagacuaugcuuacgugaccgagaucuucggcggucuugcaggguuucuguugcucuggagugccguccugauuauguaucccacaucccuggcugugaucucuaugacuuucagcaacuacguacuccagccuguuuuuccaaauugcauuccgcccaccacagccucccgcguguuaucaauggcgugucugaugcuuuugaccugggucaacaguagcucugugcgaugggcaacucguauccaggauauguucacaggaggcaagcugcuagcccucucccugauaauuggcguggggcuucugcagaucuuucaaggacacuucgaagaguugagaccuucaaaugcuuuugccuucuggaugaccccaagcgucggucaucucgcacuggcuuuucugcagggcaguuucgccuuuucuggguggaacuuccugaauuauguuacggaggaaaugguggacgcgaggaaaaaccucccccgggccauuuucaucuccaucccucuuguaacuuuuguguacaccuucacaaauauugcauauuuuacugcuaugagcccacaggagcuguugucgucuaacgccgucgcugugaccuucggagaaaagcuacugggcuacuuuuccuggguuaugcccgugucagucgcccucaguacauucggugggauaaauggcuaccuguuuaccuauagccgccuuugcuucuccggagcaagagagggccacuuaccgucuuugcucgccaugauccaugugaggcacuguacgccuauucccgcucuguuaguaugcuguggggcgacugcaguuaucaugcuggugggagauacauacacccuaauaaacuaugucagcuuuauuaauuaccucugcuauggugugacuauccugggccuuuugcugcuccgguggcgccgaccagcccugcacagaccuaucaaggucaaccuucugauucccguggcuuacuugguuuucugggccuuucuccugguguucucauuuaucagugagccaaugguauguggggucggagugauuauaaucuuaacaggcguucccauuuucuuccuggguguguuuuggagguccaaaccuaagugcguccaucggcuaaccgaaagcaugacgcacugggggcaggagcucuguuucgugguauauccacaagacgcaccggaagaggaagagaauggccccugcccuccaucucugcuucccgccaccgauaaaccuucaaagccacaguga

SEQ ID NO: 62821 - RNA, 1506 nt, Artificial Sequence
  derived and/or modified sequence opt3 from SLC7A11__Homo_sapiens__NP_055146
auggugagaaagcccgucguuagcaccaucuccaaaggcggguaccugcagggaaacgugaaugguaggcucccuucucuuggcaacaaggagccaccggggcaagaaaaaguacagcugaagcggaaagugacauuguuacgcggagucucaauuauaaucggcacuauuaucggugccgggauuuucaucagucccaagggagugcugcagaauacgggcagcguuggcaugucccuaaccauauggacagugugcgggguccucucucuguuuggagcucuuucguaugcagagcuggguacuaccaucaagaaaucaggcgggcacuacacauauauuuuggaaguguucggaccucucccagccuuuguacgaguuuggguggagcugcugaucauucgucccgcggcuaccgccgucaucagccucgcauucggcagauacauauuagaaccuuucuucauucagugugagaucccagagcuggccauuaaacuuaucacugcuguggguaucacaguggucaugguuuugaacaguauguccgugucuuggagcgcaaggauucaaauauuucugaccuucugcaaacuaacggccauccucauuaucauaguacccggggugaugcagcugauuaagggacagacucagaauuuuaaagacgcuuucuccggccgggauucaaguaucacccgccuuccucuggccuuuuauuacggcauguaugcguacgcagggugguucuacuugaacuuugucacagaagagguggaaaauccagagaagacuaucccgcucgccauuuguaucagcauggcuauuguuaccauaggauaugugcugacaaacgucgccuacuucaccacgaucaaugcagaggaauuacugcucucuaacgcuguggccguaacuuucuccgagagacuucuggguaauuuuucauuggcgguucccauuuucguggcccuaagcugcuuuggcaguaugaacgggggagucuucgcagugucuaggcuguuuuaugucgcuucccgggaaggccaucucccugagauccugagcaugauccacgugcgcaagcauacaccacuucccgccguuauugugcugcacccuuugaccaugauaaugcucuuuucgggugaccuggauucuuuacugaauuuucuauccuucgcucgauggcucuuuaucgggcuggccguagcaggccuuauuuacuugagauauaaauguccagacaugcauaggcccuucaaggucccgcuguuuaucccugcccucuucucauuuacuugccuguucaugguggcucuuagucuguacagcgaucccuucuccacaggaauuggcuuuguuaucaccuugacgggggugccagcguauuaccucuucauaaucugggacaaaaagccucggugguuucguauuaugucugaaaagaucacccgcacacugcaaauuaucuuagaggucgugcccgaggaagauaagcuguga

SEQ ID NO: 62822 - RNA, 1413 nt, Artificial Sequence
  derived and/or modified sequence opt3 from SLC7A13__Homo_sapiens__NP_620172
auggacagaggcgagaagauccagcugaaaaggguguucggguacugguggggaaccagcuuucuccuuauuaacauaaucggugccggcauuuucgucucccccaaggggguucuggcuuauucuugcaugaaugugggaguaucauugugugugugggcaggcugcgccaucuuagcgaugacaaguacucuguguagcgcugaaauuuccaucucuuuuccuugcucgggugcccaauacuauuuccuaaaacgguacuuugggucaacggucgcauuccucaaccuguggaccagccuuuuucugggaaguggcgugguugccggccaggcuuugcuccuggcagaguauuccauacagccauucuuuccgucuuguagcgugcccaagcugccuaaaaagugccucgccuuagcuaugcuguggaucgucgggauucuuacaucccgcggagugaaggaaguaacuugguugcagaucgccucaaguguucugaaagugagcauucuaucuuucaucucccucaccggugucguguuucugauacgaggcaagaaagagaauguggaacguuuccaaaacgcguuugaugcagagcuuccagacauuucacaccugauccaggccauuuuccagggguacuucgcuuauagcggaggcgccuguuuuacauugaucgcuggugagcucaagaaacccagaaccacuaucccuaagugcauuuucacagcacugccauuagucaccguuguguaccugcucguaaauauaaguuaccuuacggugcugacucccagggaaaucuugucuuccgaugccgucgcgauuaccugggccgaccgggcauuuccuagccuagcuuggaucaugccauucgccauaucgacaucucuguuuuccaaccuccugauuucaaucuucaagaguagccgcccgaucuaucuugcuucccaggaggggcaacugcccuugcucuuuaauacucugaacucucauagcucaccuuucaccgccguguuacugcuaguuacacucggaagucuggcaauuauccuuaccuccuugauugaucugauaaauuacaucuuuuucacgggcagccucuggucuauucugcuuaugaucggcauccugagaaggcgguaucaggaaccaaacuugucaauucccuacaaaguguuucucaguuucccucuggccacuauagucaucgacgugggguuaguaguuauuccacuggucaagagccccaaugugcacuauguguacguccuacuccuggugcuuuccggauugcuguuuuauaucccgcucauucauuucaaaauccgccuggcuugguucgagaagaugacauguuacuuacagcugcuuuuuaacauaugcuugccugauguuucugaggaauga

SEQ ID NO: 62823 - RNA, 2316 nt, Artificial Sequence
  derived and/or modified sequence opt3 from SLC7A14__Homo_sapiens__NP_066000
augagcggcuucuuuaccucccuggaccccagaagggugcaguggggagccgcuugguacgcaaugcacucucggauccuccgcacaaagccugucgagucaaugcuugaagggacugguacgaccacagcccauggcacuaaacuggcgcaaguuuugaccacaguggauuuaauuagucuggggguaggaagcugcgugggcaccgguauguaugucguguccgggcuaguugcuaaggagauggccggaccaggcgugauagucucuuucaucauugcagccguggcuucgauccucucaggcguauguuacgcagaauuugggguucgagugccgaaaacuacaggaagcgccuauaccuacaguuaugucacggugggugaguucguggcuuucuucauuggcuggaaccugauccuugaauaccugauagggacugccgcgggagcauccgccuugucuagcauguuugacucccucgcuaaucacaccaucucacguuggauggccgauagugucggcacacugaacggucuggggaagggagaggagagcuaucccgaccucuuagcacugcuuauugcuguuaucgugacuauuaucguagccuugggcgugaaaaauucuauaggcuucaacaauguccugaacgugcuaaaucucgcgguuuggguguuuauuaugaucgccgggcuguucuuuauuaacggaaaguacugggcagaaggucaguuccuuccucauggcugguccgggguccugcagggagcugcuaccugcuuuuacgcuuucaucggcuucgauaucauugccacaaccggugaggaagcaaagaauccaaacacgucaauacccuaugccaucacugcuagcuuggugauuugucucacagcguacguaaguguuucugugauccugaccuuaauggucccuuauuacacuauagacacagaguccccacugauggagauguuuguggcacacggguucuaugccgcuaaauuugucguggccauuggcagcguugcaggacucaccgugucgcuucugggcucuuuguuccccaugccuagaguaaucuacgccauggcuggggauggacuacuguuuagguuccucgcccaugucuccucauauacggaaaccccagugguugcaugcaucgugagugguuuucuggcggcccuucuggccuugcucgucagccugcgggacuuaauugagaugauguccaucggcacacugcuagcauacacucucgugucuguaugugugcugcuuuugcgcuaccagccggaaagcgauauugacggguucguuaaguuucugucagaggaacacaccaaaaagaaagagggaauacucgccgauugcgagaaggaggcuuguagucccgucuccgaaggcgacgaauuuagcgguccugccacaaauacuugcggggcaaagaaccugccaucucuuggcgauaaugagaugcugaucggaaaaucagacaagaguaccuauaacgugaaucaccccaacuacggcacaguggacaugaccacugggauugaagcugaugagagcgagaacaucuauuugaucaaacucaagaaacugauuggaccucauuacuauacgaugagaauaagguuaggucugccaggcaagauggaccggcccacagccgcgaccgggcacacugucaccaucuguguucuacuccuguuuauucuuauguucaucuuuugcuccuucauuaucuucggaucugauuacauaucggaacaaagcuggugggccaucuugcugguggugcucaugguacuguuaauuuccacacuggucuuugugauccuucagcagccggagaauccuaaaaaguugcccuauauggcuccaugucucccuuucguucccgcauuugccaugcuggugaacauuuaccuaaugcugaagcucucaaccaucacuuggauacgcuucgcugucuggugcuuugugggccugcuuauuuacuucgguuaugggaucuggaauaguacauuggaaauuucugcccgagaggaagcacugcaucagagcacguaccaaagauaugacguugaugacccauuuuccguggaggagggcuucucauacgcgaccgaaggagagagccaggaagauuggggcgggcccacugaggacaaaggauuuuauuaccagcagaugucugaugccaaggcuaacggcaggacauccaguaaagccaagagcaaaucuaagcacaagcaaaauuccgaggcauuaaucgcuaacgacgaacucgauuauucaccugaguga

SEQ ID NO: 62824 - RNA, 1890 nt, Artificial Sequence
  derived and/or modified sequence opt3 from SLC7A1__Homo_sapiens__XP_005266564
augggcugcaaggugcugcucaacaucgggcagcaaaugcuuagaaggaaagucguugacuguagccgggaggaaacccgccugucccgaugcuugaauacauucgauuuaguggcccugggaguagguucuacucuaggcgcugggguguacguccucgcaggagccguggcgcgugagaacgcuggccccgccauuguuauaucauuucugaucgcagcccuugcuagugugcuggcagguuuguguuauggggaguucggagccagagucccuaagacgggcagcgcuuaccucuauuccuacgugaccguaggcgaacugugggccuuuauuacaggguggaaucugauccucucuuauauuaucggaacuucgucaguugcgagggcauggagcgccaccuucgacgaauuaauaggucggccaaucggcgaguuuagucgcacacacaugacccugaacgcuccgggggugcuugccgagaaucccgauauuuucgcagucaucauuaucuugauacugacuggacuacucacacugggcgugaaagaauccgcuauggugaacaagauuuuuaccugcaucaauguccuuguucuggguuucauuauggugucuggguuuguaaaaggaagcgugaagaacuggcaguugacggaggaagacuucggcaauacuuccggcagacucugucugaacaaugauaccaaggaggggaaaccuggagucgguggcuuuaugccauucggguuuucaggaguguuaaguggcgccgcgacaugcuucuacgccuucguugguuuugacuguaucgcaacuaccggggaggaagugaagaacccccagaaagcuaucccugucggcauuguggccagccugcucauaugcuucaucgcuuauuuuggaguaucugccgcacuuacacugaugaugccauacuucuguuuggauaauaacuccccacuaccugacgccuuuaagcauguuggcugggagggggcuaaauacgcgguggcagucggaucacugugcgcccucagcgcuagucugcuugguucuauguucccaaugccgagggugauuuaugccauggcagaagauggccuguuguuuaaguuccucgccaaugucaacgaccggaccaagacgcccaucauagcuacucuggccuccggggcaguggcggcuguuauggccuuuuuauucgaucugaaagaccuaguggaucucaugagcauuggaacacugcuugcauacucguugguagccgcuuguguccuggugcuccgcuaucagccugagcaaccaaaccugguuuaccagauggccucuaccuccgacgaacuugaccccgcagaucagaaugagcuggcuucaacuaacgacagucaguugggcuuucucccugaggccgaaauguucagccugaagacaaucuuaucccccaaaaauauggagcccucuaagaucagcggucugauugugaacaucucaaccagucuaauugcgguccucauaaucacguuuugcauugugaccguacuggggcgagaagcccuuacaaaaggcgcuuugugggcaguguuccugcucgccggauccgcucuguuaugcgccguugucacuggcgugaucuggagacaaccggagagcaagaccaaacugucuuucaaggugccuuuucuucccgucuugccaauccucucaauuuucguuaauguguaucugaugaugcagcuagaucaggggacaugggugagguuugcaguauggaugcugauaggauucaucauuuacuuugguuauggccucuggcacagugaagaggcgagccuggacgccgaucaggcucggacuccugacgggaaccuugaucaauguaaguga

SEQ ID NO: 62825 - RNA, 2097 nt, Artificial Sequence
  derived and/or modified sequence opt3 from SLC7A2__Homo_sapiens__NP_001158243
augaagaucgagaccagcggcuacaacuccgacaaacugauuugcagaggguucauaggaacacccgccccuccagugugugauucuaaguuucuccuuucaccgaguagcgacgucaggaugauccccugccgggcugcacugacuuucgcccgcuguuugauucgacguaaaaucguuacguuagauucccuggaagacaccaagcuaugcagaugucucucuacaauggaucugauugcgcuuggugugggcucgacucugggggcuggaguauauguguuggccggcgaggucgcaaaagccgacucagguccuagcaucgugguuaguuuucucauagcugcacuggccuccgugauggcugggcugugcuacgccgaauuuggagcgagggucccaaagaccggcucugcauaucucuacacauaugugaccguaggcgaguuaugggccuuuaucacuggguggaaucugauucuuagcuacguuaucggaacauccucaguggcucgggccuggagugguaccuucgaugaauugcugagcaagcagauuggccaauuucuacgcacguauuucagaaugaacuacacugggcucgcagaguaccccgacuuuuucgcugucugucugauccuucuguuggccggacuccugucuuuuggcgugaaagaguccgcgugggugaauaaggucuucaccgccguuaacauauuagugcugcucuuuguaaugguggcagguuucgucaaagggaauguggcuaacuggaagauuucagaagaguuccuuaaaaauaucagcgccagugcuagggaaccuccaucugagaacggaacauccauuuauggcgccggcggguuuaugcccuacggauucacugguacccuggcaggcgccgcuacaugcuuuuaugcguucguuggguuugauuguaucgcaaccacgggagaggaagugcggaauccucagaaggccaucccaauuggcauagucacuagcuugcuagugugcuucauggcuuacuuugguguaucggccgcacugacacucaugaugccguauuaccugcuugacgagaagucuccccugccuguugccuucgaauaugugggguggggcccagcuaaauacgucguggccgcaggauccuugugugcgcucucaaccagucuguuaggcagcaucuuucccaugccucgcgucauuuacgcuauggccgaggaugggcugcuauucaagugccucgcacagaucaacuccaaaacuaagacaccaauaauugccacccugucuagcggagcuguggccgcacuuauggcuuucuuguucgaccugaaagcccucguugauaugaugucaaucgguacgcugauggcguauagucuuguggccgcuugcguacugaucuugcgauaccagcccggccucuccuaugaccaaccgaaguguagcccugaaaaagacgggcugggaucuucacccagagucaccaguaagagcgagucccaggugacaauguuacagaggcagggcuuuucuaugcggacucuguucugcccaucgcuacucccuacccaacagagcgcaucccugguuucauuccuuguggguuucuuggccuuccugguccucgggcugaguguguuaacaacuuacggcguacacgcuauuacccgucuggaggccuggucucuugcauugcucgcgcuguuucuagugcuguucguugccaucguccucacaauuuggcgccagccccagaaucaacagaagguggcuuuuauggugccauuccugcccuuucuuccugccuucagcauauuggucaacaucuaucugaugguucaguuauccgcagauaccugggugagauuuucaauuuggauggcuaucggauuccucaucuacuuuagcuauggcauuaggcauucucuggaagggcaccuucgggacgagaauaacgaagaggaugccuacccagacaaugugcaugcagccgcugaagagaaauccgcgauacaagccaacgaucaccauccgcgaaaccugaguagccccuucaucuuucacgagaagacuucugaauuuuga

SEQ ID NO: 62826 - RNA, 1860 nt, Artificial Sequence
  derived and/or modified sequence opt3 from SLC7A3__Homo_sapiens__NP_001041629
augcccuggcaggccuucagaagguuuggccaaaagcuggugcggcgccgaacccucgagagcgggauggcugaaacacgucuugcaagaugccuguccacuuuggacuuagucgcccugggaguugguucuacgcuaggcgcggggguguacguacucgcuggagagguggccaaagauaaggcaggcccuucaaucgucauuuguuuccugguggccgcucuuaguagcguucuggcagguuugugcuaugccgaauuuggggcuagggugccacgguccggaucugccuaccucuauucguacgucaccgugggcgagcugugggcguucacaacuggcuggaaccugauacucucauauguaaucgggaccgcaagcguugcccgcgcuuggaguuccgccuuugacaauuuaauuggaaaccacaucucuaaaacacugcaggguagcauugcacuucaugugccgcacgucuuggcugaauaccccgauuucuuugcccugggccuagugcuccugcuuaccgggcuguuggcgcucggagccuccgagucagcacuggugacuaaggucuucacaggcguuaauuuacuggugcucgguuuuguaaugaucaguggguucgugaaaggagacguccauaacuggaaacuuaccgaggaagauuaugagcuggcuauggccgaauugaaugacacguacagccuaggcccucugggcucugggggauuugugccauucgguuuugagggcauacucagaggggcugccacuuguuucuacgcauucguuggauuugauugcaucgccaccacaggcgaggaagcucagaacccccagagguccauuccuauggguaucgugauuucacugagcgucuguuuccuugcguauuuugcagugaguucugcccugacuuugaugaugccauacuaucaacuccagcccgaguccccucugccagaggcuuucuuauacaucgggugggccccggcacgguauguaguugccgugggcagccugugcgcucuaucgaccucucuccugggauccauguuucccaugccucgcgucauauacgccauggcagaagacggccuuuuguuccgagugcuggcgaggauucacacagggaccagaacgccaaucauugcuacugucgugucaggaaucaucgccgcauuuauggccuuccucuuuaagcugacagaucuuguugaccugaugaguauugguaccuugcucgcuuauagccugguguccauauguguauuaauccugcgguaccagcccgaucaggaaacuaagacaggcgaggaggucgaacuacaagaggaagccauuaccacggagucugaaaagcucacccugugggggcuuuucuuuccuuugaauagcaucccaacaccccugucaggacagauaguguacguuugcaguucccuccuggcaguguuacugacugcucuuuguuugguccucgcccaguggagcgugccgcugcuaucuggcgaccugcucuggaccgcgguagugguucugcuuuugcuguuaauuaucgguaucauugucgugaucuggcgucagccucaaucaaguacaccccuccauuucaaagugccagcccugccucuucugcccuugaugagcauuuuugucaacauauaucucaugaugcagaugacugcugggaccugggcacgcuucggcguuuggaugcugaucggauucgccauuuacuuuggcuaugggauccagcacucccuagaggagaucaagucuaaucaaccaucgagaaaaagcagggcuaagacaguggaucuggaccccggaacccucuacgugcacuccguauga

SEQ ID NO: 62827 - RNA, 1908 nt, Artificial Sequence
  derived and/or modified sequence opt3 from SLC7A4__Homo_sapiens__NP_004164
auggccagaggccugcccaccaucgcuagccucgcaaggcuuugccagaagcugaaccgguugaaaccuuuagaggacuccacaauggaaacuucucugcgccgaugucuaucaacgcucgaucugacccuucugggggugggagguauggucggcaguggguuguacguucucacaggagccguggcgaaggagguagcuggcccagccgugcugcugagcuucggugucgcagccguggcuucccucuuagcagcccugugcuaugcugaauuuggggcccguguuccgagaacuggaucugcguaccuuuucaccuaugugucgaugggcgaguugugggcauuucugauuggcuggaauguccuacucgaauacauaaucgggggagccgcuguggccagggcauggucagguuaucuggacagcauguucagucacuccauucggaacuuuacagagacccauguaggcucuuggcaaguuccccuucuggggcacuacccugauuucuuggcugccggaaucauucuccuggcgagcgccuuuguguccuguggcgcacgcgucucaaguugguuaaaucauacuuucagcgcuaucucucugcucgugauacuuuuuaucgugauucuggguuucaucuuggcccagccacacaacugguccgcugacgaagggggauuugcccccuucggcuuuucaggcgucauggcagggacagccagcugcuucuaugcuuucguuggauuugaugugauugcggcaaguucugaggaggcccagaauccuagaagguccguaccacuagcuaucgccauaagccuggcaauugccgcuggugccuacauccucgugucgaccguccugacgcuuauggugcccuggcauucucuggacccugauuccgcauuggcggacgcuuucuaccagcggggcuaucgcugggccggguuuauuguugcagccggaucaaucugugcuaugaacacugugcuccugaguuuacuguucagccuaccacgaaucgucuacgccauggcagcugauggccucuuuuuccaaguguuugcccacguacacccgagaacccagguucccguggcggguacacuggccuucgggcuuuugacugcuuuucuggcacuccugcuugaccuggaauccuugguccaguuccucucucugggcaccuuacuggccuauacauuuguggcuaccagcauuauaguccuaagguuccagaaaucaaguccuccauccagccccggaccugccucuccaggcccccucacgaagcaacagucaaguuuuagcgaucaucugcagcuuguggggacuguucacgcauccgugccggagccuggagaguugaaacccgcgcugcggccauaccucgguuuccuggacggcuauucuccuggggccguagucacaugggcuuuaggagugaugcuggccucggcaaucaccauuggcugcguucuuguguucgguaauagcacuuugcaucucccccacuggggguacauccugcuacugcuccugacauccgucauguuucuuuugucacuguuagugcucggcgcucaccagcaacaguaucgugaagaucuguuccagauaccaaugguaccccuuauuccugcccugaguaucguguugaacaucugucucaugcugaagcuaucuuaccugaccuggguucgcuuuagcauuuggcuccugaugggacuugcagucuacuucggcuaugggaucagacauuccaaggagaaucaaagggaauugccaggacugaacucaacgcacuacgugguguuuccgcgggguagcuuagaggaaaccguccaggccaugcagcccccuucucaggcuccagcgcaagaccccggccauauggaguga

SEQ ID NO: 62828 - RNA, 1524 nt, Artificial Sequence
  derived and/or modified sequence opt3 from SLC7A5__Homo_sapiens__NP_003477
auggccggcgcugggcccaagagaagggcacuggccgcgccugcugccgaggaaaaagaggaagcacgggagaagaugcucgccgcuaaaagcgcagacggauccgccccagcuggugaaggcgagggggugacccuucagcgcaacaucacacuguugaauggagucgccauuauaguuggcacuaucauugguucugggaucuucgugacgccgaccggaguauuaaaggaggcgggcucacccggccuggcccuaguggucugggcagcuugcgggguguuuaguauuguuggagcccucuguuacgcagaacuggguacaacuaucagcaaauccggcggggauuaugcuuacaugcuugagguguauggaucucugccugccuucuugaagcucuggauagaacugcugaucauucgaccaucgucacaauacaucgucgcgcucguguuugccaccuauuuacugaagccccuuuucccuacaugcccaguacccgaggaggcagcuaaauugguugccugucugugcgugcuacuccugaccgcugucaacuguuacagcgugaaggccgcaacucgugugcaggacgccuuugcugcggcaaaacuucuggccuuggcucucauuauccuguuaggcuucguccagauagguaagggggauguuaguaaucuggacccuaacuuuuccuucgaaggaacaaaacucgaugugggcaauauuguacuugcccuguauucuggcuuguuugcauacgggggauggaacuaccuaaauuucgugaccgaggaaaugaucaacccauauagaaaucugccgcucgccauuaucaucagccugcccauugucacgcuuguguacguucugacuaacuuggcuuauuuuaccacacucuccacugagcagaugcugucaagugaagccguggcagucgacuucgguaauuaccacuuaggcgugaugagcuggauaaucccuguauuuguugggcugucuugcuucggauccgugaacggcucacuauucaccagcaguaggcucuuuuucgucgguucucgggaggggcaucugccauccauucuuagcaugauccacccccaauugcugacaccugugccaucgcucgucuuuaccugugugaugacgcugcuuuaugcguucucuaaggauauauuuuccguuauuaauuucuuuucauucuuuaacuggcugugcguggcuuuggccaucaucggcaugauuuggcuccgccauagaaagcccgagcuggaaaggccgaucaaaguaaauuuagcacugccugucuucuuuauucuagccugucucuuccugauagcugugaguuuuuggaagacucccguugagugcggaaucggcuucacaauuauccuuagcggguugccaguguacuucuuuggagucugguggaaaaacaagccuaaauggcugcuccaggguaucuucuccaccacugugcugugucagaaguuaaugcagguagugccccaagaaacauga

SEQ ID NO: 62829 - RNA, 1548 nt, Artificial Sequence
  derived and/or modified sequence opt3 from SLC7A6__Homo_sapiens__NP_003974
auggaggccagagaacccggcaggccuaccccaacauaccaccuggugccgaacacuagccagucccaagucgaggaagacguuucuucacccccucagcggaguagcgagacgaugcagcucaagaaagaaaucucccuucugaauggggugucuuugguagugggaaacaugauugguucgggcauauucgucucaccaaaggggguguuaguucauaccgcuagcuauggaaugagucugaucgugugggcaauuggcggucuauuuuccgucgugggggcccucugcuacgcggagcugggaacaacuaucaccaaaucuggcgcuagcuaugccuacauucuugaggcauucggcggguuuaucgccuucauacgccuguggguauccuugcucguuguggaacccacaggacaggcuaucauugcaaucaccuuugccaauuauauuauccaaccuucauucccaaguugugaucccccuuaccuggcuugccgacugcucgccgcggcauguauaugcuuacugacuuuugucaacugugccuaugugaagugggguacacgugugcaggacaccuucacguacgcuaaagucguugcccuuauugcaaucauugugaugggcuugguaaagcugugccaggggcacagcgagcauuuucaggaugcuuucgaaggaucuuccugggacaugggcaaucuaucacucgcccuguacagcgcgcuuuuuaguuauucugguugggauacucugaacuucgugaccgaggagaucaagaauccagaaagaaacuugccgcucgccaucgggauuuccaugcccauagucacacugaucuacauuuuaacuaauguggcauauuacaccguucugaacaucagcgacgugcucucgucugaugcugucgccgugacauuugcugaccaaaccuucggaauguucuccuggacgauaccuauugccguagcacuuucauguuuuggcggccugaaugccaguaucuucgcuagcuccagguuguuuuucguugggucucgggagggacaccuaccagaucugcucagcaugauccauauugaacgcuuuacucccaucccugcgcugcuuuucaacugcacaauggcacugauuuauuugauaguggaggacgucuuucagcucaucaauuacuucucauuuaguuauugguucuuugugggucuguccgucgugggccaguuauaccugagauggaaagaaccaaagaggccccggccgcuaaaacucagcguuuucuuuccuauuguguucuguaucugcucuguauuccuggucaucgugccccuuuuuaccgauacuauuaacucauugauagggaucggaauugcccugaguggcguuccauucuacuuuauggguguguaucucccugagagccgccgaccccuguucaucagaaauguccuugcugccauuacaagggggacccagcaacuguguuuuugcguguugacggagcucgacguagcagaagagaagaaagaugaacggaagaccgacuga

SEQ ID NO: 62830 - RNA, 1536 nt, Artificial Sequence
  derived and/or modified sequence opt3 from SLC7A7__Homo_sapiens__XP_011535601
augguggacagcaccgaguacgaagucgccucccagcccgagguugaaacaucuccucugggcgauggggcuucaccaggaccggagcaagugaagcucaaaaaggaaaucagucuucugaacgguguaugcuugauugugggcaauaugauagggagcggaaucuucgucucccccaaaggcguguuaauuuauucugcaucguuuggucugagccuaguuaucugggccguggguggacucuucucagucuuuggcgcgcuguguuacgcugagcuuggcacuacgauuaagaaaaguggggccuccuaugcauacauccuggaggccuucggaggguuuuuggcuuucauaagacucuggaccucucugcugaucauugaaccuacaagccaggcaaucauugccaucacuuuugcuaacuauauggugcagccacucuuccccuccugcuuugccccuuacgcggcaucaagguuacuggccgcugccuguauaugccuuuugaccuucauuaauugugcauauguaaaguggggcacacugguucaggacaucuuuaccuacgcuaaggugcuagcccucauugcggucaucguggccgggaucgugcggcugggacaaggcgcaaguacucacuucgagaacagcuuugaagguucuuccuucgcugucggggauauugcccuugcucuguacucagccuuguucagcuauaguggaugggacacacucaauuacguuaccgaggagaucaaaaacccagaacgcaaucugcccuuaucuauaggcauuuccaugccuaucgugacgauaauuuauauccugacuaacguagcauacuauaccgugcucgauaugcgagacauccuugccagcgaugcugucgcggugacauuugcagaccagauuuucggcaucuuuaauuggauuauaccacugucgguugccuugucuugcuucgggggacuaaacgcuuccaucguggccgcaucacgucuguuuuucgucgguaguagagagggccaucucccggaugccauuuguaugauccacguggaaagguuuacucccguaccuagccugcuuuucaaugggaucauggcucugauuuacuugugcguugaggacauauuucagcucaucaacuauuacuccuucucuuacugguuuuucgugggacugagcauugucggccaguuauaucugcgguggaaggaaccagaucgccccagaccucuaaaacucucaguguuuuucccaaucgucuucugucugugcaccauuuuucuuguggccguucccuuguacagugacacaaucaauucccugauagguaucgcaauugcgcucagcgggcugccguucuauuuucuuaucauuagggugccugagcauaagcggccccuguacuugcgccgaaucguaggcucugcuaccagauaucuccaaguccuguguaugucaguggccgcagagauggauuuagaagacggaggcgagaugccaaaacagagggacccuaagaguaacuga

SEQ ID NO: 62831 - RNA, 1293 nt, Artificial Sequence
  derived and/or modified sequence opt3 from SLC7A8__Homo_sapiens__NP_001253965
augggccaguacgggcaagagcugagcuggaagugccucgugaaagccgucugucuucaggaacacucccagcccucucagcuguugugcaccuuacugcuauguuggugcguucucggaagagagaggccuuuccggaaggcucaaucaacaaguagcccacuggaaggugugccgcgcuuucuuaaacgacuguugcucacuuggguaaacuguuccucugugcguugggcaacgagaguccaggacaucuucaccgccggcaagcugcuggcgcucgcuuuaauuauaaucauggggauugugcagaucugcaaaggagaguauuuuuggcuggaacccaagaaugccuucgagaacuuucaggagccugauauuggccuuguugcauuggccuuccugcaagguucguuugcuuacgggggauggaauuuccuaaacuaugugacagaagaacucgucgacccauacaagaaucugcccagggcaaucuuuauaucaaucccucuugugacuuucguauauguuuuugccaacguggcuuacgucaccgccaugagcccacaggaacuguuggcgaguaaugcaguggccgugacauucggcgagaaacuccugggcgucauggcuuggauuaugcccaucuccguugccuuaucuaccuuugggggagugaacgguagccuguucacuuccucacgccucuucuuugcaggcgcucgggaggggcaucuuccuaguguacuggccaugauucacgugaagagauguacaccaaucccggcguugcuauuuaccugcauaagcacgcugcucaugcuggucacuucugauauguauacccuuauuaauuacgugggauucaucaacuaccuguucuauggcguuacaguggccggucagauugucuugagguggaaaaagcccgacaucccucggccaaucaaaauuaaucuccuguuucccauaaucuacuuacuguucugggcauuucuacucguguucucccuguggucagaaccuguaguuugugggauuggacuugcuaucauguugacuggcgugccagucuauuuucugggcguguacuggcagcauaagcccaagugcuucagcgauuuuauagagcuccugacccuugucagucagaaaaugugugugguuguguauccggaaguagagcgcgggucuggaacagaagaggccaacgaggacauggaggagcaacagcaaccuauguaccagcccaccccaacgaaggauaaagacgucgcuggucagccucagcccuga

SEQ ID NO: 62832 - RNA, 1464 nt, Artificial Sequence
  derived and/or modified sequence opt3 from SLC7A9__Homo_sapiens__XP_011524704
augggcgacaccgggcugagaaagaggcgggaggaugagaaaagcauccagucccaagagcccaagacaacuucucuccagaaagaacuuggacugauuucagguauaaguaucauugugggcacgaucauugggagcggaaucuucgucuccccuaagucuguuuugucgaacaccgaggccgugggcccaugcuuaauaaucugggcugcaugugguguacuggccacacuaggggcgcucugcuuugcugaacugggaacuaugauuaccaaaucaggcggcgaguacccguaucuuauggaggccuacgggcccaucccugcauaucuguucagcugggccaguuugauugugaucaagccaacauccuuugcuauaauuugucucucuuucagcgaauacgucugcgcacccuuuuaugugggauguaagccuccacagaucguugugaaaugccuggccgcugccgcgauucuguucaucuccaccgucaauucacucagugugcgcuuagguagcuacguacagaacaucuuuacugcagccaagcugguuauuguggcuauaaucauuaucucuggccuugucuugcuggcccaagggaauaccaaaaacuucgacaauuccuuugagggagcacagcuaucagugggcgcuauaagccucgccuucuauaacggucugugggcguacgauggguggaaucagcuuaacuacauuacagaagaacugcgaaaucccuaucguaacuugccucucgccaucaucauuggaaucccacuggugacggcauguuacauuuuaaugaaugucaguuauuuuacuguuaugaccgcuacagagcugcuccagucucaagccguggcuguaacuuucggcgacagagugcuuuacccggccuccuggauagucccccuguuuguggcauucagcaccaucggcgccgcuaacgggacaugcuucaccgcgggaagguugauuuauguugcaggucgggaaggccacaugcuaaaggugcugucguacaucucuguccgcagacucacgccugccccagcuaucauuuucuaugggauaaucgccacuauuuacaucauucccggagauaucaauucccuggugaacuacuucucauuugcagccuggcuuuucuauggccugacaauauugggucucaucguaaugagguuuacccggaaagagcuggaacgcccuauuaagguuccaguggucauccccguguuaaugacucugauuagugucuuccuagugcucgcuccgaucauaagcaagccuacaugggaguaccuguauuguguucuuuuuauuuuguccgggcugcucuuuuacuuucuguucgugcauuauaaauuuggcugggcccagaagaucucuaaacccauuaccaugcaccuucagaugcugauggaaguagucccaccugaggaggaccccgaauga

SEQ ID NO: 62833 - RNA, 2907 nt, Artificial Sequence
  derived and/or modified sequence opt3 from SLC8A1__Homo_sapiens__NP_001106271
auguacaacaugagaaggcugagccucucccccaccuucucuaugggcuuucaccuucuggugacagucucauuguuauucagucauguugaccacgugaucgccgagacugaaauggagggggaaggaaaugagacgggugaaugcaccggcagcuauuacuguaagaaagggguaauucugccuauaugggagccacaggauccguccuuuggagacaagaucgcucgggcaacaguguauuucgucgccaugguguacauguuucuaggcguuucuauuaucgcggaucgcuucaugucgucaauugaggugaucacuagccaagaaaaagagauaaccaucaagaaacccaacggugaaacaaccaagacuacaguccgaauuuggaaugagaccgugaguaaccucacgcugauggcucuuggguccucugccccugagauccuguugagcguaauugaaguuugcggacauaauuuuacugcaggcgaccucggcccauccaccaucguggggucagccgcuuucaacauguuuauaauuaucgcacugugugucuauguggugcccgauggagagacacguaagauuaaacaccugagagucuucuuuguuacugccgcuuggaguaucuucgccuacaccuggcucuauaucauuuuaagcgugauaucuccugguguaguggaagucugggagggccugcuuacauuuuucuucuuuccaaucugcgugguuuucgcguggguggcagacaggcgguugcuguuuuacaaguacgucuauaaacgcuacagagccgggaagcagaggggaaugauuaucgaacaugagggcgaucggcccuccucaaaaaccgagauagaaauggacgguaaggugguaaauagccacguugagaacuuccuagauggggcucucgugcuggaagucgacgagcgcgaucaggacgaugaagaggcccgaagagagauggcaaggauucuuaaggaacugaaacagaagcacccugacaaagagaucgaacaauugaucgagcucgcuaauuaucaggugcugagucagcagcaaaagucucgggccuuuuaccguauucaggcgacgcgcuuaaugacuggagccggcaacauccugaaaagacaugcagcugaccaggccaggaaggcugucuccaugcacgaagugaauacagagguuaccgagaacgauccagugagcaaaauuuucuuugaacagggcacuuaucaaugucucgagaauugcgggacaguagcccuuaccauaauccggcgaggaggugaccugacgaacaccgucuucguggauuuucgcacagaagacggcacugcaaaugccgggucggauuacgaguucaccgagggaacaguuguguuuaagccgggcgacacucagaaggaaauuagagucgguaucaucgaugacgauauuuucgaggaagacgagaacuuuuuggugcaucuaucuaacguaaaaguguccucagaagcuagugaggaugggauacuggaggcgaaucacguuagcacccucgcaugucugggcucccccucuacagccaccgucacuaucuucgacgacgaucacgcuggaauuuucacguuugaagaaccugugacacaugugagcgaaucaaucggcauuauggaggucaagguucuuaggaccaguggggcccggggaaacgugaucgugccauauaaaacuauagaagguaccgcacgcggcgggggagaggacuucgaggauacaugcggcgaacuggaguuucagaaugacgaaaucguaaagaccauuuccgucaaagugaucgaugacgaggaauacgagaagaacaagacuuucuuuuuggagauuggugaacccagacucguugagaugagcgaaaagaaggcccuguuacugaaugagcuagggggcuucacaaucacgggacaaccuguguuuaggaaaguccacgcucgugagcauccaauacucucuaccgugauuacuaucgccgaugaauacgacgauaagcagccccugacaucaaaagaggaagaggaacggcgaauugcagagaugggcagaccgauccuuggggagcacaccaaguuggaaguuauaaucgaggaaaguuaugaguucaagagcacaguggacaaacugauuaagaaaacuaaccucgcgcugguagucggaaccaauuccuggagggaacaguuuaucgaggcuauuacggugucugccggugaggaugacgaugacgacgaauguggcgaggaaaaacuuccuucgugcuucgauuacgugaugcauuuucugaccgucuucuggaaaguuuuguuugcauucgugcccccaacagaguauuggaacgggugggccuguuucaucguaagcauacucaugauuggacuguuaacugcuuuuaucggcgaccuggccucccacuucgguugcaccaucgggcuaaaggauucagugacagcagucguguuuguugcucucggcaccagugugccugacacuuucgccucuaaggucgcggccacgcaggaucaauacgcugacgcaagcauuggaaaugugacaggcuccaacgccguuaauguguuucuggggaucggagucgcuuggucaauugccgcaauauaucacgcggccaacggcgaacaguucaaaguaagccccgguacccuugcuuuuucugugacuuuguucacaaucuuugccuucauuaauguuggggugcugcucuaccgccggagaccagagaucggaggcgagcuggguggccccaggaccgcaaaguuacugacuuccugccuuuuugucuugcucuggcugcuauauauuuucuucaguagccuggaggcuuacugucauaucaaaggguuuuga

SEQ ID NO: 62834 - RNA, 2766 nt, Artificial Sequence
  derived and/or modified sequence opt3 from SLC8A2__Homo_sapiens__NP_055878
auggccccccuggcucucgugggcgucacccuucuguuggcagccccuccaugcagcggggcggcuacaccgacucccuccuuaccuccacccccugccaacgacucugauacgucaaccggagguugucagggcaguuacagaugccaaccagggguucugcuacccgugugggagccugacgauccaagccucggagacaaggcagccagggcuguaguguauuucgucgcaaugguguacauguuucugggcguuuccaucauugccgaucgguucauggcugccauagaagugaucacaucuaaagagaaggaaauuacuaucaccaaagcgaauggugagacaucggucgggaccgugcgcauuuggaacgaaacuguaucaaaucuuacacugauggcauugggaagcagugccccggagauccuccuguccguuauagagguguguggccacaacuuucaggcuggcgaacuggggcccggaaccaucgucgguucugccgcauucaauauguuuguggugauugcugucugcaucuauguuauuccugccggcgagagccgaaagaucaaacaucuccguguguucuuuguaacggcguccuggucaauauucgccuacgugugguuauaucugauucuugcagucuuuaguccaggggugguucaggugugggaagcuuugcugacucuagucuucuuucccguguguguaguuuucgccuggauggcugacaagagacuccuguuuuacaaguauguguacaaaagguaccggaccgauccucgcagcggaaucauuaucggcgccgagggugacccacccaagucuaucgagcuugaugggacauucgucggagcagaagccccgggcgagcugggcggguugggaccuggucccgcugaagcgagagagcucgacgcauccaggcgggaagugauucagauacugaaagauuuaaagcaaaaacacccagacaaggaucuggagcagcucgucggcaucgccaacuauuacgcucuucugcaucagcagaagucacgcgccuucuaucgaauucaagcaacuagauugaugaccggggccggaaaugugcuaaggcggcacgcugccgacgcaagccgucgcgcggcuccugccgagggcgcaggugaagacgaggaugacggggccaguagaaucuuuuucgaacccucucuguaccauugccucgagaacuguggcuccguucugcuuagcgugacaugccagggaggcgaagggaauucgaccuuuuauguagauuacaggacggaggacggaucugcuaaagccgguuccgauuaugaguacucagaaggcacucuggucuucaagccaggggagacacagaaagaauugcggauaggaauuaucgacgaugacaucuuugaggaagaugagcacuucuuugugcgacuccugaacuuacgcguuggcgacgcacaggguauguucgagcccgaugggggcggaagaccuaagggcaggcugguggcuccacuacucgccaccgucacuauucuggacgacgaucacgcggggaucuuuaguuuccaagaccggcuuuugcaugugagcgaauguaugggaacaguagaugugcgcguugucagauccucuggugccaggggcaccgugcgucugccguaccggacgguggacgggaccgcucgaggaggcgguguccacuaugaggaugcaugcggggaacucgaguuuggcgacgaugagacaaugaaaacucugcagguuaagauuguggacgaugaagaguacgaaaaaaaggacaauuucuuuauagagcuuggacagccccaauggcugaagagaggcaucagcgccuugcuccugaaccagggggauggagacaggaaauuaaccgcugaagaggaggaagcccgccggauugcagagaugggcaagccugugcugggugaaaauuguagacuagagguaaucaucgaagagucauaugauuucaaaaacacagucgacaagcucauuaaaaagacuaaucuggcgcuugugauagggacccauaguuggagggagcaguucuuggaagccaucacaguuuccgcuggagacgaggaagaggaagaggauggcagccgcgaggaacgacugccaucuugcuuugacuacgugaugcacuuccucaccgucuuuuggaaggugcuguucgccugcguucccccuacugaguauugucacgguugggcaugcuuuggcgugucaauuuuaguaaucgggcugcuuacggcuuugauuggagaucucgccagucauuucggcuguacagucgggcugaaagacagcgugaacgcaguggucuuuguugcccuaggaaccuccaucccagauacuuucgcuucuaagguggcggcccugcaggaccaaugcgcagaugcuucgauaggcaacguaaccgguagcaaugccgugaacgucuuucucgggcugggaguggccugguccguugcugcaguguacugggccguccagggccggcccuucgaagugcguacagguacccuugcguuuucaguuacuuuguucacaguguuugcuuucgucggcaucgccguacuguuauauagaaggcgcccgcacauugggggagagcucggcgggccucggggaccaaaacuggcaacgaccgcccuuuuccugggcuuguggcuccuguacauccuauuugcuagucuggaggcauacugucauauuagagguuucuga

SEQ ID NO: 62835 - RNA, 897 nt, Artificial Sequence
  derived and/or modified sequence opt3 from SLC8A3__Homo_sapiens__NP_001123889
auggagagaggcaucagcgacgugaccgauaggaagcugacaauggaagaggaagaggccaaacggauugcugaaauggggaagcccguccucggagagcacccuaaacuugagguuauaaucgaagaguccuacgaguucaagacuacgguggacaaacugauuaagaagaccaacuuggcauuaguaguggguacacauucuuggcgcgaucaguuuauggaggccaucacugucucagcggcuggcgacgaggaugaagacgagaguggggaagaacgacugccaagcugcuucgauuaugugaugcacuuucuaaccguuuucuggaaagugcucuuugccugugucccgcccacagaauacugccauggaugggcauguuucgccguguccauucugaucauaggcaugcuuaccgcuaucauuggugaccuggcaucucacuuugggugcacuaucggauugaaggauucgguaacagccguuguguucgucgcuuuuggcaccucagugccugacacguucgccagcaaagcggcagcccuccaagauguguaugcugacgccaguauuggcaaugucacuggguccaacgcaguuaauguguuucugggaaucggucuggcuuggucuguagccgcgauauacugggcccuccagggccaggaguuccaugugagcgcagggaccuuagcuuuuuccgucacacuguucacuauuuucgccuuuguguguaucucaguucuuuuguaucguagaaggccacaccugggaggcgagcuaggugggccccggggaugcaagcucgcuaccacauggcuguucgugagucuuuggcuguuguacauucucuuugccacccuggaagcauauuguuacaucaaaggcuucuga

SEQ ID NO: 62836 - RNA, 2118 nt, Artificial Sequence
  derived and/or modified sequence opt3 from SLC9A1__Homo_sapiens__XP_011540323
augggcaaggacgccugccccggguuccacgugaucccuaccauuagcuccauagucccagagucuugucugcucaucguugugggacuucugguagguggcuugauuaaaggggugggagaaacaccgcccuuuuuacagucagaugucuucuuucuguuccuacucccuccaaucauucuggacgcuggcuacuuucuuccccugagacaauucacugagaacuuggguacgauccucauauuugcagugguugggacccuguggaaugccuucuuucugggaggccucauguaugcggugugcuuagucggcggggaacagaucaacaauauuggacugcuugauaacuugcuguucgguaguaucauuagcgcuguggacccuguagccguucuagcaguguuugaggaaauccauauaaaugagcuccugcacauucuugucuucggcgagucccuguugaacgaugccgugacagugguccucuaccaucuguuugaagaguucgcuaauuaugaacacguugggaucguggacauuuucuuaggauuucugucuuucuuuguaguggcacucggcgguguccuuguggggguuguguacggagucaucgccgcuuucacuucgagguuuaccucacauauccgggugauugagccacuguucguauuuuuguauagcuacauggccuaucuaagugcggagcuguuccaccucuccggcauaauggcacugaucgccucuggcguugugaugcgccccuacgucgaagcuaacauuagccacaagucccauacaaccaucaaauacuuucuuaagauguggucaagugugagcgagacucugauauucaucuuuuugggggucucuacaguggccggaucccaccauuggaauuggaccuucguuauuucaacgcuccuguuuuguuuaaucgcacgagugcuggguguacuaggccucacuugguucauuaacaaauuccguaucgucaagcugaccccuaaggaucaguuuauuauagcuuaugggggacuuagaggcgccaucgcguucagcuuggguuaccugcucgacaaaaagcacuuuccaaugugcgaucuguuccuuacagccauuaucacugugaucuuuuucaccguuuuugugcaggggaugacaauuaggccgcuggucgacuugcucgcagugaaaaagaaacaagaaaccaagcggaguauaaaugaggaaauccacacgcaguuccuggaucauuuacugacuggcauugaggacaucuguggacacuauggccaucaccauuggaaggauaaacuaaaccgcuuuaauaagaaauacguaaagaaaugccucauugcuggggagagaucuaaggaaccccagcugaucgccuucuaucacaaaauggagaugaagcaggcuauagaacuuguggaguccggagguaugggcaagaucccuagcgccguuucgacagucucuaugcaaaacauucacccaaaauccuugcccucagaaaggauccugccugcacucaguaaggacaaagaggaggaaauucggaagauccugcgcaauaacuuacagaaaacccgacagagacugaggagcuacaaccggcauacucuuguggccgacccauaugaggaggcuuggaaucagauguugcuccgucgccaaaaggcgagacagcuggaacagaagauaaacaauuaccuaacagugcccgcacacaaacuggauuccccgaccaugucuagggcccggauugggagcgacccucucgcuuacgaacccaaggaggaucugccagucaucacgauugacccugccucaccccaaaguccagaguccguugaucuugugaacgaagaguugaaaggaaaggugcugggcuuaagccgagaccccgcaaaaguagccgaagaggaugaggacgaugacggugggaucaugaugcgcucuaaggaaaccucaaguccuggcacagaugacgucuuuacuccagcuccgagcgacucccccucuucgcagagaauacagaggugucucagcgauccuggaccacaucccgagccuggcgaaggggagccauucuuucccaagggacaguga

SEQ ID NO: 62837 - RNA, 2439 nt, Artificial Sequence
  derived and/or modified sequence opt3 from SLC9A2__Homo_sapiens__NP_003039
auggagccccugggcaacuggagaagccucagggccccucuuccaccgaugcuguuguuacugcuacuccagguggcugggcccgucggagcacuggccgaaacccuucugaaugcgccucgggcuauggguacauccucuucaccacccaguccugccagcguuguggcaccaggcacuacguuguucgaggaaucccgccuccccguauuuacccuggacuacccucacgugcaaaucccauucgagauuacacuguggauacucuuagccucucuggcuaagaucggguuucaucuuuaucacaaauugccgacuauuguccccgaaucgugccugcuaaucauggugggacuccugcuuggcgguauuaucuucgggguugaugagaagucaccuccagcaaugaaaaccgacguguuuuuccuguacuugcugcccccuauaguccucgaugccggauauuuuaugccaacacgacccuucuuugagaacaucggcaccauuuucugguacgcugugguaggcacuuuauggaauagcaucgggauuggaguuagucuguuugguaucugucagauagaagccuucggccucuccgacauuacacuucugcagaacuugcuauuugggucucugaucagcgcgguggauccggucgcagugcucgccguguucgagaauauucaugucaacgaacagcuguauauccuuguuuucggagagucccuguugaaugacgcugugaccguagugcucuacaaccuguuuaagucauucugccaaaugaaaacgaucgagacuauugaugucuuugccggcauagcaaauuucuuugugguugguaucgggggaguguuaauuggcaucuuccugggcuuuauagcugccuucaccacacguuuuacucacaacauuagagucaucgaaccucuauucguguuucucuauaguuaccugagcuacaucaccgcggagauguuccaucuuucugggauuauggccaucacagcaugugcuaugaccaugaauaaguauguagaagagaacguuucccagaagucauacacgacuauuaaauauuuuaugaagauguugagcagugugucugaaacacugauauucaucuucaugggagucuccaccguggguaaaaaucacgaguggaacugggccuuugucugcuucacucucgcuuuuugucugauguggagggcccuuggcguguucguucugacacaggugauuaaucgguuucgcaccauccccuugacguucaaggaccaguuuaucauugcauacgggggacucagaggcgccauaugcuucgcucugguauuuuuacugccagcggcagucuucccuaggaaaaagcuauuuaucaccgccgcuauugugguuaucuucuuuacaguguucauucucgguaucacuauacggccccuggucgaguuccuugaugugaagcgcagcaacaaaaagcaacaggccguaucggaagagaucuauugucgauuguuugaccacgugaaaaccgggauugaagauguuugcggccauuggggacacaacuucuggagagacaaguuuaaaaaguucgaugacaaauaccugaggaagcuccugauccgggagaaucagccaaagucuuccauugucucauuauauaaaaagcuggaaaucaaacaugcaauagagauggccgagacaggcaugauuaguacugugcccaccuuugcuagccuuaacgacugucgugaagagaagauccgcaaagugacauccucugaaaccgaugagauuagagaauugcucagcaggaaucuguaccagauccggcaacgaacucuaucauacaaccgccacagucugacggccgacacauccgagagacaggcaaaggagauacucaucaggcggcgccacagccugagagaaucuauuaggaaggauucaagucuuaaucgugagcaucgggcgagcaccuccacuucucgauauuugucgcugccuaaaaacaccaaguuaccagaaaaacuccagaagagaaggacaaucagcauugcugacggaaauuccucagauagugacgccgaugcagggaccacuguccugaaccuucaaccgcgcgcccggagauuccugcccgagcaguuuucuaaaaagagcccucaguccuacaagauggaguggaaaaaugaaguugacguggauucagguagggacaugccaagcacacccccuacgccacacucucgcgagaagggcacccagacuuccggguugcuccaacagccccugcuaaguaaagaucagagcggaucugaacgagaggacucccugacagaaggcaucccgccuaagccacccccucggcucguguggcgugcuucagagcccgguaguagaaaagccagguucgggagcgagaagccauga

SEQ ID NO: 62838 - RNA, 2505 nt, Artificial Sequence
  derived and/or modified sequence opt3 from SLC9A3__Homo_sapiens__NP_004165
auguggggccugggggccagaggacccgacaggggucuccuucuggcuuuggcauuaggcgggcuggcccgggcgggaggcguggaggucgaaccugguggggcucacggagagagcggcggcuuccagguugugaccuuugaaugggcccauguacaagauccauacgugaucgcacuauggauucucgucgccucccuggcuaagauaggguuccaccuuucucauaaagugacaucaguugugccggagagugcacuguugaucguccucggacuggugcuggguggcauuguaugggccgcugaccacaucgccagcuuuacucucacgcccaccguuuucuuuuucuauuuacugccuccaauugugcuugaugcgggguacuuuaugcccaaccgcuuguucuuuggaaaucugggcacaauccuacucuaugcagucguggguacuguguggaacgccgcuaccacagggcugucccuuuacggagucuuccugucuggcuugaugggcgaccuccagauagggcuguuagauuuucuccuguucggaucgcuuauggccgcaguugacccuguggcuguacuggccguguuugaagagguccaugugaaugagguuuuguucaucauuguguucggugaaucacuacugaacgaugcggucaccgugguacucuauaauguuuuugagagcuucguggcccugggcggggacaacgucacuggaguggauugcgucaagggcaucgugaguuucuucguugugucccuuggugggacacugguaggcgucguguuugcauucuugcucucucugguuacccgauuuacgaaacacgugcguauuaucgaaccaggauucgucuuuauaauuagcuacuuauccuaucugacuucagagaugcuaagucucagcgcuauccuggccauuaccuucuguggcaucugcugucagaaguacgugaaagcuaauaucucugagcaguccgccacaacuguaagauacaccaugaagaugcuugcaucaagcgccgaaacaauuauauuuauguucuuggggaucagugcugugaaccccuuuauuuggaccuggaauacggcguucguucugcucacucuggucuucaucucuguguauagggcaauaggagugguccuucaaacauggcuguugaaccgguaccgcaugguucagcucgagccuauugaccagguggugcuguccuaugguggcuuaagaggggccguagcuuuugcccuggucgugcuacucgauggagacaagguuaaagaaaagaaucuguucgugagcaccacuaucaucgucguguuuuucacaguuauuuuucagggccuuaccaucaaaccauuggugcaauggcugaagguaaaaaggucggagcaccgggaaccgcgccucaacgagaagcugcauggucgagcauucgaucacauuuuaucugccauagaggacaucuccgggcagauuggccauaauuaccugagagacaaguggucacacuuugauaggaaauuccuuagucgggucuugaugcgucgcagcgcucagaaguccagagacaggauccucaacguguuucacgaacugaaucuaaaagaugccaucucuuauguggcagagggagaacggcgaggcagccuggcguucauucgcucacccaguacggacaacgucguuaacguggauuuuaccccuagauccagcacaguagaggcuucugugucauaccuccugagggaaaaugucagugccgugugccuugacaugcagagcuuggagcaacggcgcagauccauaagggaugcagaggacaugguuacucaucacacccugcagcaguauuuauacaagccacgucaagaauacaaacaucucuauucucggcacgagcugacacccacugaagaugagaagcaggaccgagaaaucuuccauagaaccaugaggaaacgccuugagucguuuaagagcacaaagcugggguugaaccagaauaaaaaggccgcuaaacucuacaagcgggagagagcccagaaaaggcgcaacuccucaauuccuaauggaaagcugccaauggaaagucccgcacaaaacuucaccaucaaggagaaagaucuagaacugucugacacugaggagccgccuaauuaugacgaagagaugagcgguggcauugaauuucucgcuuccgugacgaaggauacagccucagacagccccgcggggaucgauaacccagucuuuucuccugacgaggcccuggaucgaucccuuuuggcucggcugcccccaugguuaagucccggagaaaccgugguuccuagccagcgugcaagaacucagauaccauacucuccgggcaccuucuguaggcucaugcccuuucgccuguccucaaaaaguguggacagcuuccuucaggccgaugguccugaggagcggccacccgcugcccugccugaaucgacacacauguga

SEQ ID NO: 62839 - RNA, 1077 nt, Artificial Sequence
  derived and/or modified sequence opt3 from SLC9A3R1__Homo_sapiens__NP_004243
augagcgccgacgcugcagccggcgcgccccugccuagacucugcugucuugagaaggggccaaacggauacgguuuccaucugcacggcgaaaaagggaaguugggacaguauaucagguuaguggagccgggcucccccgcugaaaaagccggucugcuagcaggggaucggcucgucgagguuaauggagaaaacguggagaaggagacccaccaacagguagugucucgcauucgagccgcucugaaugcaguccgucuucuggugguugacccugaaacagaugagcaguugcagaaacucggcgugcaagucagagaggaacugcugagggcccaggaggcuccaggccaggccgaacccccugcggcagccgaggugcagggggcuggaaacgaaaaugagccacgggaagccgacaagucacaucccgagcaacgcgagcucagaccuagguuaugcacuaugaagaaagguccaaguggcuacggguuuaaccugcacagcgauaaguccaaaccgggacaguucauacggucuguagaccccgauucgccugcagaagccucaggccuucgcgcccaggaccgaaucguugaggugaauggugucuguauggaagggaagcagcauggagauguggugagcgcgauuagagccggcggcgacgagacgaaauugcuggucguugauagggaaaccgacgaguuuuucaagaagugccgggugaucccaagucaagagcaccuaaacgggccccucccuguaccauuuacaaauggagaaauucagaaagagaacucccgugaagcacuggcugaggccgcucuugaaucuccccgcccggcccuggugagaagcgcauccucagauaccagugaggaguugaauagccaggacucuccucccaagcaagacuccacugccccaucaagcacaaguucuuccgauccuauccucgacuucaacauaagccuggcuauggcgaaagaaagggcacaccagaagcggucgucuaaacgagcuccccagauggauugguccaagaaaaaugaguuauuuucaaaccuguga

SEQ ID NO: 62840 - RNA, 1014 nt, Artificial Sequence
  derived and/or modified sequence opt3 from SLC9A3R2__Homo_sapiens__NP_001123484
auggccgcucccgagccucugagaccaaggcucugccggcuugugcgcggcgaacagggguacggauuccaucugcacggugagaagggccgacgugggcaauuuaucagaagggucgaaccgggaagccccgcagaggccgcggcuuugcgggccggcgaccgcuuaguugaagugaacgguguaaauguggagggggagacccaccaucaggucgugcagagaauuaaagcaguugaaggacagacaaggcugcuaguggucgaucaagagacugacgaagaacuccggcgccgacagcugacguguaccgaggaaauggcccagagaggccuuccuccagcucacgaucccugggagccuaagccagacugggcacauacaggcucccacucuucagaagccgggaaaaaggaugugaguggaccccugagggaguugcggccucgucucugccaucugcgcaaagguccacagggcuauggguucaaccugcacagcgacaaguccagaccgggacaauacauaaggucuguagaucccggcucgccugcugcccggucaggucuccgagcgcaggaccgcuuaaucgaaguuaaugggcagaacguggagggacugagacacgcagaggucguggccagcauuaaggcuagggaagaugaggcccggcuuuugguggucgacccagaaacugaugagcauuuuaaacgccugagaguuacccccacagaggagcacguggagggcccucuaccaagucccguaaccaauggcacuuccccggcacagcucaacgggggaucugcuuguagcuccaggucagaccugccugguagugauaaggacacagaagacggcagcgccuggaaacaagaucccuuccaggagucugggcuucaccuguccccaaccgcggccgaagcaaaggagaaagcucgugccaugcgggugaauaagcgagcuccucagauggacuggaacagaaagagggaaaucuuuucaaauuucuga

SEQ ID NO: 62841 - RNA, 2397 nt, Artificial Sequence
  derived and/or modified sequence opt3 from SLC9A4__Homo_sapiens__NP_001011552
auggcccugcaaauguucgugaccuacagccccuggaacugccuccuucuguuggucgcuuuagaguguuccgaagcaucuucagaccugaaugagagugccaacagcacagcgcaauaugcuuccaaugccugguuugcagccgcuucuucggaaccugaggaaggcaucucaguuuucgagcuagauuacgacuaugugcagauuccauacgagguaacucucuggauacugcuugcaagccuggccaagaucggguuucacuuguaucauagacucccgggacugaugcccgaaaguugccugcucauuuuagugggugcucuggucggcgggaucauuuucggaacggaucacaaauccccuccagugauggacucuagcaucuacuuucuuuauuugcugcccccuauaguucuagagggcgguuacuucaugccaaccaggcccuuuuucgaaaacaucggguccauucucuggugggccgugcugggagcgcuuaucaaugcacugggcauuggcuugucacucuaccugaucugucaggucaaggccuuuggguuaggagaugugaaccugcuccagaaucuucuguucgguaguuugauaagcgcuguagacccuguugccgugcuagcagucuuugaggaggcucgggugaacgaacaacuguauaugaugauuuucggcgaggcccuccugaaugaugggaucacagugguccuuuacaacaugcugauugcguuuacuaaaaugcauaaguucgaagacaucgagaccguugauaucuuggccggaugcgcacgcuucauugugguaggccucgguggggugcuguuuggaauagucuucggcuuuaucucugcuuucauuacacgauuuacccagaauaucuccgccauagaaccauuaauuguguucauguuuucauaucugagcuaccuagcugccgagacucucuaucugaguggcauccuugcaaucacagccugugcuguuaccaugaaaaaguacguggaggaaaacgucucucagacguccuauacuaccauuaaguacuucaugaaaauguugagcucggugucugagacacugaucuuuauuuucauggggguauccacuguuggaaagaaucacgaauggaacugggcguuuauaugcuucacccucgcauuuugucagaucuggcgugccauuucaguguucgcucuguucuacaucaguaaucaauuuagaacauucccguuuagcaucaaagaccagugcauuauauucuauuccggugucaggggcgccgggucuuuuagccuugcauuccuguugccccucucacuguuuccucggaagaaaauguucgugaccgccacguuagucgugaucuacuuuacuguuuucauucagggaaucacagugggcccacugguacgcuaucuagaugucaagaagaccaacaaaaaggagaguauuaacgaggaacuccauaucagacugauggaccaccuuaaagcugguauagaggaugugugugggcacuggucccauuaccagguuagggacaaguuuaaaaaguucgaccaccgguauuugcgcaaaauccugauucgaaagaaucuccccaagagcucuaucgugucacuguacaaaaaguuagaaaugaaacaagccauugagauggucgaaacuggcauccugaguagcacagcauuuuccauaccucaucaggcgcagaggauucaaggaaucaagagacuuucuccagaggauguggaaucgauucgggacaucuugaccagcaacauguaucagguacgucagcgcacgcucuccuacaauaaauacaaccugaagccccagaccucagagaagcaagcuaaagagauacuaaucagaaggcagaauacacugcgggaaaguaugcgaaagggccacucucucccgugggggaaaccugccggaacuaagaacauucgcuaucugagcuaccccuaugguaauccacaguccgcaggcagagauaccagggccgcuggguucucagacgaugacagcucugauccuggaucccccaguaucacauucagcgccugcucucggauuggcucccuucagaaacaagaggcacaggaaaucauaccaaugaagucauugcaccgcgguagaaaggcuuuuaguuucggguaccagaggaacacuagccaggaggaguaucugggcggagugcgucggguugccuuacgacccaaaccucucuuucaugcggucgacgaagagggcgaaagcgggggagaguccgaagguaaggccucucugguggaggugagaucgagguggaccgcugaucacggccaugggcgcgaccaccaucggucacacaguccacuucugcagaaaaaguga

SEQ ID NO: 62842 - RNA, 2691 nt, Artificial Sequence
  derived and/or modified sequence opt3 from SLC9A5__Homo_sapiens__NP_004585
augcugagagccgcucucagccuucuggcauugcccuuagccggcgcggcugaggaaccuacccagaagccagaguccccgggggaacccccuccaggacuggagcuauucagguggcaauggcacgaaguggaggcccccuaccucgucgcacuguggauccuuguugccucucuggcuaaaauuguguuucauuugucacggaagguaacaagucucgugccugagagcugccugcugauacucuuaggucugguccuuggcgggaucguguuggcaguugccaaaaaggcugaauaucagcuggagccaggaacuuucuuucuauuccuccugcccccuauugugcuugacuccggcuacuuuaugccaucucgccuguucuuugauaacuugggugccauccucacguaugcggucguggggacccuguggaaugcauucacaacuggagccgcuuuauggggccugcagcaggccggccucguagcaccgcgaguucaagcugggcuucuggacuuuuugcuauucggaucgcugauuucagccguggaucccgucgcggugcucgccguguuugaagagguccacguuaacgagacccuguucaucauaguguuuggugaaagccuucugaaugacgcaguaacaguggucuuguacaaaguguguaacaguuucguugagaugggcuccgcuaaugugcaggccaccgauuaucucaagggggucgcuucucuguucgugguaaguuuaggaggcgccgcaguuggucugguguuugccuuccuacucgcucugacuacacguuuuaccaagagagucaggaucauugaaccucuuuugguguuccugcucgcguacgcagccuaucugacggcugagauggccucccuuucagcaauccuggccgucacuaugugcggguugggauguaaaaaguacguggaagcuaacauuagucauaaaagccggaccacaguuaaguacacuaugaaaacccucgccucuugcgcagagacagugaucuuuaugcuguuaggcauauccgcgguagacucaagcaagugggcuugggauaguggccugguccuagggacccucauuuucauccuguuuuuccgcgcccuuggagugguuuugcagacgugggugcugaaucaguuuagacucgucccacuggacaagauugaucaagugguaaugucuuaugguggcuuaaggggagcaguggccuucgcucugguuauccuuuuggaccggacuaaaguccccgccaaggauuacuuuguggcaacaaccaucguggucguuuucuuuacugugauugugcaggggcucacaauaaaaccucugguaaaguggcuaaaagucaagcgcuccgagcaccauaaaccaacccugaaccaggaacuccacgagcacacguucgaccauauccuggcugccguggaagauguugugggccaccaugguuaucacuacuggcgagacagaugggagcaguucgacaagaaguaucuuagccaauugcugaugaggcggucggcguaccguauucgcgaucagaucugggacgucuauuacagauuaaauauaagggaugccauuucuuuuguggaccaagggggccacguucucuccucaaccggacugacacuucccaguaugccgagccggaacuccguggcugaaacuucuguaaccaaucuguugcgagagagcggcucaggggcaugucucgaucugcaggucaucgacacagugcgcaguggaagagauagggaggacgccgugaugcaucaccuacugugcgguggccucuacaaaccucggcgcagauauaaggcuuccuguagcaggcauuucaucucugaagaugcccaggagcgucaggacaaagaagucuuucagcaaaacaugaagcggcgacuggagucauucaaaaguacuaagcacaauauuugcuuuaccaagagcaaacccagaccaaggaagacagggcgccggaaaaaggauggaguugcaaacgcggaagccaccaauggcaaacauagaggucuuggguuccaggacacugcugccgugaucuugacgguagaguccgaggaagaggaagaggagucugacucgagcgaaacagagaaggaagaugacgagggcauuauauuuguggcaagggcuaccuccgaaguccugcaggagggaaaggugucaggcaguuuagagguuuguccuucuccccgcaucauuccacccagcccuacuugcgccgaaaaagagcucccauggaaguccgggcagggagaucuggcaguguacgucucaagcgaaaccacaaaaaucgugccgguugacaugcaaaccgguuggaaccagucuaucuccagucuugagagccuggccucucccccuuguaaccaggcuccaauucuaacuugccugcccccucacccacgaggcacagaggaaccccaggugccgcuccacuugccuuccgauccacggucaaguuucgcguuucccccuagccuggccaaggcagggcguucgagauccgagucuagcgcugacuuaccccaacagcaggaacuccagccacugaugggacauaaagaucacacgcaucuuucaccuggcaccgccacuagccacuggugcauacaauucaauagggguucccgccuguga

SEQ ID NO: 62843 - RNA, 2106 nt, Artificial Sequence
  derived and/or modified sequence opt3 from SLC9A6__Homo_sapiens__NP_001036002
auggccagaaggggcuggcggcgcgcuccccugcgacguggggugggaagcuccccuagagcaaggcggcucaugcgcccacuuuggcuguuguuagccgucgguguuuucgacugggcgggcgcuucugaugggggaggcggugaggccagagcaauggacgaagagaucgugucagaaaagcaggccgaggaaagucacaggcaagauagcgcuaaccugcuaauuuuuauacuccugcuuacccugacaaucuugacuauuugguuguucaaacaucggcgcgcacgauuucugcacgagacggggcuggccaugaucuacggacucuuaguaggccuggugcuuagauauggcauucaugucccguccgacgugaauaacguuaccuugucuugcgaggugcagucgucacccacaacucugcuagucaaugugagcgggaaguucuacgaauauaugcucaaaggagagaucaguucccacgaacugaacaauguacaggauaacgagaugcuuaggaagguuaccuuugacccugagguguucuuuaauauacuguugccacccaucauuuucuacgcugguuauucucucaaacggcgucacuuuuuccgcaaccugggcagcaucuuagccuacgcguuucuggggacagcaauuuccuguuucgucaucggaucaauaauguauggcugcgugacccucaugaaggugacuggucagcuugccggggauuuuuacuucacagacugucuguuguucggagcuauugucagugccaccgauccuguuacggugcuagcaaucuuucaugaacugcaaguagacguggagcucuacgcucugcuuuucggcgaaagcguccugaaugaugccguggcgauuguuuugucuuccucaaucguggccuaucagccagcaggcgacaacagccacacuuuugaugucaccgcuauguucaagaguaucgggauuuuucucggaauauucucugguuccuuugccaugggcgcugccacaggggugguaacugcacugguuaccaaauucacaaaguuaagagaguuucagcugcuagaaaccggacucuucuuucugaugagcuggucgacguuccuuuuggccgaggcuuggggcuuuacugguguggucgcggugcuguucugcgggaucacacaggcacauuacaccuauaauaaccucucuacugagucccaacacaggacaaaacagcuguucgaacuucugaauuuucucgccgagaacuucauuuucucauacaugggccucacccuguuuacguuucagaaucaugucuucaaccccaccuuugugguuggagcuuucguggccaucuuuuuaggccgggcagccaacauauauccucugagucuacuccugaaucuugggcgacgcagcaagauuggauccaacuuccagcacaugaugauguuugcugguuugagaggcgccauggcauucgcgcuggcuaucagggacacagccacuuacgcacggcaaaugauguuuucuaccacacuccugaucguauucuucacugucuggguguuugggggaggcaccacagccauguuaagcugucugcacauucgcguugguguggacucagaucaggaacaucuuggggucccagagaaugaaagaaggaccacuaaagcugagagugccugguuguuccguaugugguauaacuuugaccacaauuaccucaagccgcugcuaacgcauuccggacccccucugacaaccacucucccagcaugcuguggccccaucgcucggugccugaccagcccucaggccuacgagaaccaagaacagcuuaaggaugacgauucugacuugauucugaaugauggcgacauaucauuaacauauggggauaguaccgugaacacugagccagcgacaagcuccgcuccccgaagauucaugggaaauucuucggaagacgcccucgauagggagcuggcauuuggugaccacgaacuuguaauccgcggcacgcggcugguguugccgauggacgauagcgagccuccccucaaccugcuagacaauaccagacaugggccagccuga

SEQ ID NO: 62844 - RNA, 2178 nt, Artificial Sequence
  derived and/or modified sequence opt3 from SLC9A7__Homo_sapiens__NP_115980
auggagcccggcgacgccgcuagaccugggagcggaagggcaaccggugccccaccgccccggcugcuccuucugccuuuguuacugggcugggggcuacgcguggcggcugccgcauccgccucuucaaguggagcugcagccgaagauagcuccgcuauggaggaacucgccacagagaaggaagcggaggagucucaccgacaggacucggucucacugcuuacuuucauccuguugcucacgcugaccauucugacaauauggcucuuuaaacaucguagaguuagguucuuacacgaaacuggccuggcaaugaucuacggucuuauuguggggguaaucuugcgguauggaaccccagccacaagcggccgcgauaagagucuguccugcacccaagaggacagagcuuuuucuacucuacucgugaacgucagcggcaaauucuuugaauacacacugaagggggagauuucccccggaaaaaucaauucaguggagcagaacgauaugcuuaggaagguuaccuucgacccugaaguguuuuucaauauacuguugccacccaucauuuuucaugccgguuauagucucaagaaacggcacuucuuucgcaaccugggcagcaucuuagcauacgcuuuccuggggacggccgucucuuguuuuauuaucggaaaucucauguauggcgugguaaaacuuaugaagauaaugggucagcuguccgauaaguucuacuauacugacugcuuguucuuuggggcgauuaucucagccaccgauccuguuacagugcuagcaauuuucaacgagcugcaugcugacgucgaucucuacgcccugcuuuuuggagaaagcgugcugaaugacgcuguggccaucgucuugaguucuuccaucguugcauaccagccagccggccucaacacucacgcuuucgaugcggcagccuuuuucaaaagcgugggcauuuuucuggggauauucucgggaucuuuuaccaugggugcuguaacaggcgugaaugccaacgucaccaaguucacgaaguuacacuguuuuccgcugcuagagacugcacucuucuuucugauguccuggucaacauuccuuuuggccgaggcuugcggguucaccggagugguugccgugcuguuuuguggcaucacucaagcacauuauacauacaauaaccucagugucgaaagccgauccagaaccaaacagcuguucgaggugcuucacuuucuggcggaaaauuucaucuuuucuuauauggguuuggcucucuucacguuucagaagcauguauucagccccauuuuuauaauuggggccuucguugcaaucuuucugggcagggccgcucacaucuacccuuuaucauucuuucugaaccuaggacggcgucacaaaauuggcuggaauuuccagcauaugaugauguucagugggcuccgcggagccauggcauuugcucuggccaucagagacaccgcguccuaugccaggcaaaugauguucacaacuacccuuuugauuguguuuuucacagucuggauaaucgguggcgggacuaccccaaugcugagcuggcucaacauucgggugggagucgaggaacccucugaggaagaccagaacgagcaccauuggcaguacuuucgagugggcguugauccugaccaggauccacccccgaauaacgacucauuccaagugcugcagggugaugggccugacagugcucgcggcaauagaacaaagcaggagagcgcauggaucuuuagguuaugguauuccuucgaucacaacuaccugaaacccauccuuacccauucuggaccaccuuugacuacgacacuccccgccuggugcggccugcuagcucggugucugaccucgccacaaguauacgacaaucaggaaccccuccgcgaggaagauagcgacuuuauucugacugagggggaucuuaccuugacauauggagacuccaccgucacugccaacgguucaaguucuagccacacagcauccacgucacuggaaggcagcagaaggaccaagucuuccagugaggagguguuagaacgugaccucgggaugggagaucagaaaguuagcucucggggcacucgacugguguucccucuugaggacaaugcguga

SEQ ID NO: 62845 - RNA, 1794 nt, Artificial Sequence
  derived and/or modified sequence opt3 from SLC9A8__Homo_sapiens__NP_001247420
augggcgagaagauggccgaagaggaaagauuccccaacaccacacacgagggguuuaaugugacucugcauacgacccucgucguuacaacuaaacuugugcugccuaccccaggaaagccgaucuugcccguacagacaggugaacaagcucagcaggaggagcagagcuccggcaugaccauuuucuuuucuuuacuggugcuagcaauaugcaucauucucguccaccuccuuaucagguaccggcugcauuucuugccugaaucaguggccguugugagucucgggauucugaugggagcggucaucaaaauaaucgaguuuaagaaacuggcuaacuggaaggaagaggagauguuccgcccaaauauguuuuuccucuuacugcuucccccuauuaucuuugaaagcggcuauuccuugcacaaggguaacuucuuucaaaauauugggucuaucacucuguucgccguguuuggaacagcaauaucggccuucguaguuggcggcgggauuuacuuccuaggacagggguuuuucuuugugugugucugcguguucguguguuuuauccuccaggcugacgucauuucaaaacugaacaugaccgauagcuucgcauuuggcagucuuaucuccgccguugacccaguggcuacgaucgccauuuucaaugcgcugcauguagaucccguguugaacaugcucgucuuuggggagucuauacugaaugacgcagugagcaucguuuuaacuaacaccgccgaaggacugacacgaaagaauauguccgaugugucaggcuggcagacuuuccuccaagcucuugacuauuuucugaaaauguucuuugguagugccgcauuggggacccuaacaggacugauuagcgcucucguccugaagcacaucgaucuucguaaaaccccuucucuggaguucggcaugaugauaauuuucgccuacuugccauauggccucgcggaagggaucucccugucaggaaucauggccauuuuauuuagcgguaucgugaugagucacuacacgcaucacaaccugucuccgguaacucagauucuaaugcagcagacacucagaaccguugcauuccugugcgagacuuguguguuugcuuuccuuggcuuguccauauuuagcuucccccauaaguuugagaucucguucgucauuuggugcaucgugcugguccucuuugggagggccgugaauaucuucccucugucuuaucuucugaacuuuuuccgggaccacaagauuacaccaaaaaugauguuuauaaugugguucuccggauugcgcggcgcuauccccuacgcccucucacugcacuuagaucuggaaccuauggagaagagacaacuaauugguaccacgaccaucguuauugugcuguucacaauccugcuuuuggguggcaguacuaugccacugauaaggcucauggacaucgaagaugcaaaagcccaucggcgcaauaagaaagacguaaaccugagcaagaccgagaaaaugggaaacacagucgaauccgagcacuuaucugagcugacugaagaggaauacgaggcucauuauauucgaagacaggaucuuaagggcuuugugugguuggacgcgaaguaccucaaucccuucuuuaccaggcggcugacacaggaagaccuacaccaugggcguauccaaaugaaaacccugacuaacaagugguaugaggagguucgccagggaccgagcgguucagaagaugacgagcaggaacuccuguga

SEQ ID NO: 62846 - RNA, 1938 nt, Artificial Sequence
  derived and/or modified sequence opt3 from SLC9A9__Homo_sapiens__NP_775924
auggagagacagagcagggugauguccgaaaaggacgaguaccaauuccagcaccagggcgccgucgaacugcucguuuuuaacuuccuucugaucuugaccauuuuaacaauauggcuguuuaaaaaucaucgguuccgcuuucuacacgagacugggggagcuaugguguauggucucaucaugggccugauucuucgauacgcaacggcccccaccgauaucgaaucugggacaguauaugacugcgugaagcugacuuucucaccuaguaccuugcucgucaacauuacagaucagguguacgaguauaaauacaagcgugagaucagccaacauaauauaaacccacaccagggaaaugcgauccuggagaaaaugaccuuugacccggaaauuuucuuuaacguucuguuacccccuaucauuuuccaugcuggcuauuccuuaaagaagagacacuuuuuccagaaucuggguucuauccuuacuuacgccuuuuuggggacagcaauaucguguauugugaucggacugauuauguacggcuucgucaaagccaugauccacgcuggccagcuaaagaacggggauuuccauuuuaccgacugccucuucuuuggaucacugaugagcgcaacggauccagugacuguacuugccaucuuccacgaacugcauguugaccccgauuuguauacccuccuguuuggugagaguguguuaaaugacgcugucgccauugugcugacauacuccauaucuaucuauagcccuaaagagaacccaaaugcguucgaugcagccgccuuuuuccaauccgugggcaacuuucucgggauuuucgcuggaucauuugcaaugggcagugcuuacgccaucauaacugcgcuucugaccaaguucacaaaauugugugaauuucccaugcuagagaccggucuguucuuccuccugagcuggucugccuuucuuuccgcagaagcugccgggcugacgggaauugucgcuguuuuguucugcggcgugacucaggcccacuauacauacaauaaccucucaagcgacaguaagaucaggaccaagcagcuguuugaguucaugaauuuucucgcagaaaacguaaucuucuguuauaugggccuggcccuauuuacuuuccagaaccacauuuuuaaugcucucuucauccugggggcguuucuugcaauuuucguggcccgggcuugcaacauauacccuuugucuuuucugcucaaucugggacgcaaacaaaagaucccauggaacuuccagcauaugaugauguucuccggucuuagaggcgccauugcauuugcccuggcuaucaggaauacagagagccagccgaaacaaaugauguucaccacgaccuugcuccuggucuuuuucacaguguggguuuuugggggaggcacuacccccauguuaacauggcugcagauccgggugggugucgaucuagacgagaaccucaaggaagacccuucgucucagcaccaggaggccaauaaccuggauaaaaauaugacuaaggcagaauccgcgcgccuuuuccgaaugugguacucauuugaccauaaauauuugaagccaauucugacccacagugggcccccucucacaaccacucugccagagugguguggccccauaagcagauuacugacguccccgcaggcuuacggagaacaacuuaaggaggaugacguggagugcaucguaaaccaggaugaauuggccauuaauuaucaggagcaagcaucuagcccuuguucacccccagccaggcucggccuggaccagaaagcuaguccucagacacccgggaaggaaaacaucuacgagggagaucuaggucugggcggguaugaacucaaacuggagcagacccuuggacaaucccaguugaauuga

SEQ ID NO: 62847 - RNA, 1428 nt, Artificial Sequence
  derived and/or modified sequence opt3 from SLC9B1__Homo_sapiens__NP_001094344
augcacaccacagagagcaagaacgaacaucuggaggacgaaaauuuccagacuuccacgacaccccaaucucucaucgauccuaacaauaccgcccacgaggaaacuaaaaccgugcuuucagacacagaggagauuaagccacagaccaaaaaggaaacuuacauaaguugcccgcugagaggcgucuugaacguuaucauuacaaauggggugaucuuauuuguaauuugguguaugaccuggagcauccugggauccgaggcucuacccgguggcaaccucuucgggcuguuuauaaucuucuauucugcaauuaucggaggcaaaauucuucagcugaucaggauaccuuuggugccaccccucccuccacugcuggguaugcucuuagccggguuuacgauucggaauguccccuucaucaacgaacaugugcacguuccuaauacuuggucgucaauucugcgcagcaucgcgcuuaccaucauuuugauacgagcuggacugggccuagauccacaggcccuccgucaucugaagguggucugcuuuagacuugcagugggcccgugucugauggaggccagugcugcagccguauucucccacuuuaucaugaaguuccccuggcaaugggccuuuuugcucggguucguucugggagcugugucuccugcggucguggugccauacaugauggucuuacaggagaacgguuauggcguugaagaggggauucccacacugcucauggcagccagcuccauggacgauauccuugcuauaacuggauuuaauaccugccugucaauuguguucaguagcggcgguaucuugaacaaugccaucgcaucuauuaggaacguauguaucucccuacuggcugggauugugcucggauucuuuguccgguacuucccuucagaagaccagaaaaagcugacacuuaaacgcggcuuucugguguugaccaugugcguuagcgccgugcucggcagucagagaauagggcugcacggaucugguggcuuauguacgcugguccuauccuucaucgcggggacuaaguggagccaagagaaaaugaaggugcagaagauuaucacaaccguaugggauaucuuucagccacuccuguucggacuuguuggcgccgaagugucggucucuuccuuggagucaaauauuguggguauaagugucgcaacucugagccucgcucugugcgugaggauccuuacaaccuaucuguugauguguuuugccggguucuccuuuaaagagaagauuuucaucgcucucgccuggaugcccaaagcaacgguucagauuaaccaagccauccuguuacuguuucuacuccgggaagaguggaccaacugcaagguggcuaaaaagugugaauacacaaaagagcgccaguga

SEQ ID NO: 62848 - RNA, 1254 nt, Artificial Sequence
  derived and/or modified sequence opt3 from SLC9B2__Homo_sapiens__NP_001287685
augggcgacgaggauaagagaaucaccuacgaagacagcgagcccuccacagggaugaacuauacuccuucuaugcaccaggaagcccaagaggaaacggugaugaaacugaagggaauugaugcuaaugagccaaccgaggguucaauacuccuuaaaaguagcgaaaagaaacugcaggagacaccgacugaagcaaaccauguccagagguugcggcagauguuagccugucccccucacggccugcuagaccgcguuaucaccaaugggaugcuccuggcgggauuccuuauucgaaacaucccagugauuaaugauaacguacaaaucaagcauaagugguccucuucgcugcguucaauagcuuugagcaucauucucgugagagccggccugggucuggacaguaaagcacucaagaaauuaaagggggucugcgugaggcuguccaugggacccugcaucguugaggccuguacaucugcucuuuuggcacacuaccugcuaggccucccuuggcaguggggcuuuauucugggguucgugcuuggagccgucagcccagcugugguaguucccuccaugcuguugcuccaggguggcggguauggaguggagaaaggcgucccuacccuguuaauggccgcggguucauuugaugacauccuggcaauaacuggguucaauacaugccucggaauugccuuuaguaccggcagcacgguguucaacgugcuucggggcguccuggaaguugugaucgggguagcuacuggaucuguguugggcuuuuucauucaguacuuuccaucccgcgaucaagacaagcuagucuguaagagaaccuuccuggugcucggucugucaguucuugccguguuuagcaguguccauuucggguuuccgggaucuggcggucugugcacauuggugauggcauuccucgcugggaugggcuggacuuccgagaaagccgaaguagagaagaucaucgcgguugccugggauauuuuccagccccuguuauuuggacugauaggcgcagaagugagcaucgcuucgcuaaggccugagaccgucggguguaaucggauuugcggauucggucacucuaaagugacauggcgcgagaccauccgaagacucuggaacggcugugucgacuccgggauauuugugcacccacaucacucacccaauuggaagagugccuauugguucacgggaccucaggcuagcgccgaauccuga

SEQ ID NO: 62849 - RNA, 3534 nt, Artificial Sequence
  derived and/or modified sequence opt3 from SLC9C1__Homo_sapiens__NP_898884
auggccggcaucuucaaggaguuuuucuuuagcaccgaagaccugcccgaggugauucucacacuuucccugauaucuucaaucggggcuuucuugaacagacacuuagaagauuuuccuauuccagucccgguuauccuguuccuacucggaugcaguuuugaggugcugagcuucacuuccucucagguacaaagguacgcaaaugccauucaguggaugucgcccgaccuuuucuuccggaucuuuacgccuguggucuucuuuaccacagcguucgauauggacacuuauaugcugcagaaauuguucuggcagauacuccugaucucaauuccagguuuucuggugaacuacauccucguuuuauggcaucuggcuagcgugaaucaacuuuugcugaagcccacccaguggcuacucuucagugccauucuggucuccucugauccuaugcuuacagcagccgcuauccgcgaccugggcuugagccgaucccucauaucacugauuaacggggaaaguuuaaugaccagcgugaucucucugauuacuuuuacauccaucauggauuucgaccagcgucuccagucaaaaagaaaucacacccuugcagaggagaucguaggaggcauuuguagcuauauaaucgccaguuuucuguucgguauuuugucuuccaagcuaauccaauuuuggaugagcacgguuuucggggaugacgugaaccauauaucgcugauuuucucuauccucuaccugaucuucuauauuugcgaacuugucggaauguccggcaucuuuacucuggcuauugugggcuugcuccuuaauucaaccaguuucaaagccgcgauagaggaaacauuacugcuagaguuuuggacuuuccucagcaggaucgcauuccugaugguguuuaccuucuuugggcuuuugauuccagcccacacauaccuguauaucgaguucgucgauaucuacuacucccucaacauuuaucugacccuuauaguucugcgguuuuugacgcuccuguuaaucucucccgugcugagccgcguaggacaugaauuuucauggagauggauuuuuaucaugguguguagugagaugaaggguaugccuaauauuaacauggcucuacuccuggccuacuccgaccuuuauuucggcagcgauaaggaaaaaucucagaucuuguuucacgggguccuggugugccucauaacucugguugugaauagguucaucuuaccagucgcagugacaauucugggacuucgggacgcuaccucaacuaaguacaaaaguguauguugcacauuucagcacuuccaggaguugaccaagagcgccgcguccgcccucaaauuugacaaggaucuggcaaacgcugacuggaauaugaucgaaaaggccauuacgcuagagaacccguauaugcugaaugaggaagagaccacagaacaucaaaaaguuaaguguccccacugcaacaaagagaucgaugaaauauucaacacugaggcuauggagcucgccaaucgccgacugcuuucugcacagauugccucguaccagagacaauauaggaacgaaaucuugagccaguccgcugugcagguccuggugggcgcggcagagucauucggugaaaagaaagggaaguguaugaguuuagacaccauuaaaaauuacucugagagccagaagacagucacuuuugcccggaagcuccugcuuaacuggguguacaauacccguaaagaaaaggagggaccuuccaaauauuucuuuuuccgcaucugccauacaauaguuuuuaccgaggaauuugagcacgugggcuaccugguaaucuugaugaacauuuuuccauucaucauuucauggaucagccaacucaaugucauauaucacucugaacugaagcauacuaacuacuguuuucuaacgcuguauauucucgaggcucugcuuaaaaucgccgcaaugagaaaggauuucuuuucccacgccuggaauaucuucgaguuggcuauuacacugaucggcauuuuacaugugauacucaucgaaauugacaccaucaaguacauuuucaacgagacugaaguuaucguguuuauaaaagucgugcaguucuuuaggauccugcggauuuucaagcugaucgcccccaaacugcuacagauuaucgauaagcgaaugagucaccagaaaaccuuuugguaugggauacucaagggauacguacaaggugaggcagacauuaugacaaucaucgaucagauuaccagcucuaagcagauaaaacagaugcuguugaagcaagugauccgcaauauggaacaugcgauuaaagagcugggcuacuuagaguaugaccacccugaaaucgcuguuacugucaagacaaaagaggaaauuaacgugaugcucaauauggccacggagauccugaaggcauucgggcuuaagggaauaaucuccaaaaccgaaggcgccgguauuaacaagcugaucauggcuaaaaagaaagagguguuggauucacagaguauuaucagaccacucacugucgaggaaguucuguaccacauacccuggcuagacaagaauaaagacuauauuaacuuuauccaggagaaggccaagguggugacauucgauugcgggaacgacaucuuugaagagggcgaugaaccgaaaggaauuuacaucauaauuagcggcaugguaaagcuggagaaaucgaagccugggcuuggaaucgaccagauggucgaguccaaagaaaaggauuuccccauuaucgacaccgauuauaugcucucuggugagauaauuggcgaaaucaauugccugacaaacgagccaaugaaguacagcgcaacuuguaaaaccgugguugagacgugcuuuaucccuaagacccauuuguaugacgcuuucgaacaauguucaccccugauuaaacagaagaugugguuaaaacucgggcuggccaucacagcgaggaagauucgggagcaccuuaguuacgaagauuggaauuacaacaugcagcugaaguuguccaauauauauguggucgacaucccaaugucuacuaaaaccgauauuuacgacgagaaccucaucuaugugauccugauucauggagccguugaagauugccuacugcgcaagacauacagagcucccuuucuuauaccuaucacuugucaccaaauucagagcaucgaggacuucaccaaagugguaauuauccagacgccaauaaauaugaagacauucaggcguaacauccggaaauuugucccgaagcacaaguccuaucucacccccggccugauugguucaguggggacuuuggaggaaggcauccaggaggaacgaaaugugaaagaggacggagcacauagcgccgcuacagccagaaguccucaaccaugcucuuuacugggcaccaaguucaacuguaaagaaucccccaggauuaaucuccgcaagguccggaaagaguga

SEQ ID NO: 62850 - RNA, 3375 nt, Artificial Sequence
  derived and/or modified sequence opt3 from SLC9C2__Homo_sapiens__NP_848622
augagcuccuacuucugggcccagaacgagucuaauagacccgaccugcucugcggccaaccugcugauuaucuuguggaagagaagcacuuuaccacacuggucuguuucaucguuguguuagggggauugcugaaaaugugccuaaagaacugugaaguaauugugcucacuauacugucacuuagugguuuugucaucggccauauggcauacaauagcguggagguucaccagauuguguauccacuguugaggacguccucuuucucgcucuacucauauuuuagcccgcugaucauuuucauggucgcccuggacguggaauuuuacacccucaaaaagauguucuggcagguauuacugacagggcuuaucaguuuuuccacugcgucuauaaucauuggauauguugugaucaaauucaacaaggauagcugggacuugcaguccugccugcuauuuucaauuacccucggcaucauagauccccugcggagugucaauagccuuaagacaauugguaucucuaaaauuuacaucgaccugauccgcggggaguccuugauuauauguucaaucgcuagcauuuucuuuggaaacuuccgaggcaaucguauccauuucaguauauuuagagaucuccacgugggcauugagcugucuuacgacaucuuaggguccaucauuuucggauauuggugcgccaagaucauucaauguauacuggcagauguguuuagcaacaugcucaccaauaucauucuuugcuucucgauggucuacaugacuuuuuauaucguugaguuccuggguaugucuggcacauuggcccuagcugcaguggggcugaaccucgacucccugaccuuuaaaccuaagaucgaacuuguaauuacgaaauuccugaggauauuuucaaguguguacgaacauuugaucuaugccuucuuuggaauugucaucggcuguggugagcucagccacuacgaguuccacacuauuccauuuaucuucauacuguucaccacagugaauuuaguucggcugcuaacuauccuccuggugucccccauucuuaugcauucuaacuaugaauacaauuggcgcuggggagucgugaucaccuggagcgggauuaagggcguauuuaacuugcugugggcuccugauguuuacaaucucgccgagagaaagguggaagucccacagauguucauccuguaugugcaggucauaucacuucugacaaugggcauuaacaguuacgugaugacccaguccgcgaggaaauuggaccucugcguucugagcuuaccccggcaaaugauccugcagaacgcaacgcagcacauucaggagaucgugcaaaauacuauaacacuauuuaagaccgaaaagauccucacuaacguaaauuggacacuggucgaggauaagacccgcauugaguauaucccuuucucucaugugucacacaacgacaugaaaacggaaaguaccacagacgaggcccuuauggaagaggcucgauugcacguugccgcaauucagaugagcuccuuugaaaagcagagaaauaacgggauccuggagauagaggcugccaggauucucaucggagcggccaaauguuacuauucuauccaagguaaguucaugucgauuuacgaugugagcacuuauaugcggacccguuccuggcugaucaaguuuaaaaaugucuuaacauuccuggaauacugcauugagaagauacauuuuaucccaccggaaucaaacacuuuccuuaccuuuauuuuccacaucguguuuagugaggaguucgaauacacaggccagauuaucaauuugauauauaucuaccccaugauuauccaucucuggccuauggcacgcgggcugaacguaucugcucuaauuagcaucaauuauuacuucauguuucuguaugugcucgaguccacccugaaaauaauuauccuuaagagaaaauacuuccagcagugcuggaacacuuuggaauuuuucauccugguuauuggaauaaucgacaucuuuugugucuauuucgugaaguuaaggccagauaaucucgcccugauccaacuuacggugauuaugggcuaccugcggaucauacgauuuuugccccucuucaagaucauugucccuauccugauucgcaucgcugacguucagauaaagaagagacuaucacugauguacagcauuacaaaagguuauaucaagucucaggaggaugccaaacuccugaucaagcagauugcagugugcgaauccaucuaccaaaaacuuugugagauauuggagaccaacaaacaggacgccgugaaggaacugguauuaauggagcacgaagggagggaugucgugauugcucucaaaacuaagcaggcgauccggaauguuauugcaaaagcccugaagaaccuuaccuuucugugcagucgcggcaucauagacaagcaugaggugauugaaaucaacaaaguccuacucaagaaacugaaggcuuugaauaacuucccaaaagccauucccccgccuacacccgauauuuaucugcacaauaucauuugguuagagggaaaggacgugcucauagacuuuuucaaagagagagcaaagcuggccuguuucgauagcggcgacaccaucugcaaagggggagaaaugccacaggguauuuaccuuaucaucucuggcauggcuauucugcacuccuugucaccuacuuuugggauagagaguaaccaaaggugugaucguggaagccgggacauguucacagaauuuugcacgaccggcgauaucauuggugagcucucgugucugcuaaaacgagaaaucgaguauacuguuauuugcgagacaucccugcaggccuguuucaucucucuugaagaccucuacgagggguuugaugcauucuggcccagccuggaauauaagauaugguugaaacuggcguuaucaaccgcuuaccaguacuuugagaguucccucaucgacgaagaucugagauuccagaauugcgugauguuuaaccaagccuauguagagacacuuucuagcuacuccgacaugauuaucgauaauaugacuaugaaguucgucauuaucguguauggcucagugauagacaccaaaacggaggaaccauacuuugcacccugcauuaucccuaccacaugugagcagguccagggaacuagcgaucugaguaaguugcucauuauccaagccucugaacugacccagaggaacuccaauacaaacguuauggcuagcgugaauacuguauucgagcagccaggcaagaacauaaaugggcgccagaaaaugucguga

SEQ ID NO: 62851 - RNA, 2013 nt, Artificial Sequence
  derived and/or modified sequence opt3 from SLCO1A2__Homo_sapiens__NP_602307
augggcgagaccgaaaagagaaucgagacacacaggauucggugccugagcaaacucaagauguuccuucuggccauaacuugugcuuuuguguccaaaacguugucugggucauacaugaacaguauguuaacccagaucgaacgccaauucaauauucccacaagccuggucggauuuaucaacgguuccuucgagauuggcaaucuacuccugaucauauuuguuucuuauuucgggacuaaguugcaucgaccuaucaugauuggaaucggcugcgugguaaugggucugggguguuuucuuaaaucgcucccacacuuccugaugaaccaguacgaauaugagucaaccgugagcgucaguggaaaucuguccucuaacagcuuucucugcauggagaauggcacacagauuuuacguccgacccaggaccccuccgaauguacuaaggaggugaagucacugauguggguuuacgugcuugucggcaacaucgugagagggaugggagaaacaccuauauugccacuggguauuaguuauaucgaggauuucgcaaaauuugagaauagcccccuauacauuggccucguagaaaccggggccaucaucggaccucugauuggccuucuguuggcgucuuucugcgcuaacguuuauguggacacggguuuugucaauacugaugaccucauaaucaccccaacagauacuaggugggugggggccuggugguucggauuccugauuugugcaggcgugaacgucuuaaccgccauccccuuuuucuuucugccuaauacacucccaaaggagggccuugaaaccaacgcugacauaauuaaaaaugagaacgaagauaagcaaaaagaggagguuaagaaggaaaaauacgggaucacgaaggacuuccugccguuuaugaaauccuugucaugcaaccccaucuacaugcuauucauucuggugagcguaauccaguuuaaugcauucgugaacaugauuaguuuuaugccuaaguaucucgagcagcaguacggaauaucuuccagcgaugccaucuuccugauggguauuuauaaucuuccacccaucuguaucggcuacauuauagggggacugaucaugaaaaaguuuaaaauuacugucaagcaagcugcccauaucggcugcugguugucgcuccuggaauauuuacuguacuuccuaucuuuucucaugacaugugagaacuccucagugguugguauuaauaccaguuaugaagggaucccucaggaccuguacguggagaacgauauauucgcggacugcaaugucgauugcaacuguccaagcaagaucugggaccccgugugcggcaauaacggacuuuccuacuugucugcaugucuggccggcugcgagacuagcauugggacaggaaucaauaugguauuccagaacuguucaugcauucagaccagugguaauuccagcgcuguucucggccugugugacaaagggccggauugcucucuuaugcugcaauacuuuuugauccucucagccaugaguagcuucauauauucccuggcagcuauuccuggauauaugguguuacugcgguguaugaagucugaagagaaaucgcuaggcgucggucuccacacguuuugcacccgcguguucgccgggauccccgcgccaauuuacuuuggcgcccugauggacagcacaugucuucauuggggaacuuugaagugcggcgaauccggggcaugcagaaucuaugauucaaccacauucagguacauauaucugggacucccugcugcccugcgggguaguucuuuuguccccgcuuuaaucauucugauccuuuugcgcaaaugucaccucccaggcgagaacgccagcuccgggacugaacugauugagaccaaggugaagggaaaagagaaugaaugcaaggacaucuaccagaaaucaacaguucuaaaggaugacgagcugaaaaccaagcucuga

SEQ ID NO: 62852 - RNA, 2076 nt, Artificial Sequence
  derived and/or modified sequence opt3 from SLCO1B1__Homo_sapiens__NP_006437
auggaccagaaccaacaccugaauaagaccgccgaggcucagcccagcgaaaacaaaaagacaagauacugcaauggccucaaaauguuccuugcagcccuguccuugucuuuuaucgcgaagacuuuaggggcuauuauaaugaaaucaaguaucauucauaucgagaggcgguucgaaauuagcuccucucuggugggauuuaucgaugguucguucgagauaggcaaccuacucgucaucguuuuugugucauauuucgggagcaagcugcaccgcccuaaacuuauuggaaucggcuguuuuauuauggguaucgggggaguacugacggccuugccacauuucuuuaugggcuacuaucgauacaguaaggaaaccaauauaaacuccucugagaauagcacauccacucucucaaccugccugauuaaccagauccugagucucaaucgugcaagcccggagauugugggcaagggguguuuaaaagaaucuggauccuauauguggaucuacgucuucauggguaacaugcugagaggcaucggggagacacccauugugccucuuggauugucauauauagacgauuuugccaaggaaggccacagcagucuguaccuagguauccucaaugcuauugcaaugaucgggccaauaauuggauucacccugggcucuuuauuuuccaaaauguacguugacaucggcuauguggaucugagcacuaucaggauuacacccaccgacucgcggugggucggggccuggugguugaacuuccucgugucuggacuguucuccaucauuucaaguauaccauuuuucuuuuuaccucagacgcccaauaagccucaaaaggagcgcaaagcuagccugucccuccauguacuugagacuaacgaugaaaaggaccagaccgccaaucugacaaaccaggguaaaaacaucacuaagaauguuaccggcuucuuucagucuuucaaaagcauuuugacaaacccacuauacgugauguuuguccugcucacccugcuucaagugucaaguuauaucggggcguucacguacguguuuaaguaugucgagcagcaguacggacagccguccagcaaagcaaauauccuguugggcguuauuacuauacccaucuucgccucugguauguuucucgggggcuauauuaucaagaaguucaaacugaacacagugggaauugcuaaguuuucaugcuucaccgccguaaugagucuuagcuucuaccugcuauacuuuuucauccucugugaaaauaaauccguggcaggccugacuaugacauaugaugggaacaauccugucaccucucacagagacgugccacuuucguacugcaacagcgauuguaauugcgacgagucccaaugggaacccguuuguggaaacaaugguauaacguauaucucaccuugcuuggcuggcuguaagaguucuagcgggaacaaaaagccaauuguguuuuacaauugcuccugccuggaggucaccggacuccagaacaggaauuauucagcccaccugggcgaguguccccgggaugacgcgugcacacgcaaguucuacuuuuucguggccauccagguacuuaaccuguuuuucagcgcauugggugggacuucucauguuaugcucauugugaaaaucguccaaccggaacugaaguccuuagcucugggcuuucacaguauggugauacgagcccuaggaggcauucucgcuccuaucuauuucggggcccugauugacaccacauguaucaaauggagcacuaacaauugcggaaccagagguucuuguaggacauacaacuccaccucauuuagucgggucuaccuuggcuugagcucgaugcugcguguguccucucucguucuguauauaaucuuaauuuacgcaaugaagaaaaaguaucaggagaaggauaucaaugccagcgaaaacgggucagugauggacgaggcuaaucuggaaagucuuaacaaaaauaagcauuucguacccuccgcgggagcagauucugagacucacugcuga

SEQ ID NO: 62853 - RNA, 2109 nt, Artificial Sequence
  derived and/or modified sequence opt3 from SLCO1B3__Homo_sapiens__NP_062818
auggaccagcaccaacaucugaacaagaccgccgagagcgcuuccucugagaaaaagaaaacaagaaggugcaauggcuucaagauguuucucgcagcccuuucauucaguuacaucgcgaaagcucugggagggauuauaaugaagaucagcauuacucagaucgaacggcgcuuugauauuuccucuucguuggccgguuuaaucgacggcucauucgaaauagggaaccugcuagugaucgucuuuguuagcuauuucggaaguaagcuccaccgacccaaacugauuggcaucgguugucuucugauggggacgggauccauuuugaccucucucccucauuucuucaugggcuacuaucguuacagcaaggagacacacaucaauccauccgaaaacucaacaaguagccugucuaccugccugauaaaucagacacucuccuuuaacggcaccucaccggagauuguggagaaagauuguguaaaggaaagcgggagucauauguggaucuauguguucaugggaaauauguuaagagguauuggcgagacucccaucgucccucuggggaucucuuacauugacgauuuugcaaaagaaggacacuccagccuuuauuugggcucgcugaacgccauagguaugaucgggccagugauuggauucgcucuaggcucucucuuugcaaagauguacguugacaucggcuacguggaucuguccacaauaaggauuacccccaaggacucacggugggucggggccugguggcuuggauuccuggugagugguuuguucagcaucaucuccucuauuccauuuuucuuucucccuaaaaaucccaacaagccucagaaagagcgcaagaucagccugucauuacacguacugaaaacgaaugaugacagaaaccaaacugcuaaucucaccaaccagggcaagaauguuacuaaaaacgugacuggguucuuucagagucuuaaguccauucugaccaacccauuguaugucauauuccuacugcucacacugcuucaggugagcucuuuuaucggaucauucaccuacguguuuaaguauauggagcaacaguacggccagagugccagccaugcgaauuuccuguuggguauuaucacgaucccgacugucgcaacagggauguuucucggcggauucauuaucaaaaaguuuaaacuguccuuaguuggcauagccaaguucucuuuccugaccucgaugauuagcuuucuauuccagcuccuguauuuuccccuuaucugcgaauccaaaucaguggcuggguugacucugacauacgauggaaacaauaguguagccucucacguggacgucccucucagcuauuguaacuccgagugcaauugugaugaaucacaaugggagccagugugcgguaacaauggcauuaccuaccugagccccugucuugcagggugcaagucuuccaguggaaucaagaaacauacgguuuucuacaacuguagcugcguggaagucaccggccugcagaauaggaacuauucugcucacuugggugagugcccucgggacaauacauguacucgcaaguuuuucauauacguggccauccagguaauuaacucccucuuuucagcgaccgggggcacaacuuucauccuguuaaccguuaaaauugugcaaccagagcugaaggcccuagcaaugggauuucagaguauggucauccgaacacucggcgggauacuggcucccauuuauuucggagcccuuaucgacaaaaccugcaugaaguggagcacuaauucguguggugcucagggcgccugcagaauuuacaacuccguguuuuucgggagggucuauuugggacugucuaucgcacuccgguuuccggcccugguguuauacauaguuuucaucuucgcuaugaagaaaaaguuucagggcaaagauacgaaggcgagcgacaaugaacguaaagugauggaugaggcaaaccuggaauuucuuaacaauggugagcacuuuguaccuucagccgggacagacaguaagaccuguaacuuggauaugcaagacaaugcugccgcaaacuga

SEQ ID NO: 62854 - RNA, 1923 nt, Artificial Sequence
  derived and/or modified sequence opt3 from SLCO1B7__Homo_sapiens__NP_001009562
augaagaucagcaccacacagauugagcggagguucgaaauauccucuucacuggugggccucaucgacgggaguuuugagauuggaaaccuuuucgucaucguuuuugugagcuacuucgguuccaaacugcaccggcccaaguugauuggcaucgggugcuuuuuaaugggaacuggcucuauacugauggcccuaccucauuucuuuauggguuauuaccgcuauucgaaagaaacgaauaucgauccaucagagaacagcaccaguaaucucccgaacugucugauuaaucaaaugcuuucccugaaccgaacacccucugaaaucauugagcgugggugcguaaaggagagcggaucccacauguggaucuacguguucaugggcaauauguugagaggcauaggggaaacuccuauugucccacucggaaucucauauauugacgauuuugcuaaagagggucauaguagccuguaccugggcaccgugaacguuauggggaugacaggacucguguucgcauuuauguuaggcucucuguucgccaagauguaugucgacaucgguuacguggaucuuuccaccaucaggauuacucccaaggacucacgguggguaggggcguggugguugggauuucugguuagcggcauagugaguaucauuucuuccaucccuuucuucuuucuaccacucaaucccaacaaaccucagaaggaacgcaaagucagccuguuccuucacgugcugaagacaaaugauaaaagaaaccagauagcuaauuugaccaacaggcggaaguacauuacgaagaaugugacuggcuuuuuccagucgcucaaaucuauccugaccaacccauuauaugucaucuuuguuauuuucacacugcuccauauguccucauacaucgccagucuuacuuauauuauaaagaugguggagcaacaguacggguggagcgcauccaaaaccaacuuucuguugggaguacuagcccugccggcuguggcaaucgguauguucucuggcggguauauuaucaagaaauuuaagcucagccuggucggacuugccaaacuggcuuucuguucagccacagugcacuugcucagucagguucuguacuuuuucuuaaucugcgaguccaagagcguggcgggccugacccuaacguaugacgguaauucucccguccgcucacacguggauguaccucucaguuacuguaacagcgaaugcaauugugacgagucccagugggaaccaguuugcgggaacaauggcauuacuuaccugucucccugucuugcaggaugcaagucgagcuccggcaacaaagagccuauaguguuuuauaauuguucaugcgucgaagugaucggguugcaaaacaagaauuacagugcccaucugggagagugcccacgagaugacgcuuguacaagaaaaucuuaugucuacuucgugauucagguucucgaugccuuccugugcgcagugggucuuaccagcuauuccguacuggucaucaggauugugcagcccgaguugaaggcucucgccaucggcuuucacucaaugauaaugcggagcuuagggggaauccugguuccgauuuacuucggcgcgcugaucgacacuacauguaugaaauggucuaccaacuccugcggugcccguggggcaugucgcauuuauaauaguacguaccuaggcagagccuuuuucggacucaagguggcucugaucuuuccuguccuuguguugcugaccguauucauauuugugguuaggaagaaaagccauggcaaggacacaaaaguccucgaaaacgagagacaggugauggaugaagcuaaucuggaguucuuaaacgacucugaacacuuugugcccuccgccgaggagcaauga

SEQ ID NO: 62855 - RNA, 1992 nt, Artificial Sequence
  derived and/or modified sequence opt3 from SLCO1C1__Homo_sapiens__NP_001139417
auggacaccagcuccaaggagaacauccagcuguucugcaaaacaucugugcaacccgucggcagaccuucauuuaagacugaauacccaaguagcgaggaaaaacagccguguugcggggagcucaagguuuuccuuugugcccuguccuuuguguauuucgcuaaagcauuggccgaaggauacuuaaagucuacgauuacccagauagagaggcgguuugauauccccucgucacugguaggugugauugacggcagcuucgagaucgggaaucuacucgucauuacauuugugaguuauuucggagcgaagcugcaccgcccuaaaaucauaggcgcugguugcguuaucaugggggugggaacucuucugauugccaugccacaguuuuucauggaacaauacaaguaugagcgauacucccccucuagcaacuccaccuugucaaucaguccuugucuccuggaaaguucuucccagcugccagucucagugauggagaaaagcaagaguaaaauuucuaauggcugcguacagacaguugcaaucauaggccccauuuuuggguuccucuuaggaucccugugugccaagcuguauguggauaucgguuuugucaacuuggaccauauuaccaucacuccuaaggauccacagugggugggcgcuugguggcugggguaccuaaucgcaggaauuauaagccuccuggccgcugugccguucugguaccuucccaaaucgcugccucguucucaauccagagaggacucaaauaguagcuccgaaaagucuaaauucaucauugaugaccacacagauuaucagaccccacagggcgagaacgccaagaucauggaaauggcgagggacuuuuugcccagccucaaaaaucuguucgguaacccugucuacuuuuuauaucugugcacgucaacuguucaguucaauagucucuuugggauggugaccuacaagccaaaauauauagagcaacaguacggacaguccagcucucgggcaaacuucguaauuggccuuaucaauauccccgccguggcucugggcaucuuuucagggggaauugucaugaagaaguuccgcauuaguguguguggugccgcaaaauuguaucuaggcagcuccguuuuuggguaccuucucuuccugucucuuuuugcucugggaugcgaaaacucggauguggccggcuugacagucagcuaccaagguacuaagccgguguccuaucaugagagagcccucuucucagacuguaauaguaggugcaaaugcucugagaccaagugggaaccuauguguggggagaacggcauaacauacguaagcgcgugccuggcaggaugucagaccuccaaucggucaggcaaaaacaucaucuuuuauaacugcacguguguugggauugcugccagcaagucuggaaauuccagugguaucgugggccgcugccagaaggauaacggguguccccagauguucuuauacuuccuggucauuagcgugauaacuucuuauacacuaucccucggaggcaucccagguuacauucugcuuuugcgaugcaucaaaccucaacugaagucauuugcucucgggauuuauacccuggccaucagaguccuugcaggcauacccgccccaguguacuucggaguucugaucgacacuagcuguuugaaauggggcuuuaagaggugcgggagccggggaucgugucgucucuacgacuccaauguguuccgccacauuuaucuggguuuaacaguaauccugggcaccgucucuauucuacucagcaucgcugugcuguuuauacuuaaaaagaacuacguuucaaagcauagaaguuucauuacgaaaagggaacggaccaugguguccacacgauuucagaaggagaauuauacuaccucugaucacuugcugcagcccaacuacuggccugggaaagaaacacagcucuga

SEQ ID NO: 62856 - RNA, 1932 nt, Artificial Sequence
  derived and/or modified sequence opt3 from SLCO2A1__Homo_sapiens__NP_005621
augggccugcuccccaagcucggggccagccagggauccgacaccucuacaucaagagcugguaggugcgcacggaguguguucggcaacaucaaagucuuuguucugugucaaggguuguuacagcugugccagcuacucuacagcgccuauuucaaguccucucugacuacgauugagaaacgcuuuggacuuucgucaagcaguuccggccugauaucuagcuugaaugaaaucuccaacgcgauucucaucauuuucgugucauacuuugguagucgaguacaccguccuagacugaucgggauaggaggccuguuccucgcugccggcgcauuuaucuuaacccugccacauuuccuuagcgagccguaucaguacacauuggccucuacugggaauaacuccaggcugcaagcugaacuaugucagaagcacuggcaggaucuucccccuucaaaaugccauagcaccacacagaauccacaaaaggagaccaguucuauguggggacugaugguggucgcacagcuucuggccgguauuggcacugugcccauccagccuuuugggauuuccuauguugacgauuucagcgaaccaucgaacucucccuuguacaucuccauacucuuugcuauuucaguguucggaccugccuuuggcuaucuguuagguagugucaugcugcagaucuucguggacuacgggcggguaaauacagcggcaguuaaccucgugccaggagauccgcgcuggauuggcgccugguggcuuggccuguugaucagcuccgcucuacugguccucaccucuuuccccuuuuucuuuuucccuagagccaugccaaucggggcaaagagggcucccgccacggcggacgaggcccggaaacuggaggaagcaaagagccgcggaucacuuguggauuuuauuaaacgauucccuuguauauuucugagauugcucaugaauagucuguucguguuagucguucuggcucaaugcacuuuuuccagcgugaucgccggucuaucuaccuuccucaacaaguuucuggagaaacaguacggcacaucagcugccuaugcaaauuuccuuauuggggccguaaacuugccagcugcggcacugggaaugcucuuuggcgguauccugaugaagagguucguguucagucuucaggccauaccccggauugcuacuaccaucaucacaauuagcaugauccugugugucccguuguuuuucauggggugcuccaccccuacgguggccgaaguuuaucccccaucuacuucgagcuccauucacccucaaucacccgcaugucgucgcgacugcaguuguccagauucuauauuucaucccgugugcggcgacaauggaaucgaguaccucagcccuugccacgccggcuguuccaacauuaauaugucaagcgcuacaucuaagcagcugaucuacuuaaacugcuccugugucaccgggggaagugccagcgcaaaaacugguucuugcccagugccgugugcgcacuuccugcuacccgcuaucuuucucauuuccuucguaucacugauagccugcaucagucauaacccucuuuauaugaugguuuugagaguggucaaucaggaggaaaagagcuuugcaauuggcgugcaguuccugcucaugaggcuguuagccuggcugccaucgcccgcucuuuacggguugacaaucgaucacuccuguauucgguggaacucucucugccugggacgacgcggcgccugugcauauuacgacaaugaugcucuaagagacagguaccugggucuccaaaugggguauaaagcccugggcaugcuuuugcugugcuuuaucagcuggcgggucaagaaaaacaaggaguacaaugugcagaaagcggccggauuaauauga

SEQ ID NO: 62857 - RNA, 2064 nt, Artificial Sequence
  derived and/or modified sequence opt3 from SLCO2B1__Homo_sapiens__NP_001138683
augggaaccgagaacacacccgggggaaaggccagcccugacccacaggaugugagaccguccgucuuccacaauaucaaacuguuuguucucugccauucucuucugcaauuggcucaguuaaugauuucagguuaccugaagaguagcauauccacuguggagaaaagguucggccuaucuucgcagacgucagggcuccuggcaucuuuuaacgaaguaggaaauaccgcccuuaucguguucgucaguuauuuuggcucccgggugcaccgcccccgaaugauugguuacggggcgauccugguugcuuuggccggacuccugaugacacugccucauuucauuucugaaccauaucguuacgacaacacuagccccgaggauaugccucaggacuuuaaggcaucccucuguuuaccaaccacaucagcccccgcuagugcaccuagcaauggcaacugcagcuccuauaccgaaacucaacaccugucaguggucggcaucauguucguggcccagacacuuuuggggguaggagguguuccaauacagccguuuggcaucagcuacauugaugacuucgcucauaauaguaacucuccccuguaucuagggauccucuuugccgugaccaugaugggaccuggccuggcguucggucuugggucccugauguugagacucuacgucgauauuaaucagaugccagagggaggcaucagccugacgauaaaagaccccaggugggugggcgcauggugguuaggguuucugauugccgcuggagccguggcacucgcugccaucccuuacuucuucuuuccaaaggagaugcccaaggaaaaacgggagcuucaauuccgcagaaagguccuggcgguuacugauucgccggccaggaaagguaaggacucuccuuccaaacagucacccggcgaaaguaccaagaagcaggauggguuggugcagauugcaccaaaccuaacaguaauccaauuuaucaaaguguucccucggguccugcuccagacucugcgccaccccauuuuucuucuggugguuuugagccaggugugucucuccucuauggcugccggaauggcuaccuuccugccaaaguuuuuagagcgacaauucagcauaacagccucauaugcaaaucugcuaaucggcugccucaguuuucccuccgucauuguggguaucguaguugggggcgugcuggucaaaagacuucacuugggaccugugggcuguggggcccugugccuccugggaaugcuucuguguuuguucuuuagccucccacuguucuuuauagguuguucuucacaucagauugcuggcaucacccaccagacgagugcgcauccgggguuagagcugagccccuccugcauggaagcaugcucuuguccucuagacggauucaacccagucugcgaucccucgacuaggguggaguacaucacaccuugccacgccggcuguagcuccuggguugugcaggacgcucucgacaauucacaaguauucuauaccaacugcaguugugucguggaagguaauccaguucuggccgggucuugcgauagcacuuguucccaccuugugguccccuuuuugcugcucgugucacugggcagcgcauuagccugccugacacauaccccgucuuucaugcuuauuuugcggggaguaaagaaagaggacaagacgcucgcugugggcauccaguuuauguuccugcguauucuagccuggaugccuuccccaguuauacacgggagugcaaucgauaccacauguguccauugggcgcugagcugcggacgcagagcuguguguagguacuauaacaacgaccuccugcggaaucgauuuauuggucuucaguucuuuuucaaaacuggcucugugaucugcuuugccuugguccuggcaguuuuacgccagcaagauaaggaagccagaaccaaggaguccaggucaagucccgcuguggagcagcagcuccuggugagcgggccuggcaaaaagcccgaagacucgcggguauga

SEQ ID NO: 62858 - RNA, 2079 nt, Artificial Sequence
  derived and/or modified sequence opt3 from SLCO3A1__Homo_sapiens__NP_001138516
augcagggcaagaaacccgggggaagcuccgguggcgggagaucuggagagcugcaaggcgacgaagcccagaggaacaagaaaaagaaaaagaaggugucaugcuucaguaauaucaaaauuuuucucgucagcgagugugcucuuaugcuggcacaggguaccguuggggccuacuugguguccguauuaacaacucuggaacggcgcuucaaccuacagucugcggaugugggagucauagcuucgucauuugagaucggcaaucucgcccugauucuuuucgugagcuauuuuggcgcacgagggcaccguccuagacugaucggaugcgguggcauuguuauggccuugggggcucuccugagugcacugccagaguuccucacgcaucaauacaaguaugaagccggagagaucagguggggcgcugaaggucgggacgugugugccgcgaacggguccggaggcgaugagggcccggaccccgauuuaauaugccgcaauagaaccgcaacaaacaugauguaccugcuuuugaucggggcccagguccugcuaggaauuggugcuacuccugugcagccacucggcguaucuuauaucgacgaucacguuaggcggaaagacagcucccuguacauugggauccuuuuuaccaugcugguguucggacccgccuguggcuuuauauuggguucauucugcacaaagauuuaugucgaugcaguguuuaucgacaccaguaaucucgauauuacuccugacgauccacgcuggaucggggcuugguggggcggauuccuguuauguggcgcccugcucuuuuucagcucucuucugauguucggguuuccccaguccuugccuccacauucagaaccggcgauggagagcgagcaagccaugcuaagugaacgagaguacgaaagacccaaaccuucuaacggagugcugaggcacccacucgagcccgacuccagcgcaucgugcuuccagcagcugcgggucaucccuaagguuacaaagcaucuucugucuaauccaguguuuaccuguauuauauuggcugccugcauggaaaucgcuguaguggccgguuucgcagccuuucucggcaaauaccuggagcagcaauucaacuuaacgacuuccucagcuaaucagcugcuagggaugaccgcgauucccugugcaugccucggaaucuuucugggcggucuuuuggucaagaaacugagucucagcgcccugggggcuauacguauggccaugcuugugaaccugguuuccacagcaugcuaugugucuuucuuguuucucggcugugacacuggaccggucgccggcgugaccguaccuuacgggaauagcacagcucccggaucagcccuggauccauauaguccuugcaacaauaacugugagugccagaccgacuccuucacgcccguuuguggugcagauggcauuacuuacuuaagcgcgugcuuugcuggguguaacucuacaaaucugaccggaugcgccugucuaacuacagugccagcagaaaacgccaccgucgugcccggcaagugcccuucaccagguugucaagaggcuuuccucacguuucugugcgucaugugcaucuguagucuuaucggggccauggcacagaccccgagcgugauuaucuugauucgcacaguuucccccgaacugaaaucuuaugcucucggcgugcuguucuuacugcuuagauugcucggauucauaccuccaccccugaucuuuggcgccgggauugacucgacuugccuauucuggagcaccuuuuguggagagcagggcgcgugcguacuguacgauaaugucguguauagguaccucuacguuuccaucgccaucgcucugaagucauucgcauuuauucuuuauacaacuaccuggcaguguuugcggaaaaacuacaagcgauauauaaagaaucacgaaggugggcugaguacaucuaccgaguaccaagacaucgagacugagaaaacgugcccugaaagccacuccccaucagaagauagcuucgugcgcucuuga

SEQ ID NO: 62859 - RNA, 2169 nt, Artificial Sequence
  derived and/or modified sequence opt3 from SLCO4A1__Homo_sapiens__NP_057438
augccccugcaccagcucggcgacaagccucuuaccuucccaagcccgaacuccgccauggagaaugggcuggaucauacacccccuucuagaagggcuucaccaggaacucccuugaguccugguagcuuacgguccgcagcccacucuccacuggacacgucgaaacaaccccuaugccagcucugggcggaaaagcauggcgcucgcgggacccacgaggugcgauacgucucagccggacagagcguugcauguggcuggugggccuuugcuccuccaugccuucaggugcugaacacaccgaaagguauccuguucuuuuugugugcagccgcuuuccuccaagggaugacuguaaauggauuuauuaacaccgugauaacaagucuggaacguagauaugaucugcauuccuaccagucuggccucaucgccagcuccuaugacauugcggcaugcuuaugucugaccuucgucucauacuuuggcgggaguggacacaagcccagguggcuugguuggggcguguugcugauggggacuggaagccuaguuuucgcccucccucacuuuacagcuggccgguaugagguggaacuggaugccggugucagaaccugcccagcaaaucccggggcugugugugccgacucuacguccggacuuucaagauaccagcugguauucauguugggccaguuucuccauggcguuggggcgacuccucuguauaccuuaggagugacauaccuggaugagaacgucaaaagcaguugcucuccaguguacaucgccauuuucuauacugcagcuauccucggucccgccgcuggcuaccuuauagggggagcccuguugaauaucuauaccgagaugggcaggcggacagaacuaaccacggaguccccgcugugggugggugcauggugggucggguuucucggcagcggagccgcugcguucuucacugcaguuccuauucugggcuacccccgccaacuuccagggucgcagcgauaugccgugaugagagcugccgaaaugcaccagcugaaggacucuuccaggggagaggcaucaaacccugauuuugguaagacaauccgggacuugccccucaguauuuggcuguuacugaaaaauccaaccuucauccuacucugucuggccggcgcuacugaggccacacuuauaaccgggaugagcacguuuucccccaaguucuuggaaucucaguuuagccugucagcaagugaggcggcuacccucuucggauaccugguagugccugccggcggugggggcacauuucuuggaggcuucuuugucaacaaacugcguuugcgcggguccgcagugauuaaguucugccucuuuuguacuguugugagccuguuaggaauccuggucuucucucuacauugcccaucagugccgauggccgguguaaccgcuaguuauggcgggagccuccugcccgaaggacaccuuaauuugacagccccuugcaacgcagcuuguuccugccaaccagagcacuacucucccguuuguggcucggauggucugauguacuuuagccucugccaugccggguguccugcggccacugaaaccaauguggacggccagaaagucuauagagauugcuccuguauuccacagaaccugucaaguggauucggccacgcuacagcagggaagugcaccucuacuugucaaaggaagcccuuacugcuuguguucaucuuugucgugaucuucuuuacguucuugagcuccauuccggcccucacagcuacccugcggugcguucgagacccucagcgcucauuugcccuaggaauacaguggaucgugguacgcauucugggcgguaucccagggcccauagcauucggaugggucauugacaaagcgugucuccuguggcaggaucaaugcggccagcaggguagcugccuuguguaccaaaauucugccauguccagguauaucuugaucaugggccuguuauacaagguucucggggugcuguuuuucgcuauugccuguuuucuuuauaaaccucugagugagagcucugacggauuggagacuugccuccccucccagucaagugcaccagauagcgcuaccgacucgcagcugcaguccucugucuga

SEQ ID NO: 62860 - RNA, 2175 nt, Artificial Sequence
  derived and/or modified sequence opt3 from SLCO4C1__Homo_sapiens__NP_851322
augaagucagccaaaggcaucgagaaccuggcuuucgugcccuccucuccugacauucucagaaggcuuucagcaaguccaagccagauagaagucuccgcccugucuucggauccgcaacgggagaauagccagccccaggaauugcagaagccucaagagccacagaaaagccccgaaccuaguuuaccauccgcgcccccuaacguuucugaggagaagcugcgcagccuaucccucucagaauuugaggaagggaguuacggauggcgaaauuuccacccacagugccugcagcguuguaacaccccggguggcuuucuucugcauuauugcuugcucgcugugacacaagggaucguagugaauggacuggucaacauuagcaucucuacuguggagaaaagauacgagaugaaguccucacugacgggccucauuagcaguucuuaugacaucuccuucuguuuacugagccuuuuuguuucguucuuuggugaaagggggcacaagccccggugguuggccuucgcagccuuuaugauaggacugggcgcucuaguguucucucucccucaguuuuucuccggcgaguacaaacuggggucacuuuuugaagauaccugcgucacaacucgcaauaguaccagcuguacauccucuaccagcucacugaguaacuauuuguacguguucauccucggacagcuguuacugggugcaggcgggacuccacucuauacacuuggaaccgccuuccuggacgauuccguacccacgcauaagagcucuuuguacauuggcacugguuacgcuaugucaauccuagggccugccauuggauauguucugggcggccagcuccugaccaucuacauagacguggcgaugggggagaguacagaugucacugaagacgauccaagauggcuuggagcaugguggauugguuuucuguugagcuggaucuucgccuggucccucauuauccccuuuucuugcuucccgaaacaucugccuggcaccgcugagauccaagccgggaagacaucgcaggcacaccagagcaauuccaacgcugacgugaaauuuggaaagucaauuaaggauuuccccgccgcgcugaaaaaucugaugaagaacgccguguuuaugugucuaguccucaguaccucuagcgaggcacugauaacgacuggcuucgcuacauuucuuccaaaauucaucgaaaaucaauuugguuugaccuccucauucgccgcuacuuuagggggcgccguucucauuccuggagcagcccugggccagauccuugggggauuucuggugagcaaguucaggaugacaugcaaaaacaccaugaaguucgcuuuguuuacgucugguguagcgcucacccuguccuucguguuuauguaugcaaaaugugagaaugaacccuucgccggcgucagugagagcuacaacgggacaggagaauuaggcaaccugauagcuccaugcaaugccaacuguaauugcucucgguccuauuacuaucccgugugcggugacgggguucaguacuuuucaccuuguuucgcaggcugcaguaacccaguggcccaccgcaagccgaaggucuacuauaauuguagcugcauugagcgaaaaacugagaucaccucgacagcugaaacuuuuggauucgaggccaaggcaggcaaaugugaaacccacugcgcgaagcuacccaucuuucucuguauuuucuuuaucgugauuauauucacauuuauggcugggaccccuaucacuguauccauucugagaugcguuaaccauaggcagcggucucuugccuugggaauccaauucauggugcugcgucuccuggguacgaucccaggccccauuauauucggguuuacaaucgauagcaccuguauuuuaugggacaucaaugacugcggaauuaaaggcgcauguuggaucuacgauaacauaaagauggcccacaugcuggucgcuaucucagugacuugcaaggucauuaccauguucuuuaaugguuucgccaucuuucuuuauaaaccuccacccagugcaacagacguguccuuccauaaggagaacgcuguugugaccaauguauuggccgaacaggaucucaacaaaauugucaaggagggguga

SEQ ID NO: 62861 - RNA, 2064 nt, Artificial Sequence
  derived and/or modified sequence opt3 from SLCO5A1__Homo_sapiens__NP_001139480
auggacgagggcaccgggcugcagcccggagccggugaacaacucgaggcuccugcaacagccgaagcggugcaggagagaugcgaaccagagacucuuaggagcaagucccugccggucuugucuucagcuaguugucggcccagcuuauccccuacgucuggcgaugccaacccagcauucgggugcguugacucgucaggacaccaggagcugaaacagggccccaauccucuagccccaagccccagugcuccuuccaccucugcaggucucggggauuguaaccaucgcguggaccugagcaagacauuuuccguaucaagugcccuugcuaugcugcaagaacgacguugcuuguacgugguccucacugauagcagauguuuccuggugugcauguguuuucugaccuucauccaggcccucaugguuucuggauauuuauccucagugauuacaaccauagagaggcgguacagccugaaaaguucugaauccggccuuuuggucagcugcuuugacaucggcaaucuggugguaguuguguucgucucguauuuugggggacgcgguagaaggccacuauggcucgcggugggcgggcugcuuauugcauucggagccgcucuguuugccuugccgcacuucaucucucccccuuaccagauucaggagcucaacgcauccgcuccaaaugauggccugugucaaggugggaacucaacugccacauuagagcccccugcgugcccaaaggacaguggaggcaauaaccauuggguguaugucgcccuguuuaucugugcacagauacucaucggcauggggagcacccccauuuacacgcuuggaccgacuuaucuggaugacaauguuaaaaaggaaaacuccucuuuguaccuagcuaucauguacgugaugggugcccugggcccugcuguaggguaucuccugggaggccuucugauugguuucuacguggauccccggaauccaguccacuuggaccagaacgauccucgcuuuaucgggaauugguggagcggcuuccuccugugcgccauagcaauguucuuagugauuuuucccauguucaccuuuccaaagaaacugcccccucgacauaagaaaaagaaaaagaagaaauucucaguugacgccgugagugacgaugacguccuaaaggagaaauccaacaauagcgaacaggcugauaagaaagugucuucaaugggauuuggcaaggacguaagagaucucccaagggcggcaguucggauccugaguaacaugacauuccuuuuugugagcuuguccuauacugccgagucugcuauugucaccgccuucaucacauuuaucccgaaauucauugaaucgcaauuugggauacccgcaagcaacgccuccaucuacaccggagugauuaucgucccuucagcuggugugggcauaguucuugggggauauauuaucaagaagcucaaacugggcgcccgugagagugcaaagcuggcgaugaucugcucuggugugagccuguuguguuucuccacgcucuuuauuguagggugcgagucaaucaaucugggcggaauuaacauaccauacacuacaggccccagcuuaaccaugccucaccgcaaucugacugggucuuguaacgucaauugcggauguaaaauccacgaauaugagccagugugcgguuccgacggcauuacauacuucaaccccugucuagcugggugcguuaauaguggaaaccucagcaccggcaucagaaauuacacggaauguaccugcgugcagucuaggcaggucaucacaccgccuacugugggucaacggucccagcugcgaguagugauuguuaagaccuaucuuaacgagaauggguacgccgucucaggcaaauguaagcgcacaugcaacacuuugauaccauuccugguguuucucuucaucgugaccuuuauuacagcaugcgcccagcccagugcuaucauugucacccugagcauccauucguauuccaauuuacuguggucuagccacuga

SEQ ID NO: 62862 - RNA, 2160 nt, Artificial Sequence
  derived and/or modified sequence opt3 from SLCO6A1__Homo_sapiens__NP_001275931
auguucgugggcgucgccagacacagcgggucccaagacgagguuucuaggggaguggaaccccuggaggcugcacgggcccaaccugcgaaggaucgccgagcuaaagguaccccaaagucaaguaaaccgggcaagaaacaucguuaccucagacuucugcccgaagccuugaucagguuugggggauuccggaagcgcaagaaagcaaagagcuccguaucuaaaaagccuggcgagguggacgauucguuagaacagccaugcggucuggggugucuagucucaacaugcugugagugcuguaacaauauuagaugcuuuaugauauucuauuguauccuccugauuugccagggagugguuuuuggccuuaucgacgugagcauuggcgauuuccagaaagaguaccaacugaagacuaucgaaaaguuggcccucgagaaaaguuaugacauauccucugggcuggucgcuaucuuuauugcauucuacggagauaggaagaaagugaucugguuuguagccagcuccuuccugauuggucucggcucauuacugugugcuuuucccaguaucaacgaagagaauaagcagagcaaaguugggauagaggacauuugcgaagagaucaagguggucucuggaugucaguccucaggcauuagcuuccagaguaaauaucuuucuuucuucaucuugggucaaacggugcaggggaucgccggaaugccucuguacauucuaggcauaaccuucaucgaugaaaacguggcgacacacuccgcaggcauuuaucucgggaucgccgagugcacuagcaugauaggauacgcucuggguuacguccuuggcgccccacugguuaaggugcccgaaaauaccacaucggcaaccaacacuacaguaaauaacgggucuccugagugguuguggaccugguggauuaauuuucucuucgcugccguggucgcguggugcacgcugaucccauuauccuguuuuccgaacaauaugcccggaucaacucggaucaaggcccgcaaacgaaagcagcugcauuucuuugacaguagacucaaagaucuuaagcugggcaccaacauuaaagacuugugcgcagcucuauggauccugaugaagaauccugugcucauuugucuggcccuuagcaaggcuacagaguaucugguuauaaucggugccuccgaauuuuugccaauuuaccucgagaaccaguuuauccugacucccaccguggcaacaaccuuagccgggcugguccuaaucccuggcggagcucucggccaacugcuugggggagugauuguaucuacguuggaaaugagcugcaaagcgcugaugagguucauaaugguuacuucagugaucagucucauucugcuugucuuuaucauuuucgugcgguguaauccaguccaguuugcagguaucaacgaggauuaugacggcacagggaagcugggaaacuugaccgcccccugcaaugaaaaaugucguugcuccagcucuauauacucaaguaucuguggccgcgacgauauugaguauuucagcccgugcuuugcugguuguacuuacuccaaggcccagaaccagaaaaagauguauuacaauugcucuugcaucaaggaggggcucauuacagcagacgccgaaggcgauuucaucgacgcuagaccuggaaaaugugaugccaagugcuacaaacugcccuuauucauagcauuuauuuucucgacccugaucuuuagcggcuucuccggggugccaauuguucuagcgaugacgagggugguaccugacaagcuccggucacuggcucuuggagucaguuaugugaucuugcgaauauuugguaccauccccggcccaucuauuuucaaaaugagcggggagacauccuguauccugcgcgauguuaacaagugcggacacacuggcagauguuggauuuacaauaagaccaaaauggccuuucuccugguggguaucugcuucuuauguaagcugugcacaauaauuuuuacuaccaucgcauucuuuaucuauaaaaggcggcuuaacgaaaauacagacuuccccgaugucaccgugaagaacccuaaaguaaagaaaaaggaggaaacugacuuguga

SEQ ID NO: 62863 - RNA, 1737 nt, Artificial Sequence
  derived and/or modified sequence opt3 from SLFN12__Homo_sapiens__NP_001275938
augaacaucagcguggaccuggagaccaauuacgccgaacucguccuugauguuggcagagugacacugggggagaacuccaggaagaaaaugaaggacugcaaauugcggaagaaacagaaugaaucuguaucacgcgcuaugugugcauuacugaacaguggagguggcgugauuaaggccgagauagaaaaugaggauuauagcuacacuaaggacgggaucggacuagaucucgagaacuccuucucuaauauucugcuuuuuguccccgaauaucuggacuucaugcaaaacggcaauuacuuuuugaucuucgugaaaucguggucacucaacacgagcggucugcgaauuaccacacugaguuccaaucucuauaagcgugauaucacuucugcgaaaguuaugaacgcuaccgccgcauuagaguuucugaaggacaugaaaaagacaagagggaggcuuuacuugcggccugaacugcuagccaagcgcccaugcguggauauacaggaggagaauaacaugaaagcucucgcaggagucuucuuugacagaaccgaacuggauaggaaggagaaacuuacuuucacagaaagcacccacguggagaucaagaauuuuuccacggaaaaacuguugcagcggauuaaggagauccucccgcaguauguaucagccuucgcuaacacugacggcggcuaccuguuuauuggguuaaacgaggauaaagaaaucauaggauucaaggccgagaugagugaccuggacgaucucgaacgcgagauugaaaagagcauccgaaaaaugcccguucaucacuuuuguauggagaagaaaaagauuaauuacucuugcaaauuccuugguguguaugacaagggcucccuguguggguacgucugcgcguugagaguggagagguucuguugcgcaguguuugccaaggaaccugauucauggcaugucaaagacaaccggguuaugcaacuaacccguaaggaguggauccaguucaugguggaagcugagccaaaauuuagcaguucuuaugaagagguaaucucccagauuaauacaagccugcccgccccucacucguggccacuccuggaguggcagcgccaaagacaucacugucccggacuuucuggcaggauaacuuacaccccugaaaaccugugccggaaguuguuccuccagcacgagggucugaaacaguuaaucugugaagagauggauuccgugcgaaaggggucacugauuuuuagucgcagcugguccgucgaccuaggacuccaggagaaucauaaggugcugugcgaugcacuuuugaucucucaagacagcccaccgguucuguauacauuccacauggugcaggaugaagaguuuaaaggcuacucaacccagacggcucucacucugaagcaaaaacuugccaagauaggcggguauaccaaaaaggucugcgugaugacaaagauuuucuaccugagucccgaaggaaugacuuccugucaguacgacuugagaagccagguaaucuauccugagucuuacuauuuuacaaggcggaaauaccuccugaaggcguuauucaaagcccugaagcgccuaaaaucacucagagaucaguuuaguuucgcagaaaaccuguaucaaaucauugguaucgacugcuuucagaagaaugacaaaaagauguucaagagcuguaggcgucuuaccuga

SEQ ID NO: 62864 - RNA, 1767 nt, Artificial Sequence
  derived and/or modified sequence opt3 from SLFN12L__Homo_sapiens__XP_011522471
auggaccuggccagaaaggaguuccucaggggcaacgggcuugcugcaggaaaaaugaauaucagcauugaucuggacaccaacuacgccgaauugguguuaaaugucggucggguuacacugggcgagaacaaucgcaagaaaaugaaggauugccagcuacgaaaacaacagaacgaaaaugugucccgugcgguaugugcucuccugaacucugggggaggcgugauaaaggccgaggucgaaaauaaggguuauucauacaaaaaggacgggaucggacuugaucuggagaacaguuuuagcaauauguugcccuucgugccuaacuuucucgacuucaugcagaauggcaacuauuuucacauuuucguuaaauccuggucucuggagacuucgggcccacagaucgcaacgcugucaagcagucucuacaagagagaugugaccuccgccaaagucaugaaugcuucugcagccuuagaauuucugaaggacauggagaagacagggggaagggcuuaucuucggccggaguuccccgccaaacgcgcgugcguggauguacaagaagagagcaacauggaagcauuggccgcugacuuuuucaacagaacugagcuggguuacaaggaaaaacuaaccuuuacagaguccacccauguugaaauuaagaauuucucaacugagaaacuccugcagaggaucacagagauacuuccucaguaugugagugccuuugcaaacaccgauggcggguaccuguucgucggauugaaugaagacaaggaggugaucggcuucaaagcugaaaagagcuaccucacgaagcuggaggaagugacuaaaaacucuauugguaaguuaccaguccaccauuuuuguguugagaaagggaccaucaauuaucugugcaaguuccucggaguguacgauaaaggccggcuuuguggcuauguauacgcccugcgcguggagcgauuuugcugugcggucuucgccaagaagcccgacuccuggcacgugaaagacaacagaguuaagcaguugacagaaaaagaguggauucaauuuaugguggauucagaaccugucugcgaggaacuaccaagccccgcaaguacuucuuccccugugagccagucguauccacugagggaguacaucaauuucaagauacagccgcuccgguaucaucugcccgggcuuucugagaaaauuaccugugcuccuaagacauuuugccguaaccuguucucccagcacgaaggauugaagcaacucaucugugaggaaauggguucaguaaauaaaggcagucugauuuuuagccgcuccuggucuuuagaccuggggcuacaggagaaccacaagguucucugcgaugcccugcuuaucagccaggacaaaccacccguguuguacaccuuccauaugguccaagaugaggaauuuaaggacuacucaacgcagacugcucagacacugaaacagaagcucgccaagaucggaggcuauaccaaaaaggugugcgucaugacuaaaauuuucuaccugaguccugaggguaagacauccugucaauaugaucuuaauagccaggugauauacccagaaucuuauuacuggaccacggcacagaccaugaaagaccuggagaaggccuugucaaacauccuccccaaagaaaaucagauuuuucuguucguuugcuuauucagauuuugucuguucgugugcugguuuguauguuucuuucuaagguga

SEQ ID NO: 62865 - RNA, 2739 nt, Artificial Sequence
  derived and/or modified sequence opt3 from SLFN14__Homo_sapiens__NP_001123292
auggagagccugaagaccgacacagaaaugcccuacccugaggugaucgucgauguuggcagagugauuuucggggaagagaacaggaaaaagaugacuaauuccugccucaaacggucugaaaacucacgcauaauccgagccauuugugcccuucugaauaguggagguggcguaaucaaggcagagauugacgauaaaacguauagcuaccagugccacggguugggacaagacuuagagaccuccuuucagaagcugcuaccaucuggcucgcagaaguaucucgauuacaugcagcaaggucauaaccugcuuaucuucgugaaaucauggagcccggacgucuuuagucugcccuugcguauauguucccucagaucuaaucuguauaggcgggaugugacaagcgccaucaaccuguccgcgucaagugcucucgaauuacugcgcgagaagggguucagagcccagaggggacggccucgcguuaaaaaguugcacccacaacaggugcuuaaucgaugcauucaggaagaggaggacaugagaauccuggcaagcgaauuuuucaaaaaggauaagcuaauguacaaagagaagcucaacuuuacugaaucuacccaugucgaguucaaaagguuuacaaccaagaaagugauuccccggaucaaggaaaugcugccucacuauguauccgccuucgcuaauacucagggcggcuacguucuuauagggguggacgauaaaucaaaggaggucgugggauguaagugggagaaagugaacccagaccuguugaagaaagaaauugagaauugcaucgaaaagcuccccacauuucauuucuguugcgagaaaccuaaggucaacuuuaccacgaagauucugaauguuuaccagaaagauguguuagacgguuauguaugugugauccaggucgaaccauucugcugugugguuuucgcagaggccccggacagcuggaucaugaaggauaacagugugacucgucugaccgcugagcaaugggucgugaugaugcucgacacacagucugcucccccuucccuuguaacugauuacaauagcugccugauuucgucugcguccucagcacgcaaaaguccaggcuaucccauaaagguucacaaauuuaaggaagccuugcagagacaccuauucccugugacccaagaggaaguccaguuuaagccagagagccugugcaaaaagcucuuuuccgaccauaaagaacuggaggggcuuaugaagacacugauccaccccuguucucagggaauugugaucuucagcaggucaugggcuggcgaugucgguuuccggaaagagcagaacguguugugcgacgcccuccugauagcaguuaacaguccggugguauuauacaccauucugaucgauccuaauuggcccgggggacuagaauaugcucgaaacacggcccaucaacucaagcagaagcugcagacugucggcggcuacacagggaaaguguguaucauuccacgccuuauccacuuguccagcacccagucuagaccuggagagauuccccugagguauccacggucauaccgccucgcggacgaagaggagauggaagaucugcuucaagcccugguuguggucaguuugagcuccagaucucuccugucggaccagauggguugcgaguuuuucaauuuacugauaauggaacagagccagcuacucuccgagucacugcaaaagacuagggaacuuuuuaucuacuguuuccccggcgugcguaaaacagcauuggcuauuaagaucauggagaaaaucaaggaucuguuucacugcaaaccuaaggagauucucuauguaugugaaagugacucucugaaggacuucgugacccagcagacgaccugccaggccguuacacggaaaacuuuuaugcaaggggaguucuuaaagauaaaacauaucgucauggaugaaaccgagaacuucuguagcaaguacggaaauugguauaugaaagcuaagaacauuacacacccaaaggccaaaggcacugguuccgaaaaucugcaucacgggauccuuugguuguuucucgacccguuccagauucaucacgcagaugugaacggccugcccccuccaucagcccaguuuccccgaaagaccaucacaagcggaauacacugcgcucuagagaucgcgaaagugaugaaggaggaaaugaaaagaauuaaggagaauccuccaucuaacaugucccccgacacccuggcacucuucagugaaacugccuacgaggaagcuacgugugcccaagcacugccgggcgucugcgagacaaagaccaaucuuacuaccgagcagaucgccaacuauguugcuaggaaaugccauagcuuguuucaguguggguaccugccuaaggauauugccaucuuaugccgccggggagaagacagagguagguaucgccucgcacugcuuaaagcgauggagcugauagaaacacaccgaccaucugaggugguguucucccccgcuaccggcguaugggggucacauauugucuuggauaguauccagcaauuuagcggacucgagcggacugugguuuucggccugucgccugaaugugaccaguccgaggaauuucacaagcuaugcuucgccucucgugcaauuaaacaccuguaccuccuguacgagaagagagccgcuuauuga

SEQ ID NO: 62866 - RNA, 2676 nt, Artificial Sequence
  derived and/or modified sequence opt3 from SLFN5__Homo_sapiens__NP_659412
augagccugagaaucgacguggauaccaacuuccccgagugcgucguugacgccggcaaggugacacucgggacucagcaaaggcaggaaauggauccucggcuucgcgagaaacagaaugaaauuauacugcgagcuguaugugcauuguuaaacuccggagguggcaucauuaaggccgagaucgaaaauaaaggguacaacuaugagcgucacggagugggccuggacgucccaccgauuuuuagaucucaucuagauaagaugcagaaagagaaucacuuccucaucuuugugaagucauggaacacggaagcggguguuccccuggcuacccuuugcaguaaucuguaccauagggagcggacaagcacugacgugauggauucccaagaagccuuggcauuccucaagugucgcacccagacaccuaccaacauaaaugucucuaacucgcuggggccacaggccgcucagggaucagugcaauaugagggcaauaucaacguaagcgcagccgcucuguuugacagaaaaaggcuccaguacuuagagaagcugaaucuucccgaaaguacucacguugaguucgugauguuuuccacagaugucucucauugcgugaaagaccgguugccuaagugugugagcgccuucgcgaacaccgaaggcggguaugucuuuuucggaguucacgaugagacgugccaggugauugguugugaaaaagagaagaucgaccugacuucccuacgcgcaucaauugauggcugcaucaagaaacucccaguacaccauuuuuguacccagcgacccgagauaaaguacgugcugaauuuccuugaaguccacgacaaaggggcccugagaggauaugugugcgcuauuaagguugagaaauuuuguugcgccguguucgcaaaggucccuaguagcuggcaagugaaagacaacaggguacggcaguugccaacacgugaauggacugcuuggaugauggaggccgauccggaccucucucgcugccccgaaaugguucugcaguuaucccugucaagcgcgaccccuagaaguaagccaguguguauccauaagaacucugagugccucaaagagcaacagaagagguacuuccccgucuuuuccgaucggguggucuacacaccugaaagccuuuauaaagagcuguucucgcagcacaagggcuugcgagaccuaauuaauaccgaaaugcgcccauuuucucaggguauccugaucuucucccaaucaugggccguggaucucgggcugcaggagaaacagggaguuauuugugacgcacuucugauaagucagaacaauacgcccaucuuguacacuauuuuuagcaagugggaugcuggcugcaagggcuauuccaugaucguggccuacucucucaaacaaaagcugguaaacaaagggggauauacagguagauuauguauaaccccgcuggucugcgugcuaaauagcgacaggaaggcucagucaguuuacaguuccuaucuccagauuuacccugaaagcuacaacuucaugacuccccagcacauggaggcccugcuucaaucuuuggugaucguccugcucggcuuuaaaucauuccugagugaggaacuugggagcgaggugcugaauuugcucacaaacaagcaguaugaacuguuauccaagaaucugcggaaaacccgcgagcuauuuguacauggacucccaggcucugguaagacgauccuggcacuuagaauuauggagaaaaucaggaacguguuccacugugaaccugccaauauuuuguacauaugcgagaaccagccccugaagaaacucguuucguuuagcaagaagaauaucugucagccagucacccguaaaacauucaugaagaacaauuuugaacauauucaacacaucaucauugaugacgcucagaacuuccggacugaggauggggacugguauggcaaagcgaaguucauaacccagacagcacgagacggacccggcgugcuguggaucuuuuuagauuacuuccaaacuuaucaucuguccugcucagggcuuccuccaccgagugaccaguaccccagagaagagauuaacagggugguccgcaaugccggaccuaucgcuaacuauuugcagcagguuaugcaagaggcccggcagaauccacccccuaaccucccacccgguucucuggugaugcuauacgaaccgaaaugggcacagggcgugccugggaaucuggagauuaucgaagaucucaaccuggaggaaauacuuaucuacguagccaauaaguguagauuuuugcugaggaacggauauagcccaaaagacauugcugucuuauucaccaaggccuccgagguggagaaguacaaagaucgccuccugacagcaaugcgaaagcggaaacuuucacagcugcacgaagagagcgacuugcuccugcaaaucggcgaugcgucugacguucuaaccgaucacauugugcuggacuccgucugccguuuuaguggucucgaaagaaauaucguguucgggauaaaccccggcguugcuccucccgccggagcauauaaucugcuuuugugccuggccagcagggcuaagcgccauuuauacauucucaaagccucuguguga

SEQ ID NO: 62867 - RNA, 4605 nt, Artificial Sequence
  derived and/or modified sequence opt3 from SLIT1__Homo_sapiens__NP_003052
auggcccugacccccggcugggggagcuccgcuggaccugugagaccagagcucuggcuucuguugugggcagccgcguggagguuaggugcuucugccugcccggcacuguguacaugcacuggcacgaccgucgacugucacgggacaggacuacaggccauccccaagaacauuccucggaauacugaacgccucgagcugaacggcaauaacauaacccgaauccauaaaaaugauuucgcuggucuuaagcaacugcguguuuugcagcucauggaaaaccagauuggggcaguggagagaggagccuuugacgauaugaaagaacuggagaggcugcggcucaaucgcaaccaguuacacaugcugccagagcuuuuguuccaaaauaaccaggcucugucaagacuagaccucagugaaaaugccauccaggcgauucccaggaaggcauuucggggcgccacagaucugaaaaaccuucagcuggacaagaaucaaaucagcugcauagaggaaggcgcuuuccgcgccuugcgagggcucgagguacugaccuuaaacaauaacaacaucacuacaauuccuguguccucuuuuaaucauaugccaaagcugagaaccuucaggcuccacucgaaccaucuguuuugugauugccaccuugcaugguugucacaguggcuacggcagcgucccacgaucggacuguucacucaguguagcgguccugcuagucuccgcggccugaaugucgccgaggugcaaaaauccgaauuuucuugcagcgggcagggagaggcgggcagaguuccaaccuguacacuuuccucagguaguugcccggccauguguacuugcagcaacgggauuguggacugcaggggaaagggccugaccgcaauccccgcuaauuugccugaaacaaugaccgagauacggcucgaacugaacggcauuaaaucuaucccacccggggccuucuccccuuaccgaaaguuacgcagaauugaucugucaaauaaccagaucgcugagaucgccccagacgcauuucaaggacuaaggagccucaauagucugguccuuuaugguaacaaaauuacggauuugccccggggcguguucgggggacuguacacucuccagcugcuucuguugaaugccaacaagauaaauuguauccgcccggacgcuuuucaggaucuccagaaccugucuuuacugucccuauaugacaauaagauucaaagccucgcgaaaggcacauucaccucgcugagagcaauccagacucuucacuuggcccagaacccuuucauaugcgacuguaaccugaaguggcucgcugauuuucugaggacaaaucccauugagaccucuggugcccguugcgcauccccacggcgauuagccaacaaaagaaucgggcagaucaagaguaaaaaguucagguguucagcuaaagaacaauacuuuauuccuggcacggaggacuaucagcugaauagcgaaugcaacuccgauguaguuuguccccauaagugccgcugugaggccaauguggucgaaugcucuagccuuaaguugaccaaaaucccagagcggauuccccagucaacagcagagcucagacugaacaauaacgaaauaaguauccuagaggcgacuggaauguucaagaaacugacccaccucaagaaaauuaaucuguccaacaauaaggugagcgaaaucgaggacggcgcuuuugaaggggccgcaucugugucagagcuucauuugacagccaaccagcuggagaguaucaggagcggaauguuccgcgguuuagauggccuccgaacucugaugcuucggaauaaccguauuuccuguauacacaaugacucuuuuaccgggcugagaaacgucagguugcucucgcuguacgauaaccaaaucacaaccguuagcccuggagcuuucgacacucuacagucccugucaacgcucaaucugcuugccaacccauuuaauugcaacugccaguuggcauggcugggcgguugguuacgcaagcggaaaauugugacagggaauccgagaugucagaaccccgauuuccucaggcaaaucccucugcaggacguagcuuuuccagauuuccgaugcgaagagggccaggaagagggaggcugucuuccccgcccucaaugcccacaggagugugccugccuggacaccgugguccgguguaguaauaagcaccuaagagcgcuccccaaagggauuccgaagaacgugacugaacuguauuuggacggaaaucaguuuacccugguuccuggucaguuaucuacauucaaauaccuccaacugguggaucuuagcaacaauaagaucuccucacugagcaacucuuccuucaccaauaugagucaguugacuacacucauacugagcuacaacgcccuacagugcaucccaccccuggcuuuucagggccuuaggucucuccgucuguugucccugcaugggaaugacauuucaacguuacaagagggaaucuucgcagaugucaccagucucagccaccuggccauuggcgcuaacccucuuuauugugacugccaucugcgcugguugucguccugggugaagacugguuacaaagaacccgggaucgcccggugugcaggcccacaggauauggagggaaagcuccugcuaacaaccccugcgaaaaaguuugaaugccaggggcccccaacacuggccguacaggcuaaaugcgaccuuugucucucuagcccgugccaaaaccagggcacuugucacaaugauccucuggagguuuauagaugcgccugucccucaggauacaagggcagggacugcgaggugaguuuggauuccuguucuagcgguccaugcgaaaacgggggaaccugucaugcacaggagggcgaagacgcucccuucacgugcuccuguccuaccgguuuugagggcccaacaugcggggucaauacugaugacugcguggaucacgccugugcaaacggaggcgucugcguggacgggguuggaaauuauaccugucaaugccccuuacaguacgaaggcaaggccugugagcagcugguggaccucugcucaccugaucugaacccgugucagcacgaggcucaaugcguagguacaccagacgggccccgaugugaaugcaugccuggauaugcgggcgauaauuguagcgagaaccaggacgauugccgggaccaucgcugccagaauggugcccaguguauggaugaagucaacaguuacucuugccuuugugcagagggcuacuccgggcaacugugcgaaauaccaccccacuugccugcuccgaaaagccccugugagggaacugagugccagaauggcgccaacuguguggaccaggggaauagaccaguuugccagugucuaccuggauucggcggucccgaaugcgagaagcugcucucggugaacuuugucgauagggacaccuaucugcaauucacggaucuucagaauuggccacgggccaacauuacauuacaggugucaaccgcugaagacaaugggauccugcucuacaacggagauaacgaccauauugcaguagaguuguaucagggccacgugcgaguuucuuacgacccugguaguuaucccuccagcgccaucuacucugcggagacuauaaaugauggccaauuucacacagucgaacugguggcuuucgaccagauggugaaccucagcaucgaugggggauccccaaugaccauggacaauuuuggcaaacauuauacucugaacucagaggccccgcuuuacgucgggggaaugccuguugaugugaauagugcagccuucagacuguggcagauuuugaacggcaccgguuuucacggguguauccgcaaucuauacauuaacaaugaacugcaagacuucacaaagacgcagaugaaacccggagugguaccaggcugcgagcccugcaggaagcucuauuguuuacauggcaucugccagccuaacgcuaccccagggcccaugugucacugcgaagcaggaugggucggucugcauugugaucagccugccgacggcccgugccacgggcacaaaugugugcauggacaaugcguuccacuugaugcgcugagcuacucuugucagugccaggacggcuauuccggugcucucuguaaucaggccggggcauuggccgagcccugccguggacugcaaugucuccacggccauugccaggcuucaggcacuaagggggcccacugcgugugugauccuggauucaguggugagcugugcgaacaggagagcgaaugucggggcgaccccgucagagacuuucaucaggugcaaaggggguacgcaauaugccagacaacccgcccacuuuccuggguugagugucgaggaucuugcccuggccaggguuguugccaagggcuaagacugaagcggaggaaauucacauuugaauguucggauggaacuagcuucgcugaggagguggaaaagcccaccaaaugcggcugugccuugugcgcguga

SEQ ID NO: 62868 - RNA, 4578 nt, Artificial Sequence
  derived and/or modified sequence opt3 from SLIT2__Homo_sapiens__NP_001276064
augagaggcgugggguggcagaugcugagccucucccuuggacuggucuuggccaucuuaaacaagguugcuccccaagcaugcccugcccaguguucuugcucagguaguaccguggacugucacggccuggcgcuaaggagcguaccacggaauauuccgcgcaacacagagcgacucgaucugaaugggaacaauauaacucguaucacgaaaaccgacuucgcuggacuuagacaucugaggguguugcagcucauggaaaacaagauuuccacaaucgagcggggcgccuuucaggaucugaaagaacuggagcgccucagauuaaauaggaaccaucugcaacuuuuccccgaauugcuguuucuagguacugcaaagcucuaccggcuggaccuuucugagaaucagauucaggccaucccucgcaaggcuuuccgaggggcagucgauauaaagaaccugcaguuggacuauaaucaaaucucgugcauugaggauggagccuuuagagcucucagggaccuggaaguguuaacccugaacaauaacaauaucacacggcucucaguugccagcuucaaccacaugccaaaacuucguaccuuucgccugcacaguaacaauuuguacugugauugccaucuagcguggcuguccgacuggcucagacagaggccccgggugggccuguauacucaguguaugggcccuucucaccuucgagggcacaacgucgcagaggugcagaaacgcgaguucguaugcagcgaugaagaggaaggacaucaauccuuuauggccccaucauguaguguucugcacugccccgcugccuguacaugcagcaauaacauuguggacugcagagguaagggcuugaccgagaucccuacgaaucucccagaaacuauaaccgagauuaggcuggaacagaacacaaucaaagucauuccgcccggggcauucucuccuuacaagaaauuacggcgcaucgaucuguccaauaaccagaucucagagcuagcuccagacgccuuucaaggacucagaagccugaauagucuuguguuguauggcaacaagauuacugagcugcccaagucucucuucgaaggucuguuuucccuucagcuguugcuccugaaugcgaacaaaauaaauuguuuaaggguggacgccuuccaggaucugcauaaccuaaaucuccugagccuuuacgacaacaaguugcagaccaucgcaaaagggacauucucgccucugcgugcuauucaaaccaugcaccucgcccagaacccauuuaucugcgauugucaccugaagugguuagcugacuaucugcauacgaaucccauagagacuucuggagcccggugcacauccccgcgaagacuugcaaacaaaaggauuggccagaucaaguccaaaaaguuccgcuguaguggcaccgaagauuaccggagcaaguuguccggggacugcuuugccgaucucgcuuguccugagaaaugcagaugugaaggaacuacagucgacugcucuaaucagaagcugaacaaaauccccgagcacauuccacaauacaccgcggagcuaaggcugaauaacaaugaguucacgguucucgaagcaaccgguaucuuuaagaaacugccucagcuucgcaagauuaacuucagcaauaacaagauaacagauaucgaagagggcgccuuugaaggggcuucaggagugaaugagauuuugcugaccaguaaccgauuagagaauguacagcauaaaauguucaagggccucgaaucccugaaaacucuuaugcugcggagcaaccguaucacauguguggguaaugacucuuuuaucggguugucaagugucagacuccugagccuauaugauaaccagauuacuaccguggcccccggcgcauucgacacacugcacucccucucuacccugaaccuuuuggccaauccauuuaacugcaauugcuaccuggcuugguuaggagaguggcucaggaagaaacgcauaguuacuggcaacccccggugucaaaagccuuauuuccugaaggaaaucccaauucaggacguggccauccaggauuuuacgugcgacgaugggaaugacgauaacucguguagcccgcuuuccagaugccccacagaguguaccugccuggacacugucgugagguguucaaauaaaggacuaaagguacucccuaaagguauuccacgagauguuaccgagcuguacuuggacggcaaccaguucacacuggugcccaaggaauuaaguaauuauaaacaucucacccugaucgaucuuucuaacaaucgcauaagcacucuguccaaccaaucauucagcaauaugacacaguugcucacgcugauccuaucuuacaaccggcugagaugcauuccuccaaggaccuuugacgggcuuaagucccuccgucuguugagucugcacggaaaugauaucagcgucgugcccgagggcgcauucaacgacuuaucugcgcucucccaccuggcuauuggugccaacccgcuuuauugugauugcaauaugcaguggcugucagacugggucaagagugaauacaaagagccugggaucgcacgcugugccggcccaggagaaauggcugacaaguugcuccugacuacacccagcaaaaaguuuaccugccaaggcccuguggauguuaacauacuagccaaaugcaaucccugucugucgaacccaugcaagaaugacgggacauguaacuccgauccuguggacuucuaccggugcacuugucccuauggauuuaaaggucaggauugcgacguaccaauucaugcauguaucucuaauccgugcaagcacggcgggaccugucaucuuaaggagggagaggaagauggcuucuggugcauuugugcugacgguuuugagggggaaaacugcgaggucaauguggaugacugcgaagauaacgacugugagaauaacagcacgugcguugauggcaucaauaacuacaccugucucugcccucccgaguauacaggagaacugugugaggaaaaauuggacuucugcgcccaggacuuaaauccaugucagcacgauucaaagugcauacugacucccaaaggcuuuaagugugacugcaccccuggguacgugggagagcacugugauaucgacuucgaugacugccaagauaacaaaugcaagaauggcgcgcauuguacagacgccgucaacgguuauacuugcauuuguccagaaggguacaguggacucuuuugcgaguucucacccccuauggugcugccgagaaccucuccaugugauaacuuugacugccagaauggcgcucaguguaucguaaggauuaacgagcccaucugccagugucuuccugguuaucaaggcgaaaagugcgagaaacuggugagcguuaauuucauaaacaaggaauccuacuugcagauuccaucagcaaaaguccgaccccagacgaauaucacacuacagaucgccaccgaugaggacagcgggauucugcucuacaagggagacaaagaucacaucgcuguggagcuguaucggggccgcgugagagccaguuacgacacugggucucauccugcauccgcgauuuauagcgucgaaacaauaaacgauggaaauuuccacaucguugagcuuuuagcccuggaccaaucgcucucauugucuguggauggcgguaacccgaagauuaucaccaaucugaguaagcaguccacucucaacuuugacagcccccuguacguagggggaaugccaggcaaaucuaauguggcuagccuuaggcaggccccuggucaaaacggcaccuccuuccauggguguauucggaaucuguauaucaacucagaauugcaggauuuucagaagguccccaugcagacaggaauacuaccaggcugcgagccuugccacaaaaaggugugugcacacgggacgugccaacccaguagccaggcuggauucaccugugaaugccaggagggcuggauggguccacugugugaccagcgaacuaaugauccgugccucgggaacaaauguguucauggaacaugcuuaccuaucaacgccuuuucuuacuccuguaagugccuggagggccacgguggcgugcuuugugacgaagaggaagaucuguucaaucccugccaagcaauuaaguguaaacaugggaagugcagacucucaggauugggccagccauauugcgaguguaguagcggguacaccggagacuccugcgaucgcgaaaucucuuguaggggcgagcguauucgggacuacuaucagaaacagcaagguuacgccgcuugccagacaacuaagaaagucucgagacuggagugucgcgggggaugcgcgggcggccaguguugcgggccccucaggagcaagcgaagaaaauauucauuugaauguaccgacggauccaguuucguggaugagguugaaaaggugguaaagugcgguuguacgcggugcgucucuuga

SEQ ID NO: 62869 - RNA, 4572 nt, Artificial Sequence
  derived and/or modified sequence opt3 from SLIT3__Homo_sapiens__NP_003053
auggcccccggcugggcuggggugggagcagccgucagagcgaggcuggcucucgcccuugcacuggccagcguuuuguccgguccuccagcuguggcaugcccgaccaaguguacaugcucugccgcuucaguagacugucacggcuuagggcugcgggccgugccccgcggaaucccucgaaacgcggagcgucuagaucucgacagaaauaacauuacuaggauaacgaaaauggauuucgcaggccugaagaaucuucggguccugcauuuggaagacaaccaggugaguguuaucgagcgcggugccuuucaagaucucaaacagcuggaaagacugaggcucaauaagaacaaauuacaggugcugccagagcuuuuguuccagagcacccccaagcugacacggcuagaccucuccgaaaaucaaauucaggggaucccucgcaaggcuuuucgaggaauuacugaugucaaaaaccugcagcuugacaauaaccacaucucuugcauagaggauggcgccuucagagcacugagggacuuggagauccucacccugaauaacaauaacauuucgcggaucuuagugacaucauuuaaucauaugccaaagauucguacccugcgccuccacagcaaccaucuuuacugugauugccaccuggcuugguugagugacuggcuaagacagaggcggacuguaggccaauucacacuguguauggcccccguucaccuccgaggguuuaacguggcggauguccagaaaaaggaauaugugugcccugccccacauuccgagccgcccucuuguaaugcaaacagcaucuccugcccuucaccauguaccugcaguaauaacauaguggacugccgcggaaaaggucugauggaaauucccgcuaaucuuccugagggcaucgucgagauuagacuggaacagaacagcaucaaggccaucccagcuggggccuucacgcaguacaagaaauugaagaggauugacauaucuaaaaaucaaaucuccgauauugcacccgacgccuuucagggacucaagucacugacuagcuuaguucuguauggcaacaaaaucaccgagauagcuaagggucuauucgaugggcucgugagucugcagcuuuugcugcucaaugcgaacaaaauuaauugucugcggguaaacacauuucaagaccuucagaaucugaacuugcucucucuguacgauaauaaguuacagacuaucuccaagggacuguucgcaccgcuacagagcauccaaacccuccaccuggcccagaacccuuuugugugcgacugucaucuuaaaugguuggcugauuaucugcaggacaaccccauugaaacaucgggcgcccgcugcaguuccccaagaaggcucgcaaauaagcguaucucacagauuaaaaguaagaaauuccgguguagcggcuccgaggauuaccgaucuagauucagcucagaaugcuuuauggaccuggucuguccugagaaguguaggugcgaggggaccauaguggauugcaguaaccaaaaguuaguucgcauccccucccaccucccagaauaugugacggaccuucgguugaaugacaacgaggucagcgugcucgaagccacuggaauuuucaaaaagcugcccaaucuaagaaaaaucaaccugucuaauaacaagaucaaagagguaagggaaggugcuuuugauggcgccgcaucaguucaggagcucaugcugacagggaaucagcuugagaccgugcacggacgcgucuuccgaggcuugaguggucugaagacuuuaaugcuccggagcaaccugauuggguguguguccaaugacacauuugcgggccuuucuucgguccgucuguugagccucuacgauaacagaauaaccacgaucaccccuggagcuuucacaacucuggugucccuaucaaccauuaaucugcucaguaacccauuuaauugcaacugccaucuggccuggcuuggcaagugguugaggaaacgccggaucguuucugggaacccgagaugucagaagcccuucuuucugaaagaaauuccuauccaagacguggcaauacaggauuucacaugcgacggaaaugaggaaagcuccugucaguuaucaccaaggugccccgagcaguguacuugcauggaaaccguaguccgauguagcaacaagggucuccgcgcccugccucggggcaugccaaaagaugugacagagcuuuaccuggaggggaaucaccuaaccgcuguucccagagaacucucugcccugaggcauuugacucugaucgacuuauccaacaauaguauuagcaugcucacgaacuauacauuuucuaauaugucccaccugucaacccuuauccugaguuacaaccguuugcgcugcauuccggugcaugcauucaauggacuccggagccugagaguccuaacucugcacggcaacgauaucucguccgugccugaggguucuuuuaaugaccuuaccagccucucacaccuggcuuuggggacaaacccacugcauugugauugcaguuuaagguggcucuccgaauggguaaaggccggcuauaaggagcccggaauagcgcgauguucuagcccugagcccauggccgaccggcugcuucugaccacuccaacacaccgcuuccaaugcaaaggcccuguggauauuaauaucguugcuaagugcaacgcauguuuguccucacccugcaaaaauaacgggacguguacccaggacccagucgaacucuacagaugcgccuguccguauagcuacaagggaaaagacugcacugugccuauuaacacauguauccagaaucccugccaacaugguggcaccugucaccugagugauucucacaaggacggguucuccugcagcuguccacuaggauuugagggccagaggugcgaaauaaaccccgaugacugcgaggauaaugacugugaaaacaaugcuacaugcguggaugguaucaacaauuaugucuguauuugcccuccaaacuacacuggggagcugugugacgagguuaucgaucauugcgugcccgaacuuaaucucugucagcacgaggccaaaugcauuccucuggacaagggcuucucgugugaaugcgugccgggauacucaggcaaguugugugagaccgauaacgacgauugcguagcacauaaaugccggcacggggcgcagugugucgacacgaucaauggauauaccugcacauguccacaaggcuuuucuggucccuucugcgaacauccuccacccaugguguuacugcagacuucuccuugugaccaguacgagugccagaacggggcccaauguauaguugugcagcaggagccgaccugccgaugucccccaggauuugcuggcccuagaugcgaaaagcucauuacagucaauuucguggguaaagauuccuauguugagcuggccagcgcaaaggugcgcccccaggcuaacaucucucuucaaguagccacugacaaagauaauggcauccuguuguacaagggggacaacgauccacuagcacuggaacucuaucagggacacgucaggcugguguacgacagccuuuccucaccucccaccacgguguauagugucgagacaguuaaugauggccaguuucacagcguggaauuaguaacccugaaccaaacucucaacuugguggucgacaaggggacaccaaaaucucugggaaagcuccagaaacagccggccgugggcauuaauuccccucuguaccuuggugggauccccaccucaacuggacugagugcuuugcgucagggcaccgaucggccacuagguggcuuccauggguguauucacgagguuagaauaaacaaugagcugcaagacuuuaaggcgcugcccccucagagcuuaggaguguccccaggcugcaaaucuugcacagucuguaagcaugggcugugcaggucgguggaaaaggauagcguugugugugagugccgccccggauggacgggcccucuuugugaccaggaagcccgagacccgugccugggucacagaugucaucacgggaaaugcgucgcaaccggaacuucauacauguguaagugcgcugagggcuaugguggcgaucucugugacaacaaaaaugauuccgccaacgccugcagugcuuucaagugucaccaugggcagugccacaucucugaccaaggagagccauacugcuugugucagcccggcuuuagcggggaacauugccagcaggagaauccuugucugggacaaguagugcgggaaguuauuaggcgccagaaaggcuaugcauccugcgccacagcgucaaaggugcccaucauggagugucguggugggugcggaccacaguguugccagccuaccagaucuaagcggaggaaauacgucuuccaauguacagauggcagcaguuuuguggaagagguagagcgccaccucgaaugcggcugucuggcuugcuccuga

SEQ ID NO: 62870 - RNA, 2091 nt, Artificial Sequence
  derived and/or modified sequence opt3 from SLITRK1__Homo_sapiens__NP_001268432
augcugcucuggauccuucuguuggagaccagcuuaugcuucgccgcuggcaacgugacaggggacgucuguaaggagaaaauuugcuccuguaaugaaauagaaggagaucugcacguugacugcgagaagaaagguuuuacuucucuacagagauucacggcacccaccucacaauuuuaccaucucuuccugcacggcaacagucuuacaaggcuguuuccuaaugaguucgccaacuuuuauaaugcggugagcuugcauauggaaaacaaugggcuccacgagaucguaccaggagcuuuccugggccugcagcucgugaagcgguuacauauuaacaauaacaaaaucaaguccuuucgcaagcagacuuuccugggucuugaugacuuggaauaccugcaggccgauuuuaaucuacuccgagacauugauccgggggcauuccaagaccugaacaaacuugagguccugaucuugaaugauaaccucauaucuacccugcccgccaauguguuucaguauguuccuaucacacacuuagaccugcguggaaacagacucaagacccuuccauacgaagaggugcuggagcagauucccggcaucgcugaaauuuugcuagaggauaacccuugggacuguacuugcgaucugcucucgcugaaagaauggcuugagaauaucccaaagaacgcacugauaggcagggucgugugugaagcccccacacgguugcaggggaaagaccucaaugagaccacggagcaagaccugugcccuuuaaagaaccgcguagauucaagccugccagcuccgcccgcccaggaagagacuuucgcgccuggaccacuacccaccccuuucaagacaaauggucaggaagaccacgcaacuccaggcagugcccccaacgggggaaccaaaauuccgggcaauuggcagaucaagauuagaccuacagcugccaucgcaaccgguuccucuaggaacaaaccccucgcuaauagccugccauguccugggggaugcuccugugaucauauccccggcucaggccuuaagaugaacugcaauaaccggaauguuaguagcuuggccgaccugaaaccaaagcucucuaacgugcaagagcuguuucuucgcgauaauaaaauucacuccauacgaaagucacauuucgucgacuauaagaaccugaucuugcucgaucuggggaacaauaacauugcgacgguggaaaauaacacuuuuaaaaauuuacuggaccuaagauggcucuacauggauagcaacuaucuggacacacuuaguagggagaaguucgccggauugcagaaucuggaguaccucaacguggaauacaaugcaauccagcugauauuacccgguaccuuuaacgcuaugccuaaacugcggauucuuaucuugaauaacaaucuccugcguucucuaccagucgauguuuucgccggcgugucccugagcaagcucucgcugcacaacaauuauuuuauguaccuuccgguagcugggguguuggaccaacugacuucuaucauucagaucgacuuacacggaaaccccugggagugcuccuguacaauugucccuuucaaacagugggccgaacgccucggcucagaggugcugaugagugaucuuaagugcgaaaccccaguuaacuuuuucagaaaggacuuuaugcuguugagcaaugaugagauauguccccagcucuaugcaaggaucuccccuacgcugaccucucauagcaaaaacucaacaggucuagccgagacugggacccacaguaauuccuaccuggacacaagccgggugucuauuucaguccucgugccaggccugcuuuugguauucguuacuuccgcuuuuaccguggucggaaugcugguguucaucuuacgaaaccgcaagagaagcaaaaggcgggaugcgaauaguucugcaucggaaaucaacagccuccaaacagucugcgacuccucauauuggcauaauggccccuacaacgccgauggggcucaccgcguguaugacuguggaagucauucucugagcgauuga

SEQ ID NO: 62871 - RNA, 2538 nt, Artificial Sequence
  derived and/or modified sequence opt3 from SLITRK2__Homo_sapiens__NP_115928
augcugagcggcgugugguuccucuccguccuuaccguugccgggauccugcagacagagucuagaaagacugcuaaagacauuugcaagauaagguguuugugcgaagagaaagaaaacguguuaaauaucaacugugagaauaagggauuuacgaccguaucacugcuacaacccccucaguaccggauuuaucaacucuuccugaacgguaaucuucugacacgcuuguacccaaacgaauuugugaauuauaguaacgcagucacucuccaccugggcaauaacgggcugcaggagauccgaaccggagccuucagcggccucaaaacauuaaagcgucugcaucuuaauaacaauaaguuggagauucugagagaagauaccuuucuaggucucgagucccuggaauaccuucaggcggacuauaacuacaucucugcuauagaggccggggcauucucgaaacugaauaaguugaaagugcucauccugaacgauaacuuacugcucucacuuccgagcaauguuuuuagguucgugcuguugacucaccuagaccugcggggaaaccgccucaaggucaugcccuuugccggcgugcuggagcauauuggcgggaucauggaaauucagcuugaggaaaauccuuggaacugcacaugugaucuguugccacucaaggcuuggcuggacaccaucacgguauucguuggagagauagugugcgaaacucccuuuagauuacacgguaaagaugucacccagcugacaaggcaggaccuauguccucggaagagugcauccgauucuagccaacgcggcucccaugccgacacucacgugcagcgacucucaccaaccaugaaucccgcucugaacccuacaagagccccaaaagcgaguaggccgcccaagaugcggaaucguccuaccccacgcgugacggucagcaaagauagacagucuuucgggcccauuaugguuuaucagacuaaguccccugugccacuuacaugccccucaagcuguguaugcaccagucaaucuuccgacaacggauugaaugugaacugucaggagaggaaauuuacuaauaucagcgaucugcagccgaagccuacaucgcccaaaaagcucuaccugaccggcaacuaccuucaaacggucuauaagaaugaccuguuggaguacucuucccucgaccuguuacaccuggguaacaaucggauugcagugauccaggaaggggccuucaccaaccuaacaucacuccgacgccuguaucuuaacggaaauuacuuggagguucuguauccaaguauguucgauggccuccagagccugcaguacuuauaucuggaauacaacgugaucaaagagauuaagccucuuacuuuugacgcuuugauaaaucuccaacugcuauuccugaacaauaaccuccugagaucccuucccgauaauaucuuuggcgggaccgccuugacaaggcugaacuuacggaauaaccauuucucucaccucccagucaaaggagugcuggaccagcuucccgcauuuauucagaucgaucugcaggaaaauccuugggacugcacuugcgauauaauggguuugaaggacuggaccgagcaugcuaacagcccaguaauuaucaaugagguuacaugugaaucaccggccaaacacgcgggcgagauccucaaguuccuggggcgcgaagccauuugccccgauaguccuaaccuauccgacggaaccgugcugagcaugaaucacaacacugauacgccaagaucucucucagucagucccagcuccuacccugagcugcauacagaagugccacuuucugucuugauccugggcuuacucgugguuuuuauucugucgguguguuucggugcagggcuuuuuguauucguccugaagaggcguaaaggcgugcccagcguuccgcggaacaccaauaaccuagacguguccucauuucaacuccaguauggaaguuacaauacugagacccacgacaagacagauggccaugucuauaacuacauaccuccacccguggggcagaugugccagaauccuaucuauaugcaaaaagagggagaccccguagcuuacuaucgaaaccugcaggaguucucuuacagcaauuuggaagaaaagaaagaggagccagccaccccugcuuacacuauuuccgccacagaacuguuagagaagcaggcaacgcccagagaaccagagcuccuguaucagaacaucgccgaaagggugaaggagcuuccgucagcuggucugguucacuacaauuuuuguaccuugccuaaacgccaauucgcgcccagcuaugagucucggagacagaaccaggauaggaucaauaagacuguccucuacggcacaccacgcaaaugcuucguggggcaauccaagcccaaccauccucugcuacaggcaaaaccacagagugaacccgacuaucuggaggugcuugaaaagcagaccgccauuagccaacucuga

SEQ ID NO: 62872 - RNA, 2934 nt, Artificial Sequence
  derived and/or modified sequence opt3 from SLITRK3__Homo_sapiens__NP_055741
augaagcccagcaucgccgagaugcugcacagaggcaggaugcucuggauuauacuucuguccaccaucgcuuugggguggacaacuccuauuccauuaaucgaagacucugaggaaauugaugagccgugcuucgaccccuguuacugcgaagugaaagagucacuguuucacauccacugugauaguaagggauucacgaacauaagccagaucaccgaguuuuggucccggccuuucaaacuauaucuccaacgcaauucuaugcgaaagcuguacacaaacucguuucuucaucugaauaacgcagucucaauuaauuuggguaacaaugcccuccaggacauccagacuggcgcguucaacgggcugaaaauucugaagcgucucuauuuacacgaaaauaagcuggauguuuuuagaaacgacaccuuccuuggauuggagagccuggaauaccuacaggcugauuauaaugugaucaaaaggauagagaguggcgccuuucggaaccucuccaagcugcgcguacuuauucugaaugacaacuugaucccaaugcuccccacaaaucuguucaaagcagugucuuuaacccaucuggaucucagagguaacaggcuuaagguccuguuuuaccgggggauguuggaccacauuggacgcagccuaauggagcugcaacucgaagagaacccuuggaauugcacuugugaaaucgugcagcugaaauccuggcuugagcgaaucccauauacagcccugguuggcgauauuaccugcgaaacgcccuuccacuuucauggcaaggacuugagagagauaaggaagacugagcucuguccucuguuaucagauagugaaguggaggcuagccuggggaucccacacucuuccucaagcaaagaaaacgcauggccgaccaagcccaguucuaugcuauccagcguccauuucacagccucgucuguggaguacaaauccucaaauaagcagccuaaaccaacuaagcagccccggaccccucguccacccaguacaagccaagcucucuacccgggaccuaaccagcccccaauugccccuuaucagaccagacccccaauccccauaauuugcccuacggguuguacuugcaaucugcacaucaacgaccuuggcuugacaguaaauuguaaagaacgcggguucaacaauaucuccgagcugcucccaaggccgcugaacgcgaagaaguuguaccugucuagcaauuugauucagaaaaucuaucggucagacuuuuggaacuucaguucccucgaucuguuacaccugggaaauaaccgaauuagcuacguucaagacggcgcauuuauaaaucuacccaaccucaagucucuguuccuuaacgguaaugauaucgagaaauugaccccugggauguuucgcggacugcagucacuccauuaucuguacuucgaauuuaacgugauuagagagauccagccagccgcuuucaguuuaaugcccaaucugaaacuuuuguuucucaacaauaaccugcuaaggacucugccuacagacgccuucgcaggcaccagccucgcucggcugaaucuucgcaaaaacuauuuucuuuaccugccagucgccggcguguuagaacaccucaaugcgaucgugcaaauugaucugaacgagaaucccugggacugcacgugcgaucuugucccguucaagcaguggauagaaaccaucuccucuguuucggugguaggggacgugcuguguagaagcccugagaacuugacacauagggauguccguacuauugagcucgaagugcugugcccagagaugcuacacguugcccccgcaggagaauccccugcucagcccggugacucacaucugaucggcgccccaaccagugcuucuccuuacgaguuuagcccacccgggggaccggugccucucuccguccugauucuuucauugcugguguuauucuucagcgccguauuuguugcagccggccucuucgcuuaugugcugcggcgaagaaggaagaaacuucccuuucgcucuaagcggcaggagggugucgaucugacagggauccaaaugcagugucacagacuauucgaagacggcggaggcgggggagguggcuccgggggaggcgguaggccaacucucaguagccccgagaaagcgccuccaguggggcacgucuacgaauauauaccccauccugugacccagaugugcaauaacccgaucuacaagccacgcgaggaagaggagguugcagugucuuccgcccaggaagcuggcucagccgagcgaggaggccccgggacacaaccuccaggaaugggugaagcacuguugggcagugagcaguuugccgaaacccccaaagagaaucacagcaacuaucggacucuguuagagaaggaaaaggagugggcucucgccguaucguccucucagcugaacacgauugucacagugaaucaucaccacccucaucacccggcaguugggggagugagcggcgucgugggugggaccggcggagaccuugcgggcuuccgucaucacgaaaagaacgggggaguagugcuguuucccccaggcgguggguguggaucaggcaguauguugcucgauagagagaggccucagcccgcuccaugcacuguugguuucgucgacugucuguacggcaccgugccuaagcuaaaagaacugcaugugcaucccccagggaugcaauauccggaucuucagcaggacgcccgccucaaggagacacuguuguuuuccgcaggaaaaggcuucaccgaucaccagacucaaaagucugacuaccuggaguuacgggccaagcuccagacaaaaccugauuaccuggaaguccuugagaagacgaccuauagauuuuga

SEQ ID NO: 62873 - RNA, 2877 nt, Artificial Sequence
  derived and/or modified sequence opt3 from SLITRK5__Homo_sapiens__NP_056382
augcacacaugcugucccccugugacacuggagcaggaccuccauagaaagaugcacagcuggaugcuucaaacucuggccuucgcugucacguccuugguuuuaucuugcgcagaaaccaucgauuacuauggcgagauuugugacaacgccugcccaugugaagagaaagaugggauacugacagugucaugcgaaaauaggggaaucauuagucuaagcgagaucuccccgccccgguuuccuauuuaccaucuccugcuuucugguaaccuguugaaucgccucuauccaaacgaguucguaaauuacacuggcgcgucgauccugcaccuggggucaaacgugauacaggacaucgaaaccggagcuuuucauggccuccgagguuuacguagacugcaccuuaauaacaauaaguuggagcugcuaagggaugacacauuccucgggcuggaaaaccuugaguaucugcaggucgauuacaauuauauuagcgugaucgagcccaacgccuuuggaaaauugcaccuccugcagguuuuaauucugaaugacaaccuccuuaguucccugccuaauaacuuguuccgguuugugccacuaacccaucuggaucuccgcggcaacagacugaagcugcugcccuacgucggcuugcuccaacacauggacaaagugguagaacugcaguuagaggaaaauccuuggaacuguucuugcgagcugaucagccuaaaggauuggcucgacuccauaucauacagugcacugguuggggauguggucugugaaacuccauucaggcuucauggacgggacuuggacgaggugagcaagcaggagcugugcccgcgccgacucauuucugauuaugaaaugagaccccagacaccucuguccaccacggguuaccuucacacuaccccagccucagugaauagcgucgcuacaaguucuuccgcaguuuauaaacccccucugaagccacccaaaggcacuaggcaaccgaacaagccucgggugcgucccaccagccgccagccaucgaaagacuugggguacucuaauuauggaccuuccaucgccuaccagacaaagucacccguaccacucgagugucccaccgcuugcaguugcaaccugcagauuagcgauuuaggccugaaugugaacugucaagaaagaaagaucgaguccaucgccgaacuacagccuaaaccauauaauccgaagaaaauguaccucacggagaacuacauugcggucgugaggcggacugacuuucuggaggcaacaggucuugauuugcugcaccucgggaauaaccgaauaucuaugauccaggaccgcgccuucggagaucugaccaauuuaagaaggcuguaucuuaacggcaaucggauugaacgcuugagccccgagcucuuuuacggccugcaaucacuacaguaucuguuccuccaguacaaccugaucagagaaauacagagugggacuuuugacccuguuccaaaccuucaauugcuguucuuaaauaacaaucuccugcaggcuaugcccuccggaguguucagcggucuuacacuguugaggcucaaccugcguucuaaucauuuuaccucacuaccugucaguggcgugcuggaucagcucaagagccugauucagaucgaccuucacgauaacccaugggacugcacgugugacaucguagggaugaaauuguggguugagcaacugaaggugggagucuuaguggaugaagucauuugcaaagcccccaagaaguucgcagagaccgacaugcgguccaucaaaucugagcuccuguguccggauuauucggacgugguugugagcacaccuacuccauccucaauucagguacccgcucgaaccagugccgucaccccugcggugagacuuaauucuacuggcgcccccgcaagccugggugcugggggcggagccuccucaguuccacuaagcgugcucauacugucuuugcuguuagucuuuaucauguccguguucguagcugccggccucuuugugcugguuaugaagaggcgcaaaaagaaccagagugaucauaccagcacaaauaacucugacgucuccucauucaauaugcaguacaguguguaugggggagguggcgggaccggaggccacccucaugcacacgugcaccaucggggucccgcccuuccaaaagucaagacuccggcugggcacguuuacgaauacauuccucauccccugggccacaugugcaagaacccaaucuauagaagcagggagggaaauucgguggaagauuacaaagacuugcacgagcucaaggugacguauuccucuaaccaucaccuucaacagcagcagcaacccccuccacccccucagcagccgcaacagcagccacccccucagcuacaacugcagccaggcgaggaggaacgccgagaaagccaucaccuucggucacccgcguacaguguauccacaaucgagccucgugaagaucuccugucuccgguccaggacgcagauagauuuuauagggggauuuuggagcccgacaaacauuguagcaccacuccagccggaaauucccugccugaguaccccaaguucccaugcagcccugcugccuauaccuuuucacccaacuacgauuuacgccggccacaccaguaccuccacccgggugcaggcgacaguagacugagggaaccugugcuuuauucucccccauccgccguuuucguggagcccaaccgaaaugaauaccuggaguugaaagcuaagcucaacgucgaaccugacuaucuggaggugcuagagaagcaaacaaccuuuagccaguucuga

SEQ ID NO: 62874 - RNA, 2526 nt, Artificial Sequence
  derived and/or modified sequence opt3 from SLITRK6__Homo_sapiens__NP_115605
augaagcuguggauccaccucuucuacagcucccuucuggccugcauuucuuugcauucacagacccccguguuaaguagcagaggcuccugugacucucugugcaacugugaggaaaaagaugggacaaugcuaauaaauugcgaggcuaagggaaucaaaauggucucggaaauuucaguuccuccaagcaggccguuucaacucagucugcuuaacaauggucugacuauguugcacacgaacgacuucuccggccucaccaaugcaaucucuauucaucugggguuuaacaauaucgccgauauagagaucggagcguucaacggccugggucucuuaaagcagcugcacauuaaucauaacagccuugaaaucuugaaagaggacacauuucacgggcuggagaaucuagaguuccuccaggcugauaacaauuuuauuacugugaucgagcccuccgccuucucaaagcugaaccggcuuaagguacugauauugaaugacaacgcaauugaaagucucccuccaaacaucuuucgcuucgugccccugacccacuuagaucugcgaggaaaucagcuccaaacacuuccuuaugucggcuuucuggagcauauuggccguaucuuggaccuacagcuggaggauaacaaaugggccuguaauugcgaccuccugcagcuuaagaccuggcuggaaaacaugccaccccagagcaucauuggggaugugguuuguaauucuccuccauucuuuaaaggauccauauugucaagacucaagaaagagagcaucugcccgacucccccuguguacgaagaacacgaagacccaagugguucucugcauuuagcugcaacauccagcauuaacgauucgaggaugucuaccaagacgacuuccauccugaagcuacccaccaaagccccuggccucauaccauauauuacaaagcccucaacucaacugccggggccuuacugucccaucccaugcaauuguaaaguccuuaguccuagcggauugcugauccacugccaggagcggaacauugagucccucucugaccugagacccccaccccagaauccucgcaaacuuauccuggcuggcaacauuauacacagcuugaugaagucagaccucguggaauauuucacccuggagauguuacaucuggguaauaacaggaucgaaguacuagaggaagggaguuucaugaaucucacacggcugcagaaacuuuacuugaacggaaaucaccugaccaagcucuccaagggcauguuucugggcuuacauaaccuggaguaucuuuacuuggaguacaacgccauuaaggaaauccucccagggacguucaauccgaugcccaaacugaagguucuauaucugaacaauaaccuccugcaagugcuuccuccacacaucuuuagcggaguccccuugacuaaagugaaucugaagacaaaccaguucacccauuuaccugugucuaauauucucgaugaccuggaucuucugacucagauagacuuggaggauaacccaugggacugcucaugugaucucgucggucugcaacaguggauccagaaacuaaguaagaauacaguuaccgacgauauucugugcacgagccccggccaccucgacaagaaagaacugaaggcgcuuaacuccgagaucuuguguccggggcuggugaauaacccuucuaugccaacccagacaucguacuuaaugguaacuacccccgcaacaacuaccaauacagccgauaccauucuccgcagccugacugacgcugugccucuuuccguccugauccuaggacuccugauaauguuuaucacgauuguguucugcgccgcaggcaucguuguguugguccugcaccgaagaaggcgguauaaaaagaaacaaguggacgaacagaugcgugauaacucacccguacauuuacaguacaguauguauggucacaagacaacccaucacacuaccgagcgcccaucugcuagccucuacgagcagcacaugguuuccccuauggugcaugucuauagaucacccagcuuugggccaaagcaccuggaagaggaagaggagaggaaugaaaaagagggcucugacgccaagcaucuucaacggucccuguuggaacaggagaaccacaguccgcucacaggaagcaacaugaaauacaagaccacuaaucagucuacagaguuccuguccuuucaggaugcgucaagucuauaccgaaacauucuggaaaaagagcgcgaacuucaacagcucggcaucacggaguaucugagaaagaauauagcccaguugcagccugacauggaagcacauuaccccggggcucacgaggaacugaaguuaauggagacccucauguauagcaggccacggaaagugcuggucgagcaaacuaagaacgaauacuucgagcuuaaagccaaucugcacgcugaacccgauuauuuggaggugcucgaacagcagacauga

SEQ ID NO: 62875 - RNA, 3615 nt, Artificial Sequence
  derived and/or modified sequence opt3 from SLK__Homo_sapiens__NP_001291672
augagcuucuuuaacuucagaaagaucuuuaaacugggcuccgagaagaaaaagaaacaguacgaacacgugaagagggaccucaaucccgaggauuucugggaaauuauaggggagcuuggagacggugccuuuggcaaggucuauaaagcucaaaacaaggaaaccucuguucuggcagccgcgaaagugaucgauacaaagucagaggaggaauuggaggacuacaugguagaaauugauaucuuagcuaguugcgaccauccuaauauugugaaacugcuagaugccuucuauuacgagaacaaucucuggauccugauagaguuuugugcagggggagccgucgacgcugugaugcuugaacuggagcggccauugacugaaagccagauccagguugugugcaagcagacgcucgaugcacugaacuaucugcacgacaauaagauuauccaucgcgaucucaaagccggcaacauuuuauucacccuggacggugauaucaagcuggcugacuuuggggucuccgccaaaaauacacgaacuauacaacguagagacucuuucauuggaaccccguacuggauggcgcccgaggugguaaugugugaaacaucgaaggauaggccuuaugacuacaaagcagauguuuggucauugggcaucacccugauugagauggccgagaucgaaccaccccaccaugagcuaaacccuaugcgggugcuccugaagaucgcuaaaagcgaaccacccacucuugcccagccuagucgcugguccucuaauuuuaaggacuuccugaagaaaugcuuggagaagaacgucgaugcaagauggacaaccagccagcuccugcagcacccauuugugacgguggacuccaauaaaccgauuagggaauuaauagcugaggccaaggcggaggucacugaagagguugaagauggcaaagaggaagacgaggaggaagagaccgaaaacucacugcccaucccugccaguaagcgggcaagcucugaucucuccauugcuucaagcgaggaggacaaacuuagucaaaaugccuguauccuggaaucuguguccgagaagacagaacgcagcaacucggaggauaaguugaacucuaaaauacuaaaugaaaagccaacuaccgacgagcccgagaaagcuguagaagacauuaacgagcacaucacagaugcccagcuggaagcaaugaccgagcuccaugaccgaacggccgugaucaaggaaaaugagagagagaagaggccuaaacuggaaaaccuuccagauacugaggaccaggaaacagucgauauuaauuccgugucagaggggaaggaaaacaauaucaugauuacccuggagacuaacauagagcacaauuugaaaagugaagaggaaaaggaccaggagaaacaacagauguucgagaacaagcucaucaagagcgaagagauuaaagauacaauccugcagaccguugacuuagugucccaagaaacgggagagaaggaagcuaauauccaggcggucgauucugaggugggucugaccaaagaggacacacaggaaaagcuaggcgaggaugacaaaacucagaaggauguaauuagcaacaccucagacguuauagggacaugcgaagcagccgacguggcucaaaaagucgaugaggacagugccgaagauacucaguccaaugacggaaaggagguggucgaggugggccagaagcucaucaacaaacccaugguugguccggaagcagggggaaccaaggaggugccuauuaaagaaaucguagagaugaaugaaauugaggagggcaagaacaaagaacaggccaucaacagcucugagaauauaauggauaucaacgaagaacccggcacaaccgagggggaagagauuacugaaucaaguagcacggaggaaauggagguccgguccgugguugcugacacagaucaaaaggcccugggaucugaggugcaggacgcaucgaaggucaccacucagaucgauaaagaaaagaaagagauuccagugagcaucaagaaagaaccugagguaaccgugguuucccagcccacagaaccacaacccguccuuauaccuucaauuaauaucaacagugacucuggugagaauaaggaggaaauuggcagcuuguccaagaccgagacuauccugccaccggaaucagagaaccccaaagaaaaugauaacgacagcgggacaggaucuacggcggauaccuccaguauagaccucaaucugagcaucucuuccuuccuuucaaagacuaaagacaguggcagcauuucgcugcaggagacacgucgccagaagaaaaccuugaagaagacaagaaaauuuaucguggaugguguggaggucuccguuacuaccucuaagauugugacggacagcgauucaaaaaccgaggagcucagguuccugcggcgacaggaauuacgcgagcugagauuucuacaaaaggaggaacagagggcucagcaacagcucaacaguaaacugcagcagcaacgggagcagaucuuccgcagauuugaacaggagaugauguccaagaaaaggcaguacgaccaagaaauagagaaucuugagaagcagcagaagcagacaauugaacguuuggagcaagaacauacuaaccggcugcgagaugaggccaaaagaaucaagggggaacaggagaaagagcucucuaaguuccagaauaugcugaaaaacaggaagaaggaggaacaagaauuugugcagaaacagcagcaagaguuagacggcagccugaagaaaaucauucagcagcagaaggcagaacuugccaauaucgagcgcgaguguuugaacaacaaacaacagcucaugcgggcuagagaagccgcaauuugggagcuggaagagaggcaccuacaggagaagcaccagcugcucaagcaacagcugaaagaucaguauuucaugcagcgccaucaacuuuugaagcgacacgaaaaagagaccgaacagaugcagcgguacaaucaacgucugauagaggaauuaaagaacagacagacacaggagagggcucgccucccuaaaauccagcgguccgaggccaagacuagaauggcgauguuuaagaaaucacugaggauuaauagcaccgccacgccagaccaagaucgagacaagaucaaacaguucgcugcacaggaagagaagcgccagaaaaacgaacggauggcccaacaucagaagcacgagaaucagaugagagaucuucagcugcaaugcgaagcuaacguaagggaguugcaucagcuccagaaugagaagugucaccuucuagucgaacacgagacacaaaaacugaaggaacucgacgaggaacauagucaggagcugaaagaguggcgugaaaaacuucgcccccggaagaagaccuuggaggaagaguuugccagaaaacugcaggagcaggaaguguucuuuaagaugacuggagagucugaaugcuuaaacccuuccacacaaagcaggauuucgaaguucuauccaauccccucacuccacucuaccggcaguuga

SEQ ID NO: 62876 - RNA, 2487 nt, Artificial Sequence
  derived and/or modified sequence opt3 from SLMAP__Homo_sapiens__NP_001291349
augcccagcgcccuggcuaucuuuaccugcagaccuaacucccacccauuccaggagaggcauguguaccucgacgaaccgauuaagauaggccggucugucgcacgcugucgacccgcccaaaauaacgcgacauucgauugcaaaguucuuucacguaaucacgcucuggugugguuugaccauaagacugggaaauucuauuugcaggauacgaagaguagcaacggaaccuuuaucaauucccagagauuaucuagggguucggaggaaucaccuccaugugagauucugagcggcgacaucauucaguucgggguagaugugacagaaaacacucggaaagucacccacggaugcaucgugaguacaauaaagcuauuucuccccgacggcauggaggcccgccugagauccgauguuauccaugcaccucuuccaucucccguggacaaggucgccgcuaauaccccuagcauguacucccaagagcuguuccaguugucacaguaucuccaggaagcacugcacagggagcaaaugcuggaacagaaacucgccacuuuacagcggcugcuugcuauuacacaggaggccagugauaccagcuggcaagcguugaucgacgaggaucgccugcuaucucgacucgaagugauggguaaccagcugcaggcauguuccaagaaucaaacggaggacucacuuagaaaagaacugauugccuugcaggaggauaagcacaacuacgaaacuaccgcuaaagagagccucaggcggguacugcaggagaagaucgaaguugugcguaaguuaagugaggucgaacgcucucuguccaauacagaggacgaaugcacucaucucaaagagaugaacgagagaacccaggaagaacuuagggaacuggccaauaaguauaacggggcagugaaugagauaaaagacuugagcgauaagcuaaaaguggcugaaggaaagcaagaggagauucagcagaaaggccaggccgaaaagaaggagcugcaacacaaaaucgacgaaauggaggagaaggaacaggagcuccaggcgaaaauugaagcccugcaggcagauaacgacuuuacaaacgagcggcuuaccgcucugcaaguccgauuggaacaucuccaggagaagacgcugaaagaguguucgucuuuagaacaccuucuauccaagucaggcggggauugcacuuucauccaccaguuuaucgagugucagaagaaacucauuguugaaggacaucugacaaaggccguggaggaaaccaaacuuaguaaggagaaucaaacucgcgcuaaagagagcgacuucuccgauacauugucuccaagcaaggaaaagucaagugacgauaccacggacgcccagauggaugagcaggaccugaacgaaccgcucgcaaaaguaucccugcuuaaggacgaucugcaaggugcccagagcgagauagaagcuaaacaggagauccagcacuugagaaaggagcucauugaagcgcaagagcuggcaaggaccucuaaacagaagugcuuugaauuacaggcccugcuagaggaggaacggaaggcuuaccgcaaucagguggaggaaucaacaaaacaaauccagguccuccaggcccagcugcaaagacuucauauagacacugagaacuugagggaagagaaggauagugagauuaccagcacacgugacgaacugcucuccgcacgggaugagauccuguuacugcaccaggccgcugccaaaguggcaucugaacgagacacugauaucgcgucgcuucaggaggaauugaagaaaguuagagcugagcucgagagguggcgcaaggccgcaagcgaauaugagaaagaaauuaccucccugcaaaauucauuccagcuacggugucagcagugcgaggaccaacagagagaagaggccacaaggcugcagggcgagcucgaaaagcugcgcaaggaguggaacgcucuugaaaccgagugccauaguuugaaacgagagaaugugcuguuaucuagcgaacuccagcggcaagagaaggaacugcacaacucccagaaacagucacuugagcugacuagcgauuugucuauccuccagaugucccguaaggaacuggagaaucaagucgggagucuaaaagagcagcaccugagagacagcgccgaucucaagacgcugcuuucuaaggcagaaaaccaggcuaaagacgugcagaaggaguacgagaaaacacaaaccguauuguccgagcugaaguuaaaauucgaaaugacugagcaggagaagcagucaauuaccgaugaacucaagcaauguaaaaauaaccugaagcugcugagggagaaaggaaauaacaagcccuggccuuggaugccaaugcuagccgcgcucguugccgugacagcuauaguccuguacgugcccggcuuggcacgcgccaguccuuga

SEQ ID NO: 62877 - RNA, 585 nt, Artificial Sequence
  derived and/or modified sequence opt3 from SLMO2__Homo_sapiens__NP_057129
augaagaucuggaccagcgagcacguguucgaccaucccugggaaacagucacuacggccgcuaugcagaaauacccuaacccaaugaauccguccguugugggcguagaugugcuggacagacacauugaucccucugggaagcuccauucacacaggcuucugaguaccgaguggggauugccuagcauagucaaauccuuaaucggugcagcccggacaaagacuuaugugcaagaacauucuguuguggacccagucgagaaaaccauggaacugaagucgacaaacauuucauuuaccaauauggugagcguagaugagcgccuaaucuacaagccccacccucaggacccagagaaaacuguucucacacaggaagcgauuaucaccgugaagggcgucagucuguccucuuaucuugaggggcugauggcuagcacgauauccucaaacgccaguaaaggacgagaagcaauggagugggugauccacaaguugaaugccgagauugaggaacucacugcuagcgcacguggcaccaucagaacacccauggccgcugccgcguucgcagaaaaauga

SEQ ID NO: 62878 - RNA, 96 nt, Artificial Sequence
  derived and/or modified sequence opt3 from SLN__Homo_sapiens__NP_003054
augggcaucaacaccagagagcuguuccucaauuuuacaauugugcuuauaacugucauccugaugugguuguuaguuaggagcuaccaguauuga

SEQ ID NO: 62879 - RNA, 399 nt, Artificial Sequence
  derived and/or modified sequence opt3 from SLPI__Homo_sapiens__NP_003055
augaaaagcuccggccuguuccccuuucucgugcuucuggccuuggggaccuuagcuccuugggcagucgagggaucugguaaaucauucaaggccggcguuugcccaccgaaaaagagugcgcagugucugagauacaaaaagcccgaaugccaaagcgacuggcaguguccugggaagaaaaggugcuguccagauacaugcggaaucaagugucuagaccccguggauacuccuaacccaacgcggcgcaaacccggcaagugcccuguaaccuauggucagugucucaugcugaauccaccgaacuuuugcgagauggacgggcaguguaaacgagaucuuaagugcugcaugggaauguguggcaaguccugcgugucucccgucaaggcuuga

SEQ ID NO: 62880 - RNA, 3051 nt, Artificial Sequence
  derived and/or modified sequence opt3 from SLTM__Homo_sapiens__NP_001013865
auggccgcugcaaccggcgccguggcggcuagcgccgcauccgggcaggccgagggaaagaaaaucacagaccugagagucauugaucucaagucugaacuuaaaaggcggaaccuggacauaacugguguuaagacgguguugaucucacgcuuaaaacaagcuauugaggaagagggcggggaucccgacaauaucgaacugaccguaaguacagauacuccuaacaagaagccaaccaaaggaaagggcaaaaagcacgaggcagacgagcuaagcggugaugccuccguggaagacgaugcuuucauuaaagacugcgagcucgaaaaucaggaggcccaugagcaggaugggaacgacgaacugaaggauucugaggaauuuggagagaaugaagaggagaacguccacucgaaggaacuucugucagcggaggaaaauaaacgagcacaugaguugaucgaagccgagggcauagaggacaucgaaaaggaggacauugaaagccaggagaucgaagcucaagagggcgaggaugacacauuccucaccgcccaggauggggaagaggaagagaacgagaaagaaggaagucuggcagaggcugaccacacugcccaugaagagauggaagcgcacacaaccgugaaggaggccgaggaugacaauauuuccguuacgauccaggcagaagaugcuauaacucuggacuuugauggugacgaucucuuagagaccggcaaaaacgugaagauuacagacucugaagccagcaaaccgaaggacgggcaggaugcuaucgcccaaucccccgagaaggaaucaaaagacuacgagaugaaugcaaaccacaaggauggaaagaaggaggacugugucaaaggcgauccuguggaaaaggaggcccgugaaaguagcaagaaagcugagucuggugacaaggaaaaagauacucugaagaaagggccauccucaaccggagcgagcggccaggcaaagaguucuuccaaggagagcaaagacucgaagacaucuuccaaagaugacaagggcucaaccaguagcacguccgggucuagcggaucaaguacuaaaaauauuuggguauccggucuuagcucuaacacaaaggccgcugauuugaagaaucuguucggcaaauaugggaagguucuaucagccaaaguggucaccaacgcaagaagucccggagccaagugcuacggcaucgugacuaugagcuccucuacagaggugucgagguguaucgcucaucuccaccggaccgaacugcauggucagcuuauuagcgucgagaaaguuaagggggacccuuccaaaaaggaaaugaagaaagagaacgaugagaagucaaguucucgcagcuccggcgacaaaaagaauacgucagacagaagcucuaaaacccaggccuccgugaagaaggaagagaaaaggaguagcgaaaagucugagaaaaaggaauccaaagauacaaagaagauagagggaaaagacgagaagaacgauaauggcgcaucagggcaaaccagugaaagcaucaaaaagucggaggagaaaaagcggauuuccucuaagagcccaggacacaugguaauccuggaccagacuaaaggugaucacugccgccccucacgaagaggcagguaugaaaagauacaugggcggaguaaagaaaaggagcgugcguccuuggacaaaaagcgcgauaaagacuacagaaggaaggagauucucccuuuugaaaagaugaaagagcagcggcugcgagaacacuuagugcgcuucgagagacugaggcgggcuauggaacuccgcagaaggcgugagaucgccgagcgggaacgaagagagagggaacgcauccggauuaucagagagagggaggaacgcgagcgacuucaacgggaacgugagagacuggaaauugagaggcagaaguuggagcgcgaacggauggagagagaaaggcuagagcgagaacgcauacggaucgagcaggagagaaggaaagaagcagagcguauugcccgcgaacgggaggaacugagaaggcagcaacagcagcuccgauaugagcaggagaagcggaacucucugaaacgcccaagagaugucgaccauaggcgggaugacccguacuggagcgaaaauaagaaacuuucccuggauacagacgcucgauuuggacacggcucagacuauagcagacaacagaaccgcuucaaugauuuugaccauagggagcguggucgguuccccgaaaguucugccgugcaguccagcucguuugagagaagggaucgcuucguugggcagucagagggcaaaaaggcacgaccuacugcuagacgggaagacccaucuuuugagagguaccccaaaaacuucagugauucccgccguaaugaaccuccacccccgagaaacgaguugcgggaaagcgacaggcgcgaggugcgaggagagagagaugaacggaggaccgucaucauccacgaccgcccugauauuacacaccccagacauccaagggaggccggcccuaaucccucucggccaaccagcuggaaguccgaagggucaaugaguacugacaaacgugagacgcgcguggaacgacccgagagaagcggaagggagguaucuggucacuccguucggggcgcgccuccagggaaccgcucaagugccagcggauacggcuccagagaaggugauaggggagugauaacagaccggggcggaggcucucaacauuauccggaggaacgacacgucguggagagacacgggcgcgacaccucgggacccaggaaggaauggcauggcccuccaagccagggucccucauaccacgauacucggcguaugggggacgggagagcuggcgcagguaugaucacccagcauuccaguaaugccucuccuauuaacaggaucguccagauuagcggcaauuccaugccacgcgggucaggaucuggcuucaagcccuuuaaagggggaccgccucggcgauucuga

SEQ ID NO: 62881 - RNA, 1761 nt, Artificial Sequence
  derived and/or modified sequence opt3 from SLU7__Homo_sapiens__NP_006416
augagcgccaccguggucgacgcuguuaacgcagcgccccuguccggcucuaaggagaugucacucgaagaaccuaaaaagaugacaagagaagauuggaggaaaaagaaagagcuugaagaacagcggaagcuggggaaugccccagcugagguggacgaagagggaaaggauaucaacccgcacauuccccaauacauaaguagcguaccuugguauaucgacccauccaaacgccccacuuugaagcaucagcgaccucagccagaaaaacagaagcaauucucuucgucaggugagugguacaaacguggcgugaaggagaauagcauuaucacgaaguauagaaaaggggccugcgaaaacuguggagcaaugacccacaagaaaaaggauugcuuugagaggccccggcgcgucggcgccaaauucacagguacuaauauugcuccugacgaacaugugcagccacaguuaauguuugauuacgacgggaagagagauagguggaacggauauaauccggaggaacacaugaaaaucguugaggaguacgcaaagguggaccuggccaagcggacccuaaaagcucagaagcuccaagaggagcuggccaguggcaaacuugucgaacaggcgaacucccccaagcaucaguggggcgaggaggagccuaauucucagauggagaaagaucacaacagcgaagacgaggaugaagacaaguaugcagacgauauagacaugccagggcaaaauuucgauuccaagcgccgaaucacagugagaaaccugaggauucgggaggacaucgccaaauacuugcguaaucucgaucccaacucagcuuacuaugacccuaagacccgcgccaugagagaaaauccauacgcaaacgcugguaaaaaccccgaugagguaaguuaugccggagacaauuuuguuagguacacuggcgauacaauuagcauggcgcagacccagcuguucgccugggaggcauaugacaaggggucugaagugcaucugcaagcugauccgacgaaacucgaguuacuguacaaguccuuuaaggucaaaaaggaagacuucaaagagcagcagaaggagucaauccuugaaaaauauggaggccaggagcacuuggacgccccucccgcugaacugcuacucgcccaaacugaggauuacguggaauacagccggcacgguaccgugauaaaggggcaggagcgagcagucgccuguaguaaguaugaggaagacguuaaaauucauaaccacacacacaucuggggaucuuacuggaaggagggccgcuggggcuauaaaugcugucauuccuuuuucaaguacagcuauugcacuggggaagcuggaaaagagauuguaaauucggaagaguguaucaucaacgagauuaccggugaagagucugugaagaaaccacagacacugauggaacuucaccaggagaagcugaaggaagagaaaaagaaaaagaaaaagaagaaaaagaaacauagaaaguccucaagugauagcgacgaugaggagaaaaagcacgaaaaguugaaaaaggcgcucaaugcagaagaggccaggcuguuacaugugaaagagaccaugcaaauagacgaacggaagcgcccuuacaacuccauguaugagacgagagaacccacugaggaagagauggaggcuuacaggaugaaacgucagcggccagaugaccccauggccucuuuucugggccaguga

SEQ ID NO: 62882 - RNA, 312 nt, Artificial Sequence
  derived and/or modified sequence opt3 from SLURP1__Homo_sapiens__NP_065160
auggccagcagaugggcugugcagcugcuccuugucgcagccugguccaugggcugcggggaggcgcugaaguguuauaccugcaaagaacccaugacaucugcuucauguaggacuaucacgcggugcaagccugaggacaccgccuguaugacaacuuugguuaccguggaagcagaguacccauucaaccaaaguccgguagugacacgcagcugcuccucuucgugugucgccaccgaucccgacucaauuggagcugcacacuuaauauuuugcuguuuccgagaucugugcaauagcgaacuauga

SEQ ID NO: 62883 - RNA, 5505 nt, Artificial Sequence
  derived and/or modified sequence opt3 from SLX4__Homo_sapiens__NP_115820
augaagcugagcgugaacgaggcccaacucggcuucuaccuugggucccugucucacuugucagcuugccccgggaucgacccucgaaguagcgaagaucaaccagaguccuuaaaaaccggucagaugauggacgaaucugaugaggacuuuaaggaacugugugcaucguucuuucagagggucaaaaagcauggcauuaaagagguuucaggggagcggaagacacagaaggccgcgagcaauggaacucaaauacgcaguaaacuuaagcgaacgaaacagaccgcuacaaagacuaaaacccuccagggcccggccgaaaagaagcccccuuccgguucucaggcaccacguacuaaaaagcaaagagugaccaaauggcaggccagcgagcccgcucacuccguaaacggggaaggaggcgugcuggcaucagccccugauccacccguccuuagggagacugcucagaauacacagaccggcaaccaacaggagccuaguccaaaucugagccgggaaaagacgcgcgagaacgugccaaauucugacucccagcccccuccaucaugcuugacuaccgccguucccagcccuaguaaaccaagaacagcgcaacucgugcugcagaggaugcagcaguucaagcgggcagaucccgaacgccugcgacaugccucugaggaauguucccucgaggcugccagagaggaaaacgucccgaaagacccucaagaggaaaugauggcagggaauguguauggauuaggucccccagcuccugagagcgaugccgcgguagcccugacucuucagcaggaauuugcaaggguuggcgcuucggcccacgacgauucuuuggaggagaaggggcuguucuuuugccagaucugucaaaagaaccuauccgcuaugaaugugacccggcgugaacagcaugucaaccgcugccucgacgaggccgagaaaacacugagacccucagugccacagauucccgaguguccuaucugcggaaagccauuccuuacccugaaaaguaggacgagccacuugaagcagugugcagugaaaauggaagucggcccgcaacuccuguuacaggccguucggcugcagacugcucagcccgaggguuccucuagcccuccaauguuuucauucagugaucacucccgagggcucaagcgcagaggacccacaagcaagaaagagccuaggaagcggcgcaaaguggacgaagcgccaucugaggaccuucugguagcaauggccuugucaagaagugaaauggagcccggcgcugccgugccggcacuaaggcuggagagcgccuuuuccgaacguauucggccugaggcugaaaauaagucuaggaaaaagaagccacccgucucgccuccccuccugcuugugcaagauagcgagaccacuggcagacagaucgaagacagaguugcccuguugcucuccgaggagguggaacugucaaguacaccaccuuuacccgcaucucgcauacugaaagaggggugggaacgggcgggacagugcccaccgccucccgagagaaagcagagcuuccuaugggaagguuccgcucucaccggcgccugggcaauggaggauuuuuacacggccaggcuggucccaccccuugugccucagcgcccagcucagggguugaugcaggagcccguaccuccgcugguuccacccgaacauucagagcucagcgaacgacggucuccugcccugcacggaaccccaacagcaggcugugguucccgugggcccaguccuagcgcuucucaaagagagcaucaggcccuucaggaccugguggauuuggcgagggaaggccucuccgccucaccguggcccggaaguggcgggcuggcuggaagcgaggguacugcaggcuuagacgucgugccagggggacugccucuaaccggcuucgucgugcccucgcaggauaaacacccagaccgcggugggcggacacuccugucccuuggcuugcugguugccgauuucggagcuauggugaacaauccucaccucucugacguacaauuucagacugauagcggcgagguccuguaugcccauaaguucguguuauacgcaagaugcccccugcuuauccaguauguuaacaacgaaggguuuucagcgguggaggacggagucuugacccagagggugcuccugggugacguaaguacagaagccgcucgaaccuuccuacacuaccuguauacugccgauacgggccucccaccggggcuguccucugagcuuagcuccuuggcacaucgcuuuggagugucagagcugguucacuuaugcgaacaagucccuauugcuacagacagcgagggcaaacccugggaagagaaggaagccgagaauugugagagucgggcagaaaacuuccaggagcuccugagaucuaugugggccgaugaagaggaagaggcugagacccuucugaaguccaaagaccaugaagaggaucaggaaaaugugaacgaggcggaaauggaggagaucuacgaauuugccgcaacucaaaggaaguugcuccaggaggaacgugcugccggugccggggaggacgcugauuggcuggagggcggaagcccagugucgggccagcuacuggcagggguccagguucaaaaacagugggacaagguggaagagauggaaccccucgagccuggacgcgaugaagccgcgaccacaugggagaaaaugggccagugcgcucugccacccccucagggucaacacucaggggcccggggagcagaggccccggaacaggaggcuccagaagaggcacuuggccacucuaguuguuccagccccucuagagacugccaggccgaaaggaaggaggguagcuugccucauuccgaugacgcgggcgauuacgagcagcuguucucaaguacccaaggggaaauuagcgagcccucucagaucacuuccgaaccagaggaacagucaggagcugugcgagagcggggcuuagagguaagucaccgccucgccccuuggcaggcaagucccccgcauccuuguagauuucugcuugggccgccccaaggaggcuccccaagggguucucaccacacaucggggagcucacuguccacgccucggagucgaggaggcaccucucaggucgguagccccacucuacucuccccagccgugccuucaaaacagaagagagaccgcucuauacugacauugagcaaggaacccggccaucaaaaagggaaggagaggcguaguguucuggaaugccggaauaaaggaguguuaauguucccggagaaguccccaagcauugaccucacccagucuaacccugaucacucauccaguagaagccagaaaucgucuuccaagcugaaugaggaagacgaggucauccuucuguuggauagcgacgaagaacucgaacuggagcagacaaagaugaaaucaauuaguucugauccccuagaggaaaagaaagcucuggagaucuccccaaggagcugugaacuauuuucaaucauugacguggaugccgaccaagagcccagucagagcccuccgcgcuccgaagcaguucuccagcaggaggaugagggcgcucugcccgaaaaccgagggucuuugggaagacggggcgccccauggcuguucugcgacagggagagcuccccuucagaagcgucuacuaccgauacgaguugguuagugcccgccaccccucucgcaucgcgcagccgugacuguuccucucaaacacagauaucaagccugagauccggucuugcuguacaggccgucacucagcauaccccacgggcuaguguggggaauagggagggaaacgaaguggcacaaaaguuuucugucauccgcccccagacaccuccaccccagacuccgagcucaugccugaccccuguuuccccaggcacgagugauggucgaagacaaggccaccggagccccucuaggccucauccagggggacacccccacuccucaccguuggccccucaucccauuagcggcgaccgcgcccacuucucgagaagguuccucaaacauucuccaccugggcccaguuuucugaaucagacaccagcuggagaggugguagaggugggcgacuccgaugacgaacaggaggucgcgagccaccaggcaaaccggucacccccucuagauuccgacccaccgauccccauagaugacuguugcuggcauauggaaccucugucuccaauucccaucgaucacuggaaucuugagcguaccgguccucucagcacaagcuccccaagccgccgaaugaacgaggccgcugacucuagagauugcaggucacccgggcuguuggacacaaccccuauccggggaaguuguacuacccaacgcaaguuacaggaaaaguccagcggcgccggcucucugggaaauucgagaccgucauuccucaacagcgcacugugggaugugugggacggagaggaacagaggccacccgagacaccucccccagcccagaugccuuccgcugguggcgcgcaaaaacccgaagggcuugagacgccaaagggagccaaccggaaaaagaaucugccgccuaaaguucccauuaccccaaugccccaguauaguaucauggagacuccuguguugaagaaggaacuagaccgauuuggcgucagaccacugcccaaacgccagauggugcucaagcugaaagagauuuuccaguacacacaccaaacccuugauucugacagcgaagaugagucccagucaagucagccuuuacugcaggcaccgcauugccaaacacucgcuucucagacuuauaagccaagcagggccgguguucacgcacagcaagaagccaccacggggcccggagcucaucggccuaaaggcccagccaagacaaaaggcccccgucaccagagaaagcaccaugaguccauaaccccucccucaaggagcccaacuaaggaggcgccgccuggguugaacgacgaugcacagauccccgccucucaggaauccguggcuaccagugucgacggaagcgauucgucccugucuucacaaagcaguuccucuugugaguuuggugccgcuuucgaaagcgcaggcgaggaagagggggagggagaaguaucagccucccaggcugccgugcaggcagcggacacagaugaggcccuccgcugcuacauucggaguaaaccagcucuguaucagaagguucuucuguaccaaccuuuugaauugcgagagcuacaggccgagcugagacagaauggccucagggugagcucucgccgguuacuggacuuccuugauacucacuguaucaccuuuacaacggcagcuaccagacgugaaaaacugcaggguaggcggcgccaaccccgagggaagaaaaaggucgagagaaacuga

SEQ ID NO: 62884 - RNA, 1227 nt, Artificial Sequence
  derived and/or modified sequence opt3 from SLX4IP__Homo_sapiens__NP_001009608
auggccagcaagaaauucgcugugaagugcggcaacuuugcaguccugguugaccuccacauccuuccccagggguccaauaaagauaccucuugguucucagagcagaagaaagaagaggugugucuguuguuaaaggaaacaauugacaguagaguacaggaguaccuggaagugaggaagcagcaucggccuagcaacgccgaguuuacucgcuccaauccacuaucucucaaaggauaugguuuccagauaacggcguacuuucugaagcgaggcauccgucuuagaugcauuaggucgacccaaaacgcugagcugugugucuucccggaucgguuugugguuugcgugucacaguuggccuucagccgcgaccuccuggcaagucagaaugaagaucugacagagagaguccuccacgggguguccgacuauuuugccgaaugugcugagucuagcuuacccccuuccgcaaaacugaggcggaacgcccuuaaggagaucguaaaacgcacugaaaccaagucaaguguuacaagcaagucucagacccgaagagauacuguggagacauccucagacagcgucauugcugaaaucgccaggcggcguaaugauggacaagcgaguucuuccccacccagcgagucgaugggccaggcaaaagacucuauaaaggccgcugaaucccauugggguuugccugugcagaaacuggagaaggugaaccagacccaaccagaggauacgucagggcagcagaaaccccacccuggagaacgccuaaagacuggccuccugaguagaagcccagucugcuccugugagucugccagcccgugccccaaacaaucaccuaggguugcaaagacccagcagaagcggcgaaauuguaguuccgcugaagacuucgaucaucacggccgcgugagccuugggucugacagacugguaccaagggagaucauuguggaaaaaucaaaggccguccggguguugcccgcgagugagcucagcgacccuggacuguuacugaaacaggaucucgccaagacaacuuccaaagaggaacuucacguucuggagucuuugucgagccgccaucuaaugaagaacaauccaggucaagcacagcagaccggccuggcuacaaacaccgaaagacucuccacgauccaaaauucacccacuaagaaaaggaagaaauacgagcgugggcacuga

SEQ ID NO: 62885 - RNA, 1398 nt, Artificial Sequence
  derived and/or modified sequence opt3 from SMAD1__Homo_sapiens__NP_005891
augaacgugaccagccuguucuccuuuacaucucccgccgucaagagacuccuuggcuggaaacagggggacgaggaagagaagugggcugaaaaagcaguugaugcccuggugaagaaauugaagaagaaaaagggagcgauggaggaauuagagaaagcucugucaugcccuggucaaccaaguaauuguguaacuaucccgaggagccuagacggccggcuccaggugucccaccgcaaggggcugccccaugucauuuacugccgaguguggcguuggccugaucuucagucucaccaugagcugaaaccauuggaauguugcgaguuccccuuuggaucgaagcagaaggaaguuuguauaaacccuuaucacuacaaaagaguggagucaccaguccugcccccugugcucguaccaaggcauagcgaguauaauccgcaacacagucugcucgcccaguuccggaacuuaggccagaaugaaccccacaugccucugaacgcaacguuuccagacuccuuccagcaacccaauucucauccuuuuccacacagccccaacuccucauacccgaauaguccugguuccucuuccucaaccuauccccauagcccaacaaguucugauccugggucccccuuccagaugccagccgacacucccccuccagcuuaccuuccgcccgaggauccuaugacccaggacggaagccagccaauggauacaaacaugauggcacccccuuugccaucggaaaucaaucgcggcgacguucaagccguggcuuaugaggaacccaagcacuggugcucuauugucuacuacgagcugaacaauagagugggcgaggccuuucacgcguccucaaccagugugcuagucgauggguucacugacccgagcaacaauaaaaacagguuuugucucggacugcuuuccaacguuaaucggaacucuacaaucgaaaauacccgccgacauauugguaagggcgugcaccuguauuacguagggggagagguguaugcagaaugcuugagcgauucaaguaucuucguccaguccagaaacuguaauuaccaucacggcuuucauccuacgacugugugcaaaauaccaagcgguuguucucucaagaucuucaacaaucaggaguucgcccaacuguuagcucagucaguuaaccacggguuugaaaccguguaugagcugacaaaaaugugcacuauuaggaugaguuucgucaagggauggggcgccgaguaccaccggcaggacgugaccagcacacccugcuggaucgaaauucaucuccacggcccucuucaguggcuggacaagguauugacccaaauggggagcccccauaauccaaucucuucgguuagcuga

SEQ ID NO: 62886 - RNA, 1404 nt, Artificial Sequence
  derived and/or modified sequence opt3 from SMAD2__Homo_sapiens__XP_006722514
augagcuccauccugcccuucaccccuccaguggucaagagacuccuuggcuggaaaaagucugccgggggaucagguggcgcugggggaggcgagcagaacggucaagaagagaaauggugcgaaaaggcaguuaaaagucuggugaagaaguugaaaaagacagggagguuagacgagcuggaaaaagccauuacuacgcagaauuguaacaccaagugcguaacaauaccgagcacuuguuccgagaucuggggacuaucuacccccaauacaauugaucagugggacaccacuggccucuacucguuuucagagcagacacggagccuggauggccgccuucaagugagucaccgaaaagggcugccucaugucaucuauugccguuuguggagauggccagaccuccacucccaucacgaacugaaggcgauugagaacugugaauacgcuuucaaucugaagaaagaugaggugugcguuaaccccuaucauuaccagaggguggagaccccuguccucccacccguguuaguaccucggcacacggaaauccugacugagcuuccaccguuggacgauuauacccacucuauacccgaaaauacaaacuuuccugccggaaucgagccacagagcaauuacauucccgaaacuccuccacccgguuauaucuccgaggacggcgagaccucagaucagcaacugaaccagaguauggacacagggagcccggcagaacuaucuccuaccacgcucucccccguuaaucauucacuggaucuucagccagugacuuacagcgagccugccuucugguguaguauugcuuacuaugaacugaaccagcgcgucggagagacauuucacgcaucucaacccuccuugaccguggacggcuucacugauccaagcaauucggaaagauuuugccucggucuguuaucuaacgugaauaggaacgccacagucgagaugacccggcgccauaucgggcgaggaguuagacuguacuauauaggcggcgagguguucgcugaaugucucuccgacucagccauuuuuguacagagucccaacugcaaucagagguacggguggcacccugcgacgguguguaagaucccaccgggaugcaaccuuaaaauuuucaauaaccaagaguuugcagcccuguuggcucagagcgucaaucaggguuucgaagccguguaucagcuaacccggaugugcacaauccguauguccuuuguuaagggcuggggagcagaguaccgcagacaaacugugaccucuacacccuguuggaucgaacugcaccucaacgggccucugcaguggcuugacaaaguccugacucagaugggcagcccaucagugaggugcaguuccaugagcuga

SEQ ID NO: 62887 - RNA, 963 nt, Artificial Sequence
  derived and/or modified sequence opt3 from SMAD3__Homo_sapiens__NP_001138574
auggagcugugcgaguucgccuuuaacaugaagaaagacgaagugugugucaaucccuaccacuaucagagaguugaaaccccugugcucccaccgguacuugugcccaggcauacagagaucccugcugaguucccaccccuggaugacuacagccacuccauuccugaaaacacuaauuuuccagcaggcauagagccccaaucuaacaucccugaaacgccaccgcccggguauuugucagaggauggagaaaccagugaccaucagaugaaucacagcauggaugccgguuccccuaacuuaucuccaaaucccaugucgccugcgcauaacaaucuggaccuacagccagucacauacugcgagcccgcuuucugguguucaauuagcuauuacgagcucaaccagcgggugggcgaaacuuuucacgccagucaaccguccaugaccguugauggguucacagacccuucuaauagcgagcgcuuuugccugggacuucuguccaacgugaaucgaaacgcagccgucgaauugacccguagacacaucggcaggggugugcggcucuauuacauugggggagagguauucgcugaaugucugucagauagugcaaucuuuguucagagccccaauugcaaccagcgcuacggcuggcauccagccacuguguguaagauaccucccggcugcaaccugaaaaucuucaauaaccaggaguuugcugcccucuuagcgcaaucugucaaucagggguucgaggcaguguaucagcugacaagaauguguaccauuaggauguccuuugugaagggauggggugccgaauaccggcgccagacggucacuucaaccccaugcuggaucgagcuucacuugaacggcccccugcaauggcuagacaaaguucucacacagauggggagcccuaguauucgauguucuuccgugagcuga

SEQ ID NO: 62888 - RNA, 1659 nt, Artificial Sequence
  derived and/or modified sequence opt3 from SMAD4__Homo_sapiens__NP_005350
auggacaacaugagcaucaccaauacacccacuuccaacgaugccugccugucuauugugcacucacucaugugucauagacagggcggggagagugaaacguucgcuaagagggcaauagagagccuugucaaaaagcugaaagaaaagaaagacgaguuggauuccuuaaucaccgccauuacaacuaauggagcgcacccuucuaagugcguuaccauccaacggacacuggacggucgccuacagguggcuggccgaaagggguuuccacauguaauuuacgcccgucucuggagauggccggaucugcacaaaaacgaacuuaagcaugugaaauauugucaguacgcauucgaccugaagugcgauucggucugugugaaucccuaucacuacgagaggguugugucaccuggaaucgacuugagcggccucacccugcagaguaacgccccauccucuaugauggucaaagaugaguaugugcacgacuuugaaggucaacccagccuguccacugaggggcauucaauacagacaauccagcacccuccaaguaaucgggcuagcaccgaaacguacucuacucccgcacucuuagccccuuccgagucaaacgcuaccagcacagccaauuucccaaacauuccgguagcgaguacuucucagcccgcauccauccugggaggcagccauucggagggccuuuugcaaauugccucugggccucagccaggacagcagcaaaaugguuuuaccggccagcccgcuacauaucaccacaacuccaccacgacuuggacagggucacgcaccgccccuuacacuccaaaucugccccaucaccagaacggacaucuacaacaccauccgccuaugcccccacacccuggccacuacuggcccguucauaaugaacucgcauuccagccacccaucaguaaccacccugcuccagaguauuggugcagcauagccuacuuugaaauggaugugcaggucggugagacauucaaggugccguccucuugucccauugugaccgucgacggguauguugauccuagcggaggcgacagauuuugccugggccagcuuucaaacgugcauaggacggaagcgaucgagcgggcccgccugcacauugggaagggaguacaauuggaguguaaaggugaaggcgacguguggguccgaugccucagugaucacgcaguguucguucaguccuacuaucuggacagagaggcugggagggccccaggagaugcugugcauaagaucuaccccagcgccuauaucaaagucuuugacuuacggcagugucaccgucagaugcaacagcaggcagccaccgcucaggcggcagccgcugcccaagcagccgcuguggccggcaauauuccugguccagggucuguaggcggaauagcacccgcgaucucacugagugcugccgcaggcauugggguugaugaccuccgcagacuuugcauccugaggaugagcuucgugaagggaugggguccggauuacccucggcaguccauaaaagaaacaccaugcuggauugagauccauuugcaccgagcccuacagcugcucgacgaaguccugcauacuaugcccaucgcugauccucagccccuugacuga

SEQ ID NO: 62889 - RNA, 1398 nt, Artificial Sequence
  derived and/or modified sequence opt3 from SMAD5__Homo_sapiens__NP_001001420
augaccagcauggccucccuguucucuuuuacaucacccgcugugaagagacuccuuggcuggaaacagggggacgaggaagagaagugggcagaaaaagccgucgaugcgcugguuaagaaauugaagaagaaaaagggagcuauggaggaauuagagaaagcccugaguagcccuggucaaccauccaagugcgugacuaucccgaggucucuagacggccggcuccagguaucgcaccgcaaagggcugccccaugugauuuacugucgagucuggcguuggccugaucuucagucacaccaugagcugaagccauuggacauaugcgaguuccccuuuggaagcaagcagaaagagguguguaucaacccuuaucacuacaagagaguugaaaguccagugcugcccccuguccuggugccaaggcauaaugaguucaacccgcaacacucccugcucguacaguuucggaauuuaucucacaacgagccccauaugccucagaaugcaacguucccagauagcuuucaccagcccaacaauaccccuuucccacugucccccaacucaccguauccucccaguccagccagcucuacauacccuaauucccccgcuucaagcggcccagguagucccuuucaacuuccugcagacacuccaccgcccgccuauaugccuccagaugaccagauggggcaggauaacucucagcccauggacaccuccaauaacaugauuccucaaaucaugccaagcauuucgucucgcgauguucagcccguggcuuacgaagaaccgaaacauuggugcuccaucgucuauuacgaauugaauaacagagugggagaggccuuccacgcgucaaguacaagcgugcuggucgacggcuuuaccgauccuuccaauaacaagucuagguucugucuaggccuccugagcaacguuaaucggaacucaacuauagaaaauacacgccgacacaucgggaaaggagugcaucuuuacuauguagguggcgagguguacgcagagugccugagugacuccagcauuuuuguccagucuagaaacuguaauuuccaccauggguuccacccaaccacggugugcaagauccccucaaguuguagcuugaaaauuuuuaacaaucaagaguucgcccagcuccuggcucaguccguuaaccauggauuugaagccguguaugaauuaacuaagaugugcaccaucaggaugucuuucgucaagggcuggggugcagaguaccaccggcaggacgugacaucgacuccuuguuggauagaaauucaccuccaugggccccuccaauggcuugauaaaguacugacccagaugggaagcccauugaauccuaucuccucaguuaguuga

SEQ ID NO: 62890 - RNA, 1491 nt, Artificial Sequence
  derived and/or modified sequence opt3 from SMAD6__Homo_sapiens__NP_005576
auguucagaagcaagagguccggccuggugcggcgccucuggcgaucucgugucguucccgacagagaggaagggggaucagguggcgggggaggcggugaugaggacgggagucuuggaagcagggccgaaccugcuccacgggcacgcgagggcggcgggugcggaagauccgaagugaggccgguagcgccccggcgcccucgagaugccgugggucagagaggcgcucaaggggccggaaggcggcgucgcgcaggcgguccacccagaccuaugucugagccaggggccggagcuggcucgucacuguuggacgucgcagagcccggcgggccuggaugguuaccagaaagcgauugugagaccgugacaugcugucuguuuagugaaagggacgccgcuggugccccgcgggaugcguccgacccccuagcaggcgccgcucucgagccugccgggggaggccgaucucgcgaggcaagaagcaggcugcuucuguuggaacaggagcucaaaacuguuacguacucccugcugaagcggcucaaagaacgcucauuagauacccugcuugaggcuguggaaaguagagguggggucccaggcggaugcguguugguacccagggccgaccugcgucuaggcgggcagccugcgccaccccagcuccugcuuggacggcuguuccgauggccggauuugcaacacgccguugagcucaagccucugugugguugccauagcuuugcagcugccgcugacggccccacaguguguugcaacccauaucacuucucuagauuaugugggccugagucacccccacccccuuacuccaggcugagcccacgcgaugaauauaaaccgcucgaccuuagugacucuacucuguccuacaccgagacagaagccaccaauagcuugaucacugcacccggagaguuuucggaugccucuauguccccugacgcuacaaagccaucacauuggugcagugucgcguauugggaacaccggaccagagugggcaggcuauacgcaguguaugaucaggccgucagcauuuucuacgaccugccccaggguuccggguuuugucucggccagcugaaccuugagcaacgcucugagagcguucgacggacgcguucaaagauaggauucggcauccuguugaguaaagaaccugauggggugugggcuuacaauagaggagagcauccaauuuuuguaaacucccccacucucgacgccccggguggcagggcacuggugguccgcaaggugccuccaggguauagcaucaaaguuuucgauuuugaacggucuggauuacagcacgcccccgagccugacgcugccgauggccccuacgacccaaauucagugagaauuaguuucgcaaaggguugggggccuugcuauagcaggcaguuuaucaccuccugccccuguuggcuggaaauacuacucaacaauccacgauga

SEQ ID NO: 62891 - RNA, 636 nt, Artificial Sequence
  derived and/or modified sequence opt3 from SMAD7__Homo_sapiens__NP_001177751
auggacuuccugaagcccaccgccgauugcccugacgcugugccaagcuccgcagagacaggcgggacuaacuaccucgccccgggaggucuuucugauucacagcuguuguuagaacccggcgacagaagucacuggugugucguugcguauugggaggagaaaacgaggguggggcggcuguacugcguacaagaaccuagccuagauaucuuuuaugaccucccacagggaaauggcuucugucugggucagcuuaacuccgauaauaagucucagcuggugcaaaaaguccgcucgaagauugggugcggaauacaguugacccgagaaguggacggcguuuggguguacaaccguucaagcuaucccaucuuuauuaaaagugcuacacucgauaauccugacuccagaacucugcugguccauaagguguucccaggcuuuucuaucaaggccuucgauuacgagaaagcauauagccuccagaggcccaacgaccacgaguuuaugcagcaaccuuggaccggguucacaguacagauuuccuuuguuaagggauggggucaguguuacacccggcaguucaucucaaguugcccauguugguuagaagugauauuuaauagccgcuga

SEQ ID NO: 62892 - RNA, 1404 nt, Artificial Sequence
  derived and/or modified sequence opt3 from SMAD9__Homo_sapiens__NP_001120689
augcacagcaccacacccaucuccucucuguucucauuuacuuccccugccgugaagagacuccuuggcuggaaacagggggacgaggaagagaagugggcugaaaaagcagucgauagccugguuaagaaauugaagaagaaaaagggagccauggacgaguuagaaagggcgcuguccugcccaggucaaccgucuaaaugugugacgauuccccggucgcuagauggccgccuccagguaucacaucgaaaggggcugccucacgugauauacugccgugucuggagauggccagaccuucagagccaucacgagcugaaacccuuggaguguugcgaguucccuuuuggaaguaagcagaaggagguguguaucaacccauaucauuacaggcggguugaaacccccgugcucccuccaguccuggugccgcgccacuccgaguauaauccccaacugucucucuuagcuaaauucagaagcgccucccugcacucagagccucuuaugccacauaacgcaacauaccccgauaguuuucagcagccuccaugcagcgccuugcccccgucuccuucccacgcuuucucacagagccccuguacugcaaguuauccacauucuccuggcucccccagcgaaccagagucgcccuaccaacacucuguagacaccccuccacugccguaucacgccacagaagcuagugagacccagucaggucagcccguugaugccacugcggacaggcaugugguccuaaguauuccuaauggggauuuucggccagugugcuacgaagaaccccagcacugguguagcguggcauacuaugagcucaacaaucgcgucggagaaacauuccaagccuccucucgaagcguucugaucgacggcuuuaccgauccuucaaacaauagaaacagguucugccuuggccuguugaguaaugugaaccguaauuccacgauugagaacacucggcgccauaucgggaagggaguacaccucuacuauguggguggcgaagucuacgcugagugugugagcgacucuucaauauuuguucagaguagaaauugcaacuaucagcauggguuccacccagccaccgugugcaaaauccccagcggauguucccugaaggucuuuaauaaccaauuauucgcacagcugcucgcucagucugugcaccauggcuucgaaguaguuuacgagcuuacaaaaaugugcacuauuaggaugucguuugugaaggguuggggagccgaguaucaccggcaggaugucaccagcacaccguguuggaucgaaauucaucugcacgggccuuugcaauggcuagacaaagugcugacccagaugggcuccccacacaaccccaucucaagugucucuuga

SEQ ID NO: 62893 - RNA, 294 nt, Artificial Sequence
  derived and/or modified sequence opt3 from SMAGP__Homo_sapiens__NP_001029045
augaccagccugcucacaacucccuccccuagagaggaacuuaugacgaccccaauccugcagccgacagaggccuugucucccgaagacggcgcuucaacugcauuaauugccguggucauaaccguuguguuccugacacuacucaguguagugauccugaucuuuuucuaccuuuauaagaacaaagggagcuacgucaccuaugagccuacugaaggagagccauccgcgauugugcaaauggagucugaucuggcuaaggguucggaaaaagaggaauacuuuauuuga

SEQ ID NO: 62894 - RNA, 1404 nt, Artificial Sequence
  derived and/or modified sequence opt3 from SMAP1__Homo_sapiens__NP_001037770
auggccaccagaagcugcagggagaaggcucagaaacugaacgaacaacaccagcucauccuuuccaagcuguugcgggaggaagacaauaaauacugugcagauugcgaggccaagggcccccgcugggcgucuuggaacauugggguguucauauguauccgaugcgcugggauucaucguaauuuagguguccacaucucaagaguuaaaagugugaaccuggaccaguggacagccgaacagauucaauguaugcaggauaugggcaauacuaaggcaaggcuacucuaugaggccaaccugccugagaauuuucggcgcccacagacggaccaggcuguagaauuuuucaucagagauaaguacgagaaaaagaaauauuacgacaagaacgcaauagccaucaccaauauuagcuccucugaugcuccgcuucaaccccuggugucgucaccuagcuugcaggccgcggucgacaaaaacaagcucgaaaaggagaaagagaagaaaaaggaagagaaaaagagggaaaaagagccagaaaagcccgcaaagccucugacagccgagaaacugcagaagaaagaucagcaacucgagccaaagaaaaguacuucccccaagaaggcugccgaaccuaccguggacuuacuggggcuugauggaccagcaguugcuccggugacaaauggcaacaccacugugcccccuuugaaugacgaucuggacaucuucgguccaaugauuucuaacccccuaccugccacagucaugccacccgcgcaggggaccccgagcgccccugcagcugccacgcucuccacuguaaccucaggagaccuggaucuuuuuacagagcagacuaccaaaagugaagagguugcuaagaaacaacugagcaaggacucuaucuugucccucuauggcacaggcaccauacagcagcagucaacgcccgggguguucaugggaccaacuaauauuccuuuuacaagccaagcccccgcagccuuccaggguuuuccaaguaugggcguccccgugccugcugcgccagggcugaucggaaacgugaugggccagucuccguccaugauggucgguaugcccaugccuaacggguucaugggaaaugcacagaccggcguuaugccauuaccccaaaacgugguaggcccucagggaggaauggugggucagaugggcgccccacagagcaaauuugggcugccccaagcucagcagccgcaguggucgcucucucaaaugaaucagcagauggccggaauguccauuucaagugcaacuccuacagccggcuucggucaaccaagcuccaccacggcuggguggucuggcagcucaaguggacagacccuuuccacacagcuguggaaguga

SEQ ID NO: 62895 - RNA, 3213 nt, Artificial Sequence
  derived and/or modified sequence opt3 from SMARCA1__Homo_sapiens__NP_001269803
auggagcaggacaccgccgcuguggcagccacagucgcggcugccgaugcaacugccacgaucguugugauugaagacgagcaacccggcccuagcaccucccaggaagagggggcugcagccgcugccacagaagcgacugcagccaccgagaagggagagaaaaagaaagaaaagaacguaucuucauuccagcugaaacucgcugccaaggcaccaaagagugagaaagaaauggauccggaguacgaggaaaagaugaaagcugacagagccaagagguuugaguuccuucugaaacagacagaauuguuugcgcacuucauacaacccagcgcccagaaguccccuaccucuccauuaaauaugaagcugggucggccccgcaucaaaaaggaugagaaacagucgcuaauuucagcaggcgacuaucgacaucguagaacugaacaggaggaggaugaagaacuccugagcgaaaguaggaagacauccaacgugugcauccgguuugaggucucuccuagcuacgugaaagggggaccacuucgcgacuaucaaauuagaggccugaauugguugaucucccucuacgaaaacgguguuaaugggauacuggcugaugagaugggacugggcaagacccuccagacgaucgccuuacugggcuaucuuaaacacuacaggaacauucccgggccucauaugguguuggucccaaagucaacucugcacaauuggaugaacgaguucaagcggugggugccgagucuacgcguaaucuguuuuguuggagacaaagaugcucgagccgcauucauuagagacgaaaugaugcccggugagugggaugugugcgucaccagcuaugaaauggugaucaaggagaaaucuguguuuaagaaauuccauuggagguaccucgucauagacgaagcccaccggauuaagaaugagaaguccaaacugucagagaucguucgugaauuuaagagcacaaaccgccuucuguugacuggcaccccucuccagaauaaccugcacgaguuaugggcucugcucaauuuccuucugccagacguguuuaacagugcggaugacuucgauucuugguucgacacaaagaauuguuugggggaucagaagcuaguagaaagacugcaugcagugcucaaacccuuucugcuuaggcggauuaagaccgacgucgagaagucccugccucccaaaaaggagaucaaaaucuacuugggacucagcaagaugcaacgagaaugguauacgaaaauucugaugaaggauauagacguguuaaacucgucuggcaagauggauaaaaugcgccugcuaaacauccucaugcagcugagaaagugcuguaaucaccccuaccuuuucgacggugccgagccggggccucccuauacuacagaugaacauauuguuuccaacucaggaaaaaugguggucuuggacaagcugcucgcuaaacugaaggagcagggcaguagggugcuuaucuuuagccaaaugacccggcuguuggacauacucgaagauuacugcauguggcgcggcuaugaguacuguagacuggacgggcagacuccacacgaggaaagggaggauaaauucuuagaaguagaguuucugggacagcgugaagccauugaggcauucaaugccccuaacuccucuaaguuuaucuucaugcuaagcacacgggcugguggccucgggaucaaucuggccucagcagacguugugauucuuuaugauagugacuggaacccccaggucgauuugcaagcgauggaccgagcucacagaaucggacagaagaaaccagugagggucuuucgccugauuaccgauaauacgguggaggaacggauaguugagagagccgaaaucaagcucaggcuggacuccauugugauccagcagggccgcuuaaucgaucaacagagcaacaaacuggcaaaggaggaaaugcuucagaugauucgacauggugccacccacguauucgcuucuaaagagucagaguugacagacgaagauauaacuaccauccucgagcguggggaaaagaagacagccgagaugaaugagcggcugcagaaaaugggcgaaaguagccuaagaaacuuuaggauggacauugagcaaucccuguacaaguucgaaggagaggacuaccgcgaaaaacagaagcucggcauggucgaguggaucgagcccccuaaacgggaaagaaaggcaaauuaugcuguggaugccuacuuuagggaggcgcugcgaguuucugaaccaaagauuccgaaagccccacgcccuccaaagcagcccaacgugcaggacuuccaauucuuuccuccacggcuuuucgaguugcuggaaaaagagaucuuauauuacagaaagacuauaggguauaaaguccccaggaauccggauaucccuaacccagcucucgcacagcgugaggaacagaagaagauugacggagccgagccccugaccccugaagagacagaagagaaagagaaacuucugacccaagguuuuacuaauuggacgaaacgcgauuucaaccaguuuaucaaggcuaacgaaaaauacggccgggacgauauugacaauaucgccagagagguggaagggaagucgcccgaggagguaauggaauauagcgcaguguucugggagaggugcaacgaauugcaggauauagagaaaauuauggcgcagaucgaacgaggagaggcccggauucaacgcagaaucuccauaaagaaggcucucgacgccaaaaucgcaagguacaaggcuccauuucaucagcugcggauucaguacggcacaucaaaagguaagaauuauaccgaggaagaggaucgauuccuaaucuguaugcugcacaaaaugggguuugacagagaaaacguuuacgaggaacuccgccagugcgucaggaaugccccucaauuccguuuugauugguucauuaagagucggacugcaauggaguuucagagaagguguaacacccugaucucucuuauagagaaggaaaauauggagauugaggagcgcgaacgagccgagaaaaagaaaagagcuacaaagacccccaugagccagaaacggaaggcggaguccgccacugaaucaagcggcaagaaagacgugaagaaagugaagucuuga

SEQ ID NO: 62896 - RNA, 4545 nt, Artificial Sequence
  derived and/or modified sequence opt3 from SMARCA2__Homo_sapiens__NP_001276326
augagcacccccacagacccuggcgccaugccacacccggggcccuccccuggaccaggucccucuccuggcccaauccuggggcccucaccuggaccaggcccgagucccgguagcgugcauuccaugauggggccuucuccaggacccccuucggucucacacccaaugcccacuaugggcagcacggauuucccgcaggagggcaugcaucaaaugcacaagccuauugacgggauacaugauaaaggaaucguugaagacauucacugcgguaguaugaagggcaccgggaugagacccccacacccuggaaugggucccccacagucccccauggaucagcauucucagggcuacaugagcccucacccauccccgcucggggcucccgagcaugugucaaguccuaugagcggaggcggcccaacacccccucaaaugccacccucucagccgggggcacuuaucccuggagacccacaggccaugucccagcccaacagggguccuucacccuuuagcccaguacaacugcaccaguugcgggcgcagauuuuagcuuauaaaaugcuggcccgcggccagccucuacccgaaacucuccaacuggcagugcaggggaagcgaacccuuccaggacugcagcaacagcagcagcaacagcagcagcaacagcagcagcaacagcagcagcaacagcagcaacagcagccgcagcaacagccuccccagccacagacacaacagcagcagcaacccgccuuggucaauuacaaccguccuaguggcccaggucccgagcucucugggccuuccaccccgcagaaacugccagugcccgcuccuggcggaagaccaagccccgcaccuccggccgcugcccagcccccagcggcagccguuccuggccccucggugccacaaccugcucccgggcagccaucuccgguccugcagcuccagcaaaagcaguccaggaucucaccuauacagaagccccagggauuagauccaguggaaauccugcaagagcgggaguaucgccuucaggccagaauugcacacaggauccaggaauuggagaaucugcccgguagucuaccuccagaccuccggacuaaagcuacaguagaacugaaggcccuucgccuguugaacuuccagcgacaacucagacaggagguuguggcguguaugaggcgggauaccacgcuggagacugccuuaaauagcaaagcauacaagcguuccaaacgccagacccugagagaagcuaggaugacagagaagcucgaaaagcagcagaaaauugagcaagaacggaagcgacgccagaaacaucaagaguaucuuaacucuauccugcagcacgccaaggacuuuaaagaguaccauagaagcgucgcuggcaagauacagaaauugucaaaggccguggcaacuuggcacgccaauaccgaaagggagcagaagaaagaaacagagcggauugaaaaggagcgcaugagaaggcuaauggcugaggaugaagagggguaucguaaacugaucgaccaaaagaaagaucggcgacucgcguaccugcuucagcagaccgacgaauacguggcaaaccugacgaauuuggucugggagcauaagcaggcccaagcugccaaggagaaaaagaaaagaaggcgccggaagaaaaaggcagaagagaacgccgaaggaggcgagagugcucucggucccgacggggaaccuauugaugaguccagccagaugucugaccugccgguuaaggugacucacacagagaccggcaaaguauuauucggaccagaagcccccaaggcaucacagcuggaugcguggcuagagaugaauccuggcuaugaaguggcucccagaagugacagcgaggaauccgauucugacuacgaggaggaagaugaggaagaggaaucgagcaggcaggagacugaggagaaaauccuccuggacccaaacuccgaagaagucucagagaaggaugccaaacaaaucauugaaacagcaaagcaggacguggaugacgaguauaguaugcaguacucugcccgcgggagccaauccuauuacaccguugcucacgccauaucagagcgaguggaaaagcagagcgcacuuuugaucaauggaacgcugaaacauuaucagcuccagggucuggaguggauggucucucuuuacaacaauaaccugaacggcauuuuggcugacgaaauggggcucggaaagaccauccaaacaauagcccugauuacuuacuuaauggagcacaaacggcugaauggcccuuaucuaaucaucgugccccucuccacccugaguaacuggacauacgaguuugauaagugggcgccaagcguaguuaaaauuucuuauaaggguacuccugccaugcguagaucccuugugccgcaguugaggucagggaaauucaauguccugcucaccacauacgaauauaucauuaaggacaagcauauacuggcuaaaauccgcuggaaguacaugauuguggaugagggccaccggaugaaaaaccaccauugcaaguuaacccaggucgaccugaaugaagaggaaacuauccuuaucauuagaagguugcacaaagugcuccgacccuuucugcuacgccggcugaagaaggagguugagagucagcucccagaaaaaguggaguauguaauaaagugugauaugagcgcacugcagaaaauccuuuacagacauaugcaagccaagggaauuuugcugacggacggcucggaaaaagauaagaaggggaaaggaggcgcuaagacauuaaugaacaccaucaugcagcucaggaaaauuugcaaucacccuuacauguuccagcauaucgaggaauccuuugccgagcaccuggguuauucuaacggggucauaaauggagcagagcuuuaccgugcgagcggcaaguucgaacuguuggaccgcauccuccccaaacugcgggccacuaaccacagagugcuacuguuuugucaaaugaccucacucaugacaauuauggaggauuauuucgcuuuuaggaauuuccuguaccuucgauuggacgguaccacuaagagugaagaucgggccgcacuguuaaagaaauucaacgagccaggcucccaguauuuuaucuuccuccugucuacacgcgcugggggacuuggccugaaucuacaggccgcagacacgguugugauuuuugauagcgacuggaacccucaucaggaccuccaagcccaggauagagcucacaggaucgggcagcaaaaugaaguccgggugcugcgauugugcaccguaaacuccguggaggagaagauacuggcggccgcaaaauacaaguuaaacguugaccagaaagucauucaggcuggaauguucgaucagaagucaagcagucaugaaagacgcgccuuucuccaagccauccuggagcacgaagaggagaaugaagaggaagacgaggugcccgaugacgaaacucuuaaccagaugauugcuaggcgugaggaggaguucgaucuguuuaugcggauggacauggauagaaggcgcgaagacgcacgaaauccgaaaagaaagccacgguugauggaagaggaugaacucccuucuuggaucauaaaggacgaugccgagguggagaggcugacaugugaagaggaagaggagaaaaucuucggccgcgguucccgucagagacgggacgucgacuauagcgaugcgcuaaccgaaaagcaguggcugagggcuauugaggacgggaaccuugaagagauggaagaggagguucgccucaaaaagcgaaaaagacggaggaauguggauaaggaccccgccaaggaagauguggagaaagcaaagaaacgcagaggaaggccacccgccgaaaagcugucgccuaacccgcccaaauugacaaagcaaaugaaugcuaucauugacacuguaaucaacuacaaggauucaucuggccggcagcugagugaggucuuuauacaguuaccaucccguaaagaacucccugaguacuaugagcugauucgcaagcccguggacuucaaaaagaucaaagaacgaaucagaaaucauaaguacaggagccuuggugaucuggagaaggacguuauguugcucugccacaacgcacagaccuuuaaucuggaaggcucucaaauuuaugaggauagcaucgugcuacaguccgucuucaaaucagcccggcagaagauugcgaaagaagaggagagugaagacgagagcaacgaagaggaagaggaggaagacgaggaagagucugaguccgaagcuaagucagugaaaguuaagauaaagcugaauaaaaaggaugacaaagggcgcgauaagggaaaaggcaagaaaagaccuaacagggggaaggccaagccagugguaagugacuuugauagcgacgaggaacaagaugagcgggaacaguccgagggaucuggcacggacgaugaguga

SEQ ID NO: 62897 - RNA, 4944 nt, Artificial Sequence
  derived and/or modified sequence opt3 from SMARCA4__Homo_sapiens__NP_001122316
augagcacccccgacccuccacugggcgggacaccgagacccggaccuuccccaggucccggcccuucuccaggggccaugcucggacccucaccuggcccaaguccggguagcgcucacuccaugauggggcccucuccuggaccacccucggcaggccauccuaucccaacucagggccccgggggauacccgcaagauaacaugcaccagaugcauaagccuauggagucaaugcacgaaaaagguaugagcgacgaucccagguauaaucagaugaagggcauggggaugcggaguggaggccaugccgguauggggccaccucccuccccaauggaccagcacucucaaggauaccccagcccucuuggcggcuccgagcacgcgucaaguccagugccggcuagcgggcccucuuccggaccucagaugucaagcgguccaggcggggcaccccuggauggagccgacccucaggccuugggccagcaaaaccgcgguccaacgcccuucaaucagaaccaguuacaucagcugcgagcucaaauuauggcauauaaaaugcuagcccgugggcagccgcucccugaucaucugcagauggcuguccaaggcaagagaccaaugcccggaaugcagcagcagaugccuacccuucccccaccuaguguuucugccacaggccccgggccaggaccggguccuggccccgggccaggacccggcccugcgccacccaauuacuccaggccucacgguaugggcgggccgaacaugccacccccuggaccaagcggcgugcccccugggaugccgggacaacccccagguggcccucccaaaccauggccugaagggcccauggcaaaugccgcugccccaacuucgaccccgcagaagcugauaccuccccagccaacaggacggcccucuccugcaccacccgcuguaccuccggccgcguccccagugaugcccccucagacccaaucacccggccagccagcccagccugcacccauggucccauugcaccagaagcaaagucgcaucacuccuauucagaaaccgagaggucucgaccccguggagauccugcaggaaagggaguaucggcugcaggcucgcauugcccaccgaauccaagagcucgaaaacuuaccagggagccuggcuggcgaucuuagaacaaaggccaccauagaguugaaagcacugaggcuacucaauuuucagcggcagcugcgucaagaaguuguggucugcaugcgcagagacacggcccuugagacugcucugaacgcgaaggcauacaaaagguccaagcggcagucuuugcgagaggcccgcaucaccgaaaagcucgagaaacagcagaagauugaacaagagagaaaaaggcggcagaagcaucaggaauaucugaauagcaucuuacagcacgcuaaagauuucaaggaguaccaucgcucagugacaggaaaaauucaaaagcugacuaaggccguagcaaccuaccacgccaacacagagagagaacagaaaaaggagaaugaaaggaucgagaaagaacguaugcggcgacucauggcugaggacgaggaaggcuauagaaaacuuauagaucagaaaaaggacaagaggcuggccuacuugcuacagcaaaccgacgaguauguugcaaaccugacggaacucgugcgccagcauaaagcggcucaggucgccaaggagaaaaagaaaaagaagaaaaagaaaaaggcagaaaaugccgaggggcaaacuccugcuauuggacccgauggcgagccacuggacgaaacaagucagauguccgaucuuccugugaaagugauccacgucgagagcgguaagauucugaccgggacugacgcccccaaggcaggacaguuggaggcuuggcucgaaaugaacccgggcuacgagguugccccacggucugauucagaagagagugguagcgaagaggaagaggaggaagaggaagaggaacagccucaagcggcccagcccccaacacugcccguggaggagaaaaagaaaaucccugacccggauuccgacgauguaucugaaguggacgcuagacacaucauugagaacgcaaagcaggaugucgacgacgaauauggcgugucgcaggccuuagcuagggggcugcaaagcuacuaugccguugcacaugcggugaccgagcgcgucgauaaacaguccgcccuaauggugaauggaguacucaagcaguaccagauaaaaggccuggaauggcuuguuucauuguacaacaauaaccugaaugggauccucgcugacgagaugggacugggcaagacgauucaaaccaucgcccuuauaacauaucugauggagcacaagcgaauuaacggucccuuuuugaucaucgugccacucaguacucugucuaauugggcauacgaguucgauaaaugggcuccuagcgucgugaaggucuccuauaaagggucacccgccgcacggcgugccuuugugccucaguuaagaagcggaaaguucaacguucugcuaaccacauacgaauauauuaucaaagacaagcauauucucgcuaagauaagguggaaauacaugaucguggaugaaggccaccgcaugaagaaucaccauuguaaacugacucagguacuuaacacccacuaugucgcgccacggagauugcugcucacagguacuccccugcagaauaaguuaccugagcugugggcccuuuugaacuuucuccugccaaccauuuucaaaucuugcuccacguuugagcaaugguucaaugcacccuuugcuaugacaggcgaaaagguggaccuaaacgaggaagagaccauccugaucauuaggcgacuccauaagguucugcgcccguuccuuuugcggagacugaaaaaggaaguggaggcccaguuaccugagaaagucgaauacgugauaaagugugauaugagugcccuccagaggguacuguaccgucacaugcaagcuaaaggggugcuucugacugacggaagcgagaaggauaagaaaggcaaagggggaaccaagacauugaugaauaccaucaugcagcuccgcaagauuugcaaccauccauauauguuucagcacaucgaagagucuuucuccgaacaccugggcuucacuggugggauuguucagggacuagaccuguaccgggcaucaggcaaauuugagcuccuggauagaauccuucccaaguugagggccacaaaccauaaaguccuguuauucugucaaaugacgagucucaugaccauaauggaggacuauuuugcguaccgagguuucaaguaucugcggcuugauggcacuacaaaggcugaagaccgcgggaugcugcuaaaaaccuuuaaugagccuggaagcgaauacuucaucuuucuccugucgacaagagccggcggguugggacugaacuuacaguccgcagacacugugauuaucuucgauucugacuggaauccacaccaggaucuccaggcccaagacagggcucaucggauuggccagcagaacgaggugcgaguccugagacuuugcaccguuaauagcguggaagagaagauccuggcagccgcgaaauauaaguugaacguggaucagaaaguaauacaagcugguauguuugaccagaagucaaguucccacgagcgcagggccuuccuccaggcaauucuggaacaugaggaacaagaugagucucgucacuguagcacgggguccggaucagccagcuuugcucacaccgcacccccgccugccggcgucaaucccgaccuagaggaaccaccucugaaggaggaagaugaggugcccgacgaugaaacaguuaaccagaugaucgcucggcaugaggaggaguucgaccuuuuuaugagaauggaucucgacaggcgccgagaagaagccagaaauccaaaacggaagcccaggcugauggaggaagacgaguugccuaguuggauuaucaaagaugacgcggagguggaacgccugacuugcgaggaagaggaagagaagauguucggccgugggucuagacaccggaaagaggucgauuacuccgacagcuuaaccgaaaagcaguggcucaaggccauagaggaaggaacacuggaggagaucgaagaggaagugaggcagaaaaagucgucacgcaaacgaaagagagauucugacgcagguaguuccacuccaaccacgagcacacggucuagggauaaagacgaugagagcaagaagcaaaagaagcgcggcagaccgcccgcugaaaaacuuuccccuaacccacccaaucugaccaagaaaaugaagaagauuguugacgccgugaucaaauacaaggauucaaguagcgggaggcaguugucugagguauucauucagcucccuucccggaaagagcugccagaauauuacgagcuaauccguaagcccgucgacuuuaaaaagauaaaagaacgcauucgaaaccauaaguauagaucacugaaugaccuugagaaggaugugaugcuccugugucagaacgcucaaacuuucaauuuggaaggaaguuuaaucuacgaggacagcaucgugcugcaguccgucuuuacaucuguuaggcagaaaauugagaaggaagaugacucggagggcgaagagagcgaagaggaggaagagggugaagaggaggggucagaauccgagagucggucugugaaaguaaagaucaaacucggacgcaaggaaaaggcacaggauagacugaaaggcggcaggcggcgaccuagcagagggucccgcgccaagccgguggucucagacgaugacucugaggaggaacaagaggaagauaggagcggaagugguuccgaggaagacuga

SEQ ID NO: 62898 - RNA, 3159 nt, Artificial Sequence
  derived and/or modified sequence opt3 from SMARCA5__Homo_sapiens__NP_003592
augagcuccgccgcugagcccccuccaccgcccccuccagaaucugcacccucaaagccugccgcgaguaucgcuagcggcggguccaacucuucgaauaaaggagguccagagggcguggccgcacaggccgucgcuucagcagccagcgcugggcccgccgacgcggaaauggaggaaauuuucgaugacgcaaguccuggaaagcaaaaagagauacaggagccagauccgaccuacgaagagaagaugcagacagacagagccaacagguuugaauaucugcucaaacagacugagcuuuucgcucacuuuauccaacccgccgcacagaagacgccuaccuccccacugaagaugaaacccggccggccucgcauuaagaaagaugagaagcagaauuuguuaucuguuggugacuaccgacaucguagaacagaacaggaggaagaugaggaacugcuaacugagagcuccaaagcuaccaacgugugcacaagguucgaggacucaccaaguuauguaaagugggggaagcuccgggauuaccaagugcgcggacugaauuggcuuaucagccuguaugaaaacggcauuaauggcaucuuggccgacgagauggggcucggaaaaacccugcagacuauaucucugcucgguuacaugaagcacuauagaaacauccccggcccgcauauggucuuagugccuaaauccacacugcacaauuggaugucagaauuuaagagguggguucccacccuucggagcguguguuugauuggggauaaagagcagcgcgcggccuucguccgagacgugcugcuaccaggagaaugggauguaugcguuacgaguuacgagaugcucaucaaggagaaaucuguguuuaagaaguucaacuggagauaccuggucauugacgaagcacauaggaucaaaaaugagaaguccaaacuuagcgaaauagugcgggaguuuaagacuaccaaccgucuguugcucacaggcacuccucugcagaauaacuuacacgaacuguggucgcuccuuaauuuccuguugcccgacguguuuaacucugcugaugacuucgauuccugguuugacaccaacaauugucuaggugaucaaaaacuggucgagcgccuccacaugguucugagaccauuccuucugaggcggauuaaggccgacguggagaagucauugcccccuaaaaaggaaguaaaaaucuauguggggcucaguaagaugcagcgagagugguacacacgcauucugaugaaagauaucgacaucuuaaacagcgcuggaaagauggauaagaugagacugcuaaauauucucaugcagcugaggaaaugcuguaaccauccauaucuuuucgacggcgccgaaccggggcccccuuacaccacggauaugcacuuggucacuaauuccggcaagauggugguucuggacaaacuccugccaaaacuuaaagagcaaggaucucgggugcugauauuuagccagaugacacgcgucuuggacauccucgaggauuauugcauguggagaaacuacgaauauuguaggcuggacggucagacuccccaugaugagcgucaggacucaauuaaugcauacaacgaaccuaauaguaccaaguucguguuuauguuauccacacgggccggcgggcugggaaucaaccuagcuaccgcggauguaguuauacucuacgacagcgauuggaauccacaaguggaccugcaggcaauggaucgagcccacagaauuggccagacgaagaccgucaggguguuccgcuuuaucacagacaacacugucgaggaacggaucguggagagagcugagaugaaacuuagguuggauucuauuguuauccagcaaggucgccugguggaccagaaucucaacaagauugggaaagaugaaaugcugcagaugauacgacacggcgccacccauguauucgcaucaaaggagagugaaaucacagacgaggacauugauggaaucuuagaacggggcgccaaaaagacugcugagaugaaugagaaacugagcaagaugggggaauccucucuucguaacuuuaccauggacacagagucgagcgucuauaacuucgaaggagaggauuacagagaaaagcagaaaaucgccuuuaccgaguggauugagcccccgaagagggaacgcaaagcaaauuaugcgguggacgcuuacuuccgggaggccuugagaguuuccgaaccuaaggcaccaaaagcccccaggccucccaagcaaccaaacgugcaggauuuucaguucuuuccuccccgacucuucgagcugcuagagaaggaaauacuguucuaucgcaaaacuaucgguuacaaggucccacggaauccggagcucccuaacgcugcccaggcacaaaaagaggaacagcugaagauugacgaagcugagucacuuaaugaugaggaauuggaggaaaaagagaagcuguuaacgcagggcuuuacaaacuggaauaagagagacuucaaccaauuuaucaaagccaaugaaaagugggggagggaugacauugagaacaucgcgcgugagguggaaggaaaaacccccgaggaaguaauagaguauagugccguguucugggaacgcugcaaugagcuccaggauaucgagaagauuauggcucagaucgaacggggcgaggcacgcauucagaggcgaaucucuauaaagaaggcccuggacacuaagauuggucgguacaaagcuccauuucaccaacuucgcaucagcuacgggaccaacaagggcaaaaauuauacagaagaggaggauagauuccugauuuguauguugcauaagcucggauuugacaaagaaaacguuuacgacgagcugaggcagugcauccgaaauucaccccaguuccgguuugauugguuccuaaaguccagaaccgccauggaacugcagagaagguguaacacucucauaacacugaucgagcgugaaaacauggagcuugaggaaaaagagaaggcagaaaagaaaaagcggggcccuaaaccaagcacgcaaaagagaaaaauggacggggcgcccgauggaaggggucgcaagaagaaauugaagcuguga

SEQ ID NO: 62899 - RNA, 3087 nt, Artificial Sequence
  derived and/or modified sequence opt3 from SMARCAD1__Homo_sapiens__NP_001121901
augaaccuguucaaucucgacagauuuagguucgagaagcggaacaaaaucgaagaggcccccgaagcuaccccucagccaagccaaccgggccccuccucuccuauuucacuuagugcagaggaagagaaugccgagggggaagugagccgcgcgaacacaccagauuccgacauaacugagaagacggaagauucuucgguccccgagaccccugacaaugagcgaaaggcuucaaucagcuacuuuaagaaccagcgugguauucaguauaucgaucugaguuccgacucugaagauguugugagcccaaauugcuccaacacaguacaggagaaaacuuucaauaaggacaccgugauuaucgucucagaacccagugaggaugaagagagccaaggauugccuacaauggccagaaggaacgacgauauaucugaguuagaagaccuguccgagcuagaagaucucaaggacgcaaaacugcagacccuuaaggagcuguuuccacagcggucagacaaugauuugcucaaacugaucgaaagcacaaguacuauggacggcgccauugcugcagcccugcucauguucggggaugcuggaggcgguccgcgcaagagaaaauuaucuuccagcucggagcccuacgaggaagacgaguuuaacgaugaccagucuaucaagaagaccaggcuggaucacggggaagaguccaaugaaucagccgagaguagcuccaacugggagaaacaagaaucuauugugcuuaaguugcagaaagaguucccuaauuuugacaagcaggaacugcgggagguucuaaaagagcaugaauggauguauacggaggcgcucgaaagccugaagguguucgcagaggaucaggacaugcaauacgucucacagagugaagugccaaacggaaaagagguauccagccgcucucagaacuaucccaagaaugccacuaagaccaaacuuaagcaaaaauuuucaaugaaggcucagaacggcuucaauaaaaagcgaaagaaaaacguuuuuaauccuaagagaguggucgaggauagugaauacgacagcggcuccgacguggggucuucgcuggaugaggacuauagcuccggagaagaggugauggaagaugguuacaaaggcaagaucuugcacuuccuccaggacgccucaauaggggagcugacauuaauuccacaguguagucaaaagaaggcacagaagaucacugagcugaggcccuucaacucuugggaagcucucuuuaccaaaaugagcaagacaaauggacuuuccgaggaucugauuuggcauugcaaaaccuugauccaggaacgggacgucguuauccgucuaaugaacaagugugaggauauuucaaauaaacugacgaaacaggugacuaugcucacaggcaacggugggggauggaauauagaacaaccgagcauccugaaccagucucuuucccugaagccuuaccagaaaguaggcuugaauuggcucgcccuggugcacaagcauggcuuaaacgggauucuggcggacgagaugggacuagguaaaaccauccaggccauagcauuccucgcuuaucuguaccaagagggcaauaacgggccccaccuuauugucgugccagccaguacuaucgauaacugguugcgcgaaguuaaucuguggugcccuacacucaaggugcuguguuauuacggaagccaggaggaaagaaaacagaucagguuuaacauucacucucgguaugaggacuacaaugucaucgugaccacguauaacugcgcuauuuccucaagugaugaccgaagccuuuuccgcagacugaaguugaauuacgccauauuugaugagggccauaugcucaaaaacauggguucgaucagguaccagcaccugaugaccauuaaugcaaacaaucgguuacugcuaacagggacucccguacaaaacaaucuccuggaacuuauguccuugcugaacuucguuaugccacauauguuuucuagcucaaccagugagauccgcagaauguucuccucuaagacaaagagcgccgacgaacaguccaucuaugagaaagaaaggauugcucacgcgaagcagauaaucaaacccuuuauucuccgucgggugaaggaggagguccugaaacaauuaccuccaaagaaggaccgaaucgaacugugugcaaugucagagaaacaggaacagcuuuacuugggccucuucaauagacugaagaaaagcauuaacaaucuagugacugagaagaacaccgaaaugugcaacgucaugaugcagcugaggaaaauggccaaucacccgcuccugcaucgccaauauuacacagcugagaaacuuaaggagaugagucaguugaugcugaaagaacccacccacugugaggccaacccugauuuaaucuuugaagacauggaggugaugacugauuucgaacuccauguucugugcaagcaguaucggcacauaaauaacuuucagcuugacauggaucugaucuuggacucuggaaaauucagagugcucggcuguauucuguccgagcuaaagcaaaaaggggauaggguaguccuguucagccaguuuacgaugaugcucgacauccuggaggugcuuuugaagcaucaccagcaccgcuaccugcgauuagauggaaagacacagauuucggaacggauccaucucauagacgaguucaauaccgauauggacauuuuuguuuuccugcuuucaacuaaagccgguggccuggggaucaaccuaaccucugcaaauguggucauucuccacgauaucgacugcaacccauauaaugacaagcaagcugaagaucguugccauagagugggacagacaaaagagguacuggugauaaaguugaucagucagggcaccauugaggaauccaugcugaaaaucaaccaacagaaguuaaaacucgagcaggacaugacuacaguugaugaaggugacgaggggagcaugcccgccgauauugcaacgcugcuuaagaccucuaugggccuguga

SEQ ID NO: 62900 - RNA, 2865 nt, Artificial Sequence
  derived and/or modified sequence opt3 from SMARCAL1__Homo_sapiens__XP_005246688
augagccugccccucaccgaggaacagagaaagaaaaucgaggaaaacaggcaaaaggcccuugcucggcgcgcagagaaacuguuggccgaacagcaccagcgaacauccucuggcacuucaauugcggggaauccuuuccaggcuaagcaaggaccaagucagaacuuuccgcgugagagcugcaaacccgugucccauggugucauauucaagcagcagaauuuaucuucgucaagcaacgccgaccaaagaccucacgauagucauuccuuucaggcaaagggcaucuggaaaaagccagaggaaaugcccacggccuguccugggcacucuccaaggagccagauggcucugaccggaauuucacccccucuagcacaguccccaccggagguucccaaacaacagcuccugaguuacgaacuuggccagggucaugcccaagcuagcccugagauccgguucacaccauuugccaaucccacucacaagccucuggcgaaaccaaagucuucccaggagacccccgcacacucaagcgggcagccgccucgcgacgccaaguuggaagcuaaaacagccaaggcaagucccucuggacagaacauuuccuauauccauagcucgucugaguccgugaccccaagaacugaaggcaggcuccaacagaaaucaggcaguagcguacagaagggggucaauucccagaaaggaaagugcgugcggaacggugaucgcuuccaagugcugauaggcuacaaugcugagcugaucgccguuuuuaaaacacucccuucuaagaacuaugaccccgauaccaagacguggaauuucagcaugaacgacuacucagcguuaaugaaagccgcacagagucugccaacugugaaucuucagcccuuggaaugggcuuauggguccagcgagucuccuucaaccaguagcgagggacaggccggccugccauccgcuccgucucuaucguuugucaagggucgauguaugcucauuagcagagccuacuucgaagcagauaucuccuauucacaagaccugauugcccuuuuuaaacagauggauaguaggcgguacgacgugaagacacguaaauggucuuuccuguuggaggaacacagcaagcucaucgcuaagguacgcugccugccccagguucaguuagauccucugccaacuacccucacacuugcguuugcaucccaacugaaaaagaccucauugagccuaacgcccgacgugccugaggccgaucugucugaagucgacccaaaacucguguccaaccugaugcccuuccagagagcuggggugaauuucgccauagcaaagggaggcaggcuucuguuggccgacgauaugggccucgggaaaacuauucaggcuaucuguauugccgcauuuuaccggaaggaguggccgcuguuagucguugugccuaguagcguacgauucacaugggagcaagcguuucugcgcuggcuaccaucucucucccccgacugcaucaacguggucgugaccggaaaggauagacugacugcuggucuuaucaacauuguuucauucgacuugcugaguaaacucgaaaagcagcugaaaacaccuuuuaagguggucauaaucgaugagagccauuuccuuaaaaauucgaggaccgcccggugucgcgcagccaugcccgugcugaagguagcuaagagaguuauuuugcucuccggcacgccagccaugucuaggccugcagaacuguauacccagaucauagcugugaaacccacauuuuucccacaguuucacgccuucggguuacguuacugcgacgcgaagcggaugccguggggaugggauuauagcggcucaaguaaccugggugagcuaaaacuccugcuugaagaggccgucauguugcgaagacugaaguccgacgugcucucucaacugccugcuaaacagaggaagauugucgugaucgcacccgggcgcaucaaugcccggacuagagcugccuuagaugcagcggccaaagagaugaccacaaaggacaagacuaaacagcagcaaaaggaugcucugauuuuguuuuucaacaggaccgccgaagcaaaaaucccaagcguuauugaguacauacuugaccuccuggaauccggccgcgagaaguuucuaguguucgcucaccauaaaguaguccuggacgccaucacacaggagcucgaacgaaagcacgugcagcauauucggaucgauggaucaaccagcagugcagagcgugaagaccugugucagcaauuccagcuuucugagagacacgccguugcuguguuguccaucacugcggccaauaugggccugacguuuagcucggcagauuuagucguguucgcugaacucuuuuggaaccccgggguacugauucaggccgaggacagggugcaucgcauaggacaaacaucaucuguugguauccacuaucuugucgccaagggcaccgcugaugacuaccuguggccuuugauucaggagaaaaucaaggugcucgcagaagccgggcugagugagacuaauuucuccgaaaugaccgagagcacagauuaucuauacaaagacccaaagcagcagaaaauuuacgaucuguuucaaaagucuuucgaaaaggagggaagcgacauggagcuccuggaagcggcugaguccuuugaucccggcucagccagugguaccagcgggucuuccucacagaacaugggcgacacucuugaugaaaguagcuugacagcauccccucagaaaaagcggagauucgaguuuuucgacaauugggacucuuuuacgucgccgcuguga

SEQ ID NO: 62901 - RNA, 1131 nt, Artificial Sequence
  derived and/or modified sequence opt3 from SMARCB1__Homo_sapiens__NP_001007469
augaugaugauggcccugagcaagaccuucggccagaaacccgugaaguuucaacucgaggacgauggggaguucuacaugaucggauccgaggucgguaacuaucuuagaauguuuaggggcucucuguacaaacgguauccuucauuguggcgccgauuagcuacaguugaagaacguaagaaaauuguggcaaguagccacgaccauggguacacuacgcuggccaccuccguaacacuacucaaggcgucugaaguggaggagauacuggauggaaaugacgaaaaguauaaagcugucucgaucucaacugagccaccgaccuaccuuagagaacagaaggccaaaaggaacagccagugggugcccacacugccuaauaguucccaccauuuggaugcaguuccaugcucuaccacuauuaaccggaaucgcaugggcagagacaagaaaaggacauucccccucuguuuugaugaccacgauccugccgugauccaugagaacgcuagccagccagagguccuggugcccauucggcuggacauggaaaucgauggucaaaagcuccgcgacgcauucaccuggaauaugaacgagaaguuaaugacgccugaaauguuuuccgagauacugugcgaugaccuugacuugaauccacugacuuucguaccggccaucgcuucagccauucgacagcagaucgaaaguuaucccaccgauagcauucuagaggaccagucugaucaaagaguuaucauaaaacucaacauucacguggggaauaucucccuggucgaccaguuugagugggauaugucagaaaaggagaacagcccugaaaaauucgcgcuuaagcuguguagugaguugggacucggcggcgaauuugugacaacuauugcauacucuaucagggggcagcuguccuggcaccagaaaaccuacgccuucagcgagaauccauuacccacaguggagaucgcuauucggaacaccggagacgccgaucaauggugcccucugcucgaaacgcuuacugacgcagagauggaaaagaaaauacgugaucaggaccgcaauacaagaaggaugcggcgacuggcuaacaccgccccagcgugguga

SEQ ID NO: 62902 - RNA, 3318 nt, Artificial Sequence
  derived and/or modified sequence opt3 from SMARCC1__Homo_sapiens__NP_003065
auggccgcugcagccggcgggggaggucccggcaccgcggugggggcuacaggaagcggcaucgccgcagccgcugcaggucuggccgucuacagaaggaaggacgggggaccugcuacuaaauucugggaguccccagaaacgguuucucagcucgauucagugcggguauggcuuggcaagcacuauaaaaaguacgugcaugccgacgcgccgaccaacaaaacacuggcaggcuuggucgugcaauuacugcaguuucaggaggaugccuucgggaagcacguuacuaaucccgcuuuuaccaagcuaccugccaaaugcuucauggacuuuaaggcaggaggugcucucugucauauucugggcgccgcguauaaauacaagaacgaacagggguggcgccgauucgaucuucaaaauccaagucguauggacagaaacguggagauguuuaugaauauagaaaagacacugguccagaacaauugcuugaccaggcccaacaucuaucucauuccugauaucgaccugaagcuggccaauaagcucaaagauauuaucaagcggcaccagggaacuuucacagacgagaaaagcaaggcaucccaucacauauacccauauucuucgucacaggaugacgaggaaugguuacgccccgugaugagaaaagagaagcaaguacugguucacuggggcuuuuacccugauagcuacgacaccugggugcauaguaacgacgucgaugcugaaaucgaggacccaccgauucccgagaaaccuuggaaggugcacgugaaguggauccuugauacggacauuuucaaugaauggaugaacgaggaagauuaugaggucgacgaaaauaggaaaccaguuuccuuucggcagcgcaucucuacuaagaacgaggagcccgugcgaagcccugaaagaagggaucggaaagccuccgcuaaugcccguaagcgcaaacauucaccaagucccccgccucccaccccaacagagagcagaaagaagucugguaaaaaggggcaggcauccuuguacggaaaaaggcggucacagaaggaagaggacgaacaagaggaucugacuaaagacauggaggauccuacccccguaccaaacauagaagaggugguccuacccaagaacgugaaucucaagaaagacagcgaaaacacaccuguuaagggcggcaccguggccgaccuggaugagcaggacgaagagacggucacugcugggggaaaagaggaugaagacccagcgaagggugaucagagucgaucuguggaccuuggcgaggauaauguaacagaacaaaccaaccacauuaucauuccguccuaugcaagcugguucgacuacaauuguauccacguuaucgagcgcagagcccugcccgaguuuuucaacgggaaaaauaagucgaagacuccugaaauuuauuuggcuuacaggaacuucaugauagauacauaucggcucaauccacaggaguaccugaccucuacggccugccgcagaaacuuaaccggagacgugugugcagucaugagggugcaugccuuucuggaacaguggggccucgucaauuaccagguggaucccgagucccguccuauggcuauggguccacccccgacaccucacuucaacguucuugccgacacuccaucagggcuggugcccuugcaucuacggaguccucaaguacccgcagcgcagcagaugcugaauuuuccagagaaaaacaaggagaaaccugucgaucuccagaauuucggccugcgaaccgacaucuauagcaagaaaacacuugcuaaguccaaaggagccucugcaggcagagaguggacugaacaagagacccuguugcuccuggaagccuuagagauguacaaggacgauuggaacaaggugagcgaacacguugggucaaggacacaggacgagugcauucugcauuuucuacgccuccccaucgaggauccauaucuggaaaacagugacgcuucccuuggaccguuggccuaccagccugugcccuucagccagucugguaauccagucaugucaaccguggcauuucuggcuaguguaguggauccccggguugccagcgcggccgcuaaagcagcccucgaggaguucuccagagucagggaagaagugccucuggagcuuguggaggcucacgucaagaaaguucaagaagccgcacgcgcgucuggcaagguggacccaacuuaugggcuggagucgagcuguauagccggaacgggccccgaugaaccugagaaauuggagggugcugaagaggaaaagauggaggccgacccggaugggcagcagccagaaaaggcagagaacaaaguggagaaugaaacagacgagggcgauaaggcucaggacggagaaaacgagaaaaauuccgaaaaggagcaagauucagagguaagugaagacaccaaaucugaggaaaaggagacugaagagaacaaggagcucaccgacacaugcaaagaacgagagagcgauaccggcaagaaaaaggucgaacacgagauuuccgaggggaauguggccacugcagccgcugcggcccuggcaucagcugccacaaaagccaagcauuuagcugcaguugaagaacggaagaucaaaagccugguggcccuacucgucgaaacgcagaugaagaaacuggagaucaaacuucgucacuuugaagaguuggagaccauuauggacagagaaaaagaggcgcuggaacagcaaaggcagcagcuccugacugagcgccagaacuuccauauggaacaauuaaaguacgcugagcugcgggccagacagcagauggagcagcaacagcacggacagaauccccagcaagcacaccagcauucugguggcccugggcuugccccauugggagcugcaggccaccccgguaugaugccucaucagcaaccgcccccauauccucucaugcaccaucagaugcccccaccucacccaccacagccggggcagaucccuggccccggauccaugaugccaggccaacacaugcccgggaggaugauuccuacaguggccgcgaacauacauccaaguggaagcggccccaccccuccggguaugccacccaugccugggaauauccugggaccccgaguuccacuaacagcuccuaacggcauguacccuccaccuccgcagcagcagcccccaccucccccacccgccgauggugugcccccgcccccugcacccggcccacccgccucugcugccccuuga

SEQ ID NO: 62903 - RNA, 3459 nt, Artificial Sequence
  derived and/or modified sequence opt3 from SMARCC2__Homo_sapiens__NP_001123892
auggccgugagaaagaaagacggcgggcccaacgucaaguacuaugaggcugcagauaccguuacacaguucgacaaugugaggcuguggcucgguaaaaacuacaagaaauauauccaagccgaaccuccaacuaauaagagccuuuccucucugguagugcaguuguuacaguuucaggaggaagucuucggaaagcacgugucaaacgcgccgcugacgaaacuacccauuaagugcuuucucgauuucaaagcuggcgggagucugugucauauacuugccgcagccuacaaguuuaaaagcgaccaaggauggcggcgcuaugauuuccagaauccuucccgaauggaccguaacguugagauguuuaugaccaucgaaaagucucuggugcagaauaacugcuugucgagaccaaauauuuuccucugucccgagaucgagccuaagcugcugggcaaacucaaggauauuaucaaaaggcaccaggguacagucacugaagacaagaacaaugcuucacaugugguauacccaguucccgggaacuuagaggaagaggagugggugcggccugucaugaaacgcgauaagcaagugcugcuucacuggggauauuacccagacagcuacgauaccuggauaccggcaagugaaaucgaggccuccguggaagacgcucccacaccugagaaaccaagaaagguccaugccaaguggauuuuggauaccgacacuuuuaaugaauggaugaacgaggaggacuaugaaguuaaugaugacaaaaaccccgugucuaggcggaagaaaaucagcgcgaagacacugaccgaugagguaaacuccccugacucagaucgccgagacaaaaagggcggcaauuacaagaaaagaaagaggaguccaagccccucuccgacgccugaagccaaaaagaaaaacgccaagaaggggcccuccacuccauauaccaaaucaaagcggggacaccgugaggaagaacaggaggaucuaacaaaagacauggaugaaccuagccccgugccaaaugucgaggaagugacucuccccaagaccguuaacaccaaaaaggacagugagucugcuccugugaaggguggcaccaugacggaucuggacgaacaggaggacgaguccauggaaacuacagggaaagaugaggacgaaaauagcaccggaaacaagggcgagcagacuaaaaauccagaucuucacgaggacaacgucacagaacaaacccaucacauuaucauaccgucguacgccgcaugguucgauuauaauucugugcaugcuauugagcgcagagcccugcccgaauuuuucaacgguaagaauaaauccaagacgccugagaucuacuuggcguauaggaacuuuaugauugacaccuaccggcucaauccacaggaauaccugacaucaacugccugccgacgcaacuuagcaggggauguaugugcuaucaugagaguucacgccuuccuggagcaguggggacucaucaauuaucaaguggacgcugagaguaggcccaccccuaugggcccacccccgacaagccacuuccauguccuugccgauacuccuuccggccuggugccauugcagcccaaaaccccucaggggcggcaggucgacgcagauacaaaggccggacgcaaggguaaagaacuagacgaucuggugcccgagaccgcuaagggcaaaccagaacuccaaacuucugcgagccagcagaugcugaacuuuccugacaaggggaaagagaagcccacggacaugcagaacuucggacuuagaacagauauguacaccaagaaaaauguuccaucaaagaguaaagcagccgcuuccgccacuagggaauggaccgagcaagagacacuguugcuccuggaagcauuagagauguauaaggacgauuggaacaaagugagcgaacacguaggcucucguacccaggacgagugcauucugcauuuucuacggcucccgauagaagauccuuaccuggaggacucagaggccagucuuggucccuuggcuuaucagccaauccccuucagccaguccgggaauccugucaugucuacuguggccuuucuggcaucgguuguggauccacgagucgcgagcgcugccgcaaaguccgcccucgaagaguucucaaagaugaaagaagaggugcccacagcucugguagaggcccacgugagaaagguugaagaggcagcuaaagucacgggcaaggccgacccugcguuuggacuugaaaguucuggcauugccgggaccacuagcgaugagccggaaaggaucgaggaguccggaaacgacgaagcucgcguggagggucaagcaacagaugagaaaaaggagccaaaggaaccccgggagggcgggggagccauagaggaagaggcuaaagaaaagaccucagaggccccuaaaaaggacgaagagaaaggcaaggagggugauagcgaaaaagagucugaaaaguccgacggggacccaauuguggaucccgagaaggagaaagaaccuaaggagggccaggaagagguccugaaagaaguuguggagagugagggagaaagaaagacaaaaguggagagggacaucggcgaagggaauuugagcacugcagcggccgcugcccucgcagcugccgcaguaaaggccaagcaucuggcugcggucgaggaacgcaaaaucaagucuuuaguggcccugcuaguugagacccagaugaaaaagcucgagauuaaacugcgacacuucgaggaacuugaaacgaucauggaucgggagcgugaagcauuggaguaccagagacaacagcugcucgcugacaggcaggccuuucacauggagcaacugaaguaugccgaaaugcgcgcucggcagcagcauuuccagcaaaugcaccagcagcagcaacagccgcccccagcauuaccucccggaucccagccaauuccucccaccggugccgcgggcccaccggcugugcaugggcuggccgucgccccugcaucagugguucccgcuccagcaggaaguggcgcacccccugguagccuugggccaucggagcagauaggccaagcgggauccacagcuggcccccagcagcaacagccugccggggcaccgcagccaggagccgugcccccuggcguacccccaccugguccccacgggccaucuccuuuuccgaaccagcaaacucccccaagcaugaugccuggagcuguccccggcucaggucacccaggcguggccgcacagaguccugcuaucguggccgcgguccaggggaauuugcuccccuccgccucuccgcugccagauccuggaacaccccuaccacccgacccuacagcaccgagccccggcacuguuaccccagugccucccccucaguga

SEQ ID NO: 62904 - RNA, 1548 nt, Artificial Sequence
  derived and/or modified sequence opt3 from SMARCD1__Homo_sapiens__NP_003067
auggccgcuagagcaggcuuccagagcguggcccccuccgggggagcgggugcuucuggcggggccggagcagccgcugcacugggcccuggugggaccccaggaccgcccgucaggaugggcccugccccaggccaagggcucuaccggucacccaugccuggagcugccuauccacgccccgguaugcuuccuggcagucgaaugacaccacaggggccgagcaugggacccccuggcuacggugggaacccauccguucgucccggacuggcgcagucuggcauggaccagucgagaaagaggccugcaccacaacagauccaacaggugcagcagcaggccguacagaaucggaaccacaaugcuaaaaagaaaaagauggccgauaaaauuuugccccaacgcauaagagaguuagugccggaaucacaggcauauauggaccugcuagcuuuugagaggaagcucgaucagacuaucaugcggaagcgccuggacauucaagaagcccuuaaacgaccuaucaagcagaaaagaaagcugaggauuuucaucagcaacacguuuaaucccgcgaaaagugaugccgaggacggcgaagggaccgucgcauccugggaguugcggguggagggacgucuccuggaagauucugcucugagcaaguacgacgccacaaagcagaaacgcaaguucuccucauuuuucaaaagucucguuauagaguuagauaaggaccuguaugguccagauaaccaucuuguggaauggcacagaacugcuaccacacaggagaccgacggcuuucaagucaaaaggccuggggaugugaauguacggugcacuguuuugcugaugcuagacuaccagcccccacaguucaagcucgacccccgacuggcccgccuucugggaauccauacacagaccagaccugugauuauccaagcauuguggcaguauauuaaaacgcacaagcuccaggauccacaugagagggaauuugucaucugugacaaguaccugcagcaaauauucgagagccagcggaugaaauuuucugaaauuccgcagcgcuuacacgcccugcucaugcccccugagccaaucauuaucaaccacgugaucuccguggaucccaaugaccagaagaaaacugcuugcuacgauauugacgucgaaguugaugacacccuuaagacacaaaugaacucauuccuguugagcacugcgagucagcaggagauagcaacccuagauaauaaaauccaugagacaauugaaaccaucaaccaacugaagacgcagagagaguuuaugcucucuuucgccagggacccucagggcuucauaaaugauuggcugcagucccaaugucgugaccuuaagacuaugacagacgugguagguaacccagaagaggaacggcgagcugaguuuuauuuccagcccugggcccaggaggcagugugcagauacuuuuauagcaaaguccagcaaaggcgccaggaacuggagcaggccuuggggauucggaauaccuga

SEQ ID NO: 62905 - RNA, 1452 nt, Artificial Sequence
  derived and/or modified sequence opt3 from SMARCD3__Homo_sapiens__NP_001003801
auggccgcugacgagguggcaggcggggccagaaaggcgaccaaaagcaagcuguucgaauuucucguccacggaguuaggcccgguaugccuuccggcgcucggaugccacaucagggggccccgaugggacccccuggcucuccauacauggguucacccgcagugcgcccugggcuugccccagcuggaauggagcccgcacgaaaacgugccgcuccuccaccgggccaaagucaggcccagagccagggccaacccguaccuacagcgccagcaagauccaggucugccaagcggcgcaaaauggcugauaagauccugccccagagaauuagggaauuggugccugagucgcaggccuauauggacuuacuggcauucgaacggaagcuagaucagacuauaaugcgcaaacgagucgacauccaagaggcucucaagagaccaaugaaacagaagaggaaacugcggcuuuacauuucaaacacguuuaaucccgccaagccggaugcggaggacagcgaugggaguaucgccuccugggaacugcguguggagggaaaguugcucgacgauccuucuaaacagaagcgcaaauucagcuccuuuuucaagucacugguuauugaacuggacaaagaucucuauggucccgacaaccacuuaguggaguggcauagaaccccaacaacucaggagaccgauggcuuucaagucaagaggccuggggaccugagugugcggugcacacuuuugcugaugcuagacuaccagcccccacaguucaaacucgauccccgacuggcacgccuucugggauugcacacccaaagcagaucugcuaucguacaggcccucuggcaguauguuaagacuaauaggcugcaggacucccaugauaaggaauacauaaacggcgacaaauauuuucaacagaucuucgauuguccucgguuaaaguuuucagagauuccacagcgccugacagcucuccuucugccgcccgacccuaucgugauuaaucacgucaucagcguggauccaagugaccagaaaaagaccgccugcuacgauauagacguggaagucgaggaacccuugaaaggucaaaugucuuccuuccuacugagcacggcaaaccagcaggagauuucggcccucgauucuaagauccacgagacuauugaauccaucaaucagcugaagauccaaagagacuuuaugcuuucauucaguagggacccuaaaggguacguucaggaucuguugcguagccagucccgggaccucaaggugaugaccgauguagcuggaaacccagaggaagagagacgagcggaguucuaucaucagcccuggucucaagaagcagugagcagguacuuuuauuguaaaauucagcagcgccggcaagagcuggaacagucauuagucgugagaaauacauga

SEQ ID NO: 62906 - RNA, 1236 nt, Artificial Sequence
  derived and/or modified sequence opt3 from SMARCE1__Homo_sapiens__NP_003070
augagcaagagacccuccuacgccccuccaccgacccccgcuccugcaacacagaugccaucuacucccggcuucgugggguauaacccuuacucacaccuggccuauaauaacuacaggcucggagguaauccaggcacgaacagucgggucaccgcgagcuccgggaucacaauucccaaaccuccaaagccgcccgacaaaccucuuaugccauauaugcgcuacucucgaaagguuugggaucaagugaaggcuucgaaucccgaccugaaauugugggagauaggaaagaucauuggcgguauguggcgugauuuaacugacgaagagaaacaggaauaucugaacgaguacgaagccgagaagaucgaguacaaugaaucaaugaaagcauaucauaacagcccugccuaccuagcuuauauuaaugcaaagaguagagccgaggcugcccucgaagaggaguccaggcagcggcagucucgcauggaaaaaggggagccauacaugagcauccaacccgcggaagauccggacgauuaugacgauggauuuuccaugaagcacaccgcaacagccagauuccagaggaaccaucggcugauaucagagauccuuagugaaagcguagugccugacguccgcucugugguuaccacugcucgaaugcaagugcugaagagacagguccaguccuugauggugcaccagaggaaacucgaggccgagcugcugcagauugaggaacggcaucaggaaaagaaacguaaguuucucgagucaacagauagcuucaauaacgaauuaaaacgccugugcggccuuaagguagagguugacauggagaaaaucgcagcugaaauugcccaagcggaggaacaggccagaaagaggcaggaggaacgggagaaggaggcagcugaacaagccgagcgaagucagucuuccaucgugcccgaagaggagcaggcugccaauaaaggcgaagagaagaaagaugacgaaaacauaccaauggagaccgaagagacgcacuuggaggaaacuaccgagagccagcaaaauggggaagagggaacaucgacuccugaagacaaggagucuggucaggagggcgucgauuccauggcagaagaggggaccucagacaguaacacaggaagcgaauccaacucugccaccguggaggaacccccaacggaucccauuccugaggacgagaaaaaggaauga

SEQ ID NO: 62907 - RNA, 3636 nt, Artificial Sequence
  derived and/or modified sequence opt3 from SMC1A__Homo_sapiens__NP_001268392
augcuggaggugagcauccccaccccucacagauacgucaggggcaaguccaaccucauggacgccauuucuuucguucuuggggaaaagacaucaaaucugcgggugaagacuuugcgcgauuuaauacauggagcuccaguagguaaaccggcagccaaccgagcguuugugaguauggucuauagcgaggaaggcgcugaggaccguacguucgccagagugaucguugggggauccucugaauacaagauuaauaacaaagugguccagcugcacgaguauucggaggaacuagagaagcucggcauccugauuaaggcaaggaauuuucuuguguuccaaggugccguagaaucaaucgcuaugaaaaaccccaaggagcggaccgcacuguuugaggaaauaagccgcaguggggaguuggcccaggaauacgauaaaagaaagaaagagaugguuaaggcugaagaggacacacaguucaauuaucauaggaagaaaaacaucgccgcggagcggaaggaagcaaaacaggagaaggaagaggccgaucgcuaccaacgacucaaagacgaaguggucagagcucaggugcagcugcagcuguuuaagcucuaucacaaugagguggagauugaaaaauuaaacaaggagcuggccuccaagaauaaagaaaucgagaaggauaaaaagaggauggacaaagucgaagaugagcuuaaggagaagaaaaaggaauugggaaaaaugaugcgggagcaacagcagauugaaaaggagaucaaagagaaggacucugaacugaaccagaagcguccucaauacauaaaagcaaaggagaauacuagccauaaaauuaagaaacuagaagcugccaagaagucccuccagaacgcgcagaaacacuacaagaaacgcaagggcgauauggacgagcuggaaaaagagaugcuuucaguugagaaggccagacaagaauuugaggaaaggauggaggaagagagucagagccagggccgggaucugaccuuggaggaaaaucaggugaaaaaguaucaccgacucaaggaggaagcaucuaaacgcgcugccacacuggcucaagaguuagaaaaguuuaacagagaccagaaagccgaccaggauaggcuggaccucgaggagcggaagaaaguagaaaccgaggcaaagaucaagcagaaacuucgcgaaauugaggagaaccaaaagagaaucgaaaaacuggaggaauacaucacuacauccaagcagucauuggaggaacagaaaaagcuagagggggagcugaccgaagagguggaaauggccaagaggcguauugaugagauaaauaaagaacucaaccaggucauggagcaacugggagacgcucggaucgaucgacaggagagcaguagacagcagaggaaggcggaaauuauggagucuaucaaacgccuuuauccagguuccguguacggccggcugauagacuugugccaacccacgcagaagaaauaucagauugcaguuacuaaggugcucgggaagaauauggaugccaucaucgucgacagcgagaaaaccggaagagauuguauucaauacaucaaggaacagaggggcgaaccugagacauuccugccauuagacuaucuggaggugaaacccacugaugaaaagcuacgcgagcucaaaggugcuaagcugguaauugacguuauacgauacgaaccuccacauaucaaaaaggcccuucaguacgcaugcgggaacgccuuggugugugacaaugucgaggaugcucggcguauugccuuuggaggccaccagagacauaagaccguggcacuggacggcacacucuuccaaaaaucgggggucaucucuggaggugcguccgaucugaaggcuaaagccaggcgcugggacgagaaggcaguggauaaacuuaaggaaaagaaagagcggcugaccgaagaguugaaggaacagaugaaagccaagagaaaagaggcugagcucaggcagguucagucacaagcccacggccugcagaugcgauuaaaguauagucagagcgaccuggaacagacgaagacucgccaccuagcacucaaccugcaagagaaauccaaacuugaaucugaguuggcuaauuuugggccgcggaucaacgauauuaaaagaauaauccagagcagggaacgugagaugaaggaccugaaagagaagaugaaucagguggaagaugagguauucgaagaguucugccgcgaaauuggaguccggaacaucagagaguuugaggaagagaaggugaaaaggcaaaaugaaauugccaagaaacgacucgaguucgagaaccagaagacacggcugggcauccaguuagacuuugagaaaaaucagcugaaggaagaucaagacaagguucauaugugggaacagaccgugaaaaaggaugagaacgaaauagagaaacuuaagaaagaggaacagcgccacaugaagaucauugacgagacuauggcgcaguugcaagaccucaaaaaucagcaucuggccaagaagucagaagucaacgauaaaaaccacgagauggaagagaucagaaagaaacuagguggggcuaauaaggagaugacacaucugcagaaagaagugaccgcaauugagacgaagcucgaacagaagaggagugaccggcacaaccugcuucaagccuguaaaaugcaggauaucaaguugccccuguccaaaggcaccauggacgauauaagccaggaggaaggaucuucacagggcgaggacaguguaagcgggucccaacgaauuucuucgaucuacgcuagagaggccuuaauugaaaucgauuauggagaccucugcgaggaucugaaggacgcacaggcggaagaggagauaaaacaggaaaugaauacacuucaacagaagcugaacgagcagcagagcguguugcaacgcaucgccgcuccuaauaugaaggccauggaaaaacucgaguccguuagggauaaguuccaggaaacuucagacgaguuugaggcagcucguaaacgggccaagaaagcaaagcaggccuucgaacagauuaagaaagagagauuugauagguucaacgcuuguuuugaaagugucgcgaccaauaucgacgagauuuacaaggcccugucucgcaacagcuccgcacaggcuuuccuagguccagaaaaucccgaggagccuuaucuggacggcaucaacuacaauugcguggccccagggaaacgauuuagacccauggauaaccucucaggaggcgaaaagacaguggccgcucuggcacuuuuguucgccauacacagcuauaaaccggcgccuuucuucguccuggacgagauugaugcugccuuagacaauacuaacaucgguaagguugcaaauuacaucaaagaacaaucuaccuguaacuuccaggccauugugaucucccucaaggaggaauuuuacacaaaggcugagagucugauugggguguaucccgagcagggcgauugcguaauaagcaaaguccuuaccuucgaccugacuaaguacccagaugcaaacccuaaucccaacgaacaauga

SEQ ID NO: 62908 - RNA, 3486 nt, Artificial Sequence
  derived and/or modified sequence opt3 from SMC1B__Homo_sapiens__NP_001278430
auggcccaccuggagcuccuucugguggaaaacuucaagagcuggagaggcaggcaggucaucgggcccuuucggcgcuuuaccugcauuauaggaccuaaugguuccggcaaaucuaacguuauggacgcuuugucauucgugaugggggagaagaucgcaaauuuacgagugaaaaacauucaagaacugauccauggagcccacauuggcaagccaaucaguagcuccgcgucuguaaaaauaaucuacgucgaggaaucgggugaggagaagacauucgcucguauuaucagagggggauguucagaauuuagguucaaugauaaccuagugagccggaguguuuauauugccgagcucgaaaagaucggcauaauugugaaagcacagaauugccuggucuuucagggcacuguggaguccaucucuguaaagaaaccgaaggagcgcacgcaguucuuugaagagauuagcaccuccggggaacuuaucggagaguacgaagagaaaaagagaaagcugcaaaaagccgaggaagacgcucaguucaacuuuaauaagaaaaagaacaucgcagccgagaggcggcaggcuaaauuggaaaaggaggaagccgagcgcuaucagucacuccuggaggaacugaaaaugaauaagauucaacuccaguuauuccagcuguaccauaacgagaagaaaauacaccuuuugaauacaaagcuggaacauguuaaccgagaucuaagugugaaaagagagagccucucucaccacgaaaauaucgucaaggcgaggaaaaaggagcaugguaugcugacucggcagcuucaacagaccgagaaggaacugaaauccguggagacauugcucaaccagaagcguccccaauauauuaaagcaaaggaaaacaccucacaccaucugaaaaaguuagacguggccaagaaaagcaucaaggauagugagaaacaguguucuaagcaggaggacgauauaaaagcucuggaaacugagcucgccgaccuugaugcagcuuggcgcuccuuugaaaagcagauugaggaagagauccugcacaagaaaagagacaucgaguuggaagccagccaacuagauagguacaaggagcugaaagaacagguccggaagaaaguugcgacaaugacccagcagcucgagaagcugcaaugggaacagaaaacggacgaggagcgacuugccuucgaaaagcgcagacacggcgaggugcaggggaaucugaagcagauuaaagaacaaaucgaggaucauaagaaaaggauugaaaaguuggaggaguauacuaaaaccugcauggacugucucaaggaaaagaaacagcaggaggaaacacugguagacgagauagagaagacuaaaucgcggaugucugaagugaacgaggaauuaaaucugauccgcuccgagcuacagaacgcaggaauugauacccacgaaggcaagagacaacagaaaagggcugagguccucgagcaucugaagcgucuuuacccugacucaguguucggucgguuguuugaucugugccacccaauccauaagaaauaccagcucgccguuacaaagguguucgggcgauuuaucaccgcuauugucguggccagugaaaaaguagcaaaggacuguauaagauuccugaaagaggaaagggccgagcccgaaacguuucuugcucuggauuauuuggacaucaagccuauuaaugagcgccuccgggagcugaagggaugcaaaaugguuaucgaugugauuaagacucaauucccacagcugaaaaaggucauccaguuuguguguggcaacggcuuagucugcgaaacaauggaggaagcgagacacauagcacuaagcgggcccgagaggcagaaaaccguggcccucgacggaacucuguuccuuaaguccgguguuaucucuggcgggagcucagauuugaaauacaaggcucgcuguugggacgaaaaggagcugaaaaaucuccgagaucggcguagucaaaagauucaggagcugaaaggauuaaugaagacacugagaaaagaaaccgaccuuaagcagauccagacguugauucaaggcacccagacaaggcucaaguauucccagaacgagcuggaaaugaucaaaaagaaacaccuaguggccuuuuaccaggagcaaagccagcugcagucugagcuccugaauauagaaucacaaugcauuaugcuuagugaggguaucaaggaacgccagcggagaauuaaagaguuccaggaaaagaucgacaagguagaggaugacauauuucagcauuucugcgaggaaaucggggucgagaacauuagggaauuugagaauaaacacgugaagcgacaacaggaaaucgaucagaaacgcuuggaguucgagaagcagaaaacucggcugaacguucaauuagaauauagcagaucccaucucaagaagaaacugaauaagauuaacacccuuaaagagacaauccagaagggcucugaagacauagaucaccugaaaaaggcagaggaaaauuguuugcagacugugaacgagcucauggccaagcagcaacagcugaaagacauuagggucacccagaacucgagcgcugagaaggugcagacacaaaucgaagaggaacguaaaaaguuccuagccguagaucgcgaggugggaaaacugcagaaggagguugucuccauccagaccucacucgaacaaaaacggcuggagaagcacaaucuuuugcuggacugcaaggugcaggauauugaaaucauuuuacucaguggcucucuggacgauauaaucgagguggaaauggggacugaggcagagagcacgcaggcgacaauugacaucuacgaaaaagaggaggcuuuugagauugauuauuccucacuuaaggaagaccugaaagcccuacagagcgaccaagagaucgaggcacaucucagacuguugcugcagcaggucgccucucaggaagauauauuacucaagaccgcugccccuaaccugagggcacuugagaaucugaaaacuguucgagacaaguuccaagaauccaccgaugcuuuugaggccagucggaaggaagcgcgcuuguguagacaggaguucgaacaggugaaaaagaggcgguacgaccucuuuacacagugcuucgaacacgugagcaucucuauugaucaaaucuacaaaaagcugugucgaaacaauuccgcccagguaucaaguuauauuaaagagcagacccaagaccaguuucagaugaucgucauaagccuaaaggaagaguucuacucgagagcugaugcacugauuggaaucuauccagaguacgacgauugcauguuuucccgcgugcuuacucucgaccugucucaguauccggauacagaaggucaagagagcucaaagaggcauggcgaaagucguuga

SEQ ID NO: 62909 - RNA, 3594 nt, Artificial Sequence
  derived and/or modified sequence opt3 from SMC2__Homo_sapiens__XP_011516451
augcacaucaagagcauuauacuggagggcuucaaauccuacgcccagagaaccgaagugaacggguuugacccccucuucaaugcuaucacaggacuuaacgguucuggcaagucaaauauucuggauaguaucugcuuuuuguuagggauuagcaaccugucccaagucagggcaucuaaucuacaggaccucguuuauaaaaacggacaggccggcaucacuaaggcgucggugucaauaacguucgauaauagcgacaaaaagcagaguccucuggguuuugagguacaugaugaaaucaccgugacacggcaagucgugauugggggacgcaacaaguaccuuaucaauggcguuaacgcuaauaacacucgagugcaggaccuguucuguuccgucggcuugaaugugaacaauccacacuuucucauuaugcaggggcguaucaccaaaguacugaacaugaagccgcccgagauacugucuaugauugaagaggccgcaggaacaagaauguaugaguacaaaaagaucgccgcucagaaaaccauugaaaagaaggaggcaaaacucaaggaaaucaaaacuaucuuagaggaggaaauuacaccuaccauacaaaagcugaaagaggaaaggagcuccuaucuugaguaccagaagguuaugcgggaaaucgagcauuugucacgccuguauauugccuaccaguuccuacucgcugaggauacgaaagugagaagugccgaagaacugaaggaaaugcaggacaaggucaucaaacuucaagaggaacugagcgagaacgauaagaaaauaaaggcguugaaucacgagauugaagaacucgaaaagaggaaggacaaggagacugguggcauccugcggucuuuagaagaugcacuggccgaggcucagcgcgugaacaccaaaucccagucagccuuugaccucaagaaaaagaaucuugcaugcgaggaaagcaaacgaaaggagcuggaaaagaacaugguggaggauaguaaaacauuggcugccaaggagaaagaagucaagaaaaucacugacgggcuacaugcgcugcaagaggccucuaauaaggacgcagaagcucucgccgcugcccagcagcacuucaacgcaguuuccgccggacugagcucgaaugaggauggcgcugaagcgacccuugcaggucagaugauggccuguaagaacgacauuucuaaagcucaaacagaggccaagcaggcacagaugaaacugaagcacgcccagcaagaguugaaaaauaagcaggcugaagugaaaaagauggauuccggguacagaaaggaccaggaggcccucgaagcaguaaaaaggcugaaggagaaauuagaagcggagaugaagaaacugaacuaugaggaaaauaaggaggaaucacuacucgagaagcggcgucagcugagucgcgauaucggaagacuuaaagaaaccuacgaggcuuugcuggccagguuuccaaaccuccgguucgcauauaaggaccccgagaaaaauuggaaccgaaauugcgugaagggccuggucgccagccuuauuuccgugaaagauacgucugcuacuacagcccuggaauugguugcaggcgagcgccucuacaacguggucguggacaccgaaguaacugggaagaagcuguuagagagaggagagcugaaaaggcgguauacaauaaucccucuaaacaagauuagcgcucgcuguaucgccccagaaacccucagaguugcgcaaaaucuggugggucccgauaacguccauguggcccuuucauuggucgaguacaaaccugaacugcagaaggcuauggaguuuguguucggcacgaccuucguuugcgacaauauggauaacgccaaaaagguggcauuugacaagaggaucaugacacguacuguaacccucgggggagacgucuucgauccacacggcacacugagugguggggcucggucccaggccgcaagcauuuuaacuaaauuucaggaacugaaggacgugcaagaugagcuucgaauaaaagagaaugaauugagagcgcucgaggaggagcuggccggccuaaagaacaccgcugaaaaauauaggcagcugaagcagcaaugggagaugaaaacagaggaagccgaccuccugcagaccaaacuucagcagucuucauaccauaagcaacaggaggaauuggaugcacugaaaaagacuaucgaggaaagugaggagacgcuuaaaaauacaaaggaaauucagcgcaaagcugaggaaaaguacgagguucucgagaacaagaugaaaaaugccgaagcagagcgggaaagagagcugaaggacgcccagaaaaaguuagauugugcuaaaaccaaggcggacgccagcuccaagaaaaugaaggaaaaacaacaggagguggaggcaaucacucuggaauuggaggaacucaagagggagcacaccucuuauaaacagcagcuggaagcugucaacgaggccauuaagucguacgagagccaaaucgaagugauggccgcugagguagcaaagaauaaagaauccgugaacaaggcccaggaggaaguuacaaaacagaaggaggucauaaccgcgcaagauacugugaucaaagcuaaguaugccgagguggcaaagcacaaagaacagaauaacgacucacagcuaaagauuaaagagcuggaucauaauaucaguaagcacaaacgcgaagccgaggacggagcugcaaaggucucuaaaaugcucaaggauuacgacuggauuaacgccgagcgacaucuguucggccagccgaacagcgcguaugacuuuaagacaaauaaccccaaagaagcugggcaacggcuucagaaguugcaggagaugaaagaaaagcugggacguaauguuaacaugagagccaugaauguguuaacggaggcagaagagagguacaacgaucucaugaaaaagaagcgcaucguggagaaugacaaauccaagauacugaccacuauugaagaucuugaccagaaaaagaaccaagcccugaauaucgcuuggcagaaaguaaacaaggauuucgguucaauuuuuagcacacuacucccuggcgccaaugcaaugcuggcuccacccgaggggcagaccgucuuggacggacuggaguucaagguggccuuaggcaacacauggaaagagaaucucacugaacugucuggugggcagcggucccuuguugcgcugaguuugauccucagcaugcugcuauuuaagccugccccaauauauauccuggaugagguggacgcagcucuugaucucucucacacccaaaacauuggccagaugcugagaacgcauuucacccacucccaguuuaucgucgugucauugaaagagggaauguucaauaacgccaacguucuguuuaagacaaaauucguggacggcguaaguacugucgcuagguucacccagugccaaaaugggaagauuagcaaggaagcaaaaucgaaggccaaacccccgaagggagcccacguggagguguga

SEQ ID NO: 62910 - RNA, 3654 nt, Artificial Sequence
  derived and/or modified sequence opt3 from SMC3__Homo_sapiens__NP_005436
auguacaucaaacaggugauuauacaaggcuucagaagcuauagggaccagaccaucgucgaucccuuuuccucuaaacacaacguuauuguggggcggaauggaucagguaagaguaacuucuuuuacgccauccaguucguacugagcgacgaguuuucccaucuccgcccugaacagcgacuugcucuguugcacgagggcacagggccacgugugauuucugcauucgucgaaaucauauuugauaauucggacaacagauuaccgaucgauaaagaggaagugucacugaggcggguuauuggagccaagaaagaccaauauuuccuagauaagaagauggugacuaaaaaugacgucaugaaccuccuggagagcgcgggcuuuagucgcuccaaucccuacuauaucgugaagcaggguaaaauuaaccagauggcuacggccccugauucucagagacuuaagcuguugagggagguagcagggacccggguuuacgacgaacgcaaagaggaaagcaucucccucaugaaggagacagagggaaagcgagagaaaauaaaugagcugcugaaguauauugaagagagacuccauacuuuagaagaggagaaagaagaacuggcccaauaccagaagugggauaaaaugaggcgggcucuugaauacaccaucuauaaccaggaguugaaugaaacacgugcaaagcuggacgagcuaucagccaaacgcgagaccaguggcgaaaagagcagacagcucagggaugcucaacaggacgcccgggacaagauggaggauauugaacgacaggugcgcgagcugaaaacuaagaucucugcgaugaaagaagagaaggagcaacuuuccgcagaaagacaggagcagaucaaacagaggacaaagcuggaauugaaggccaaagaccuccaagaugagcuggcuggcaacucagagcagcggaagcgcuuacugaaagaaagacagaagcuccuugagaaaauugaagagaagcagaaggaacuggccgagaccgagccaaaauucaauagcgucaaggaaaaagaggaaagggggauagcacguuuggcucaagccacgcaggagcggacugaccuauacgcgaagcagggacgagguagucaguuuaccucuaaagaagagagagauaaguggaucaagaaagagcugaagucccucgaccaagccauuaacgauaaaaagaggcagaucgcagcuauacacaaagaccuggaagauacagaggccaauaaggagaaaaaccuugagcaguauaacaagcuggaccaggauuugaaugaagugaaggcucgcguggaggagcucgaccggaaauacuaugaagucaagaacaaaaaggacgagcugcaaagcgaaagaaauuacuuauggagggaggagaacgccgaacagcaggcacuggccgcuaaacgcgaggaucuagaaaagaagcaacagcuccugcgagcggcaacuggcaaagccauucuuaaugggaucgacucgaucaacaagguuuuggaucauuuccggcguaaaggaauuaaucagcacgugcagaacggcuaucacgguaucguaaugaauaacuuugagugcgaacccgcuuucuacaccuguguggaggucacagccgggaauagacuguucuaccauauuguggacucugaugagguuuccaccaagauacucauggaauuuaacaaaaugaaucugccuggagaggugacguuccuuccacugaacaaguuggacgucagggauacugcauaucccgaaacaaaugacgccaucccuaugauuucaaagcuccgcuacaacccacgguuugauaaggcuuucaagcacguguuuggcaaaacccugaucugcagaaguauggagguaagcacucaauuagccagggcauucacaauggacuguaucacccuggaaggcgaucagguuucccaucgaggggcgcuaacgggagguuauuacgacacccgcaagucucggcucgagcugcagaaagaugugagaaaggcugaggaagaacuuggcgaauuggaggccaagcugaacgaaaaucucaggcguaacauugagcgcauaaauaacgagaucgaccagcugaugaaucaaaugcagcagauugaaacacagcaacggaaauuuaaggcaagcagagacucaaucuuaagugagaugaaaaugcugaaggagaaaaggcagcaguccgaaaagacuuucaugccgaaacaacgaagccuucagucuuuggaggccucacuccacgcuauggaaaguacccgggagagccugaaggccgaacuagggacagaucugcucucccagcugucucuugaggaccagaagcgcgucgaugcauugaacgacgaaauuagacaacugcagcaggagaauaggcaguuacucaacgagcggaucaaacuggaaggaauaaucacucgaguggagaccuaucuuaaugaaaaccugagaaagcgcuuggaucaagucgagcaggaacucaaugagcugagggagacagaaggcgguaccgugcuaacugcuacgacaucggagcuggaagccauuaacaaacguguuaaggacaccauggcgcggagcgaggaucucgacaauuccaucgauaaaacugaagccgggauuaaggagcugcagaagucaauggagagauggaaaaacauggaaaaggagcacauggacgcuaucaaucaugauaccaaagaacuugagaagaugacaaacaggcagggcauguugcugaaaaagaaggaggaaugcaugaaaaagauacgcgaguuaggaagucucccccaagaagcauuugagaaauaccagacccugucucuuaagcagcuguuccgaaaacuagaacaguguaacacugagcucaagaaguauagccacgugaauaaaaaggcccuggaccaauuuguaaacuucuccgagcagaaagaaaaguugauuaaaagacaggaggaacuggaucggggcuacaagucaaucauggaguuaaugaauguccucgaacugaggaaguacgaggcuauucaacuuacauuuaaacaggugagcaagaacuucucugagguuuuccagaaacuggugccugggggaaaggccacguuggucaugaaaaagggugacguggaaggcucccagagucaagacgagggggaaggaagcggcgagucugaacgcgguuccgggucacagaguagcguaccaucgguggaucaguuuaccggcguuggaauccgugucuccuucacuggcaaacagggggagaugagagagaugcaacagcucucuggaggucaaaagagccugguggcacuagcgcugauauuugccauccagaagugcgaccccgcuccuuucuaucuuuuugaugaaauugaccaggcccucgaugcacagcaucggaaagcugugucagacaugaucauggagcuggccguccacgcacaguucauuacaaccacauuuaggccagaauugcuggagagugccgauaaguucuacggcguuaaauuucgcaauaaggugucccauaucgacgugauaacugcugagauggcgaaagauuucguagaagacgauaccacgcacggguga

SEQ ID NO: 62911 - RNA, 3867 nt, Artificial Sequence
  derived and/or modified sequence opt3 from SMC4__Homo_sapiens__NP_005487
augcccagaaagggcacccagccuagcacagccaggcggcgcgaggaagggccaccgcccccuuccccagacggagcuucuucagaugcagagcccgaaccuccaaguggucgaacugagagccccgccacggcggcugaaaccgccuccgaggagcuggacaaccguucucucgaagagauccuuaauucgauuccuccaccgcccccuccagcaaugacaaacgaagccggcgcucccagacugaugauaacucacaucgugaaucaaaacuucaaaucauacgcaggggagaagauuuugggaccuuuucauaaaagguucagcugcaucauuggcccaaaugguagugggaaguccaacgucaucgauucuauguuauuuguuuucggauaucgggcccagaaaauacgcagcaagaagcuguccgugcuaauccacaauucagacgagcauaaagauauucagaguuguaccguagaagugcacuuucagaagaucauugacaaagagggcgaugacuacgaagucauccccaacagcaauuucuaugugucuagaacagcuugcagggauaacaccuccguuuaccauauaucaggcaagaaaaagacuuuuaaggacguggggaaucuccugcggagccacggaauugaucuugaccacaaccgcuuccugaucuugcaaggugaggucgaacagauugccaugaugaaaccgaagggccagacagagcaugaugaggggaugcucgaauaucuggaggacaucaucggauguggccgacugaaugaaccuauuaaagugcucugcagaaggguagagauauuaaacgaacaccggggugagaagcugaaucguguuaaaaugguggagaaggaaaaagacgcgcuugagggggaaaagaacaucgcaauugaguuuuugacccuggaaaacgagaucuuccgcaagaaaaaucaugucugucaguacuauauauacgagcuacaaaagagaauugccgaaauggagacgcagaaagaaaagauccacgaggauacuaaagagaucaacgaaaagaguaauauucucucuaacgagaugaaggcuaaaaauaaggacgugaaagauaccgaaaagaaacugaacaagaucacaaaguuuauugaggaaaauaaagagaaguucacucagcuugaccuggaggaugugcaggucagggaaaaauugaagcacgccaccuccaaagcaaagaagcucgagaaacaacugcagaaggacaaagaaaagguugaggaauuuaaaagcauacccgcuaagucgaacaauaucauuaacgagacaaccacgcggaauaacgccuuagagaaagaaaaggagaaggaagagaaaaagcugaaagaagugauggauucucucaagcaggagacucaaggacuucagaaagagaaggaaucccgagagaaggaacugaugggcuucucaaaaaguguaaaugaggcgcgcagcaagauggacguggcccaguccgaguuggauaucuaccuaucuagacauaacacagcagucagccagcugaccaaagcuaaggaagcccucaucgcugccucagagacucugaaagaaaggaaggcagccauucgggacauagagggcaaacuuccacaaacagaacaggagcugaaggagaaggaaaaagaguugcagaagcucacccaggaagagacgaauuucaaaagucuggugcacgauuuauuucaaaagguugaagaggcuaaguccagccuggcgaugaaccgcucuagagggaaagugcuagacgcaaucauucaggagaagaaaucaggaaggaucccugguauuuauggccgucucggggaccugggagccaucgaugaaaaguacgacgucgcuauaaguagcugcugucaugcccuugauuauaucgugguagacuccauugauaucgcacaggagugcguuaacuucuugaaacggcagaauauuggcguggccaccuuuaucggucuggacaagauggcugucugggccaaaaagaugacagaaauacaaacucccgagaacaccccacgacucuucgaucuggugaaggucaaagacgaaaagauuagacaggcauuuuacuucgcgcuuagggauacacugguggcugacaauuuggaucaggccacucgcguugcauaucagaaagaccggagauggagggugguaacccuccaagggcagaucauugagcagucuggcacaaugaccggaggcgggucgaaggucaugaaaggacgcauggguagcucccuggugaucgagauaucagaagaggaaguuaacaagauggagagucaauuacagaaugauucuaagaaagccaugcagauccaggagcaaaaggugcagcuggaggaacgagucgugaaacuacggcacagcgaacgugagaugagaaacacucucgaaaaguuuacggcuuccauucagaggcugaucgagcaggaggaauaccuuaauguacaagugaaagaguuggaagccaacguucuggcaacagcucccgacaagaagaaacagaagcuccuggaggaaaaugucucagccuucaaaaccgaguaugacgcgguggccgagaaggcuggcaaaguggaagcagaggucaagcgcuuacauaacacuauuguugaaaucaauaaccacaagcugaaagcccagcaggauaaacuugacaagauaaauaagcaauuggaugagugugcuagcgccauuaccaaagcacagguggcgaucaagacagccgaccggaaccuccagaaggcucaagauucugugcugagaaccgaaaaagagaucaaggacacugagaaagaaguagaugaccuaacagccgagcugaagucccucgaagauaaagcagcugaggucgugaagaauacgaacgccgcagaggaaagucugccugagauucagaaagaacacaggaaccuuuugcaggagcugaagguuauccaggaaaaugagcaugccuuacaaaaggacgcucucagcauuaaacugaaacuugagcagauagaugggcacaucgcggaacauaacucuaagauuaaguacuggcacaaagagaucuccaagauuucacugcacccaaucgaagacaauccgauagaggaaaucaguguguugagccccgaggaucucgaggccauuaagaacccugacucgaucaccaaucagauugcacugcuagaagcucgaugccaugagaugaaaccaaaccugggagccaucgccgaauacaagaaaaaggaggaacucuaucugcagcgcgucgcugagcuugacaaaauaacuuacgagcgggauuccuuuagacaagcauaugaagacuugaggaagcagcgucugaaugaguucauggccggcuuuuacauuaucacaaacaaguuaaaagaaaauuaucagaugcucacccuggguggggaugcggagcuugagcugguggacucucuagaucccuucagcgaaggcaucauguuuucaguucgcccuccaaagaaaaguuggaagaaaauuuucaaccucuccggaggcgagaagacacugucuagcuuggcucugguguucgccuuacaccauuacaagcccacuccgcucuauuuuauggacgaaauagaugcagcccuggacuucaaaaauguauccaucgucgcuuuuuacauuuacgagcagaccaagaacgcacaauucaucauuaucucacuucggaauaacauguuugaaauaagcgauagacugaucgggauuuauaaaacguacaauaucaccaagaguguggccgugaacccuaaagagauugcgucuaagggauuguguuga

SEQ ID NO: 62912 - RNA, 3306 nt, Artificial Sequence
  derived and/or modified sequence opt3 from SMC5__Homo_sapiens__NP_055925
auggccacccccagcaagaaaacauccacuccuucuccacagccgucaaagagagcucugcccagggacccuaguagcgaggugccauccaaacggaagaacucugcaccccaacucccucuucugcagucgucaggcccauucgucgaagggagcaucguucgcauuaguauggagaauuuucugacguacgauauaugcgaagugucccccggaccucacuuaaacaugaucguaggugccaauggcaccgggaaaucuagcauugugugugcgaucugccugggacuagcuggcaagccagccuucaugggucgagcagacaaggucggguuuuucgugaaacguggauguuccagaggcaugguugagauugaacucuuuagggccucaggcaaccuggugaucacacgggagauagaugucgcuaagaaucagaguuucugguuuaucaacaaaaagagcacuacccagaaaauuguggaggaaaagguagcagcccuuaauauccaaguugggaaccugugccaguucuugccgcaggacaaggugggagaguuugcuaaacucucuaagauugaacugcuggaggccacagagaaauccaucggucccccugaaaugcauaaguaucacugugagcucaaaaauuuacgcgaaaaggagaaacagcuggaaaccucaugcaaggagaagacugaguaccuucagaaaaugguccaaagaaacgaaagguauaagcaggauguggagcgguucuacgaacgcaaacgacauuuggaccugauagagaugcuagaagcgaagagaccauggguggaguaugagaaugucaggcaggaauacgaggaaguuaaacucgugcgggaucguguaaaggaggaagugcgcaagcugaaagagggccaaauucccgucacauguagaaucgaggaaauggagaacgaaaggcacaaucuugaggcacggauuaaggagaaagccaccgacaucaaggaagcuagccagaaaugcaagcagaagcaagaugugaucgagcgaaaagacaagcauauugaagaguugcagcaggccuugauaguuaaacagaacgaagaacucgaucgccaaagaaggaucgggaauacgcggaagaugauugaggaccugcagaacgaauuaaaaacuaccgagaacugugaaaaucugcagccucagaucgaugcaauaacaaacgaccuccgccggauucaagacgagaaggcucuuugcgaaggagagaucaucgauaagaggcgugagcgggaaacucuggagaaagaaaagaaaaguguggacgaucacauuguccgauuugacaauuugaugaaccagaaggaggauaaacuaagacagagguuccgcgacaccuaugaugccgugcuguggcuccggaauaacagagacaaguuuaaacagaggguaugugaaccaaucaugcugacaauuaauaugaaggauaacaagaaugcgaaauacauagagaaccacauccccucuaaugaccuucgcgccuucguuuucgagucccaagaagauauggagguguuucugaaggaaguccgagacaacaaaaaguugcgggugaaugcagucauugcuccgaaaagcucguacgccgacaaggcuccuucucguucccucaacgagcugaagcaguauggcuucuuuucauacuuaagagagcuguucgaugcccccgacccagugaugaguuaucuaugcugccaguaccauauccacgaaguuccuguggguaccgagaaaacgagggaacgcaucgagcggguaauucaggaaacuagacucaagcaaauauauacagcagaggagaaauacgucgugaagaccagcuuuuauuccaauaaaguuaucucuagcaacacuucacugaagguggcccaguuccuuacagucaccguggauuuggaacagaggcgacaucuggaggaacaacucaaggagauucaccgcaaacugcaggcuguagacagugggcuuaucgcgcugcgggaaacguccaagcacuuggagcauaaagauaacgagcucagacagaagaaaaaggaacuguuagagaggaagaccaaaaagcgucagcuggaacagaaaauuagcucuaagcuaggaucacucaaacugauggagcaagacacauguaaucuugaagaggaggaacgcaaggcaaguacuaaaaucaaggagauaaacgugcagaaggccaaauugguuaccgaacugacaaaucucaucaagauuugcacuagccugcacauccagaaagucgauuuaauucugcaaaacaccacagugaucuccgagaagaauaaacuugagucugacuacauggcugccucgagccaguugcggcucaccgaacagcauuuuauagagcuggaugaaaacagacagaggcuacugcaaaaguguaaggagcucaugaaacgagcaagacaggugugcaaucugggcgccgaacagacucuuccccaagaguaccagacgcaggucccaacaauucccaacggccacaauuccucauugccuaugguuuuccaggaccugccaaacaccuuagaugagaucgacgcucuccugacugaggagcgcaguagagccucuuguuuuaccgggcuuaauccgacaauugugcaagaauauaccaagagggaggaagagaucgagcagcugacugaagaguugaaaggaaagaaaguggaacucgaucaguaccgggagaacauaagccagguaaaggaacgauggcugaauccccuaaaggagcuggucgagaaaaucaacgaaaaguucuccaacuuuuucucaagcaugcaaugcgcgggugagguggaccuccauacagaaaaugaggaggacuaugauaaauacggcauuagaauccgcguuaaguuuaggucuuccacgcagcugcacgaacuuaccccucaccaucagagugggggagagcguagcgugucuacuauguuguaucugauggcauuacaggaacucaaccgguguccauucagagucguggacgagauuaaucaaggcauggaucccaucaacgaaaggcgcguuuucgagauggugguaaauacagcuugcaaagagaacaccucccaguacuuuuucauaacaccuaagcugcuucagaaucugccauauucagaaaagaugacuguccuauuuguguacaacgguccccacaugcucgagccgaauaccuggaaccugaaagccuuccagcgaagacggaggcgcauuacguuuacccaaccuaguuga

SEQ ID NO: 62913 - RNA, 3276 nt, Artificial Sequence
  derived and/or modified sequence opt3 from SMC6__Homo_sapiens__NP_001135758
auggccaagagaaaagaggaaaacuucagcucccccaagaaugcuaaaaggccucggcaggaggaacuggaggacuuugauaaggacggcgaugaagacgagugcaaagggaccacacucacugcagccgaggugggaaucauugaaucuauacaccuuaagaacuucaugugucauucaaugcuggguccauuuaaguucggcaguaaugucaacuuuguuguggggaauaacggaagcggcaaauccgcgguauugacggcuuuaaucgugggucugggcggacgcgccgucgcaaccaaucgagggucuucgcuaaagggcuucgugaaagaugggcaaaacucagccgacauuagcaucacacuccguaauagaggagaugacgcuuuuaaggcaaguguuuacgguaacuccauucugauccagcagcacauaucuaucgauggcagcagguccuauaaacuuaagucagccacugggaguguggucagcacccggaaggaggaacugauugcuaucuuggaccauuucaauauucagguggauaacccgguaucuguucucacacaagagauguccaaacaguuucugcagucaaagaaugagggagacaaauacaaguucuuuaugaaagccacccagcuggaacaaaugaaggaggauuauagcuacaucauggaaacuaaagagcgcacaaaggaacagauacaccagggcgaggagagacucaccgaauuaaagaggcagugcguggagaaagaagagagauuccaaaguauugcgggucugucuacgaugaagacuaaccuugaauccuugaaacaugagauggcaugggccgucgugaaugagaucgaaaagcagcugaacgcuauucgcgacaacaucaaaaucggggaggaccgagccgcaagacuagauaggaagauggaagaacagcaagugcggcucaaugaagcugagcagaaguauaaagacauucaggauaagcuggagaaaauaagcgaagagaccaacgcccgugcgcccgaauguauggcccuuaaggcagacgucguugcuaaaaagcgcgccuacaaugaggcugaggugcuguauaacagaucguugaaugaauacaaggcccucaaaaaggaugacgagcagcugugcaaaaggaucgaagaguuaaagaaaucuacagaucaaucccuggaaccugagcggcucgagcgacagaagaagauuucauggcuuaaagaacgcguaaaggcauuucagaaccaggagaauagugugaaccaagaaaucgagcaguuccagcaggccauagaaaaagacaaggaggagcacggaaaaauuaagagagaggagcuggaugucaaacacgcuuugagcuacaaucaaaggcagcuaaaggaacugaaggacuccaaaacugaucggcucaagcgcuucggcccaaacgugcccgcgcugcuugaggcaaucgacgacgccuauagacagggccauuuuaccuacaaaccuguugggccacugggagcuuguauccacuugagggaucccgaacucgcccuggcaauugagucuugcuuaaagggucugcuacaggccuauuguugccauaaucacgcugacgagcgugugcuccaagcccugaugaaacgguucuaccuuccuggcacaagccgaccaccgaucauugucucagaauuuagaaacgagauauaugaugugaggcaccgcgcagcguaccaucccgacuucccuaccguauugacggcucuggaaaucgauaaugccguuguggcaaacagucucauugacaugcgggggaucgagacuguccugcuuaucaagaauaacuccguggccagagcugucaugcagagccagaagccacccaaaaacuguagggaggccuuuacagcagauggagaccaaguguucgcuggccgcuauuacucuucagaaaauacccgaccuaaguuucugagucgggauguugacagcgagauuuccgauuuggaaaacgagguggaaaauaaaacugcccagauacucaaccugcagcagcacuuaucugcgcuggagaaggacaucaaacauaaugaggaacuacucaagcguugccaacugcacuacaaggagcuuaaaaugaagauucggaaaaacaucucggaaauuagggaguuggaaaauaucgaggagcaucagagcguagauauagccacacuggaagacgaggcucaggaaaacaaguccaaaaugaagauggucgaggaacacauggagcagcaaaaggagaauauggaacaccucaaaucacugaagaucgaggcagaaaacaaauaugacgccauuaaguucaaaaucaaucaguuaagugagcuggcugauccacuuaaggacgaguugaaccucgccgauucugaaguggacaaucagaaacgcgguaagcggcauuacgaggaaaagcagaaagagcaccuggauacccuaaacaagaaaaagagagaacuggacaugaaagagaaggagcucgaagagaagaugagccaagcaaggcagauuugucccgaacgaaucgagguugaaaaauccgcgucaauacuggauaaggagauuaaucgccuucggcagaaaauccaagccgagcaugcuagccacggggacagagaagagauuaugaggcaguaucaggaagcccgugagacguacuuggaucuggacucuaaggugcgcaccuuaaagaaguuuaucaagcuccugggcgaaauaauggagcaccgguucaaaacauaucagcaauuuagaaggugccuuacucugcgaugcaaguuguacuucgauaaccuccugucccagcgggcauauuguggaaaaaugaacuuugaccauaagaaugagacccuaaguaucagcguccagccgggcgaagggaacaaagcugccuucaaugauaugcgcgcacugucuggaggugagagauccuucucaacagugugcuuuauucucagucuguggagcaucgccgaaucgccuuucaggugucuugacgaguuugacguauacauggauauggugaaccggcgaauugcuauggacuugauccugaagauggcggauucccagagauuccgccaauuuauauuacucacuccccagucuaugagcucacugccaaguuccaaacuuauuaggauccugcguaugucugacccugagcggggccagaccacacuacccuucagaccaguuacccaggaagaggaugacgaucaaagguga

SEQ ID NO: 62914 - RNA, 6018 nt, Artificial Sequence
  derived and/or modified sequence opt3 from SMCHD1__Homo_sapiens__NP_056110
auggccgcugcagacggcgggggacccgguggcgccagcguggggaccgaggaagauggaggcggugucgggcacagaacaguuuaccuguucgacaggcgggagaaggaauccgagcucggagaucgcccucuucaggugggcgaacgaucugacuaugcgggcuuucgugcuugcguaugucaaacucuggggaucucaccagaggagaaauucgugauuacgaccacaaguagaaaggaaauaacuugcgauaacuuugacgagaccgucaaagauggagugacauuguacuuacugcagagcguuaaucagcuacuccugaccgccacuaaggaaaggaucgacuuccuuccgcauuaugauacacuggugaaauccgguauguacgaguauuacgcaucugagggccagaaccccuugccuuuugcccucgcugaacugauugacaauucgcugucagcaaccagccggaacaucgggguccgcagaauucaaaucaagcucuuauucgaugagacgcagggaaagccagccguggcuguaauagacaauggcagggguaugacuaguaaacagcugaacaauugggccguuuaucggcuuuccaaguuuacccgccagggggauuucgaaucugaccacagcggauacgugcgacccgucccugugccaagauccuugaacucagacaucaguuacuuuggcgugggcgggaaacaagcggucuucuuuguuggacagagcgcaaggaugauuucuaagcccgccgauucccaggacgugcaugagcugguacuaucaaaagaagauuucgagaagaaggagaaaaauaaggaagcuaucuauagcgguuacauucggaaccguaaaccuagugacucugugcacaucacaaaugaugacgagcgcuuucuccaucaccugauaauugaagagaaggaaaaagauuccuucacugccgucgugaucaccggcguucagccagagcacauucaauaucuuaagaacuacuuccaucuguggacaagacaguuggcacacaucuaucauuacuauauccacgggccgaaaggaaaugagauuaggaccagcaaggaaguggagcccuuuaacaauauagacaucgaaauuucgauguucgagaagggcaaagucccuaagaucgugaaccuccgggaaauacaggaugacaugcaaacgcuguacguaaacacugcugccgauucuuuugaguucaaagcgcacguugagggugacgggguggucgaaggcauuauccgauaccauccauuuuuauaugaccgcgagacauaccccgaugacccuuguuucccauccaagcugaaagaugaagacgaugaggacgauugcuuuauccucgagaaggccgcaagaggaaagaggcccauuuucgaauguuuuuggaauggccggcuuaucccguauaccucaguggaggacuucgauuggugcacuccucccaaaaagcgcgggcuggcuccaauugaauguuacaacagaauaaguggagccuuguuuacaaaugacaaauuccaggucagcaccaacaagcuaacguuuauggaucuggagcucaaacugaaggacaagaauacccuuuucacaaggauccugaacggucaggaacagcguaugaaaauugaucgggaguucgcuuuguggcucaaggacugccacgagaaauaugacaagcaaaucaaauuuacucuguucaagggcgugaucacccgaccugauuuacccuccaagaaacaggggccaugggccacauacgcagccauugaaugggacggaaagauauauaaagcuggccagcugguuaagacuaucaaaacccuaccccucuuuuacgguucuauugugagauucuuucuguacggggaucaugacggcgagguauaugcgacaggaggcgaaguccagaucgcaauggagccucaagcccuuuacgaugaagugaggaccguuccaauugcuaaguuggaccgcacuguggccgagaaagcagucaagaaguauguggaggaugaaauggcccggcugccggacagacucagcguaacguggcccgagggggaugaacugcuuccuaaugaggugaggccagcuggaacacccaucggugcccugcgcauagaaaucuugaacaaaaagggcgaggcaaugcagaaacucccugggaccucacacggaggcaguaagaaacuguuaguugagcugaaggucauucuacauuccagcucugguaauaaggaaaucauuucacacaucagucagcacgggggcaaauggccauacugguucaagaaaauggagaacauacagaagcucggaaauuauacucugaaacuucaagugguguugaacgaaagcaaugcggacaccuacgcuggccgaccccugccguccaaggccauuaaguuuucugucaaagaggggaagccugagaaauucucguuuggacuccuggauuuaccauuccggguuggcgugcccuuuaacaucccucuggaauuccaggacgaguuuggucauacaagccagcuugugaccgauauucagcccguauuggaagcauccgggcucucacugcacuaugaggaaaucacuaagggaccaaauugugucauacguggcgugacagccaaagguccuguuaacaguugccaaggcaagaacuacaaucuaaaggugacgcugcccgggcucaaagaggacucucagauccugaagauuagacuuuugccaggacauccgaggcgccugaaagucaagccugacagcgagaucuuagugauugaaaacggcaccgcuuuccccuuccagguugaggugcucgaugaauccgacaauaucacugcccaaccaaaacugauaguacacuguaaguuuucaggggcacccaaccuuccugucuacgugguggauugcagcucuuccggaacaaguauucugaccggcagcgcuauccagguccagaauaucaaaaaggaccagacauugaaggcccggauugagaucccaucuugcaaagauguugcgcccguggaaaagacuauuaaacuccugccuuccucacacguagccagacuacaaauauucaguguggagggucagaaggcuauccagauuaaacaucaggacgaggucaacuggaucgcaggggauauuaugcacaaucugaucuuucaaauguaugacgaaggagagagggaaauaaacaucaccagcgcccucgcugagaagauuaaggugaauuggacgccggaaaucaacaaagagcaucugcuucagggcuugcugccagauguucaggugcccaccucggucaaggacaugcgauacugucagguguccuuccaagaugaccacguuucuuuagagagcgccuuuacagugcgcccucucccagacgaacccaaacaucugaagugcgagaugaaagguggcaagacuguccagauggggcaggaacuucaaggagagguagugauuaucauaaccgaucaguauggcaaucagauucaggcauucucaccuaguucccugucuagccuauccaucgcggggguuggacucgacucaagcaaccugaagacaacuuuucaagagaauacccagaguaucucugugcggggcauuaaauucauaccgggucccccagggaacaaggauuuguguuuuacguggagagaauucuccgacuuuaucaggguccagcugauuagcggaccucccgccaaauuacuccugaucgauuggccagagcuuaaggaaucgauuccugugaucaauggccgugaccugcagaaccccauaaucguacaauugugcgaucagugggacaacccagcuccggugcagcacgucaaaauuucacucacaaaggccucuaaucugaagcuaaugccuaguaaccagcaacacaaaaccgaugagaagggucgcgcaaaucugggcguuuucuccguguucgcuccccggggggaacauacucuucaggugaaagccaucuacaacaagagcauuaucgagggaccaauaauuaaacucaugauccugcccgacccugagaagccagucagauugaaugugaaguaugauaaagacgcaucuuuucuggccggcggguuauucacagauuuuaugaucagcguuauuuccgaagacgacucaaucauaaagaacauuaaucccgcuaggaucaguaugaaaauguggaagcucagcaccucuggaaaccgaccuccggcgaaugccgagacuuucuccuguaacaaaauuaaggauaaugacaaagaagauggcugcuuuuacuuccgggacaagguaaucccaaacaagguggguaccuauuguauacaguuuggguucaugauggauaaaacaaauauucugaacucagagcaggucaucguggaaguucuucccaaucaaccugugaagcugguccccaaaaucaagccaccuacgcccgcagugaguaacguacgcagcgucgcuuccagaaccuuggugagggaccuccaccugucuauuacugaugacuacgauaaccauacaggaaucgaccuaguuggcaccauuauagccacaaucaaaggcucgaaugaggaggauacugacaccccacuguuuauugggaaggugcggacgcuugaauucccuuuugucaacggaagcgccgagaucaugucacucgugcuggcugaauccaguccgggucgagauucuacagaguacuucaucguuuuugaacccagauugccauuacugagccgcacccucgagccuuauauucugcccuucauguucuacaaugacgugaagaaacagcagcaaauggcagcccuuacuaaggagaaagaccagcugucccagucaauagucauguauaagucuuuguuugaagcgagccagcaacuacugaacgagaugaaaugccagguggaagaggcuaggcucaaggaggcccagcugcguaaugaacuuaagauccacaacauugauaucccaaccacacagcaaguaccucauauugaggcauuacugaaacggaagcucagugaacaggaggaauugaaaaagaaacccagaagguccuguacucugccgaauuacaccaagggcagcggggacgugcucggaaagaucgcccaccuggcucagauagaggaugaccgcgcagccaugguuaucucuuggcaccuugcgucagauauggacugcgucgugacacugacgaccgaugcugcccgaagaauuuaugacgagacucagggccggcaacagguguugccacuagauuccaucuacaaaaagacacugccugacuggaaaaggagucucccccauuuccgcaacgguaaguuauauuuuaaaccaauuggggaucccgucuucgcacgugaccugcuuaccuuuccugacaauguagaacacugugagacuguguucggaaugcugcucggcgauacaaucauauuggacaaccuggaugccgcuaaucauuacagaaaggaaguugugaaaauuacccacugcccgacgcuccugacucgggacggcgauaggauccgcagcaacgggaaguuuggaggucuucagaauaaggcccccccaauggacaaacuacgaggcauggucuucggggcaccugugcccaagcaaugccugauuuugggagagcagaucgauuuacugcagcaguacagaucggcuguuuguaaacucgacucugugaacaaggaucugaauucccaacuugaauaucugcggaccccugacaugaggaaaaagaagcaggagcucgaugagcacgaaaaaaacuugaagcugauagaggaaaaacuaggcaugacaccaauccgcaagugcaaugacagccugagacauucacccaaagucgagaccacugauuguccugugccacccaagaggaugcggcgugaagccacacgccagaaccgaauuaucaccaagacagacguauga

SEQ ID NO: 62915 - RNA, 180 nt, Artificial Sequence
  derived and/or modified sequence opt3 from SMCO4__Homo_sapiens__NP_064564
augagacagcugaagggcaaacccaagaaagagaccagcaaggacaaaaaggaaaggaagcaagccaugcaggaggcucggcagcagaucacaacugugguccucccuacgcuugcaguugugguacuguugauuguggucuucguguacguugccacccgcccaacaauaacugaauga

SEQ ID NO: 62916 - RNA, 351 nt, Artificial Sequence
  derived and/or modified sequence opt3 from SMCP__Homo_sapiens__NP_109588
augugcgaccagaccaagcacagcaaauguugccccgccaagggcaaccaauguugcccuccacagcagaaucaguguugccaauccaaagggaaccaguguugcccgcccaagcagaaucaguguugccaaccuaaaggaucucaguguugcccacccaagcauaaccacugcugucagccuaagccacccugcuguauccaggcuagaugcuguggucuggagacaaaaccugaagugucaccacucaauauggagagugaaccgaacagcccccaaacucaggauaagggcugccagacgcaacagcagccucauuccccacagaaugagucuaggcccucgaaauga

SEQ ID NO: 62917 - RNA, 2463 nt, Artificial Sequence
  derived and/or modified sequence opt3 from SMEK1__Homo_sapiens__NP_001271209
augaccgacacaagaaggcgggugaaggucuacacucugaacgaggaucgccagugggacgaucgaggcacggggcacguuagcuccggauauguggaacgucucaaagguaugucucuucugguaagagccgagucagacggcaguuuguuacuggaaagcaagaucaaucccaacaccgcuuaccaaaaacagcaggauacacuaauugugugguccgaggcagaaaauuaugaccucgcccugucuuuccaggagaaggcggggugcgaugagauaugggagaaaaucugucaaguccagggaaaggacccuucgguggauauuacucaggaccuuguugaugagucagaagaggagagguuugacgauaugagcaguccaggccuggaauugccguccugcgagcucucucggcuggaagagaucgcugaacugguggccagcucccuccccucaccuuuacgcagagagaagcuggcacuugccuuggagaacgaagguuacauuaaaaagcugcuagaacucuuccaugucugugaagaccuggagaauaucgaagggcuucaccaucuguaugagauaaucaaaggaaucuuuuugcucaacaggaccgcucuguucgaggugauguuuagugaagagugcauuauggacguaauuggcuguuuagaauacgauccagcacugagccagccccggaagcaccgcgaguuccucacaaaaaccgccaaguuuaaggaaguuaucccuauaucugacccagagcuuaaacaaaagauucaucagacuuaucgagugcaguacauccaggauaugguccugcccacaccuuccguguucgaggaaaauauguugucaacccuacacagcuuuauuuucuuuaacaaaguggagaucgucggcaugcugcaagaagacgagaaguuccucacggaucuguuugcucagcuuacugacgaggccaccgaugaagagaaaagacaggaacugguuaauuucuugaaggaguucugcgcguuuagucaaacacuccagccacagaacagggacgcauucuuuaaaacucugucuaauauggggaucuuaccggcccuggaagugauucuaggaauggaugacacccagguacgguccgcugccacagauauauucagcuaccucguggaguauaaccccucgaugguccgugaguuugugaugcaagaagcacagcagaaugacgacgauauccugcuuauuaacuugaucauagagcacaugauuugugacaccgauccugaacuggguggcgcuguucagcucauggggcugcuucgcacgcugguggacccagagaauauguuggccacugcgaacaagacagaaaagaccgaguuccucggauuuuucuacaaacauugcaugcacguccugacugcccccuuacuggcaaacacaaccgaggauaagccuucuaaagacgauuuucaaacggcucagcuacucgcccuggugcuugaauugcugaccuucuguguagagcaucacacauaucacaucaagaauuacaucauuaacaaagacauccucagaaggguucugguguuaauggcuuccaagcaugccuuucuggcacuuugcgccuugcgguucaagcgaaaaauuauaggccucaaggaugaauuuuauaaucgcuacaucaugaaaucauuccuguucgagccagucgugaaggcuuuucuaaacaaugguaguagauauaaccugaugaauagcgcgauuaucgaaauguucgaguuuaucagggucgaggacauuaaaucccucacugcacacgugauagaaaacuacuggaaggcccuggaggauguugacuacgugcagaccuucaaggggcuuaaauugcgguuugaacagcaacgcgagagacaggauaaucccaagcuggacucuaugaggagcaucuuacguaaccaucgguaucgaagagacgcuaggacacucgaggaugaagaggaaaugugguucaauacugacgaggaugacauggaagauggagaggccguagucucaccgagugacaaaaccaagaacgaugacgauauuauggacccuaucuccaaauuuauggagcgcaagaagcugaaagaaagcgaggaaaaggaggugcuucugaaaacaaauuugucuggccggcagucacccaguuucaagcucagccuguccucuggcaccaaaacuaaccuaacgucgcagagcuccacaaccaaucugccagggucaccuggaagucccgguucuccaggcagccccggguccccuggaucaguuccaaagaacacuagccaaaccgcagccauuacaaccaaaggcggucucguggggcuggucgauuacccggacgaugacgaagacgaugacgaggaugaggacaaggaagauacucuucccuugucuaagaaagcuaaguuugacuccuga

SEQ ID NO: 62918 - RNA, 2550 nt, Artificial Sequence
  derived and/or modified sequence opt3 from SMEK2__Homo_sapiens__NP_001116436
augagcgacaccagaaggcgggugaaggucuacacacugaacgaggaucgccagugggacgaucgaggcacugggcacguuuccucuacguauguggaggaacucaaaggaaugucacuucugguacgugccgaaagugacgguagcuuguuacuggaguccaagaucaaucccaacaccgcuuaccaaaaacagcaggauacacuaauuguguggucugaagcagagaauuaugaccucgcccugucguuccaggagaaggcgggcugcgaugaaauaugggagaaaaucugucaaguccaggggaaggacccuucaguggaaguuacucaggaucuuauugacgagagcgaggaagagagauuugaagagaugccagaaaccagucaucugaucgauuugccgacaugcgagcucaacaagcuggaggaaauugcugaccuggugaccuccguccucucuagccccaucaggcgggagaaauuagcccuggcacuugaaaaugagggauacauaaagaaauugcugcagcuauuccaagccugugaaaaccucgagaauacugagggccugcaccaucuuuaugaaaucauucgcgguauccuguuuuugaacaaggcuacacucuucgaggugauguuuuccgaugaaugcauuauggacguaguugggugucuggaguacgacccugcauuagcccagccaaaaagacacagggaauuucugaccaagacggcuaaguuuaaagaggugauccccauaacugauucagagcuccggcagaagauucaucagaccuaucgcguccaauacauccaggacauuauccuuccuacaccaaguguguucgaagagaauuuucugagcacuuugaccucuuucaucuuuuucaacaaaguggaaauugucuccaugcuacaggaggaugagaaguuucugucagaaguuuucgcccaacucacagacgaggcgaccgaugacgauaaacgaagagaacuggugaauuucuuuaaggaguucugcgcauuuagccagacgcuucagccccagaacagggacgccuucuuuaaaacucuggcuaaguugggaauacucccugcccuggaaaucguaaugggcauggaugacuuacaagugcggagugcagcuacagauauuuucucuuaccuggucgaguuuuccccaagcauggugcgugaguucguuaugcaggaagcccagcagucggacgacgauauccuacucauaaauguggucauugagcaaaugaucugugacaccgauccggaacugggcggggcggugcagcuuaugggauugcugcgcacucucaucgaccccgagaacaugcuggccacaaccaauaagacggaaaaaucugaguuucuuaacuucuuuuauaaccacugcaugcacguacugaccgcaccuuugcucacaaauacuuccgaggauaagugugaaaaagacuucuuucugaagcauuacagauauucauggaguuucguuugcaccccaagccacucccauucucacagcacacccucaaguuccauuagccaggauaacaucguggguucuaauaaaaacaauacuauuuguccugacaacuaccagaccgcucaauuacuggcccuaauacucgagcugcuuacauucugcgucgaacaccauaccuaucacaucaagaauuacauuaugaacaaggauuugcugaggcgggugcucguccugaugaacucaaaacauacuuucuuagcucugugcgcccuucgauucaugcgcagaaucaucggcuugaaggacgaguuuuauaauagguacauuacgaaagggaaucucuucgaaccagugauaaacgcacugcuagauaauggaacacgguacaaccugcucaauagugccguuaucgagcuguuugaguucauucgcguggaagacaucaagagccuuaccgcucacauuguagagaacuuuuauaaagcguuggaauccaucgaguacguccagacuuucaagggccugaagaccaaauaugagcaggaaaaggauagacagaaccaaaaauuaaauucugugcccucgauacucaggagcaaccguuuucggcgagacgcaaaggcccuggaggaagacgaggaaaugugguucaaugaggaugaggaagaggaagguaaagcuguuguggccccggucgagaagccuaagcccgaagacgauuuuccagacaacuacgagaaauucauggagacaaagaaagcaaaggaauccgaggauaaagaaaaucuuccuaagagaaccucacccgggggauuuaaauucacuuucagucauucugccagcgcugccaacggcacaaauuccaagucagugguagcacagaucccacccgcgacgagcaacgggucuuccaguaagaccacuaaucugccuacaagcgugaccgcuacaaaaggcucuuugguuggacucgucgacuauccagaugacgaggaagaggaugaggaagaggaauccucaccgaggaagcgcccccggcuggguaguuga

SEQ ID NO: 62919 - RNA, 10986 nt, Artificial Sequence
  derived and/or modified sequence opt3 from SMG1__Homo_sapiens__NP_055907
auguccagaagggcccccggcucccggcugucuucagggggagguggcgggggaaccaaguacccucgcaguuggaacgacuggcagccacgaacugauagcgcuuccgcagacccggauaaucucaaauauucuucgucacgugacagaggcgguagcaguuccuacgggcuucaacccucuaacagcgccguggucuccaggcagcggcacgaugacacucgcguucacgcggauauccagaaugacgagaagggaggcuauucagugaacggcgggaguggagaaaauacguacgguagaaaaagccugggccaggaguugaggguaaacaaugugaccucuccugaguucacauccguccaacacgggucacgggcuuuagccacuaaggauaugcgcaaaagccaggagcgaaguaugucuuauuccgacgaaagcagacugucgaaccuacucaggcggauuacccgugaggaugaccgcgauagaaggcuggcaacagugaagcagcuuaaggaguuuauacagcaaccagaaaauaaacugguuuuggugaagcagcucgacaacauccuggccgcuguccaugacgugcugaaugagucuuccaaacucuuacaggaacugcggcaggagggagcaugcugucuuggcuugcugugcgccucacuaaguuacgaggcugaaaagauuuucaaauggaucuuuagcaaguucuccucuagcgccaaggaugagguaaaacuccuguaucuuugugcgaccuacaaggcacuggaaacuguuggugagaaaaaggccuuuucaagugugaugcaauuggucaugacaucccuccagagcauucuggaaaacguggacacccccgaguuacugugcaaaugugugaagugcauccuccuugucgcucgauguuacccucacauauucucuacgaauuuucgcgauacuguugacauccuggugggguggcauauugaucacacccagaaaccaucauugacacaacagguaaguggauggcuacagagccuggagcccuucuggguggccgaccucgcauuuuccacuacccugcuuggccaguuccuggaagauauggaggcuuaugccgaagacuugucucacgucgcgucgggcgagagcguggaugaagacguuccuccaccguccgugucacuccccaagcuggccgcauuacugagagucuuuaguacagugguaaggucuaucggggagcgguucagcccuauucgcggaccacccaucaccgaggcuuacguuacggaugugcuauauagagucaugaggugcgugacugccgcuaaccaagucuuuuucuccgaagccgugcucacagcagccaaugaguguguuggugugcugcuuggcucauuggacccuagcaugaccauacauugcgacaugguaauuacuuacgggcuggaucagcucgaaaacugucagacaugcggaaccgacuauaucauuucuguccugaaccuucugacguugaucguggagcagaucaauaccaagcucccauccaguuucguugaaaaacuguuuauucccagcucuaaguuacuguuccuacguuaccacaaagagaaggagguggucgcuguggcgcaugcaguauaucaagccgugcucucccugaaaaacauaccgguucuugaaacagcuuacaaguugauccugggcgagaugacuugcgcccucaauaaccuguuacacucacugcagcuuccugaagcauguagugagauuaagcacgaggccuuuaaaaaucaugucuucaacguggauaaugcuaaguuuguggucaucuucgacuugagcgcccucaccacaauagguaacgccaaaaauucgcugauugggaugugggcgcuaucccccacuguuuuugcucugcucucuaagaaccugaugaucgugcacagcgaucuugccgugcauuucccagcaauccaguacgccguauuguauacccuguacucacacugcacacggcaugaccacuuuauuaguuccucuuuaagcuccucaagcccuagucucuucgauggcgcugucaucucuaccgugacuacggccaccaagaagcacuuuuccauuauacugaaucuucugggaaucuugcucaagaaagacaaccugaaucaggauacccgaaagcuacugaugacuugggcacucgaagcugccguucugaugaaaaagagcgagaccuaugcgccccuuuucucguugccaucauuucauaaauucuguaagggccuguuagccaacacacucguggaagacgucaauauuugccugcaggcuuguucuagucuucacgcacuguccagcucucuacccgaugaccuccugcagagaugcguggauguuuguagggugcaguugguacauagcgggacccgcauccggcaggccuucggaaagcuguuaaaauccaucccucucgacgucgugcugucaaacaacaaucacacugagauucaagaaauaagucuugcucugagaagccacaugucuaaggccccauccaacacauuucauccgcaggacuucucagaugugaucaguuuuauuuuguacgguaauagccacaggacgggcaaagacaacuggcucgagcgccuguucuauuccugccagcgacuagauaagcgggaccaaucuaccaucccccguaaucugcuuaaaacugaugcaguccucuggcagugggcgauuugggaggccgcucaguuuacaguucugucgaaguugagaaccccucuggggagggcccaggacacauuccaaacuaucgaaggaauaauccgcagcuuagcagcucauacccucaacccagaucaggacgugucacaguggacgaccgccgauaaugacgagggccacgguaacaaucagcugcggcuuguacuguugcuccaauaccuggaaaaccuagagaaacugauguauaaugcauacgaagggugugccaacgcucuuacaagcccaccuaaggugauuagaacauuuuucuacaccaauaggcagacaugccaggauuggcucacucgaauccgccugaguauuaugcgggucggcuuguuagcgggacagccagccgugaccguuagacauggcuuugaccugcucacggagaugaagacaaccucucugagccaagggaacgagcuugaagugacuaucaugauggucguggaggcacugugugaauugcacugccccgaggcuauacagggaauugccguuugguccucaucuaucguggguaaaaaucuacuguggauuaacagcgucgcccagcaagcugaaggcagguucgagaaggcaaguguagaguaucaggaacaccucugcgccaugacagggguggauuguugcaucuccagcuuugacaaaucuguucugacccuugcgaacgcuggacguaauucagccuccccgaagcauaguuuaaacggcgagagccgcaaaacugugcugucgaagccuaccgacucuuccccagaagucauaaauuaccucgguaacaaggcaugugagugcuauaucagcauugccgauugggcugcagugcaggaguggcagaaugccauccacgacuugaaaaagucaacaaguucuacgucccugaaccucaaagcggauuucaauuacauuaagagccugucaaguuuugaaagcgggaaauucguagaguguaccgaacaacuugagcuguugcccggcgaaaacaucaaucuacuggcuggaggcuccaaggagaagauagacaugaaaaagcucuuaccuaacaugcugucucccgauccacgggagcuucagaaaagcauugaagugcagcugcucagauccucagucugcuuggccacugcacugaauccuaucgagcaggaccaaaaguggcagucuaucacagaaaacguugugaaauaucucaagcagaccaguaggauugccaucgggccccugcgacuuucgacacuaacugugagccagucccugccagucuugucuaccuuacaacuguacuguucaagcgcucucgagaauacgguguccaaccggcugaguacagaagauugccuuauuccgcuguucucugaggcccuccgcagcuguaagcagcaugacguuagaccuuggaugcaggcauugagguauaccauguaccagaaucaacugcuagagaaaauaaaggaacagacuguacccauccggucacaccugauggagcucggacuuaccgcugccaaauuugcgcgaaagagaggcaacgugucccuggccacacgcuuauuggcacagugcagugaaguccaacuggguaaaacuaccacagcucaggaucucgugcagcauuucaagaaacugagcacgcaggggcaaguugacgagaaguggggaccagaacuugauauugagaagaccaaacugcucuacacugccggccagucuacacacgcuauggagauguuguccucaugugcaaucagcuuuugcaagucggugaaagccgaauaugccgucgcuaagucuauucugaccuuagcgaaauggauccaggcagaguggaaggaaauaaguggucagcuaaagcaaguguacagggcccagcaccagcagaacuucacuggccuguccacacucagcaaaaauauccuuacccugauugaguugcccucaguaaacacgauggaggaagaguauccucguaucgaauccgagucuacuguccauauuggggugggagaaccagacuuuauccugggccaacucuaccaccugagcaguguucaggcucccgagguggccaaguccugggcagcccuugcuagcugggcguaucggugggggagaaaagucguggacaaugccucucagggagagggcguuaggcuccugccucgcgaaaagucagaggugcaaaacuugcugccggauaccauaacagaagaggaaaaagagcgaauuuacgguaucuuagggcaggcagucugcagaccagcuggaauccaggacgaggauauuacccuacagauaacugaaagugaggacaaugaagaggaugacaugguggauguaaucuggcggcaacugauuuccagcugucccuggcucucugaacuugacgagucggccacagagggcgugaucaagguuuggaggaaggucguggaucgcauuuucucacuguauaaauugagcugcuccgcauacuuuaccuuccugaagcucaacgccggucagaucccucuggacgaagaugacccacgucuucauuuaagucacagaguggagcagucuacagaugacaugauagucauggcuacucugcggcucuugaggcugcuaguaaaacacgccggcgaacugcgccaguaccucgagcaugggcuugagaccacgcccacagcgccuuggcgaggaaucauuccgcaacuguuuagcagauugaaucaccccgaaguguauguucggcaguccaucuguaaccugcucugcaggguggcacaggacucaccacaucugauuuuauacccugccaucgucggcaccauaagucuuucuagcgagucccaggcuucagggaauaaguucagcacugccauucccacccugcucggaaacauccaaggcgaagaacuacuggugucugaaugugagggugggagucccccugcuucccaggauagcaauaaagacgagcccaagucgggauugaacgaagaucaggcaaugaugcaggacugcuauuccaagaucguugauaaacugucuucagccaauccaacaauggugcuccaaguccagaugcuuguggcugagcugcgcagaguaacuguguugugggacgaacuguggcucggcguuuuacugcagcaacacauguacguccuuaggcggauucagcagcuggaggaugaagugaagcgugugcagaacaauaacacccuacgcaaagaggagaagaucgccauaaugcgagaaaaacauacggcacucaugaagccgauugucuuugcgcuggagcacguuagaagcaucacagccgcuccugccgaaacaccacacgagaagugguuccaagacaauuauggugaugcaauugaaaacgcuuuggagaaacugaagacuccacucaaccccgccaaaccuggcaguuccuggaucccauucaaggagauaaugcuuucucugcagcagagggcacagaaacgggccagcuacauuuuacgccuggaagagaucucacccugguuggcugcgaugacaaauaccgaaaucgcccucccuggggagguguccgcaagagacacuguaacaauucauagugugggaggcaccaucacgauucugccgacuaagaccaaaccaaagaagcuacuuuuucuggggagcgauggaaaaucuuaucccuaccucuucaagggccuggaggacuugcaccuggaugaaaggauaaugcaauuucucucaaucgucaacacaauguucgcuaccauuaaucggcaggagacaccucgauuucaugccagacacuacuccgugacuccccuugguacccgcagcgggcugauccaguggguugacggagccacgccauuauucggccuguauaaaagguggcagcaacgggaagcagcuuugcaggcccagaaggcgcaagacucuuaccagacaccucagaaccccggcaucgugccacguccuagugagcucuauuacucgaaaauugggccggcucugaagacugucggacuaucccuugauguaagcagaagggacuggccccugcacgugaugaaggccguucucgaggaacugauggaggcaaccccaccuaauuuguuagccaaagaacuguggucaucuuguacaacccccgaugagugguggcgcgugacucagagcuaugcucgguccaccgcagucaugaguaugguggguuacauaaucggccucggggaccgacaucuugauaacguccugauugacaugacaacgggagaagugguucacaucgauuauaaugugugcuuugagaagggcaaaucacuaagaguaccagaaaaggugccuuucaggaugacucaaaacauugagaccgcccugggugucacagggguugagggaguguuucgccucucuugugaacaggucuugcauaucaugcggagaggccgugagacccugcuuacucugcucgaagcguucguguacgaccccuuaguagauuggacagcuggcggggaggccggauuugcuggugcaguguacggcgggggaggccagcaggcagaaagcaaacaauccaagagggagauggagcgggaaauaacccgcagucuguucagcucccgaguugccgagaucaaggugaauugguuuaaaaacagagacgaaauguuggucgugcugccgaagcucgaugguucucuugacgaguaucugucacuacaggagcagcugacggacgucgaaaaacuccaggggaaguugcuggaggaaauugaguuccuugaaggagcagagggcguggaucacccaagccauacucugcaacacagguacucggagcacacacaguuacagacccaacagcgggcuguucaggaagccauccagguaaaacucaaugaguucgaacaauggauuacccauuaucaggcggccuuuaacaaucuggaggcaacucaguuggcuucccugcuccaggaaaucaguacacaaauggaccuuggcccucccucuuacgugccagccaccgcauuccugcagaacgcugggcaggcccaccuaauaagccagugcgagcaacuggagggagaagucggugcccucuugcagcagcgcagaucagugcugaggggcuguuuagagcagcuucaucacuaugcgacaguugcucugcaauaccccaaggcaauuuuucagaagcaccgaaucgaacaguggaaaacuuggauggaggaacucauuugcaauacgaccguggagcggugccaagagcuguaucguaaguacgaaaugcaguacgccccucagccgcccccaacagucugucaguucaucacugcuaccgagaugacauugcaaagauaugccgcagauauaaacucccgccugaucaggcaaguggaacggcucaaacaggaggccguaaccgugccuguuugcgaggaccagcuuaaggaaauugagagauguaucaaagucuuucugcaugaaaacggggaggaaggaucucuaagucuggcuagcgugauuaucuccgcguuaugcacucucacgcgcaggaaucugaugauggagggcgccgcaucaagcgcuggugagcaauugguggaucuuaccucucgagacggggccugguuccuggaggaacucuguaguauguccggaaacgucacaugccugguucaguugcugaagcagugucaccuagugccccaggaucucgacauaccuaauccaauggaagcaagcgagacuguacaucuugccaacggcguguacaccucacugcaagaauuaaauucuaacuuucggcagauuaucuuccccgaggcucugagaugccucaugaaaggcgaguauacacuggaauccauguugcacgagcuugaugggcugaucgaacagaccacugacggagucccucuccaaacacugguggagucgcuacaggccuacuugaggaaugcggcaaugggucuggaagaggagacgcaugcccacuauauugauguugcucgccuccuucacgcccaguacggcgaacugauccagccacguaacgggagcguggacgagacccccaagaugagugcaggacaaauguuacuggucgcuuuugauggcauguucgcccagguggaaacugcuuuuucucuccugguagagaaguugaauaaaauggagauaccgauugccuggcggaagaucgacauuaucagagaagcaagguccacacagguuaacuucuuugacgaugacaaucaucgccaggugcuugaggaaauauucuuccugaaacgacuccaaaccaucaaggaguuuuuccggcugugugguaccuuuagcaaaacacuaucagggaguuccagcuuagaagaucagaacacugucaauggaccugugcagauugugaacgucaagacgcuguucagaaauucuugcuuuucagaggaccagauggcgaagccaaucaaagccuucaccgcugauuuuguuaggcaauugcucauuggccugcccaaccaggcccuuggccugacacucuguagcuucaucuccgcacuggggguggacauuaucgcucagguagaggccaaggauuuuggagcagaaucuaaagugagugucgacgauuugugcaagaaagccguggagcacaacauacagauugguaaguucucgcaacuuguuaugaaucgcgcgacugugcuggcuagcuccuaugacaccgccuggaagaaacaugaucuagucagacggcucgaaacaucaaucucuagcugcaagaccagucugcagagggugcaguuacacaucgcaauguuucaauggcagcaugaggaccuguugauuaaccguccucaggccauguccguaacuccacccccgcgaucagcuauacucacgucuaugaaaaagaaacugcacacacuuagccagaucgaaaccuccauugccacuguucaagagaagcuggcagcucucgagaguagcaucgaacagcgcuugaagugggccggcggggcgaauccugcucuggcccccgugcuucaggacuucgaggcaaccauugccgaaagacggaaccuggucuuaaaagagucucagagggcuucacaagugacauuucuauguuccaauaucauacacuucgaaagccuccgcacuagaaccgcagaggcccugaaccuggaugcggccuuguucgagcucaucaagcggugccagcagauguguaguuuugcuucucaguucaauuccucgguuagcgaacuggagcuuaggcuguuacaacgaguggacacaggacucgaacauccaauuggcucauccgaguggcuguugucugcacacaaacagcuuacgcaggauaugaguacccaacgugccauccagacugagaaggaacagcagauugagacagucugcgaaaccauccaaaaccugguggacaauauaaaaacuguacuaacaggucauaacagacagcucggggaugugaagcaucugcugaaagcuauggccaaggacgaggaagcagcuuuggccgauggcgaggacgucccuuacgagaauagcguucgccaguuucucggagaauacaagucauggcaggauaacauucaaaccgugcuguucacgcuuguccaggcgaugggccaggugcggucccaggagcacguagaaaugcugcaagagaucacccccacauuaaaagaacucaagacucagagccagucuaucuauaauaaccuggugaguuuugccagcccccuaguuaccgacgcaacaaaugaguguuccucacccacuucuucggcuaccuaccaaccuagcuucgccgcagccgugagguccaacacagggcagaaaacccagccagaugucaugagucagaacgcuagaaaguugauucagaaaaaucuggccacuucugcggacacgccgcccucaacagugccuggaaccgguaagagcguugcuugcuccccaaagaaagcaguccgcgaucccaagacuggcaaagccgugcaggagcggaacaguuaugcugugucuguauggaagagggucaaagccaaacuugaagggcgagacguggacccuaauagacggaugagcguugcagagcaaguggauuacgucauaaaggaagccaccaaccucgacaaucuggcucagcuguaugagggauggacagcguggguguga

SEQ ID NO: 62920 - RNA, 993 nt, Artificial Sequence
  derived and/or modified sequence opt3 from SMG6__Homo_sapiens__NP_001269255
augagauucaggcugugccaccagcggggcuguugcccccaugagcgcgaaaacaccuguacaugcaagaugaucauuagcucccuccaagugauagccgcugacuguaaacgagucacuguucuuaaguacuuucuggaggcauugugcgggcaggaagaaccuuuacuggccuucaaaggagguaaguaugugucuguagcgccagugccggauacgaugggcaaagaaauggggucacaggagggaacccgucuagaggacgaagaggaagaugucgugaucgaggacuuugaggaagauagugaggcugaaggcagcgguggggaggacgauauuagagaacucagggccaagaagcuggcacuugcccggaaaaucgcugagcagcaacgcagacaggagaagauucaggcaguucuggaagaccacucccagaugaggcaaauggaguuggaaauccggccccucuuccuggugccugauacaaauggauuuauagaccaucuggccucucucgcucgcuuacuggagucgcgaaaauacauccuugucgugccauugauuguaaucaacgaacuggauggccuagccaagggccaggagacugaccacagagcagggggauaugcgaggguugugcaggagaaagcccggaagucaauugaguuccucgagcagcguuuugaaagccgcgauaguugucugagagcucuuaccuccagggguaaugagcuggaaucuaucgccuuccggagcgaggacauaacaggccaauuggggaacaaugacgaucucauucuguccugcuguuuacauuacugcaaggacaaagcaaaggauuuuaugcccgcuucaaaagaggaaccuauccgacugcuccgcgaggucgugcuucugaccgacgauagaaacuugagggugaaggcccuaacucggaaugucccaguucgcgacauucccgcguuccugacaugggcccaggugggauga

SEQ ID NO: 62921 - RNA, 2976 nt, Artificial Sequence
  derived and/or modified sequence opt3 from SMG8__Homo_sapiens__NP_060619
auggccggccccgugagccugagagaccuccuuaugggggcuuccgcauggaugggaucugagucaccugguggcaguccaaccgaagggggaggcagcgccgcgggugggccggagcccccuuggagggaagaugagaucugcgucguuggaauuuucggcaagacagcucugcgguugaacuccgaaaaauuuucuuuagugaauacuguaugugaccgccagguguucccacuguuucgacaccaagaucccggcgacccugggccaggaauacguacggaggccggugcagucggcgaggccgggggagcugaagaucccggcgcagccgcuggugggucggugagaggaucaggcgccguugcggagggcaacaggaccgaagcagggagccaggacuacagucuacuccaggccuauuacucccaggagucuaaggugcuguaucuucuguugacaagcaucugcgauaauucccaacuccugcgggcuugucgcgcccugcagucaggagaggccgguggcgggcucaguuuaccucaugcugaagcccacgaguucuggaaacaucaggaaaagcugcagugccuuagcuugcuguaccuauuuucugucugucacauucuccugcuugugcauccaacuugcuccuucgacaucaccuaugauagaguauuuagggcgcuggacggauugcggcaaaaaguucucccgcuguuaaagacagccauuaaggauugucccgugggcaaagacuggaagcugaacugccgcccuuguccaccccgacuccuuuuccuguuucaguugaauggugcacuaaaagucgagccuccaagaaaccaggaucccgcucacccggacaagccuaaaaagcacucacccaagaggcggcugcagcaugcccucgaagaccaaaucuaccguauauuccgcaaaagcagagugcugaccaaucagaguaucaacugccuuuuuacugugccagcuaaucaggccuucgucuauauuguuccugggucucaagaggaggaucccgugggcaugcuguuggaccagcucaggucccacuguacaguaaaggauccagaaagccuguuagugcccgcaccucugucgggaccacggcgauaccaggucaugcgccagcauucuagacaacagcuauccuuucacaucgacucaaguagcuccucuagcucaggccagcucguggauuucacccugagggaguuccuuuggcagcacguugaauuggugcugaguaaaaagggguuugacgauuccgucggacggaacccgcaacccagccauuucgagcucccuacguaccagaaauggauuucugccgcuucaaagcuguaugaaguggcgaucgacgguaaagaggaggaucuuggcaguccaacuggggaacugaccagcaagauauuguccucuauuaagguacucgagggauuucuggacaucgauacaaaauucucggaaaaucgcugccagaaggcauuacccauggcccacagcgcuuaccaguccaaccugccucauaauuauacuaugaccguucacaaaaaccaacuagcccaggcacucagaguguacucacagcaugccaggggcccagcuuuucacaaguaugccaugcagcugcacgaggacugcuacaaauucuggaguaauggucaucaacuuugugaggaacguucuuugacagaccagcacugcguccauaaguuucacagccugcccaaguccggggagaaaccggaagcagaucggaacccuccagugcucuaucacaacucacgagcgagaagcaccggcgcuuguaauugcggaaggaagcaggcaccccgcgacgauccuuucgacauuaaagcagccaacuacgauuuuuaccaacuguuagaggaaaaguguugcggcaaacuggaccauaucaauuuccccgucuuugagccaucuacgccugaucccgcuccagccaagaacgaguccaguccggcaccucccgacagcgaugcugacaaacuuaaggaaaaggagccacagacucagggggaaucuacauccuugucacucgcccugagucuaggacagagcaccgauucgcuggguacuuaucccgcggacccucaagccggcggggauaauccagaggugcacggacagguugaagugaaaacagagaagcggcccaacuucguagacagacaggcuuccaccgucgaguaccucccuggcaugcugcauucuaauuguccgaaaggucuuuugccaaaguuuagcucauggagucuggugaaguuagggcccgcaaaauccuauaacuuccacacgggccucgaccagcaaggauucaucccuggcaccaauuaccugaugccaugggauauuguuauaaggacacgcgccgaagacgagggggaucuugacacuaacucuuggcccgcuccuaauaaggccaucccgggaaaacgaagcgcaguggucaugggccggggucguagaagggaugacauugcgcgcgccuuugugggguucgaauaugaggauucccggggaagaagguuuaugugcucaggccccgacaagguaaugaaagugauggguagcggcccaaaggaaagugcucugaaagccuugaacucugauaugccucucuacauccuguccagcucgcaggggcgaggacuaaagccccauuaugcacagcugaugcgccucuucguugucgugccagacgcuccucugcagauaauucuuaugccccaagugcagccaggcccgccucccuguccagucuuuuaccccgagaagcaggagaucaccuugccuccagaugggcuguggguuuuacgguuccccuacgccuaugugacagaaagaggaccuugcuuuccgccaaaagagaaugugcaacucaugucauacaagguacugaggggcguccuuaaagcagugacucaguga

SEQ ID NO: 62922 - RNA, 225 nt, Artificial Sequence
  derived and/or modified sequence opt3 from SMIM15__Homo_sapiens__NP_001041714
auguucgacaucaaggccugggcugaguacguggucgaaugggcagccaaagaucccuauggcuuucugaccacaguuauucucgcgcuuacuccucuguucuuggcuagcgccguguuauccuggaagcuggcaaaaaugauagaggccagagaaaaggagcagaaaaagaagcagaaaaggcaagaaaacaucgcuaaggcaaaacggcuaaagaaagacuga

SEQ ID NO: 62923 - RNA, 324 nt, Artificial Sequence
  derived and/or modified sequence opt3 from SMIM19__Homo_sapiens__NP_001129148
auggccggcggguacggagugaugggugacgauggcagcaucgacuauaccguccacgaggcuuggaacgaagcaacaaauguuuaccugauugugauacucguauccuucgggcuuuuuauguaugccaagagaaacaaaaggcggaucaugcgcauuuucucugugcccccuacugaggaaacgcugucagagccaaauuuuuacgauaccaucaguaagauucgauugcgucagcaauuagaaauguauagcaucuccagaaaauacgacuaucagcagccgcagaaccaagcggauucuguccagcugucgcuagaguga

SEQ ID NO: 62924 - RNA, 204 nt, Artificial Sequence
  derived and/or modified sequence opt3 from SMIM20__Homo_sapiens__NP_001138904
augagcagaaaccugaggaccgcccucaucuucggcggguuuauuucccuuauaggagcugcauucuaccccaucuauuuucggccucugaugcgcuuggaggaauacaagaaagagcaggccauuaaucgagcggguaucgugcaagaagacguccagccaccgggcuuaaagguuuggucugaucccuucgggcguaaauga

SEQ ID NO: 62925 - RNA, 306 nt, Artificial Sequence
  derived and/or modified sequence opt3 from SMIM21__Homo_sapiens__NP_001032408
auggaccaguacgugagcaccgcucccccuagauucccaaucgcccaacugggcacauuuaagcaggauuccgcagggaugggaaggauuuucaaagguaaccuccuucagaagaaagcccugacuacguuugagaaugaacaccauauacgguucuuuaccuuguuaguccuguuccacguuauggugcuacuccgcaaccauucucgaauccagggcguaucagaggacuggaagcgugcgaauaguauuuuuagaaacuuccugaggcuuaaaagcucccggaauacagcugaagccgaguga

SEQ ID NO: 62926 - RNA, 519 nt, Artificial Sequence
  derived and/or modified sequence opt3 from SMIM23__Homo_sapiens__NP_001276899
auggccacccagcaaguggacagcagaaggcaggucgcugcagagcagguugccgcgcagcugcucgaacggcgccgaggcucccacugcgaugacgagaagcaaacacuucuggcuuuguuaauccuggugcuauaccucucuacugaaauuugggggucaaguugggagguaagcgaacguauaagagaguguaacuauuaccagaaucuggccgugccccagggacuugaguaucagacgaacgaaccuuccgaggaaccaaucaagaccauuaggaauuggcugaaggagaaauugcaugucuucucugagaagcucgaagaggaagugcaacagcuggagcagcuggcaugggaucucgaauuauggcuggacgcccuuuugggugagccgcaccaggaggaacauugcucgacauacaaaucacaccugugggagugggcuugggcacuaggccgggaacauaaagggggagagggccuccuggaaaucagccuuaguggugccgagcuguga

SEQ ID NO: 62927 - RNA, 720 nt, Artificial Sequence
  derived and/or modified sequence opt3 from SMIM5__Homo_sapiens__XP_011523418
augagaaggcuggccggccgggcugggcacagccaggugacccaagacuccaaguucucucccaaaacaccuucagaugcagagcgccauaagggacucccacgagacuggcuucagagucuguuguuaagccugcgugguccgcccgccccucacugccuacuccuguuucuuagagaagcgaggggccgggaucagccaggguccggacagcgcgacagaaggggcggucugcccgaggggcgggucggagcuccugauuugcgcgcccuccaagacucuccaccccaggcacagguugaaccuccacagggcccgcccggccaagaggggcgagaaccuacuucguucuuuucaagccagccaagacccaguccuaggcggggaucccguggugagggcgaggaagaggaagggggaggcgagcgcgagcuggugcugucucucagcuccgccuuaagagcugaagaugaccagcagcaaaaaucacaggcagagacggccgcugguugucagcaaaggaguugggccgaagcgccacgaggggcagccgcucccaccaaggagguacggggacagcauguggaagccccgcgcuggggcacagcagcucagccucccacuccagagcugccuggcgccuggcccacccacugcugguguagccagcuuacagcgcaaccagggucuuccucauugggacccagcagaaccccuuga

SEQ ID NO: 62928 - RNA, 885 nt, Artificial Sequence
  derived and/or modified sequence opt3 from SMN2__Homo_sapiens__NP_059107
auggccaugagcuccggcgggucuggagguggcgugcccgagcaggaagacucaguccuguucagaagggggaccggacaaagugaugacagcgauaucugggacgauacagcucucauuaaggcauacgacaaagccguugcguccuuuaagcacgcucuuaaaaacggcgauauaugcgagacuucugguaagccuaaaacgaccccaaagcggaagccggccaaaaagaauaaaucgcagaagaaaaacacagcagccucacugcagcaguggaaggugggggacaaguguagcgcuaucuggagugaagauggaugcauuuaucccgcaacuaucgccuccauugacuucaaacgcgagaccuguguaguggucuacacaggcuauggcaaucgagaggaacaaaacuugucugauuuacugagcccuaucugcgagguggcuaauaacauagaacagaaugcccaggagaacgaaaaugagucccagguuucaaccgacgagagugaaaacagccguucuccagggaauaaguccgauaacaucaaacccaagucagcgccuuggaauagcuuucuaccacccccuccaccgaugcccggaccuagacucgguccaggcaaacccgggcugaaguucaacggaccuccacccccgccucccccaccucccccacaucuucugaguuguugguugcccccuuuuccaucuggcccgcccauuaucccuccacccccuccaauuugccccgacucccucgacgaugcagacgcccuggguagcaugcugaucucgugguacaugucuggguaucacacuggauacuauaugggcuucaggcaaaaucagaaagagggccgguguucccauucacucaacuga

SEQ ID NO: 62929 - RNA, 1308 nt, Artificial Sequence
  derived and/or modified sequence opt3 from SMOC1__Homo_sapiens__NP_001030024
augcugcccgccagaugcgcuaggcuccuuaccccucaccuguuguuagugcugguccagcuaagcccagcacggggccaucgcacaacugggccgcgauuccucaucuccgaccgugauccccaauguaaccugcacugcucuagaacgcagccuaagccaauuugugccucagacggaaggaguuacgagagcaugugcgaauaucagcgggcgaaaugucgcgaucccacccuugguguugugcauagagggaggugcaaggacgcuggccaguccaaaugucggcuggagcgcgcccaagcauuggaacaggccaagaaaccucaggaggcuguauuugugccagaaugcggagaggauggcucuuucacacagguccaaugucacacuuacaccgguuauugcuggugugugacacccgacgggaagccuauaucgggaucaagcguucagaauaagaccccagugugcaguggcuccgucacugauaaaccgcucucucagggcaacagcgggcgaaaggacgauggauccaaacccacaccuaccauggagacgcagccaguguuugacggugaugaaaucacugcacccacccuguggauuaagcaucugguaaucaaagacucaaagcucaauaacacaaauauuagaaacagugagaagguuuacagcugcgaucaagaaaggcagucugccuuagaggaggcucagcaaaauccucgggaaggcaucgugauaccagagugugcccccgggggacuguauaaaccgguccagugccaccaguccacuggcuacuguuggugcgugcuuguggacaccggucguccuuugcccgggacaucaacccgcuaugucaugccaagcugugaaagugacgcgagagcaaagacgacugaggccgaugacccuuucaaagauagggaacugcccggaugcccagagggcaagaaaauggaguuuaucacaucucuacucgacgcucugaccacugauaugguucaggccauuaacuccgcagcucccacaggcgggggacgguucagcgaaccugacccaucgcacacccuugaggaacgagugguacauugguacuuuucucaacuggauuccaauucaaguaacgacaucaauaagcgcgagaugaaaccguucaagagauacgugaagaaaaaggccaaacccaagaaaugugcgaggcgguuuacggauuauugcgacuugaacaaggauaaggucauuagccucccugaacugaaagguuguuuaggcguguccaaggagguugggcgccugguguga

SEQ ID NO: 62930 - RNA, 1341 nt, Artificial Sequence
  derived and/or modified sequence opt3 from SMOC2__Homo_sapiens__NP_001159884
augcugcucccccagcuuugcuggcugccuuuguuagccggccugcuaccaccggugcccgcucaaaaguucagcgcacucaccuuucugagagucgaccaggauaaagacaaggauuguucccuugacugcgccgggucuccucagaaaccacugugugcgucagauggaaggacauucuugagucggugcgaguuucagcgcgcuaaguguaaagacccccaacucgaaaucgccuaccgagguaacugcaaggauguuagccguuguguggcagagagaaaguauacucaggaacaggccaggaaagaguuccagcaaguauuuauuccugaaugcaaugacgauggcacguacucccaggugcagugucacucuuauaccggguacugcuggugugucacaccaaacggacggcccauaucgggcacugcuguggcacauaagaccccucgcugcccagguucaguuaaugagaaacugccgcagagagaggggacaggaaagaccgacgaugccgcugcccccgcgcuggaaacucaaccucagggcgacgaggaagauaucgcaagcagguauccaacacucuggaccgaacaggugaaaagucggcaaaacaagacgaauaagaacuccgucucuagcugcgaccaggagcaccaguccgccuuagaagaggcuaaacagcccaagaaugacaacgugguaauuccugaaugugcccauggcgggcuguacaaaccaguucaaugccaccccucaacuggauauuguuggugcgugcuugucgauaccggucgcccgaucccuggcacaaguacucgauacgagcagcccaagugugacaauaccgcaagagcucauccagccaaagcgagggauuuguacaaggggcggcagcugcagggaugcccuggcgccaaaaagcacgaguuccuaacaagcgugcucgacgcacugucuaccgauauggugcacgcugccuccgaccccucaagcaguucuggucgucuuuccgagccagaucccagccauacgcuggaggaacgcgucguucacugguauuuuaaguugcucgacaaaaacucgucuggggauauuggaaagaaagagaucaagccuuucaaaagauuucugaggaagaaguccaaaccaaagaaaugugugaagaaauucguagaauacugcgacgugaauaacgauaagucaauaaguguccaagaguuaaugggcugucugggcguggcuaaggaagacgggaaagccgacacuaagaaacggcauacaccgcgaggacacgcagagagcaccuccaaucgccagcccagaaagcaggguuga

SEQ ID NO: 62931 - RNA, 2364 nt, Artificial Sequence
  derived and/or modified sequence opt3 from SMO__Homo_sapiens__NP_005622
auggccgcugcaagacccgccaggggcccugagcugccacuccuugggcuguuguuacugcuacuccugggagacccgggucggggcgcggcuagcuccgggaacgccaccggacccggcccucgcucugccggugggucagcacgacguagugcugcagugacaggaccacccccuccacuuagccacugcggcagagccgcucccugugaaccucugagguacaaugucugcuugggcuccguucucccauauggggccacuucuacgcugcuggcgggagauucggacucacaggaggaagcacaugguaagcucguguuauggagcggccugcggaacgccccgcgcuguugggcuguaauccaaccccuuuugugcgccguguacaugccuaaaugugagaaugauagagucgaacugccaaguaggacccuaugccaggcaacacgggggcccugugcuauuguggagcgcgagcgaggauggccugacuuccucagaugcacuccagauagguuucccgaaggcuguaccaacgagguucagaauauaaaguucaacuccucuggucagugcgaagugccgcugguccggacagacaauccuaaaagcugguaugaggauguggagggguguggaauccaaugccagaacccccuuuuuaccgaagccgagcaccaggacaugcauuccuacauugcggccuucggcgcaguaacuggccugugcacauuguuuacccucgcuacguucguugccgauuggcguaauucaaaccgcuauccagcugugauccuguuuuacgucaaugccuguuucuuuguggggaguauuggaugguuagcacaguucauggacggugccagaagggaaaucgugugccgggcugauggcacuaugcgacugggggagccuaccagcaacgaaacacucucuugugucauaaucuuuguuauuguguauuacgcgcuuauggcaggaguagugugguucgucgugcugacuuacgccuggcacaccuccuuuaaggcuuugggcacaaccuaucaaccccuaucagguaaaacgagcuacuuccaucugcucacuuggagucugccauucguucuuacaguggccauccuggcagucgcccagguggacggggauucuguauccggcauuugcuuuguuggauauaagaauuaccgcuauagagcuggcuucguguuggcccccaucgggcucguccugauagugggagguuacuuuuuaauuaggggcgucaugacccuguucagcaucaagucgaaccacccugggcuacucucugagaaagcagcguccaagauuaaugagacuaugcugcggcuuggaaucuuuggcuucuuggcuuuugguuucgugcugaucacauuuucaugucacuucuaugacuuuuucaaccaggccgaaugggagcgcaguuuuagagacuacguucucugccaggcaaacgugaccauugggcugccaacgaaacaaccgauacccgauugugaaaucaagaauaggccuagccuucugguagagaaaauuaacuuguucgccauguucggcaccggaaucgcuauguccacaugggucuggacuaaggccacccuccugauauggcgucggacauggugccgauuaacuggccagucugacgaugaaccaaagagaauuaaaaagagcaaaaugaucgcaaaggcuuuuucaaaaaggcaugagcugcuacagaaucccgggcaagagcucaguuucuccaugcacaccgugagccaugacggaccuguugccggucuggcguuugaucuuaacgaaccaucugccgacgugucaagugcuugggcacagcacgucacaaagaugguggcccgccggggcgcuaucuugccccaggauauuagcguaaccccgguggccacuccuguuccacccgaggaacaggcaaaucuguggcucgucgaggcggaaaucuccccugagcugcagaaaagauuagggaggaagaagaaacgccgaaagcggaaaaaggagguguguccccuggccccaccucccgaacuucacccaccggcuccugcccccucuacgauuccacguuugccccaacucccuagacagaaaugccugguggcagcuggagccuggggcgccggugacucguguaggcagggggcauggacccuagucagcaacccauucugccccgagccuuccccgccacaagaucccuuucugccuucagcuccagcgcccguugccugggcacauggccgccggcagggacucggcccuauacacaguagaacaaaucugauggacacugaacuuauggaugcugacucugacuucuga

SEQ ID NO: 62932 - RNA, 1668 nt, Artificial Sequence
  derived and/or modified sequence opt3 from SMOX__Homo_sapiens__NP_787033
augcagagcugcgaguccucuggcgacucagccgaugacccccugaguagagggcucaggcggcgcggacaaccucgaguggucguuaucggugcuggccuugcagggcuggccgcggcuaaggccuuguuagaacagggauucaccgaugugacaguacuggaggcaagcucccacauuggcggucgugugcagucugucaaacuagggcaugccacuuuugaacucggagcuacguggauacacggcucgcauggcaacccaaucuaccaccuggcagaggccaaugggcuucuggaagagaccacagacggagagagaucaguggguaggauuagcuuguauaguaagaacggcguugcuuguuaccucacuaaucaugggcggcgcaucccgaaagauguggucgaagaguucuccgaccuguauaacgaaguguacaaucugacccaggaguuuuucagacacgauaagcccguaaacgccgagucucaaaauagcguuggaguguuuacaagggaagagguccggaaccgcauucgaaaugacccugaugacccagaagcgaccaaaagacucaaguuagcaaugauccagcaguaucugaagguggaguccugcgaaucaaguagccacucuauggaugaggugucccuuucagccuucggcgaguggacugaaauacccggugcucaucacaucauuccuagcggguuuaugagggucguugaguugcuggccgaaggaaucccagcacaugugauucagcuaggcaaacccguacgguguauccacugggaccaagcuagugcccguccucgcggcccagagauagaaccgagaggggagggagaucacaaccaugacacaggugagggcgggcagggaggcgaagaacccaggggugggcggugggacgaagaugagcaguggucuguggucguggaaugcgaggacugugagcucauuccugcggaucacguuaucgugaccgucucccugggcgugcuuaagcgacaguacacgagcuucuuucgcccaggacugcccacugaaaaaguagccgcaauucauagauugggcaucgggaccacagacaagaucuuccucgaguuugaggagccuuucuggggaccagagugcaauucgcugcaauuuguuugggaagaugaggcugaaucucacacuuuaaccuaucccccggagcugugguacaggaaaauuugugguuucgacgugcucuacccucccgaacgguauggccauguccuuuccggguggauaugcggagaggaggcccuggugauggaaaagugugaugacgaggcugucgccgaaaucugcacagagauguugcgccaguucaccggcaacccaaauauuccuaagcccagaaggauccuacguucagcaugggguaguaacccauacuuucgggggagcuauuccuacacucaggugggcucuagcggagccgauguugaaaaacuggcuaagccccucccuuauacggagucaaguaaaacagcgccaaugcaagugcuguucuccggcgaggcaacccaccgaaaguacuauagcacuacacacggggcccuucugucuggacagagagaagcugccagguugauagagauguaccgcgaccucuuucagcaggguaccuga

SEQ ID NO: 62933 - RNA, 1896 nt, Artificial Sequence
  derived and/or modified sequence opt3 from SMPD1__Homo_sapiens__NP_000534
augcccagauacggcgccagccuuaggcaguccugcccucggucugggcgcgagcaaggacaggacgguaccgcuggcgcaccagggcuccuuuggaugggacugguguuggccuuagcgcuggcucuagcccucgcacuggcccuuucagauagucgaguccugugggcuccggcagaagcccaccccuugagcccucagggccauccagcucgucuccacagaaucguucccaggcugcgggacguguucgguugggggaaccugacauguccuauuugcaagggacucuuuacugccauaaauuuaggccugaaaaaggagccaaacguagcgcgcgugggcuccgucgcaaucaaacuuuguaauuugcugaagauugcucccccugccgugugccagucuaucguucaucuauucgaagaugacaugguggaggucuggagaaggucggugcucucaccaagcgaagccugugggcugcuucugggaaguacgugcggucacugggauaucuuuuccucuuggaacauuagcuugccgaccguacccaaaccuccacccaagccuccaucacccccggcaccuggcgcucccguuucccggauacucuuccugacagacuuacauugggaucacgacuaucuggaggggacugauccagacugugccgauccucucugcugucgccgaggaaguggccuucccccagcgagcagacccggugccggguacuggggagaguauucuaagugcgaccugccuuugaggacccuagaaucccugcucucaggccugggcccagcagggccguuugauaugguguacuggacaggagacauccccgcucacgacgucuggcaucaaacccggcaggaucagcuucgugcccugacuacagugaccgcuuuggugcgcaaauuccucgguccugucccaguuuaucccgccgugggcaaucacgagagcacgccuguaaacaguuuuccacccccguucauugaagggaaucauucuuccagauggcuguacgaggcaauggccaaggcuugggagccuugguuaccagcggaagcacugaggacucuacggaucggaggcuuuuaugcccucagccccuacccuggucugcgacuuauuucguugaacaugaauuucuguucucgcgagaacuuuuggcugcucaucaauuccaccgaccccgcugggcagcugcaauggcuugugggcgaacugcaggccgcagaggauagaggagacaaaguccacauaauuggccacaucccaccugggcauugcuugaagucauggaguuggaacuacuauaggauuguggcccgguacgaaaauacacucgcugcccaguucuuuggacacacucauguugaugaguucgagguguucuaugacgaagagacccugagccgccccuuagcagucgcguuucuggcuccauccgccacaaccuacaucggucuaaacccgggcuauagaguguaccagaucgaugggaauuauucuggaagcucacacguaguucucgaccaugaaacguacauucugaaccuuacucaagcaaacauaccuggcgccaucccccacuggcaguugcuguacagggcucgugagacauauggucucccaaauacccugcccacugccuggcacaacuuaguguaccggaugcgaggggauaugcagcuguuccaaacauuuugguuccuuuaucauaaaggccacccuccaagugaacccugcggaaccccuuguagauuggcaacgcucugcgcucagcuguccgccagggcggacagcccggcccuaugucgccaucugaugccagauggcucucuccccgaggcucagucacuguggccucggccacuguuuugcuga

SEQ ID NO: 62934 - RNA, 1272 nt, Artificial Sequence
  derived and/or modified sequence opt3 from SMPD2__Homo_sapiens__NP_003071
augaagcccaacuucagccugagacucaggaucuuuaaucuuaacugcuggggcauuccuuaccuguccaaacaccgggccgaccgcaugcgacguuugggggauuucuuaaaucaggagucuuuugaccuggcucuacucgaagagguguggucagaacaagauuuccaguaucugagacagaaacuuaguccaaccuacccggcagcccaucacuuuaggagcggaauaaucgguuccggccugugugucuucucuaagcaucccauucaggaguugacacaacacaucuauacucucaacggguacccuuauaugauucaucacggagacugguuuucgggcaaggcgguuggucugcuggugcuccacuuaucagggaugguacugaaugcuuacgugacgcaucuucacgccgaauauaaccggcagaaagauaucuacuuggcacaucgcgucgcccaggcuugggagcuggcacaguucauacaccacaccagcaagaaggccgacgugguucuacucugcggagaucugaauaugcauccagaggaccuuggcuguugccuguugaaagaauggacaggccuccacgaugcuuaccuggagacuagagacuuuaaggggagugaagagggaaacaccauggugcccaaaaauuguuaugucucccaacaggaguuaaagccuuucccauuuggugugaggaucgauuacguacuguauaaagccguuucuggcuucuacauuagcugcaaguccuuugaaacaaccacuggguucgacccccaucggggaacaccucucucagaucacgaggcgcuuauggcaacccuguucgugcgccauaguccaccgcagcagaaccccagcucuacgcacggcccugccgaacgauccccauugauguguguccuaaaggaggcuuggacugaacugggucucgggauggcccaagcaagauggugggcuaccuuugccucauaugugaucggacugggccuucuguugcucgcgcuguuaugcgugcuggccgcaggcgggggagcuggugaggccgcuauucuacucuggacacccagcgucggccugguucuuugggccggggcauucuacuuguuucacgugcaggagguaaauggacuguauagggcccaggcugaacuccaacaugugcugggccgggcgcgugaggcacaggaccuugguccugaaccacagcccgcccuguugcucgggcagcaagagggcgaccgcacuaaagaacaguga

SEQ ID NO: 62935 - RNA, 1968 nt, Artificial Sequence
  derived and/or modified sequence opt3 from SMPD3__Homo_sapiens__NP_061137
auggugcuguacaccacacccuucccuaacagcugccucuccgcccuucacugugucucuugggcucugaucuuuccaugcuauugguugguugacagauuagcagccucauucauuccgacuacguacgaaaagaggcagcgggcggaugaccccuguugccugcaacuacucuguaccgcucuguuuacaccuauauaucuugcccuguugguggcaagucucccauucgccuuucugggcuuccuguuuuggagcccccuccaguccgcucgccgaccuuacaucuauucucguuuagaagauaaagggcuggcaggaggugccgcucuuuugucggaguggaagggcacugggccaggaaaaucauucugcuuugccaccgcgaauguaugucugcuacccgacagccucgcaagagugaacaaucuguucaacacacaggccagggcuaaggaaauuggccagcggauccgcaauggugccgcaagaccucaaauuaaaaucuacauagauaguccaaccaacacuuccaucucugcugccagcuuuuccucacuugucaguccgcaagggggagacggcguggcgagggccguucccggcagcauuaagcggacagcaucuguggaguauaagggggauggaggucgccauccuggcgacgaagcugccaaugggccagcuuccggagaucccgucgacucaagcaguccugaggaugccugcaucgugcgaauuggcggugaggaagggggaagaccacccgaggcagacgauccgguaccuggcggccaggccaggaacggggcuggagguggcccccgggggcagaccccaaaucacaaccagcaggacggagacucuggcucccuggguagcccuucggcgucucgugaauccuugguuaaagggcgcgcaggccccgauacgucagccaguggagagccaggcgcuaauagcaagcuccuguacaaagccuccguggucaagaaagcagccgcuagaaggcggcgacaucccgacgaggccuucgaucacgaagugucugcauuuuucccugcgaacuuagacuuccugugucuccaggagguguuugauaagcgcgcugccacuaagcugaaagaacagcugcauggguacuucgaguauaucuuguacgacgucggaguuuaugguugccaaggcuguugcagcuuuaagugccuaaauucagggcuucucuucgcaaguagauacccaauaauggauguggccuaucacuguuacccgaacaaaugcaaugacgaugcucuggccuccaagggagcacuuuuucugaaaguacaggugggcagcacuccccaggaccaaaggauugucgguuauaucgcuuguacacacuugcaugccccucaggaagauucugcgauucggugcgggcagcucgaccuguuacaggacuggcuggccgauuuccgcaagucaaccaguagcuccucugcugcaaacccagaggagcuaguggccuuugacguuguguguggcgauuucaacuuugacaauugcucgagcgaugacaaacucgaacaacagcacucccuguucacccauuacagagaucccuguaggcuuggaccuggcgaggaaaagccaugggcuaucgggacauugcuggacaccaacggacucuacgaugaggacgucugcacgcccgauaaucugcagaaggugcuugaaucagaggagggucgucgggaauaucuggccuuuccgacaaguaaaucuagcggccagaaggggcgaaaagaguugcucaagggaaacggcagaaggaucgacuacaugcugcacgcagaagaggguuuauguccugauuggaaagcggaaguagaggaguucuccuuuauuacucaacugucagggcuaaccgaccaccucccaguugccaugcgccugauggugagcucuggcgaagaggaggcuuga

SEQ ID NO: 62936 - RNA, 969 nt, Artificial Sequence
  derived and/or modified sequence opt3 from SMPDL3A__Homo_sapiens__NP_001273067
augaccacaacuauccagagccuguuccccaaccuccaaguguuuccugcccuuggcaaucacgacuacuggccacaggaucagcugccggucguuacguccaagguguauaacgcuguagcaaauuuguggaaacccugguuagacgaggaagccauuucuacccugagaaaagggggauucuacucacagaaggugacaacuaacccuaaucuaaggauaaucagucucaacaccaaucuguauuacgguccaaacauuaugacacuuaauaagaccgaucccgcgaaccaauuugaguggcuggaaagcacuuugaauaacucccagcagaauaaagagaaggucuauaucauugcucaugugccuguuggcuaccucccaucuucgcagaacaucacagccaugcgggaauauuacaaugagaagcugauagacaucuuccaaaaauacucagaugugauugcagggcaguuuuauggacacacccaucgcgacagcaucaugguccugagugauaagaaaggcucccccgugaacucucucuucguagccccugcuguuacgccagucaagagcguguuagagaaacagacuaacaauccggguauucgacuguuucaguacgacccccgugauuauaaguugcuugacaugcugcaauacuaucuaaaccucaccgaagcaaaucugaagggggaguccaucuggaaacuugaauacauacugacacagacuuaugauauugaggacuugcagccugagucacucuacggacuggccaagcaauucaccaucuuagauaguaaacaguuuauuaaguacuauaacuacuucuuugugagcuaugacucuuccgugacaugcgacaaaaccuguaaggcuuuccagaucugcgccaucaugaaucuggauaacauuucauacgcggacugucucaaacagcuuuauauaaagcacaauuacuga

SEQ ID NO: 62937 - RNA, 1458 nt, Artificial Sequence
  derived and/or modified sequence opt3 from SMPDL3B__Homo_sapiens__XP_011539561
augagacugcucgccuggcuuaucuuccuggcuaacuggggcggggcaagggccgagcccgaagaggcgcagggaccuugcgcucaagaaaaggguaaaggcccaccgcccaccagcauuuuggccuccuuagcaccugggcuggaggccggaaaguuuuggcacauagcugaccuacaucucgauccagacuacaaagugucuaaggaucccuuccaggucuguccuucagcaggcagucagccaguucccgacgccgguccuuggggugauuaucugugcgacagcccaugggcucuuaucaauuccucuauuuacgccaugaaagaaaucgagccggagcccgauuuuauucuguggacaggagacgauacuccucacgugccagacgaaaaguugggcgaggcggcaguacucgaaaucguggagcggcugacgaagcugauacgcgaggucuuccccgauaccaaaguguaugccgcucucggcaaccaugacuuucacccuaagaaucaguucccagccgggucgaacaauaucuacaaccaaauugcagaauuauggaaacccuggcugucaaaugagagcaucgcucuuuuuaagaaaggagccuucuauugugaaaaguugccggguccuaguggcgcggggcgaauuguugugcugaacacaaaucuauacuauacuuccaacgcccucaccgcagauauggcugaccccggacagcaguuucaguggcuggaggacguccuuacagaugccucuaaggcuggcgacaugguguacaucguaggucauguuccaccuggguucuuugagaaaacccaaaauaaggccugguuccgugaaggauuuaacgagaaauaccugaagguggucagaaaacaccacagggugauagcaggccaguucuucggccaucaccauacugauagcuuucggauguuguaugacgaugccggggugcccauuuccgcuauguucaucacaccaggagucacccccuggaagacgacucucccugguguugugaauggcgcgaacaauccagcaauucgcguauuugaauacgacagagccacccugucauuaaaagauauggugacauauuucaugaaccugagucaggcuaacgcccaggggacuccgaggugggagcucgaauaccaacuuaccgaggcauauggaguccccgacgccagcgcucacucuaugcacacagugcuggaucggaucgccggcgaccaguccaccuugcagcgcuacuauguuuacaauucagugagcuacagugcaggggucugcgaugaagcguguucuaugcaacaugugugcgcuaugcgacagguagacaucgacgccuauacgacuugucuauacgcauccgggacaaccccuguuccacagcugccccuccugcuuauggcccuguugggccucugcacucugguguuauga

SEQ ID NO: 62938 - RNA, 267 nt, Artificial Sequence
  derived and/or modified sequence opt3 from SMPX__Homo_sapiens__NP_055147
augaacaugagcaagcagcccguguccaaugucagagccauccaagcuaacauuaauauaccuaugggcgcauucaggccaggggccggacagccgccccggcgcaaagagugcaccccugaaguugaggaaggugugccacccacaucugacgaggaaaagaaaccuaucccaggcgcgaagaaacugcccgggccugcuguaaaccucucagagauucagaauaucaagagugagcuuaaguacgugccaaaagccgaacaguga

SEQ ID NO: 62939 - RNA, 240 nt, Artificial Sequence
  derived and/or modified sequence opt3 from SMR3B__Homo_sapiens__NP_006676
augaagucccugaccuggauccucggccuuugggcccuggcugcaugcuucacacccggggagagccagagaggaccuagggguccauacccgcccggcccuuuggccccaccccaaccuuuugggccaggauucgugcccccuccaccgcccccuccauauggccccggucggauuccuccacccccgccugcgcccuacgggccaggaauauuuccucccccacccccucagccauga

SEQ ID NO: 62940 - RNA, 942 nt, Artificial Sequence
  derived and/or modified sequence opt3 from SMS__Homo_sapiens__NP_001245352
auggccgcugcaagacacagcacccuggacuucaugcucggcgccaaggcggauggggagacaauccuuaaaggacugcaguccauuuuucaagaacaggguauggcugagucugugcauacuuggcaggaccacggcuacuuggccacguauaccaacaagaaugggagguuacccccuauaguccggggaggcgcaaucgaucgcuacuggccaacagccgacggucgacugguugaauaugauauugacgaggugguauacgaugaagacucaccguaucagaacaucaaaauucuacauaguaagcaauucgggaauauccucauacugagcggagaugugaaccuugcugaguccgaccuggcauacacucgugccaucaugggcucuggcaaagaggauuauaccgggaaggacgucuugauucucggagguggcgaugggggaauccugugcgaaauugugaagcugaaacccaagaugguuacaaugguggagaucgaccagauggucauagacggcuguaaaaaguacaugagaaaaaccugcggugaugugcucgacaauuuaaagggggauuguuaccagguacugauugaagacugcaucccuguucuuaagagguaugcuaaagagggacgggaguuugauuacgugauuaacgacuugacugccgucccaaucucgacaucacccgaagaggauagcaccugggaguuccugcgccuaauccucgaccugaguaugaaggugcuuaaacaggauggcaaguauuuuacgcaaggcaauugugugaaccugacugaggcguugucccucuacgaagaacagcuggggagauuauauugcccugucgaguucucuaaagaaauuguuugugugccaagcuaccuggagcucuggguauuuuauaccguguggaagaaagcaaagcccuga

SEQ ID NO: 62941 - RNA, 2754 nt, Artificial Sequence
  derived and/or modified sequence opt3 from SMTN__Homo_sapiens__NP_008863
auggccgacgaggcucuggcaggccucgaugaaggggcccuuagaaagcuguuggaggugaccgcggacuuagcugaaaggcggcgcauccgaagcgccauucgugagcugcagagacaagaacuagagagggaggaagaggcacucgccuccaaacgguuccgcgcugaaagacaggauaacaaggagaauuggcugcacucucagcagagggaggcagaacaacgggccgcucuugcccgccuggcgggacaguuggagucaaugaacgacgucgaggaacucacagcacugcugcgaagugccggugaauacgaggagagaaaacucauaagggcugccauccggcguguucgcgcacaggaaauugaggcugccacuuuagcgggcagacuguauagcgggaggcccaauuccggaucucgggaagauucgaagggccuugccgcacaucgauuggagcagugcgaagugccugagcgcgaggaacaagagcagcaggcugaaguaucaaaaccaacgccgacccccgaggguacaagccaggacgugacuaccgucacacugcuacucagagccccuccagggaguaccuccucuagccccgcuuccccuucaaguagcccaacucccgccucuccugaaccaccgcuggagcccgcagaggcccaaugucuuacagcugaagugccuggauccccagagcccccuccaucacccccgaagaccacgagcccugaaccccaggagaguccaacucugccuucuaccgagggccagguugugaacaaguugcucuccggccccaaagaaacaccagcggcacaaagccccacuagggggccuucggauaccaagcgggccgacgucgcuggaccacgcccgugccagagaucucuguccguguuaucacccaggcagccugcccagaaucgugagaguacaccacuggcaagcggucccuccucuuuucaacgggccggcagcguacgagauagaguucacaaauucaccucagacaguccuauggcugccaggcuccaggaugggacgccacaggcagcgcuuuccccgcugacuccggcucgcuugcuaggaccuagccugacaucuaccacuccagccucaaguagcuccgggucuucgagccggggucccuccgacacaucaaguagauuuucuaaggaacagcgcgggguggcacaaccucucgcccagcugaggagcuguccccaggaggaaggaccacgaggccggggccuugcugcccguccucuggagaacagagcagggggacccgucgcuagguccgaggaaccaggugccccguugccuguggcggugggcaccgccgagcccgggggaucaaugaaaacgaccuucacaaucgaaauuaaggauggccgcggucaggcuagcacugggcggguccuccugccaaccggcaaucaaagagcagaguuaacacugggacuaagggcucccccuacucuccugucuaccuccaguggcggcaagagcacaaucacccgaguuaacucuccaggaacucuugcccgcuuggguuccgugacgcauguaacaucauuuagucacgcacccccuagcucgcggggcgggugcuccauaaaaauggaagccgagccggcggagccacuggccgcugccguggaagcagcuaauggagccgagcagaccagagucaacaaggcacccgaaggcaggucuccucucagcgccgaggaacugaugacuaucgaggacgagggugugcuugacaaaaugcuggaucagucaaccgacuucgaggaacguaaguugauucgcgcugcgcuccgggaacugagacagaggaaacgagaucaacgggacaaggagcgcgagagaagguuacaggaagcccgggggcgaccaggcgagggaagaggcaauacagcaaccgaaacuacaacgcgccauagucagagggcugccgauggguccgccguuucuaccgugacuaaaacagagcgucugguccacagcaacgacggaacccggacagcuagaacuaccacgguggaauccucauuuguaaggcgcagcgagaaugguaguggcucuaccaugaugcaaacaaagacuuucuccagcucgucaucuaguaagaaaaugggguccaucuuugaucgagaggaccaggcaagccccagagccggaucucuagcggcucucgaaaagcggcaggccgagaaaaagaaagaacugaugaaggcacagagccuuccuaagaccuccgccucacaagcuaggaaagcaaugauugagaaguuggaaaaagagggcgccgcggguagucccgggggcccccgcgcugccguucagcguagcacaucuuucggagugccaaacgcaaauuccaucaagcagaugcugcucgauugguguagagccaaaacucggggcuacgagcacgucgacauacagaacuuuucaaguagcugguccgaugggauggcuuucugcgcccuggugcauaacuuuuucccugaagcauucgacuauggacaauuaucuccccagaauaggcgccagaacuuugaggucgcuuucucgagcgccgaaaugcugguggacuguguuccacuuguggagguagaugacaugaugauuaugggcaagaagccugaucccaaaugcgucuuuaccuacgugcagucauuguauaaucaccuccgaagacaugaacugcggcuaagggguaagaacguuuga

SEQ ID NO: 62942 - RNA, 1485 nt, Artificial Sequence
  derived and/or modified sequence opt3 from SMTNL1__Homo_sapiens__NP_001099035
auggagcagaaggaaggcaaacugagcgaggacgggaccacagugucccccgccgcugauaacccugaaaugucuggagguggcgcaccagccgaggaaacuaaggggacggcgggaaaagcuaucaaugagggcccgcccaccgagucagguaagcaagaaaaagccccugcagaggacgggaugagugccgaacuccagggagaggcuaacggccuugaugaggucaagguugaaagccagagagaggcaggcgggaaggaagacgccgaggcugaacugaaaaaggaggauggagagaaagaagagacaacuguggguucccaggaaaugaccggcaggaaggaggaaacaaaaucugagccaaaggaggccgaagagaaggaaucgaccuuggcgucagagaaacaaaaggcagaagagaaagaggccaagcccgaaagcgggcagaaagcugacgccaaugaucgggacaagccugagccaaaagcaacuguagaagaggaggaugcuaagacagccagucaggaagagaccggacagcgcaaggaaugcuccacggagcccaaagaaaaggcgacugacgaggaggccaaagcagaaucucaaaaggcuguggucgaggaugaagccaaagcugagccuaaggaaccagacggcaaggaggaggccaaacacggugcaaaggaagaggccgaugcuaaagaagaggcggaagacgcagaggaggccgaaccggggagccccuccgaggaacaggagcaggacguggagaaggaaccugagggaggcgcuggcguuauuccaucaagucccgaagaguggccugaaagcccaaccggggagggacauaacuuaucuacagauggucugggccccgacuguguggccuccgggcagacuucaccgagcgcaagugagucuuccccuagcgaugucccccaaucgccaccugaaucucccuccucaggagagaaaaaggaaaaggccccagagcgacgugugagugcucccgccagaccuaggggcccacgggcacagaaucgcaaagcgauaguagacaaguucgguggggcugccagcggcccgaccgcacuauuuagaaacacaaaagccgcuggagccgcaaucggcgggguuaagaauaugcuccuggaauggugcagggcuaugaccaaaaaguacgagcacguggauauucagaacuucuccucuagcuggucaaguggaauggccuuuugugcgcuuauccauaaguucuuucccgacgccuucgauuaugcugagcuggacccugcaaaacggcgccacaauuuuacguuggccuucuccacugcugaaaagcucgccgauugcgcacaacugcuggacgucgaugacauggugcgacucgcggugccagacagcaaaugugucuacacauauauucaggaguuauacagaucucugguucagaagggucuugugaaaaccaagaaaaaguga

SEQ ID NO: 62943 - RNA, 1542 nt, Artificial Sequence
  derived and/or modified sequence opt3 from SMU1__Homo_sapiens__NP_060695
augagcaucgagauugaauccucugacgugauaagacugaucaugcaguaccucaaggagaacucacuucacagggcccuggcuaccuugcaagaagagacaacugucaguuuaaauacgguugauagcauugaauccuucguggcagacaucaacucuggccauugggauaccguacugcaggccauucagucgcuaaaacuccccgacaagacacugaucgaucuuuaugagcaggucguccuggaguugauagaacuccgggagcugggggcggcucgcucacugcuccgacaaacugacccuaugaucauguuaaaacagacccagccagaacguuacauucaccuggagaaucuuuuggccagaagcuauuuugauccgagggaggcauaccccgacggaaguuccaaggaaaaacggcgcgccgcuaucgcacaggcccuggcuggugaggugucuguugugccuccaagcagacuaauggcccuccugggccaagcgcuuaaguggcagcagcaucaggggcuguugcccccuggaaugacaauugaucucuucaggggcaaggcagccgucaaagacguggaagaggaaaaguuuccaacccaacugucccggcacaucaaauucggucagaagucacauguagagugcgcucgcuuuagucccgaugggcaguauuuaguuacuggaagcguggacggcuucauagaggucuggaacuuuacaaccggcaaaauucgaaaggaucugaaguaccaagcccaggacaauuucaugaugauggacgaugcagugcucuguaugugcuuuucuagagacacggaaaugcuugcuacuggggcccaggauggaaaaaucaagguguggaaaauucaguccggucaaugucugaggcgguucgagcgugcgcacucaaagggcgugaccugcuugagcuuuaguaaagacucuucccagauccuaagcgccucguucgaucagacaauccgcauucacgggcugaagucuggaaaaacucucaaggaauuuagaggccauuccucauucguuaacgaggcaaccuucacacaggacggucacuauauaaucagugcuagcuccgaugggaccgugaagauuuggaauaugaaaacgacugaauguucuaacacauuuaagagccugggaucaaccgccggcacugacaucacaguaaauagugugauacuucugccuaaaaacccagagcauuucgucgugugcaauagguccaacaccguugugauuaugaauaugcaaggccagaucguccggagcuuuucuucagggaagcgagagggaggugauuucguguguugcgcuuugaguccgcgcggcgaauggaucuacuguguaggggaggacuuuguucucuacugcuucagcacggugaccggaaaacuggaaagaacauuaacuguccacgagaaggaugugauuggcaucgcccaccauccccaccagaaccugauugcaaccuauuccgaagacggucuacucaagcuguggaaaccuuga

SEQ ID NO: 62944 - RNA, 534 nt, Artificial Sequence
  derived and/or modified sequence opt3 from SMUG1__Homo_sapiens__XP_006719385
augccccaggccuuccugcucggcagcauccacgagccugcuggggcacuuauggaaccacaaccgugccccggaucccuggccgagucauuuuuggaagaggaauuaagacugaacgcggagcuaucucagcuccaguucagugagccuguggguauuauauacaauccagucgaauaugcuugggagccccauaggaacuacguuacccgguauugucagggcccuaaggaagugcuguuucuugggaugaauccaggacccuucggcauggcccaaacagguguaccuuuuggggaggugagcaugguccgcgacuggcugggaaucgugggcccaguuuugacuccgccccaggagcacccuaaacgaccagugcucggccuggaaugcccccaguccgaggggccucgucagucuaugggacaugaaauuaagucggagcugcucauggguggcuguucauggaucagagggaaaauucaaugcgauaggguccaggugcggcgcccaggauucagcagucaguuauga

SEQ ID NO: 62945 - RNA, 2274 nt, Artificial Sequence
  derived and/or modified sequence opt3 from SMURF1__Homo_sapiens__NP_065162
augagcaaccccggcaccagaaggaauggguccucuaucaagauucggcugacagugcucugcgccaaaaaccuugcuaagaaagacuucuuucgccugccugauccauucgcaaagauagucguugacggaucaggucagugucacaguacugauacggugaaaaauaccuuggacccgaaguggaaccaacauuacgauuuauauguaggcaagacagacagcaucacuauuuccguguggaaucacaaaaagauccauaaaaagcagggggccggauuucugggcugcguccgacuacucucuaacgcgauuucgcgucugaaagauaccgguuaccagagacuugaccuguguaaguugaaucccucagauacagacgcugugagggggcagaucguugugagccuccaaacccgggaucgcauaggaacuggcggcagugucguggacugcagagggcugcuggagaacgaaggaacaguauaugaggauuccgguccuggcaggccacucucuuguuucauggaggaacccgccccuuacaccgacagcacgggggcagccgcuggaggcgguaauugccgguuuguugaauccccaucacaggaccagcgcuuacaggcacaacgacugagaaaccccgaugugagggggagucuucagacuccucagaaucggccacacggacaucagagcccggaguugcccgagggcuaugaacaacguaccacaguccagggccagguguacuuccugcacacucaaaccggggugucuacauggcacgacccucgcaucccaucccccucaggaaccauuccugguggcgaugccgcuuuucuauaugaguuccuccugcaggggcauacgagcgaaccaagagaccuuaacagugucaauugugaugagcugggacccuugccgccuggcugggagguuaggucuacuguguccggucggaucuacuuuguagaccacaacaaucgaacaacccaguucacugauccccgccuccaucacauuaugaaccaccagugccaacugaaggaaccaagccagccuuuaccccugccaucggaggggucucucgaagacgaggaacuucccgcccagagauacgagagggaucuggugcagaaauugaagguccuacggcaugagcugucccuccaacagccucaggcgggccacugucgcaucgaagugucaagagaggaaauauuugaggaaaguuauaggcagauuaugaaaaugcguccaaaggaccugaaaaagcggcuuaugguuaaauuccgaggagaggagggccuggauuacgggggaguggcaagagaaugguuguaucuccugugccaugagauguuaaacccguacuauggucuguuucaauacagcacagacaauaucuauaugcuacagauuaaccccgacuccucuaucaauccugaucaccucagcuacuuccauuucgucggcaggaucauggggcuggccguguuucacggacacuacauuaacggcgguuucaccguaccauuuuauaagcagcuuuuggggaagcccauacagcugucagaccucgaaaguguugauccugagcugcauaaaucccuuguguggauccuggaaaaugacauuacgccagucuuggaucacaccuucuguguggagcauaacgcuuuuggccgcauccuccaacacgagcugaagcccaauggacggaacgucccggugacagaagagaauaaaaaggaauacguuagauuauaugugaacuggagguucaugcgcggcauagaggcccaguuucuggcacuacagaaaggguucaaugagcucauuccucaacaucugcuuaagccauuugaccagaaggaauuggagcugaucaucggaggucucgauaaaauugaccugaacgauuggaaaagcaauacucgauuaaagcacugcguagcugacucuaacaucguccggugguucuggcaggccguggaaaccuuugaugaggaacguagagcgaggcugcuucaguucguuacaggcucaacucgcgugcccuugcaaggguuuaaggcccuccagggaaguaccggcgcagcugguccucggcuguucacaauucaccuaauagacgccaauaccgauaaccugcccaaagcucauacuugcuucaacagaaucgacauuccaccuuacgagagcuaugagaagcucuacgaaaagcugcuuacggccgucgaggaaacauguggguuugcaguggaguga

SEQ ID NO: 62946 - RNA, 2247 nt, Artificial Sequence
  derived and/or modified sequence opt3 from SMURF2__Homo_sapiens__NP_073576
augagcaaccccggcgggagaaggaauggaccugugaagcugcggcucaccguccuuugcgccaaaaaccugguuaagaaagacuucuuucgcuugccagauccguucgcuaaggugguaguggacgguuccggccagugucacucuacagauacugucaaaaauacguuagaccccaaguggaaccaacauuacgaucuguauaucgggaagucagacagugugaccauuagcguuuggaaucacaaaaagauacauaaaaagcagggagcaggcuuucuagguugcgugcgacuccuguccaacgccaucaaucgucuuaaagauacaggguaccagagacuggacuuguguaagcucggaccuaacgauaaugacacugucaggggccagauugugguaucucugcaaucgcgggaucgcaucggcaccgggggacagguuguggacugcucaagacuguucgauaacgaccucccagacgguugggaggaaaggcggacagcgagcggccgcauucaguauuuaaaucacaucacccgaacuacacagugggagagacccaccaggccugcuagugaauacuccucuccagggcggccccugagcuguuuugucgaugagaacacgccuauauccggaacuaauggcgcaaccugcggucaaucaagugacccacgucuugccgaacgcagagugaggagccagcggcaucgaaacuauaugucucgcacacacuugcacacuccgcccgaucugccugagggguacgagcagagaaccacacagcaaggacagguguauuuccuacauacccagacgggcgucuccacuuggcacgacccaaggguuccccgggaucucucaaauaucaacugugaagaacugggcccucuuccacccgggugggaaauucgcaacacagccaccggaagaguguacuuuguagaccauaauaacaggacuacacaauucaccgauccgcgucugagcgcuaauuugcaccucgugcugaaccggcagaaucaguuaaaggaccagcaacagcagcaggucgugagucugugcccugaugacacggagugucucaccguuccccgauacaaaagagaucuugugcaaaagcugaaaaucuugaggcaggagcuaucucagcagcaaccacaggcaggucacugccgcauugaagucucccgggaggaaaucuuugaggaaagcuauagacaggugaugaagaugaggccuaaagaccuguggaagcgccucaugauaaaauuccgaggcgaggaggggcuggacuacggaggcguagcccgggaauggcuuuaucuguugucgcaugagaugcucaaccccuacuauggucuguuucaguacucucgugaugacauuuauacauuacaaaucaauccagauuccgcuguuaaccccgaacaccugucauacuuccauuuuguggggagaauuaugggcauggccgucuuccacggacauuacaucgacggcggguucacucuaccuuuuuauaagcagcuccugggaaagaguaucacccuugaugacauggaguugguggauccagaccugcacaauagccucgucuggauucuggaaaacgauauaacaggugugcuugaccacacuuucuguguugagcauaaugcguacggcgagaucauucagcacgaacugaaaccgaacgggaaguccauccccgugaaugaggaaaacaaaaaggaguauguaagguuguacgucaauuggcgcuuucuccggggaauagaagcacaauuccuggccuuacagaaaggcuuuaacgaggugauuccucagcaucugcuaaagaccuucgaugagaaggaacucgagcugaucaucugcggucuugggaaaauugacguuaacgauuggaaggugaauacaagauugaaacacugcaccccagacucuaacaucgucaagugguuuuggaaagcuguggaguucuuugacgaggagaggcgagcccgccugcuccaguucguaacuggcagcucacgggugccccugcaaggauuuaaggcauuacagggcgcugccgggccuagacuguucacgauucaccagauagaugcguguacaaauaaccuuccaaaggcccauaccugcuuuaauaggaucgacauucccccguaugaaaguuacgagaaauuguaugaaaagcuccugacugcaaucgaggaaaccuguggauucgcuguugaguga

SEQ ID NO: 62947 - RNA, 1473 nt, Artificial Sequence
  derived and/or modified sequence opt3 from SMYD1__Homo_sapiens__NP_938015
augaccaucggcagaauggagaacguggaagucuucacagccgaggggaagggaaggggucugaaagcuacuaaggaauuuugggcagccgacauuauauucgcggagcgggcuuacagcgccguuguguuugauucccucguaaauuucgugugccacacguguuuuaaacgccaggaaaaacuucaucgaugcggccaauguaaguucgcacacuauugcgaccguaccugucagaaggaugccuggcugaaccauaagaaugagugcucugcuaucaaaagauacgggaagguccccaacgagaauauuagguuggcagcccggaucauguggcgcguggaaagagagggaacaggcuuaacugaagguugucugguuucaguggacgaucuacagaaccacgucgagcauuuuggggaggaggaacagaaagaccucaggguggauguagacaccuuccugcaauauuggccuccacagagucagcaguuuagcaugcaauacauuucccacaucuucggaguuauaaauugcaacggcuuuacacuuucugaucagcggggccugcaggcugugggggucggaaucuucccgaauuugggucucgugaaccacgacuguuggcccaauugcaccgugauuuuuaacaauggcaaccaugaagccgucaagucgauguuccacacucagaugcgcaucgagcugcgagcgcuggggaaaauuucagaaggagaggagcucacaguuagcuauaucgauuucuuaaaugugagugaagagagaaagaggcaacugaagaaacaguacuauuuugacuguaccugcgaacauugccagaagaaacuuaaggaugacuuguuccugggcguaaaagacaacccuaagccaucccaagagguggucaaagaaaugauacaguuuucuaaggauacgcuagagaagauugacaaagcacggagcgagggucucuaccacgaagugguuaagcugugucgugagugccuugaaaaacaggagcccguguucgccgauacuaacaucuacaugcugcgcauguuguccauugucucagaagugcucaguuaucugcaggcuuuugaggaggccagcuucuacgcaagaaggaugguagacggguauaugaaguuauaccacccuaauaacgcucaacugggaauggccguuaugcgggcgggccucaccaauuggcaugccggcaacaucgaaguggggcacggaaugaucuguaaagcauaugcuauucuucuggucacacaugguccaucucaccccauaacuaaggauuuggaggccaugcgagugcagaccgaaauggagcuacgcauguuuagacagaaugaguucauguacuauaagaugagggaagcugcccugaacaaucagccuaugcaagucauggcagagccauccaacgaaccgucacccgcccucuuucauaaaaagcaguga

SEQ ID NO: 62948 - RNA, 1302 nt, Artificial Sequence
  derived and/or modified sequence opt3 from SMYD2__Homo_sapiens__NP_064582
augagagccgagggccucgggggacuggaaagguucugcagccccgguaagggccgggggcuucgcgcucugcagccuuuucaagugggagacuuguuauucuccuguccagcauacgccuauguccugaccguuaacgagcgaggcaaucacugcgaauacuguuuuacacguaaagagggucuaucuaagugcgggagauguaaacaggcguucuauugcaacguggaaugucagaaggaggauuggccgaugcauaaacucgagugcucacccaugguaguguuuggagaaaauuggaacccuagugagacugucaggcugacggcucggauccuugccaagcagaagauucacccagaacgcacccccagcgagaaacuguuggcagugaaggaguucgaaucccaucucgacaaacuggauaaugagaagaaagaccugauacaaucugauaucgccgcucuccaccauuuuuacucgaagcacuuaggcuucccugacaacgauucacugguugugcuuuuugcacaggucaauuguaacggcuucacaauugaagacgaggaauugagccaccuggggagugccaucuuuccagauguggcucuaaugaaucauuccugcugucccaacguaauuguuacuuauaagggaacccucgccgaggugagagcgguccaggagaucaaaccuggugaagagguguucacaucuuacauagaccugcuuuauccaaccgaagauaggaaugaccggcugcgcgauagcuacuuuuucacuugcgagugccaggaauguacaaccaaggacaaagacaaggcaaaaguggagauccgaaaguuguccgauccgcccaaagccgaggcuauuagagacauggucagguacgcccggaacguuaucgaagaguuccgucgcgcaaagcacuauaagucaccuagugaacuccuggagauuugcgaauuaagccaagagaaaaugucuuccguguuugaggauucaaauguauacaugcugcauaugauguaucaggcuaugggcgugugucucuacaugcaggacugggaaggggcccuucaguauggacaaaagaucauaaaaccauacagcaagcacuauccccuguacaguuugaacgucgcgucuauguggcuaaaacugggcagacucuacaugggucuggagcacaaggccgcaggggaaaaggcucuuaaaaaggccauugcuaucauggagguggcccauggaaaagaucacccuuauauuuccgagaucaagcaggaaaucgagagccauuga

SEQ ID NO: 62949 - RNA, 1287 nt, Artificial Sequence
  derived and/or modified sequence opt3 from SMYD3__Homo_sapiens__NP_001161212
auggagccccugaagguggaaaaauucgccaccgcuaagagaggcaacgggcucagggcagucacaccucuucggccaggagagcuguuguuucgcagcgacccguuagccuacacuguuugcaaagguucccgaggcgugguaugugaucguugccugcuagggaaggaaaaacucaugagauguucucagugcaggguggcgaaguauuguucagcuaagugccagaaaaaggccuggcccgaccacaaacgggaguguaagugccugaaaaguuguaagccucgcuacccacccgauagcgucagacuucugggaagggugguuuucaaguugauggacggcgcaccuuccgaaucugagaaacucuauucguuuuacgaucuggagucaaauaucaacaagcugacggaagacaaaaaggagggucuccggcaauuagugaugaccuuccagcauuuuaugcgcgaagagauucaggaugccagccaacugccacccgcuuucgaccuuuuugaggcauucgccaaagucauaugcaauaguuuuacaaucuguaacgcugaaaugcaggagguggggguaggauuguauccuuccauuucucugcuaaaucacagcugcgauccaaacugcuccaucguuuucaauggcccgcaucuccugcuucgagccgugagagacauugaagucggcgaggaacugacuaucuguuacuuggauaugcucaugaccucagaggagaggcggaagcagcugcgugaccaguauugcuuugaaugugauugcuuccgcugucaaacacaggacaaagacgcggauauguuaaccggggacgaacagguguggaaggaagugcaggagagucugaagaaaauagaggagcucaaggcacacuggaaaugggagcaaguccuugccaugugccaggcuaucauuagcucuaacuccgaaagacugcccgauaucaauauuuaccaguugaagguucuagacugugccauggaugcaugcaucaaccugggacuccuggaggaagcucuuuucuacgguacuaggacaauggagccuuaucggauauuuuucccaggcucacaucccgugcgagggguacaagugaugaaagucggaaagcugcaguugcaccagggcauguuuccucaggccaugaagaaucuccgccuggcguucgacauuaugagagugacccacgguagggaacauagcuuaaucgaggaucugauucuacuccuggaggaaugugacgccaacauccgggcaaguuga

SEQ ID NO: 62950 - RNA, 2415 nt, Artificial Sequence
  derived and/or modified sequence opt3 from SMYD4__Homo_sapiens__NP_443160
auggaccugcccguggaugaguggaaaagcuaccuccuucagaagugggccucccugccuaccucuguccaaguuacaaucucaacugcugaaacguugagagacauuuucuuacacaguagcucccugcuacagccagaggaugaacucuuucugaagaggcuuucuaagggcuaucugguggggaaggacucggaugcaccguuguucuaccgggaggaaggaaacaaaaaguuucaggagaaggacuauaccggugccgcgguacucuacucaaaaggcgugagccauagucgccccaauacagaggauaugucccugugccacgcuaaccgaucugccgcacuguuccaucucgggcaguaugaaacuuguuuaaaggacauaaaucgugcccaaacccacggauacccugagagacugcagccaaaaaucaugcuuaggaaggcugaaugcuuggucgcacugggccggcuacaggaggccagccagacaauuuccgaucucgagcgcaacuuuaccgcuacucccgcccuggcggacgugcuuccucaaacacugcagagaaauuugcauaggcucaaaaugaagaugcaggaaaaggauucacugaccgagaguuucccagcagccuuagcuaaaacgcuggaagacgccgcacuccgggaggaaaacgagcagcuuagcaaugcuucuuccucaaucggucuguguguugaucccuugaaggggcgcugccuaguggccacuaaagacauucugccuggagagcuccugguccaagaagacgcguuugugagcguacuuaacccaggcgagcugccgcccccucaccacggcuuggauaguaagugggacacccgaguuacaaauggggaucucuauugucauagaugccugaaacacacuuuagccaccgugccaugugacggaugcucuuacgcaaaguacuguucccaggaaugccugcagcaggcuugggagcuauaucauaggacagaauguccccucgguggccugcuuuugacccugggggucuucugccacaucgcccuccggcugacgcuucuggugggauuugaggaugugcguaaaauaaucacuaaguugugcgacaagauuagcaacaaagauaucugucucccugagucgaauaaccaagucaagacacugaauuacggcuuaggugaaucugagaaaaacgggaauauuguugaaaccccaauccccggaugcgacauaaacggcaaguaugagaacaauuacaacgcuguguucaaucugcuaccgcacacugaaaaccauuccccugagcacaaauuucucugugcccugugcguaucagcacuuugucgccaguuggaggccgcuagucugcaggcgauucccacagaaagaaucgugaauagcucccaacucaaggcagccgucaccccagagcugugcccugaugugacgauuuggggcguugcuauguuaaggcauaugcugcagcuucaguguaacgcccaggcaaugaccacaauccaacacacugggcccaagggaucuaucgugaccgacagccggcagguccgauuggccacagguauuuucccagugauaucacuccugaaucauaguugcucccccaacacuagcguaucuuuuaucucaaccguugcuacaauucgcgccagucagagaaucaggaaaggccaggaaauacuacacuguuaugggccucacaagagccggaugggaguggcagagcgccaacagaaacugagaucccaguacuucuucgauugcgcguguccagcuugccagaccgaggcccauaggauggcagccggcccgcguugggaggcuuuuugcuguaauucuugcggugcccccaugcaaggggacgacguccuccgguguggcucgcgaagcugcgcagaauccgcugugucaagagaucaccuggucaguaggcuucaggacuugcagcaacaggugcgcguugcccagaagcuguuacgggauggagaacucgagagagcggugcagaggcugucuggcugucaacgcgacgccgagagcuuccuuugggcugaacaugcaguagucggggagauugccgauggacuggcucgagccugcgcagcguugggugacuggcagaaauccgccacucaccuccagcggucacuguaugugguugaagugcgucacggcccuagcucugucgagauggggcaugaacuauuuaagcuggcucagaucuucuuuaacggauucgccgugccagaggcacucuccacgauccaaaaggcugaagagguacugagucuucacuguggccccugggaugacgagauucaggaauugcagaaaaugaaaagcugccuguuagaucucccuccaacacccguggguccggcccuguga

SEQ ID NO: 62951 - RNA, 1257 nt, Artificial Sequence
  derived and/or modified sequence opt3 from SMYD5__Homo_sapiens__NP_006053
auggccgcuagcaugugcgacguguucuccuuuugugucggcguugcagggagagccagggugucuguagaggugcgguucgucucaagugcgaagggaaaaggucuguuugcuacccagcucauccgcaagggcgaaacaauuuucguggagcgaccccuuguugccgcacaauuucuguggaacgccuuguaccguuauagagcuugcgaucacuguuuaagggcacuggaaaaagccgaggaaaaugcucagcggcuaacugggaagccuggacaggugcucccacauccggagcugugcacgguccgcaaagaccuucaccagaacuguccccauugccaagugauguacuguagcgccgagugcagacuggcggcaaccgaacaguaucaccagguauuguguccuggcccaucccaggaugacccccuccauccucugaauaagcugcaagaggccuggaggucuauacacuacccacccgaaacagcuucgaucaugcucauggcccggaugguugcaacugugaagcaggcuaaagauaaggaccgcuggauucgauuauucucacaguuuugcaacaaaaccgccaaugaggaggaagagaucguccacaagcugcuuggugauaaauucaaggggcaguuggaacugcuaagaaggcucuuuacagaggcgcuguaugaagaggccgugagccaaugguucaccccugacggauuucggagucuuuucgcacuggugggcacuaacggccaggggauuggaacauccucuuugagccaguggguccaugcuugugauacccucgagcugaagccacaagaccgugaacaguuagaugccuuuaucgaccagcuguacaaagauauagaggcugccacgggugaguuccucaauugcgaaggcuccgggcuuuucguucugcagucaugcuguaaccacaguugcgugccgaaugcagaaacuagcuuucccgagaacaauuucuugcuacauguaaccgcccuggaggacaucaagccuggagaagagauuuguaucucuuaucucgacugcugucaacgcgaaagauccaggcacucacggcacaaaauucugcgagagaacuaccuuuuugugugcagcuguccaaagugccuggcugaagcggaugagcccaaugucacaagugaggaagaggaagaggaggaagaggaagaggaaggcgagccugaggacgcagaauugggugaugagaugacugacguguga

SEQ ID NO: 62952 - RNA, 795 nt, Artificial Sequence
  derived and/or modified sequence opt3 from SNAI1__Homo_sapiens__NP_005976
augcccaggagcuuccuggugagaaagccuuccgacccaaaccggaaaccgaauuacucugagcuccaggauucaaaccccgaauuuaccuuccaacagccuuaugaccaggcccaccuucuggcugcaaucccacccccugagauuuugaauccaacagccaguuuacccaugcugauaugggauagcguccuagcgccucaggcucaaccaaucgccugggcaucccuccgccugcaggaaucuccgcgaguugccgagcuuacuucgcugucagacgaagauagcggcaaggggagucagcccccuuccccacccucuccugcuccaagcuccuuuucaaguacgagcgugucuuccuuggaggcagaggccuacgcugccuuccccggacucggucagguaccgaaacaacuggcgcagcugucagaagcaaaggaccuccaggcccguaaggcuuuuaacugcaaauauuguaauaaggaguacuuaagccugggcgcccuuaaaaugcauauuagaagucacaccuugccuugcgugugugggacaugcggaaaggcauucucuaggcccuggcugcuacagggccauguccggacucacaccggugaaaaaccauuuuccuguccucauugcagccgcgcuuucgccgauagaucgaaccucagggcgcaucugcaaacacacucugacgugaagaaauaucagugucaggccugcgcacggaccuuuucccgcaugucacuucugcacaagcaccaagagaguggguguagcggaugcccccgauga

SEQ ID NO: 62953 - RNA, 807 nt, Artificial Sequence
  derived and/or modified sequence opt3 from SNAI2__Homo_sapiens__NP_003059
augccccggagcuuccuggugaagaaacacuuuaacgccuccaagaaaccuaauuacucugagcucgacacccauacagucaucauuucaccauaucuuuacgaaaguuauagcaugccgguuauaccccagccugagauccuguccucuggcgcuuacucgccaauuacuguguggacgaccgcagcccccuuccacgcgcaauugccuaacggguuaucaccacugagcggauauaguuccucucuagguaggguaagcccucccccaccguccgauacaucaaguaaggaccauagcggcucugaaucccccaucucagaugaggaagagagacuccagagcaaacugagugacccucacgcuauugaggccgaaaaguuucagugcaaucuuuguaacaagacuuacucuaccuucuccgggcuggcaaaacauaagcaguugcacugcgaugcccaaagccgcaaaucguuuucuuguaaguauugcgacaaagaguacgugucccucggagcucugaagaugcacauccgaacacauacccugccaugugucugcaagauauguggcaaagcauucucacgucccuggcucuuacagggucacaucagaacucauacaggggaaaagccuuuuaguugcccacacuguaauagggccuucgcugaucggagcaaccugcgcgcccaccuucagacccauuccgacgugaaaaaguaccagugcaaaaauuguucuaagacguuuagcagaaugucauugcugcacaaacaugaggagaguggaugcugcguugcgcacuga

SEQ ID NO: 62954 - RNA, 879 nt, Artificial Sequence
  derived and/or modified sequence opt3 from SNAI3__Homo_sapiens__NP_840101
augcccaggagcuuccuggugaagacccacuccucucauagagucccuaacuaccggcgccucgagacacagcgagaaaucaauggcgccugcucagcuugugggggacuuguugugccacuguugccgcgugacaaagaggcacccaguguaccuggugauuuaccacaacccugggacagaagcuccgccguggcgugcauuucucugccucuacucccaaggauagaagaggcucugggcgccucggggcuugaugcacuggaagucucagagguggacccccgggccagccgcgcugcaaucguuccuuugaaggauagucucaaccaccugaaucugccaccgcucuuagugcugcccacuagaugguccccuacgcuuggaccagacaggcauggcgcccccgagaaauugcugggugcugaacggaugccucgcgccccagggggauuugaguguuuccacugccauaagcccuaucacacccuagcgggccucgcacgacacagacagcugcauugucaccuucaggucggcaggguguuuacaugcaaauacugugauaaggaauauacuucucugggggccuugaagaugcauauucggacccacacacucccgugcaccuguaaaaucugcggaaaggcuuucagccguccuuggcuguuacagggucacguacgcacucauacaggcgagaaacccuacgccuguucccacugcucaagagcauuugcugacaggaguaaccugcgggcccaucuccaaacccacagcgaugcgaagaaauaucgaugccgcagauguacgaagacuuucucuaggaugucccuucuggcccggcaugaggaaucagggugcuguccaggaccuuga

SEQ ID NO: 62955 - RNA, 636 nt, Artificial Sequence
  derived and/or modified sequence opt3 from SNAP23__Homo_sapiens__NP_003816
auggacaaccugagcuccgaggaaauccagcaaagagcccaccagauuaccgaugagucucucgaaucaacaaggcggauacuuggccuggcuaucgagagucaggacgcagggauuaagacuaucacgauguuggaugaacagaaagagcaauuaaaucgcauugaggaaggacuggaccagaucaacaaggauaugcgagagaccgagaaaacacuaacugaacucaauaagugcuguggucugugcgugugucccugcaaccguaccaaaaauuucgagagcggcaaggccuacaagacaaccuggggagacgggggcgaaaacuccccuuguaaugucguuucuaaacagccagguccggugacuaacgggcagcuucaacagcccacaaccggagcggcuucgggcggcuauauaaagagaaucacgaaugaugccagggaggacgaaauggaggaaaaccugacucagguagggucaauuuugggaaaucucaaagauauggcacugaacaucgguaaugagauugacgcccagaacccucaaaucaagcggauaaccgauaaagcugacacaaaucgcgauagaauugacaucgcaaacgccagggcuaagaagcugauugacagcuga

SEQ ID NO: 62956 - RNA, 621 nt, Artificial Sequence
  derived and/or modified sequence opt3 from SNAP25__Homo_sapiens__NP_003072
auggccgaggacgcugauaugagaaacgaacuggaggaaaugcagaggcgggcagaccaacucgccgaugagagccuugaauccacccgccgaaugcugcaguugguggaggagucuaaggacgcgggcauccguacauuagucaugcuggaugaacagggggagcagcuagacagaguugaagagggaaugaaucacauuaaccaagauaugaaagaggcugaaaagaaucucaaagaccuggguaagugcuguggccuuuucauaugccccuguaacaaacugaagucaagugaugccuacaagaaagcaugggggaauaaccaggacggagugguagccagccagccugcuaggguggucgaugagcgggaacagauggcaaucuccggcgguuuuauucgcagagugacuaaugacgccagggagaacgaaauggaugagaauuuggagcaaguuucugggaucauuggaaaccuccggcauauggcucuggacaugggcaaugaaaucgacacgcagaaccgccagauagaucgaaucauggagaaggccgacucgaauaaaaccagaauugaugaagcgaaccagagggcaacaaagaugcugggcucaggguga

SEQ ID NO: 62957 - RNA, 777 nt, Artificial Sequence
  derived and/or modified sequence opt3 from SNAP29__Homo_sapiens__NP_004773
augagcgccuaccccaaguccuauaacccuuucgacgaugacggcgaggaugaaggggcuagaccagcaccguggagggacgcccgggaucugcccgacggaccugaugcgccagcugaccgccagcaauaccuccgacaggaggugcuucguagagccgaagcaaccgccgcuucuacaucaaggagucuggcauugauguaugagagcgaaaaagucgguguugccuccucugaggaguuagcucggcagcgcggcgugcuggaaagaacugagaagaugguagauaaaauggaccaggaucuaaagaucucgcaaaaacacauuaauucaauaaagagcguguuugggggacucgucaacuacuucaagaguaaacccguggaaacgccuccagagcagaauggcacccugacaucccagcccaacaauaggcuuaaggaggccaucucuacuagcaaagaacaggaggcgaaguaucaagcaucccauccuaaccugcggaaauuggacgauaccgacccaguuccgcgcggugccgggucagcuaugaguacagacgccuaccccaagaauccucaccuccgagcauaucaucagaagauugauagcaaccuggacgaacugucuaugggacucggcagauuaaaagauaucgcucugggcaugcagaccgagauugaggaacaggacgauauccuugacagguugacuacaaagguggauaaacuggacgucaauauaaaguccaccgagcggaaagugcgucaacuauga

SEQ ID NO: 62958 - RNA, 1395 nt, Artificial Sequence
  derived and/or modified sequence opt3 from SNAP47__Homo_sapiens__NP_444280
augagagccgcuaggcggggccugcacugcgcaggggccgagcgcccccgacguagaggaaggcucugggacagcuccggugugccucagcggcaaaagcgcccaggcccguggagaacccagacacaggaacagaugucuagggaugucuguauccauacuuggcccugcacguacuaucuugagccuaaacggcgcuggguuaccgggcaacugucauugacaaguuuaagccugcgauucaugacugacuccaccggagaaauucuagugucuuuuccacucucgucaauaguagagaucaagaaagaagcgagccacuucauuuuuaguuccaucacaauucuggagaagggccaugcuaaacacugguucucuagccuuagacccuccaggaacguggucuuuucaaucauagagcauuucuggcgggaacuguugcucagucagccuggugccguggcagaugccagcguuccacguacccgcggggaggaacugacuggacugauggcuggcucucagaagagacucgaggacacagcaaggguguuacaccaccagggccaacagcuggauuccgucaugcgggggcuugacaagauggagucagauuuggaaguggccgaccgacugcuaaccgagcucgaaagccccgcuugguggccuuuuaguucuaaacuguggaagacgccaccggagacuaaaccccgcgaagauguauccaugaccagcugugagccuuucggaaaggaggguauccuuauuaaaaucccagccguuauuucgcauagaacagaaucucacgugaagcccggcaggcugacugucuugguguccgggcucgagauccaugacucaaguagccuguuaaugcaccgguuugaacgcgaggauguggacgauauaaagguccacuccccuuacgaaauuucuaucagacagagguucauuggaaaaccagacauggcguaucgucugaucagcgcaaagaugcccgagguuaucccgauucucgaggugcaguuuaguaaaaagauggaacuucuggaggacgccuugguacuacggucagcucgaaccuccagcccugccgaaaaaucuugcucaguguggcaugcagcuaguggccugauggguagaacacuccacagggagcccccagccggggaucaagaaggaaccgcgcugcaucuucagacgagccugccugccuuguccgaggcagacacucaggagcucacacaaauacugcgccggaugaagggcuuagcucuggaagccgagucugaacuagagagacaggaugaggcucucgacggcgucgccgcagccguggauagggcuacccugacuaucgacaaacacaaucgccgaaugaagcggcuuacauga

SEQ ID NO: 62959 - RNA, 2724 nt, Artificial Sequence
  derived and/or modified sequence opt3 from SNAP91__Homo_sapiens__NP_001229721
augagcggccagacccugacagacagaaucgccgcugcacaauacuccgugacugggucugccgucgcgagggcuguuugcaaggccacgacccacgaggugaugggacccaaaaagaaacaucucgauuaucuuauucaggcaacaaacgaaacuaauguaaacauaccucagauggccgacacccuguucgagcgggcuacaaauucaaguuggguggucguguuuaaggcauugguuaccacucaccauuuaauggugcacgguaacgaacgcuucauccaguaccuggccagccgaaauacacuauuuaaccucuccaauuuccuggauaaaucuggcucgcauggguaugacaugucaaccuuuauucguagauacagcagguaucuuaacgagaaggcuuucaguuaccggcaaauggccuuugauuucgcgcgcgucaagaaaggagcagacggcgugaugagaacgauggccccagaaaagcuguugaaauccaugccgauccuccagggucagauugaugcucugcuggaguuugacguacaccccaaugagcucacuaacgggguuaucaaugccgcauucauguuacuguuuaaggaucuuauaaaauuguucgcuuguuauaacgacggagugaucaaucugcuagaaaaguuuuucgagaugaagaaaggccagugcaaggaugcccucgaaauuuacaaaagguuccugacccggaugacacgcgucucugaguuucuuaagguggcggagcaagugggcaucgacaaaggggauauuccugaccugacucaggccccaagcuccuugauggaaacccucgagcagcaccugaacacauuagaaggaaagaaacccgguaauaacgagggcucaggggcaccuaguccacugagcaagucuucccccgcuaccacggucacuucaccuaacagcacaccagccaagaccaucgacacuagcccgcccguugaucucuucgcuacagccucugcagccgugccuguauccaccagcaaaccaucgucugaccuucuggauuugcagcccgacuuuuccucaggaggcgcugcggcagccgcugccccugcaccacccccgccugccgguggggcuacggccuggggagaucuacugggcgaagacagucucgcagcgcugagcuccgugcccucugaggcucaaauaagcgauccauucgccccugagcccaccccacccacaacuaccgcagaaauugccacagcuucagccagugcauccacuaccacaaccgucacugcugugacggccgagguugaccuuuuuggcgaugcguucgccgcuagcccuggggaagcaccagccgcuucugagggagccgcagcgccggccacacccaccccuguggcugccgcacuggacgcuuguucagguaaugauccauuugcccccagugaaggcagcgcagaggccgcuccugaguuggaccucuucgcgaugaagccacccgaaacuuccgucccggugguaaccccuacagccucuaccgcaccacccguuccugcuacugcccccucgccagccccugcuguggcagccgcggcugccgcaacaacggccgcuaccgcagccgcgacuacaaccacaacuaccagcgcugccacggcaaccacagcacccccagcucuggacaucuuuggggauuuauucgaguccacuccggaagucgccgcagcuccuaaacccgacgccgcgccaucaauugaucuguuuaguaccgacgccuucucuagucccccucagggagcauccccagugcccgagucaagccuaacagcugaucuccugucugucgacgccuuugcugcaccuuccccggccacuaccgccaguccagcuaagguggauagcucuggcguuaucgaccuuuucggugaugcguucggguccucagcaagugaaccccagccugccagccaagcugccucguccucuagcgcaucagccgacuugcuggcuggcuuuggaggcaguuucauggcgccaucccccucuccugugacgccggcccagaacaaucuccugcagcccaacuuugaggcagcuuucgggacaaccccaagcacuuccucaagcaguucuuuugauccuuccguauucgacggacuuggugaucuguugaugcccacaauggccccagcaggccagccugcccccgucagcauggugccaccgucgccugcuauggccgcgucaaaagcacucgggucugaccuggacaguuccuuagccagccugguuggaaaucuaggcaucucugguaccacuaccaagaagggggaucuccaauggaacgcuggcgagaaaaagcugacaggaggcgccaauuggcagcccaaaguggcuccagcaacguggagcgccggggucccucccuccgcuccacuucagggagccgugcccccuaccucaaguguaccgccaguggccggugcgcccagcguuggccagccuggggccggauuuggcaugcccccagcugguacugggaugccuaugaugccccaacagccagucauguucgcccagccuaugaugcgaccgcccuuuggcgcagcugccgugccaggaacacaguugucuccuucccccaccccagcaucacaaaguccuaagaaacccccggccaaggacccacuggcugaucucaacauuaaggacuuccuguga

SEQ ID NO: 62960 - RNA, 1107 nt, Artificial Sequence
  derived and/or modified sequence opt3 from SNAPC1__Homo_sapiens__NP_003073
augggcacucccccugggcugcagacagacugcgaggcccuccuuagcagauuccaagaaacugauuccgugagguuugaggacuucacggaacuguggcggaacaugaaguuuggaaccaucuucuguggucgcaugcgaaauuuggagaaaaacauguuuacaaaggaggcuuuagcacuggccuggcguuacuuccuaccaccguauacuuuucagauuagagucggcgcgcucuaccugcuuuaugggcuguacaauacccaguugugccagcccaaacaaaagauaaggguugcucucaaagauugggacgaagugcugaaguuccagcaggaucugguaaacgcccagcacuuugacgcagccuauaucuuccggaagcuccgcuuagauagagcuuuucauuucacagcaaugccuaaacugcuuucuuacaggaugaagaaaaagauucaccgggccgaggugaccgaagaguuuaaagacccaucagaucgcgucaugaaguugaucaccagugacgugcuggaagagaugcuaaauguucaugaucacuaucaaaacaugaagcaugugauuagcgucgacaaauccaagcccgauaaagcucucucucugaucaaggacgacuucuucgauaauaucaaaaacauagugcuugagcaccagcaguggcacaaggaccgaaagaauccuucgcugaaaucaaagacaaacgauggagaagagaaaauggaaggcaauagccaggagaccgaaagaugugagagggccgagaguuuggcgaagauuaaauccaaggcauuuucuguaguuauccaagccagcaaaucccggcgucaucgccaggugaagcucgacucaagugauagcgacucugcuuccggucaggggcaagucaaggccacgaggaaaaaggagaaaaaggaaagacugaaaccagcaggacggaagaugucauuacgaaacaagggcaaugugcagaacauucacaaagaagauaagccccugagccucaguaugccugugaucacugaggaagaggagaaugaaucucuuuccggcaccgaguucacagcuagcaaaaagcgcagaaaacauuga

SEQ ID NO: 62961 - RNA, 4410 nt, Artificial Sequence
  derived and/or modified sequence opt3 from SNAPC4__Homo_sapiens__NP_003077
auggacguggaugccgagagagaaaagaucacccaggagauuaaagaacuggagaggauacucgaccccggcagcuccgggucucacgucgaaaucucagagaguagccuugaguccgauucugaagcugacucgcugccuucagaggauuuggacccagcagauccgcccauuagcgaagaggagcgguggggagaagccaguaacgacgaggaugacccuaaggauaaaacauuaccagaagaccccgagacuugccugcaacuaaauaugguuuaccaggaagugauccaggagaagcucgcggaggcuaaccugcuucuggcccagaaucgcgaacaacaggaggaauugaugcgagaucucgcagguuccaaaggcacgaagguaaaggacgggaaaucucugccuccaagcaccuauaugggacauuucaugaagcccuacuuuaaagacaaggugacaggcgucgguccuccagccaacgaggauacucgugaaaaagcugcacaggggauuaaggccuucgaggagcugcucgugaccaaguggaaaaauugggaaaaggcuuuacugagaaaauccguugugucagacaggcuucagcgguugcugcaaccgaagcuacucaaacuggaguaucuucaccagaagcagaguaaagucagcucugaacuggagcgccaggccuuggaaaagcaaggaagagaggcggagaaggaaauccaggauauaaaccagcuccccgaggaagcacuguuaggcaauaggcuggacucccaugauugggagaaaaucucaaacauuaauuuugagggcagccggagugccgaagagauccgcaaguucuggcaaaacucugaacacccuuccauuaauaaacaggaguggagccgagaagaggaggaaagacuccaggcuaucgccgcagcucaugggcaccuugaguggcagaagauagccgaagaacugggaacaucgaggucugcguuucaauguuugcagaaauuccagcagcacaacaaggcccuaaagcggaaagaauggaccgaggaggaagaccguaugcugacucaacucgugcaggagaugcgcguagguucccauauuccauacagaaggaucguuuauuacauggaaggccgggauucaaugcagcugauuuaucgauggacaaagagucuugaccccgggcugaaaaagggauacugggcaccugaggaagaugcuaaauugcuccaggccguggcuaaguacggcgagcaagacugguuuaagauccgcgaggaagucccagguagaagcgaugcccagugcagggaccgguaucugcgcagauuacacuucucccugaaaaaggggagguggaaucuaaaagaggaggagcagcucaucgagcugauugaaaaguacggagugggccauugggcaaaaauagccucugagcuuccccaccguagcggcucacaguguuugaguaaguggaagaucaugauggggaaaaagcaaggacugcggcgaagaaggcgccgggcuagacacuccgugagguggagcucuaccucaaguagcgguuccucuucgggcagcuccgggggaucaaguucuagcuccucaucuagcuccgaagaggacgaaccggagcaggcgcaggcaggcgagggugaucgcgcccuccugaguccucaauauaugguccccgacauggaucuuuggguuccagcucgacagagcacgucucagccuuggcgugggggcgccggagcauggcugggcgggcccgccgcuuccuugucaccacccaaaggaaguagcgccucgcaggguggcuccaaggaagcaucuacuaccgcggcugccccuggggaggaaacaagcccagugcaaguaccggcacgggcccauggacccgugccuagaucagcucaggccagucacuccgcagacacuaggccagcuggcgccgagaaacaggcgcucgaaggugggcgccggcuguuaaccguccccguggagacaguucugagagugcuaagggccaacaccgcugcacgaucuugcacgcagaaggagcaacuccgccagccuccacugcccacuagcuccccgggcgucucaagcggagauaguguggcccggucucauguacaguggcuuagacacagggcuacacaguccggccaacgucgcuggcggcaugccuugcacagaaggcugcucaaucgacggcuguuacuggcaguuaccccuugggugggggacgucguggucccauguacucaggcgagccagcgccccgccgugguucaaacacaggcugauggacuuagagaacaguugcagcaagccaggcucgcaucgaccccuguguuuacgcuguucacccagcuauuucacauugacacagcugguugccuggagguaguccgggaacgaaaagcccucccuccaagacugccucaggcaggcgcccgcgaucccccagugcaucuuuugcaggcuucaucuagugcgcaauccacuccggggcaccuguucccuaacguucccgcccaggaggcaagcaagucugcuagccauaagggauccaggcguuuagccucaagucggguggaaagaacccucccacaggccagccugcuugcuucuacaggccccaggccuaaaccaaagacugucuccgagcuguugcaggagaaacgccuccaagaagcacgagccagagaggcgacccggggucccgugguacugccuucacagcuacuggugaguagcuccguuauccuccagccgccacugccccacacaccucacgggaggccagcucccggcccuaccguccuuaacgugccguugucuggacccggcgccccagcagccgcuaagccugggacuucgggaagcuggcaggaagcaggcacgucagccaaagacaagcgccuguccacaaugcaagcguuaccccucgcuccaguguuuagugaggccgaggguaccgcacccgccgcuucucaggcccccgcacuggggccaggacagauaagcgucuccuguccggaaucaggccuuggucaaucucaggcuccugccgcgagccguaagcagggccugcccgaggccccacccuuccuaccugcagcuccaagucccacuccucucccgguucagccacuguccuugacccauauugggggaccccacguggccacaagcgugccucugcccguaaccugggucuuaacugcucaaggccuccugccagugccuguucccgcaguggucucucuuccaagaccugccgggacaccgggacccgccggccuguuggcuacgcuccugccaccucuaaccgaaacucgggcggcacagggucccagggccccagcucugucauccaguuggcagccucccgccaauaugaaccgcgagccggaaccaagcugccgaacagauaccccugcacccccaacacaugcccuuucgcagucucccgcugaggcggacggguccguggccuucguuccuggagaggcacaaguggcuagagaaaucccggagccccggacuagcucacacgccgauccaccugaagcagagcccccuuggaguggcaggcucccagccuuugguggcguaauccccgcuaccgaaccucgcgggacgccaggaucucccuccggcacccaggagccgagagggccucugggauuggagaaacugccauuaaggcagcccggcccugaaaagggugcccucgaccuggagaaaccaccccuuccgcagccugggcccgaaaagggagcgcuggacuugggccuccugagccaagagggugaagcagccacacagcaguggcuaggcgggcaacggggaguccgugugccacugcuuggcucacgccucccuuaccagcccccagcucuguguaguuugcgagccuuaagcgggcugcuccugcauaaaaaggcucuugagcacaaggcaacuucccugguggucggaggcgaggccgaaagacccgcuggugccuugcaggcaucucuagggcugguuaggggacagcuccaagauaauccugcguaucugcuuuuacgggcccgcuuccuggcugccuuuacccucccagcauugcuggcuacacucgccccgcagggcgugagaacuacccugagcguacccuccagggugggcucagagucugaagacgaggaucuucugagugaguuggaacuagcagaccgggaugggcagccuggaugcacgacagccaccuguccaauucagggugcucccgacucgggcaaaugcagcgcguccucuugccuggauacuucaaacgacccugaugaccucgaugucuuacgaacaagacacgcccgccauaccaggaagcggcguagacugguguga

SEQ ID NO: 62962 - RNA, 297 nt, Artificial Sequence
  derived and/or modified sequence opt3 from SNAPC5__Homo_sapiens__NP_006040
augcugagcagacuccaggagcuuaggaaggaagaggaaacccuguugcgguuaaaagccgcucugcacgaccaacuaaaccgccucaagguggaggaacuggcacuucaguccaugaucucuucacgacguggcgaugagaugcugaguagccauacaguccccgagcagucccacgacauguugguucauguggauaaugaagccucuauuaaccagacuacgcucgagcugucgaccaaaucacacguaacagaagaggaggaagaggaagaggaagaggagagcgacaguuga

SEQ ID NO: 62963 - RNA, 339 nt, Artificial Sequence
  derived and/or modified sequence opt3 from SNCA__Homo_sapiens__NP_009292
auggacguguucaugaagggccugagcaaagccaaggagggggucguugcugcagccgagaaaaccaagcagggaguggcggaagcugccgguaaaacaaaggaaggcguacucuacgugggguccaagacuaaagagggagucgugcacggcguugcaacgguggccgaaaagaccaaagagcaagucacaaacguggguggggcuguaguuacuggagugaccgcagucgcccagaagacaguggagggcgcuggcucuaucgccgcggcaaccggguuugugaaaaaggaucagcuuggaaaggaagguuaucaggacuacgagcccgaagccuga

SEQ ID NO: 62964 - RNA, 1812 nt, Artificial Sequence
  derived and/or modified sequence opt3 from SNCAIP__Homo_sapiens__NP_001229864
augaccuaccugauccagagccaccauuccagaaggucucaaaacugcgccgaggacgugauucggaagacaaaaacugaucagaauggccagcucgaauguguccgcuggaugguuucagagacggaagcuauagcagagcuuaguugcagcaaggacuuccccucccugauccacuaugccggguguuacggacaggaaaagauuuuguuauggcugcuacaauuuaugcaggagcaggguaucucucucgaugagguggaccaggauggcaacucggcgguacauguggcuucacaacacggguaucugggaugcauucagacccuugucgaauacggcgccaaugugacaaugcagaaccaugccggugagaagccuagccagagugcagaacgacaagggcacacucuguguucccguuauuugguuguggucgagaccugcaugucucucgcuagccaggugguaaaacugacaaagcagcugaaggagcaaaccguugaaagagugacucuccagaaucaguuacagcaauuccuggaggcacagaaauccgaaggaaagucacuuccaaguagcccgucuucccccucaagcccugccaguaggaaaucucaguggaaguccccagacgcugaugacgauagcgucgccaaaucgaagcccggcgugcaggagggcauccaaguguuggggucucuguccgcgucaagucgggcacgcccuaaggccaaagacgaagauagcgacaagauacuaagacagcuccugggaaaagagaucuccgagaacgucuguacacaggaaaaacuuucucuggaguuucaggaugcucaagccagcucaaggaauaguaaaaagauuccauuggaaaaacgggagcucaagcuggcacgcuuacgacagcugaugcagagaucccucagcgaaucugacaccgacucaaacaauagugaggaucccaagacgacuccuguuaggaaagcugaccggccacguccgcagcccaucguggagagcguagaauccauggauucugccgagucgcuucaccugaugauuaagaaacauaccuuggcgagcgguggccgcagauucccuuuuuccaucaaggccucaaaaagucuagacgggcacucuccaagccccacauccgaaucaagcgagccugaucuggaaucucaauacccaggauccggcaguauacccccgaaccagccuagcggugacccccagcaaccaucuccugauuccacugcagcucagaagguggccaccucacccaagagugcucucaaaagcccaucguccaagaggcggacaucucagaaucugaaacuucgagucaccuucgaggagcccgugguucagauggaacaaccuagccuggaguugaacggggaaaaggacaaagauaagggacgcacgcuccagagaacuucaacaaguaaugaguccggcgaccagcugaagaggccauuuggcgccuuccggucuauuauggagaccuuaagcgggaaccagaauaacaacaauaacuaucaagcagccaaucagcugaaaacuuccacacuaccgcucaccucacugggacgcaagacggaugcuaaagguaaccccgcgagcagugcaucuaagggcaaaaauaaggccgaaauguacuccagcugcaucaaccuuucgucaaauauguugauugaggaacaucuguguaacgacaccagacacaaugacaucaacaggaagaugaaaaagucuuacaguaucaaacacauugcugagccugaauccaaggagcucuuucuguga

SEQ ID NO: 62965 - RNA, 405 nt, Artificial Sequence
  derived and/or modified sequence opt3 from SNCB__Homo_sapiens__NP_003076
auggacguguucaugaagggccugagcauggccaaagagggggucguugcugcagccgaaaagaccaaacagggagugacagaggcggcugaaaagacuaaagaggguguacucuacgugggcuccaagacgagagaaggggucgugcaaggaguugccucuguggcagagaagaccaaagagcaggccucacaccuuggcggugcugucuuuaguggggcaggaaacaucgccgcugccacaggccuggugaagagggaagaguuccccacugauuugaaaccugaagagguagcgcaggaggcagccgaagaaccauuaauugaaccgcugauggagcccgaaggcgagagcuaugaggacccuccacaggaagaguaccaagaauaugagcccgaggcuuga

SEQ ID NO: 62966 - RNA, 384 nt, Artificial Sequence
  derived and/or modified sequence opt3 from SNCG__Homo_sapiens__NP_003078
auggacguguucaagaaaggcuuuagcaucgccaaggagggggucguuggagcuguggagaaaaccaagcaggguguaacagaagcagccgagaaaacuaaggaaggcgugauguacgucggggcgaagacgaaagaaaacgugguucaauccgugaccucugucgcugagaagacaaaagagcaggccaaugcagugucagaagccguaguuaguagcgugaacacugucgcuaccaagacaguggaggaagcagagaauauugccgugaccuccggagucguuagaaaagaggaucugaggcccucugcuccucagcaggaaggcgaggccucgaaggaaaaggaggaaguggcggaggaggcacaaucagguggggacuga

SEQ ID NO: 62967 - RNA, 2733 nt, Artificial Sequence
  derived and/or modified sequence opt3 from SND1__Homo_sapiens__NP_055205
auggccagcuccgcucagucuggcgggucaaguggaggucccgcagugccuaccguccaaagaggcaucauuaagaugguucugagcgggugcgccauaaucgugaggggacagccacggggcgguccgcccccugagcgccagauuaaccucuccaauauccgagcggggaaccuugcucguagagccgcagccacacagccagacgcuaaagauacucccgacgaaccuugggcauucccagccagggaguuucugcggaagaaauugauuggaaaggaaguauguuucacgaucgagaauaaaacaccccaaggccgcgaauacggcaugauauauuuagggaaggauaccaacggagagaauaucgcugagucucugguggccgaaggucuagcgacuagaagggagggcaugcgggcaaacaauccugaacagaaccgccucucggagugcgaggaacaggccaaggcugccaaaaaggggauguggucagagggaaauggcagccacaccauucgagaccugaaauacacaaucgaaaacccaagacauuuugucgauagucaccaucagaagccggugaaugcaauuaucgagcacguuagggacgguuccgugguccgggcccuucuguugcccgauuauuaccucgugaccguaaugcugucugggauaaaauguccuacuuuccgucgcgaagcugacggaagcgagacaccagagcccuuugcggccgaagcaaaguucuuuaccgaguccagacugcuccaaagggauguucagauuaucuuagaaucaugccauaaccagaauauucugggcacgauccuucacccuaacggcaauaucacugaguugcugcuaaaggaaggguucgcucgguguguggacuggaguauugccgucuauacccgaggagcugagaaacuccgcgccgcagagagauuugccaaggaaaggcggcugcgcauauggagagauuacguggcuccaacagcgaaccuugaccagaaagauaagcaauucguggcaaaagucaugcagguucugaacgccgacgcuaucgugguaaaguugaauagcggugacuauaaaacuauucaccucucuuccaucaggcccccgcgucuggagggcgaaaacacccaggauaagaauaagaaauuacggccucuguacgacauacccuacauguuugaggcccgagaguuccucagaaagaaacuuauugggaagaaagugaacgucacaguggauuauaucaggccagcaagcccugccaccgaaacgguucccgcuuuuagcgagcgcacuugcgccacagugaccaucggaggcauuaauaucgcagaagcgcuggucaguaaggguuuggcuacugugauucgguacagacaagacgaugaccagaggucuucccauuaugaugagcuacuggccgcagaagcccgcgcuauaaagaacgggaaaggccuccacagcaagaaagagguaccaauccaucgaguugccgacauuucgggagauacacagaaggcaaaacaguuccugcccuuccuucaacgggcuggccguucugaggccguggucgaauacguguuuuccgggucaagacugaaguuguaucucccuaaggagaccugucugaucacguucuuacuggcgggaaucgaaugcccaaggggugcccgcaaucuaccgggccucguccaggagggggaacccuuuagugaggaggcuacccuguucacaaaagaacuuguguugcagcgggagguugaaguggagguagaaagcauggacaaggcaggaaacuuuauuggcuggcugcacauagauggugccaaucucuccguccugcuuguggagcacgcucugucuaaaguucauuucacugccgagagaagcucauacuauaagaguuugcucuccgcagaagaggcggccaaacagaagaaggaaaaagugugggcucacuacgaggaacaaccugucgaggaggugaugccaguacuggaagagaaggaaaggagcgccucuuacaaacccguguuuguuaccgagaucacagacgacuuacauuucuauguccaggauguggagacugggacccagcuggaaaagcuaauggagaacaugcgaaaugacauugcaucacacccuccaguggaaggcaguuacgcuccccgccggggagaguuuuguaucgccaaauucgucgauggcgaaugguauagagcaaggguugagaagguggagagcccggccaaaauucauguguuuuacaucgacuaugggaaccgugaaguacucccuuccacacgccugggaacccuuucuccagcuuucucgacucgggucuugcccgcgcaggccacggaguacgcauuugcuuucauacaagugccucaggaugacgaugccagaacagacgccguugauagcguggucagggacauccagaauacccagugccugcucaacguggaacaccuguccgcugguuguccccacguuacuuuacaauucgcagauucaaagggcgacguggggcugggacuuguaaaggagggcuuggucaugguggaagugcgaaaagagaagcaguuucagaaagucauuaccgaguaucucaaugcccaagaaagugcgaagucugcucggcugaaccuauggcgcuacggugauuucagagccgacgacgcagaugaguuuggguacucaagguga

SEQ ID NO: 62968 - RNA, 4242 nt, Artificial Sequence
  derived and/or modified sequence opt3 from SNED1__Homo_sapiens__NP_001073906
augagacacggcguggccugggcucugcucgucgcagccgcgcuugggcugggagcuagggguguucggggcgccguggcauuggccgacuucuaccccuuuggggcugaacgcggagaugcaguaaccccuaagcaggacgauggcgguagcggguuacgaccacuguccgugccguuccccuuuuucggagccgaacauucuggccuauaugucaacaauaacggcaucauuucauuucucaaagaggugagucaauucacaccuguugcuuuuccaauagccaaggaccguugcguggucgcggcauucugggccgauguggacaauagaagggcuggggauguauacuaucgggaagccacugaccccgcaaugcugcgcagagcuacggaggauguuaggcacuacuuuccugaacuucuggacuucaacgccaccuggguguuugucgcgacaugguaucgggugacuuucuuuggagguagcuccucuucgccagugaauaccuuccagacagucuugaucaccgauggcaaacucucauucacuauuuuuaacuacgagagcaucguuuggacaaccgggacgcaugccaguuccggaggcaaugcaacugguuuagggggaauugcugcccaggcuggcuucaacgccggcgacgggcagcgcuauuuuucuauccccggaagccgaaccgcagauauggccgagguggaaacaacuaccaauguaggugugccuggcagaugggcuuucaggauagacgacgcgcaaguccgggugggcggauguggccacacaaccuccguuugccuggcacuccguccauguuuaaacggugggaagugcaucgaugacugugugacgggcaauccgucauacacuugcaguugucugagcggauuuacaggccgcagaugccaucuugaugucaacgagugugccucucagcccugccagaaugggggaaccuguacucacgguauuaacuccuucaggugccagugcccugcuggcuuugggggaccaacaugugaaaccgcccaaucacccugcgacacgaaagagugucagcacggcggucagugccagguggagaaugggagcgcaguauguguuugccaagccggcuacaccggagcugccugugaaauggauguggacgauugcaguccugacccauguuugaacggcgggucuugcgucgaucuggugggaaacuauacaugucuaugcgcagagcccuucaagggucuccggugcgaaacuggcgaccauccggucccugaugcgugucuguccgcucccugccacaaugggggaaccuguguggacgccgaccagggcuacguuugcgaguguccagaagguuuuauggggcuugauugccgagagcgcgugccugacgauugugagugcagaaacggcggaaggugucugggcgcaaauacaacuuugugccaguguccccucggguucuuuggacuguuaugcgaguucgaaaucaccgccaugccaugcaacaugaauacacaaugucccgacggcgguuauugcauggaacaugggggaagcuaccuguguguaugccacaccgaucacaacgcuucgcauucucucccuuccccaugugacucagauccgugcuuuaauggcgguaguugugacgcccacgaugacagcuauacuugcgaguguccccggggcuuccaugggaagcacugcgaaaaagcacgcccucaucuuuguuccucuggaccaugcagaaacggcgggacgugcaaggaggcuggaggcgaguaccacuguagcugccccuauagguucacaggucgucacugugaaauugggaaaccugauucaugcgccaguggaccaugucauaauggcgguaccugcuuucacuacaucggcaaguacaaaugugacugcccaccgggguucuccggacggcauugugagauagcgccuagcccaugcuuucgaucucccugugucaacggcgggacuugcgaagauagagacaccgacuucuuuugccacugucaggccggauauaugggcaggcgcugccaggcugagguggauugugguccucccgaagagguuaagcacgcaacacugcgguucaaugggaccagauugggagccguggcucuauacgccugcgacaggggcuauucacugagugcaccaagccgcauucgagucugucagccucauggugugugguccgagcccccacaaugccucgaaaucgaugagugucggucucagccgugccugcacggcgggucgugucaggaccguguagcgggauaccuuugccuguguagcacuggcuaugaaggggcccauugcgaguuggagagagaugaaugcagggcucacccuugucgcaacggaggcuccugccggaaucuccccggugccuacguguguagaugcccagcaggguuuguuggaguccauugugagacagaaguggacgcuugcgauucaagucccugucagcacggcgggaggugcgagucugggggaggugccuaucugugugugugcccugagagcuucuuuggcuaccacugugaaacggucuccgacccaugcuucucaagccccugugggggacgaggcuacugcuuagcaucuaacgguucccauaguugcaccuguaagguuggguauacuggagaggauugcgccaaagaacuguuuccuccgacagcucuaaagauggagcgcguggaagagagcggcgugucuauuuccuggaauccacccaacggcccugcggcccggcaaaugcucgacggguacgcaguaaccuaugucucaagugauggaagcuacagaaggacagacuucguggaucguacucgcucgucccaccagcugcaggcucuugccgccggucgggcuuauaacaucucuguuuuuagcgugaaaagaaauucaaacaauaagaacgacaucaguaggccagcagucuugcuggcccgaacccggccccgcccuguggaaggcuucgagguuacgaaugugaccgcguccacaauuucuguacagugggcucuccauagaauaaggcacgccacugucagcggggugcggguguccauccgacauccggaggcacugagagaccaagccaccgaugucgaccgcucaguugauagguucacauuucgugcacuucugcccggaaaacgguacacuauucaguugaccacgcucagcggccugagaggugaggaacacccaacagaaaguuuagcuaccgccccuacucacguguggacaaggccccugcccccugcgaaccuaaccgcugcccgcguaacugcaaccucugcccauguggucugggacgcucccacaccagggucccuccuggaggccuaugugaucaauguuacgaccagccagucgacuaagucacgauacgugccgaacggaaaacuugcaucuuacacagucagagauuugcugccuggccggagguaucagcucagugugauagcuguucaauccaccgaacugggcccccagcacagcgagccagcccauuuauacauuaucacaucuccccgcgacggggcggaucguagauggcaccagggaggucaccauccucgggugcugaagaauaggccacccccugcccgccuuccggaguugcgacuccugaacgaccacagcgcaccagaaacucccacccaaccucccagauucuccgagcuagucgauggccgggggaggguaucagcucgcuuuggaggcaguccaagcaaggccgcuacggugagaucucagccuacagcauccgcccagcuggaaaauauggaggaggcccccaaaaggguuucacucgcucugcagcuuccagaacaugguaguaaggacaucgggaacgugccuggaaauuguagcgagaacccgugccaaaauggcggcaccuguguccccggggcggaugcacacuccugcgacuguggaccagguuucaaaggccggcguugcgaauuggccuguauuaaggugucucgcccuugcacucgacuguuuucggagaccaaggcuuuccccguaugggaagggggagugugucaucacgucuauaaaagaguuuacagggugcaccaggacaucugcuuuaaggagagcugcgagucaacaucccugaaaaagacuccaaaccggaaacagaguaagucucagacccucgagaaaagcuga

SEQ ID NO: 62969 - RNA, 777 nt, Artificial Sequence
  derived and/or modified sequence opt3 from SNF8__Homo_sapiens__NP_009172
augcacagaaggggcgugggggccggagcuaucgcaaagaaaaagcuggccgaggcgaaauacaaggaacgggguaccguccucgcugaggaccagcuugcccaaaugagcaaacagcuggauauguucaagacaaacuuggaagaguuugcauccaagcauaaacaggaaauucgcaagaaucccgaguuccgaguucaguuucaagacaugugcgccacuauaggcguggauccuuuagcuucugggaaaggauucuggucagagaugcugggcguaggugacuuuuauuacgaacuaggggugcagaucauugaggucugucucgcacugaagcaccguaacggaggccuuaucacgcuggaagaguugcaucaacaggugcucaaaggcagagggaaguucgcccaggauguuagucaggacgaucugauuagggcuaucaagaaacugaaggcccucggaaccgguuuuggcauaaucccagucgggggaacauauuuaauucagagcgugccggcggagcugaauauggaccacacugugguacuucaguuggcagagaaaaacggcuacguuaccguguccgaaaucaaggccucucugaaaugggaaacagagcgggcucgccaaguccuagaacaucuccugaaggagggucuugccuggcuggauuugcaggcacccggggaggcucacuauuggcucccugcccuguucaccgacuuauacucgcaggaaauuacugcggaggaagccagagaggcacugccauga

SEQ ID NO: 62970 - RNA, 948 nt, Artificial Sequence
  derived and/or modified sequence opt3 from SNIP1__Homo_sapiens__XP_011540462
auggaccugcaguuccacauggccggcgaggcuagccaauccuggugggaagcaagaaggucuaagucacauggguggcggcaggagcgcgaagaucacccccgacguggaagagaggacaggcagcaucgggaaccuagugagcaggagcaccgcagagccaggaacagcgaucgggaccgccaucgaggucacucccaccaaagaaggaccucuaaugaacggccaggcucggggcagggacagggccgugaucgcgacacacagaaccuccaagcgcaggaggaagagagagaguuuuacaaugcuaggcggcgagaacaucgccagagaaacgaugugggugggggaggcucagagagccaggaacuugucccgaggcccggcgggaauaacaaagagaaggaaguuccugccaaagagaagccaaguuucgagcuguccggagcauuguuagaagacacuaauacguuucggggugugguaaucaaauauucugagcccccugaagcccgcauuccaaagaagagauggaggcuguaccccuucaaaaacgaugaggugcuaccugucauguauauacaccgucaaagcgcuuaccuccugggccggcaucgaagaaucgcagacauuccaaucgaucacccguccugcucaaagcagcacgccguguuucaguauaggcuuguugaauacacccgcgcugacgggacagugggacggagagucaaacccuauauuaucgaucugggcagugguaaugggacuuucuugaacaauaagaggauagagccucaacgcuacuacgagcucaaagaaaaggacgugcugaaguuuggauucagcucucgagaguauguacugcuccaugaauccucagacaccagcgagaucgaucggaaagacgaugaagacgaggaggaagaggaagagguuagugauucuuga

SEQ ID NO: 62971 - RNA, 2298 nt, Artificial Sequence
  derived and/or modified sequence opt3 from SNRK__Homo_sapiens__NP_001094064
auggccggcuucaagagaggguacgacggaaaaaucgcuggucuguaugaucucgacaagacccuuggcagggggcacuuugcaguggucaaacuggcccggcauguuuucacaggagagaagguggcgguaaaagugauugauaagacuaaguuggacacguuagcuaccggccaccuguuucaggaaguccgcugcaugaagcuagugcaacaucccaacauaguucgacucuacgaggugaucgauacacagacuaaacuguaucuuauucuggaauugggugacgggggagauauguucgacuacaucaugaaacacgaggaaggccucaaugaggaucuggccaagaaauauuuugcacagauuguccaugccaucagcuacugucacaagcugcacgugguacaucgugaccucaagccugagaacguuguguucuuugaaaaacagggcuuagucaagcugaccgauuucggguuuuccaauaaauuccaaccaggaaagaaacuuacaaccucuugcgguucauuggcuuauagugcaccggagauacugcuaggcgacgaauacgaugcccccgcuguggacaucuggagccucggggugauucuguuuaugcuugucuguggacagccuccauuccaggaggccaacgacuccgagacucugacaaugaucauggauugcaaguacaccguucccucucacgugucgaaagaauguaaggacuugauuacgagaaugcuccagagggauccuaagcggcgcgcgucacuggaggaaaucgagaaucauccaugguuacaaggcguagaccccagcccugcaacuaaauauaacauaccacuggugaguuacaagaaucucuccgaagaggagcacaacucuauuauccagagaaugguccuuggugauauugccgacagggaugcuaucguggaagcccuggagaccaaucgguauaaccacaucacagcaacuuacuuuuugcuagcugaacgcauucugcgagagaaacaggaaaaggagauacagaccagaagcgccuccccgucaaauaucaaagcgcaauucaggcagaguuggcccacaaagauugacguuccucaggaucucgaggacgaucugaccgccacgccacuuagccaugcaacugugccccaaucuccugcucgggccgcugacuccguccugaacgggcaccguucaaagggauugugcgacagcgccaaaaaggaugaccucccagaacuggcaggccccgccuuaaguacagugccgccugcuucucugaaacccaccgcguccggccgcaagugucuauucagaguagaggaagaugaggaagaggacgaggaagauaaaaagccaaugagccucucgacucagguugugcugaggcggaagccuucugucacaaaucgacuuaccucccgcaaaucagcacccguguugaaccagaucuuugaggaaggggagagugacgaugaguucgacauggaugaaaaucugccacccaagcucagcagacugaaaaugaacauagccuccccuggaacgguccauaagagguaucaccggcgcaaaucucaggguagaggcagcucaugcaguuccagcgagaccucugacgaugacucagaaaguaggcgucggcuugauaaggacagcggguuuacauacuccuggcaucgaagagacucuucggagggaccaccgggcagcgaaggugaugggggcggacaauccaagcccucaaacgcuaguggcgggguggacaaagccucuccuagcgagaauaacgcaggagguggcuccccaucaagcgggucuggaggcaaucccacuaacaccuccgguacaacuaggcgcugugccgggccuaguaauagcaugcagcuggcuucucgguccgccggcgaguugguugaaucacucaagcugaugaguuuaugccugggaagccagcuacacggcucgaccaaauauauuaucgauccacagaacgggcucuccuucucuagcgugaagguacaagagaaaucaacauggaagauguguaucaguuccaccggaaaugcaggucagguccccgcggugggcgggauuaaauuuuucucugaccacauggcugauacuacgacagaacuggagagaaucaagagcaagaaccuuaaaaauaacguuuugcagcugccgcucugcgaaaagaccauuuccgugaauauacagaggaacccuaaagagggacuguuaugcgccucaagcccagcaaguuguugccaugucaucuga

SEQ ID NO: 62972 - RNA, 6411 nt, Artificial Sequence
  derived and/or modified sequence opt3 from SNRNP200__Homo_sapiens__NP_054733
auggccgacgugaccgcuagaagccugcaguacgaguauaaggcaaacuccaaucucguccuucaagccgauaggucucugaucgaccggacacgccgagaugaacccacuggcgagguuuugucauuaguggggaaacuggaaggaacgcguaugggugacaaggcgcagagaaccaaaccucagaugcaggaggaaaggcgggcuaagcgcagaaaaagggaugaggaccggcacgauauuaacaagaugaagggcuacacacuacucagugaggggauagacgaaaugguaggaaucauuuauaaaccaaagacuaaagagacccgcgaaacauacgaggugcugcuuagcuucauccaagccgcacugggcgaucagccgcgagacauuuugugcggugccgcugaugagguccucgcagugcugaagaaugaaaaacugagagacaaggagaggcggaaggaaaucgaucucuuacuggggcagaccgacgacacucguuaucauguucuugugaacuugggaaaaaagauaacagauuacggcggcgacaaagagauccagaauauggaugacaacauugaugaaaccuauggggucaaugugcaauuugaguccgacgaggaagagggagaugaagacguauacggugagguucgcgaagaggccucugaugacgauauggagggcgacgaagcuguggucagauguacgcugucggccaaccuaguggcgucaggggagcucaugagcaguaagaaaaaggaccugcaccccagggauaucgacgcauucuggcuucagcggcagcugucccgauuuuacgaugacgccauugugucucagaaaaaggcugaugaagucuuggagauccucaagacugccagcgacgaucgcgaaugcgagaaucaacugguuuuacugcucggauucaacaccuuugacuucauaaaagugcuuagacagcauaggaugaugauucuguauuguacauugcuagcauccgcucagucagaggccgaaaaggagcggaucaugggcaaaauggaagcggauccugagcugaguaaguuucucuaccaacugcacgagacugaaaaagaggaccuuauucgcgaagagagaagcaggcgugaacggguacgacagucuagaauggauaccgaccuggagacaauggauuuggaccaggguggggaggcccucgcaccaaggcaggugcuggacuuagaagaucuggucuucacccaaggaucccauuuuauggcuaauaagcgcugccagcuacccgacggcucauuccggagacagaggaagggcuaugaggaagugcacguuccugcccucaaaccaaagcccuuugggagcgaggaacagcugcuuccuguggagaaauugccaaaguacgcucaagccggauucgaggguuuuaaaacgcugaaccgcauccagaguaagcucuaucgagcagcccuggaaacugaugagaaucuucuguugugugcuccgacaggcgcggggaagaccaacgucgcacucaugugcaugcugcgggaaaucggaaaacacauuaauauggacggcacuauaaacguggaugacuucaagaucauuuacaucgcccccaugcguucuuuaguacaggagaugguugguuccuucgggaaaagacuggcuacauauggcauaaccguggccgaacuaacgggagaucaucagcucuguaaggaggagauuagcgcaacccaaaucaucgucugcacaccugaaaaaugggacauuaucacuaggaagggcggggagcgcaccuacacacagcuggugcggcuuauuauauuggaugaaauccaccugcuccaugacgauagaggaccaguccuggaggccuuaguggcuagggccauucgaaacaucgagaugacucaggaagacguucgccugaucggucuuucggcaaccuugcccaauuacgaggauguggcgacauuucuccggguagacccugcuaagggccuguucuauuuugacaacucuuucagaccagucccccuagaacagaccuacguggggauuacugagaaaaaggccauaaaaagguuucaaaucaugaaugaaauuguuuaugagaagaucauggagcacgcaggaaaaaaccaggugcuggucuucgugcacucccguaaggaaacgggcaaaacagcccgcgcuauucgggauaugugucucgagaaggacacccugggucuuuuuuugagagaagggucagccaguacugagguacugaggaccgaagcagagcagugcaagaauuuagagcucaaagaucugcuuccguacggcuucgcuauccaucacgccggaaugacacgaguggaccggacccugguugaagauuuguuugcggacaagcauauacaaguccucgugagcacugccacacuggcuuggggcgugaaccuaccugcacacacggucaucauuaaagggacccagguuuauucccccgagaagggacgcuggacugaacugggugcccucgauauccugcagaugcuuggcagagcugggaggccacaguacgacacaaaaggagagggcauuuugaucaccucucauggugaacugcaauauuacuuaagccuccugaaucagcagcuuccuauagagucacagauggugaguaagcugcccgauaugcuaaacgccgagauugugcucgggaauguacaaaacgcaaaggacgcggucaauuggcugggcuacgccuauuuguacauccggaugcugcgauccccaacauuauauggaauuagccacgaugaccucaaaggcgacccccugcuugaucagagacgccuggacuuggugcacacugcugcccucaugcuggauaagaacaaucuaguuaaauacgacaagaaaaccgggaacuuccaggugacggaacugggaaggaucgcaucucauuauuacauaaccaaugauacaguccagacuuauaaccaacuucucaagccuacccugucagagaucgaauuguuucguguguucagucugagcuccgaguuuaagaacauuacaguucgggaggaagagaaauuagaacuccagaagcugcuugagagagugccaaucccgguaaaagaaucuauugaggagcccucggcuaagaucaauguccuguugcaggccuucauaagccaacucaaacuggaaggcuucgcacuaauggccgacaugguguacgugacucaguccgcugguaggcugaugcgcgcgauuuuugagaucguccuuaaccgagggugggcccagcucaccgauaagacgcugaauuuguguaagaugaucgacaaaagaauguggcagucaaugugcccuuuacggcaauucaggaagcugccagaagagguugugaaaaagauugaaaaaaagaacuuucccuucgagcgccucuacgaucugaaucacaacgagaucggagaacuuauucguaugccuaaaaugggcaagacaauacauaaguauguacaccuguuuccaaaauuggagcuaagugugcaccugcagcccaucaccagaucuacucucaaggucgaacugacaauuaccccggacuuccagugggaugagaaagugcaugguagcuccgaagcauuuuggauccuuguugaggacguggauucagaggucauuuuacaccaugaauacuuccugcucaaggcuaaauaugcccaggacgagcacuugaucacuuuuuucgugccuguuuuugaaccacugcccccucaauacuucauacggguggucagcgacagguggcucucuugcgagacccagcugcccguauccuuucgccaucuuauccugccagagaaguauccucccccaacagaauugcuagaucugcagccgcucccugugagugccuuacgaaauagcgcuuucgagucucuguaccaggacaaguuccccuuuuucaacccaauucaaacgcagguuuuuaauaccguguauaacuccgaugacaaugucuucgugggcgcacccacugggucaggaaaaacaaucugugccgaauuugcgauucuuagaaugcugcuccagaguagcgagggccggugcguauacaucaccccuauggaagcuuuggccgagcagguguacauggauugguaugagaaguuccaagacaggcugaacaaaaaggucguucuccugacaggggaaacuucgaccgaucuuaaacuacugggaaagggcaauauaauuaucuccacgccagagaagugggacaucuugucucgcagauggaaacagaggaagaacgugcagaauauuaacuuauuuguggucgaugaagugcaccugauagguggggagaacggacccguucucgaaguaaucuguagccggaugcguuacauuucaagucaaaucgagcgcccuauucgaaucguggcacuguccucuagccuuuccaaugccaaagacgucgcucacuggcugggcugcucagcaacaagcaccuucaacuuucauccgaaugugagaccaguuccccucgaguugcacauacaggguuucaacaucagucauacucagaccaggcugcuaucuauggccaagccuguguaucacgcgauuacaaaacauuccccaaagaagcccgucaucguguuuguaccuagccggaaacagacucgccugaccgcuauugauauccucacaacgugugccgcagacauacaaagacagagguuccuucacugcaccgaaaaggaucugauuccguacuuagagaaauugucggacucaacucugaaggaaacacuccugaauggcgucggguaucuucacgagggacugucucccauggaacggcgacucguggagcaguuguucaguuccggcgccauccagguuguggucgcuagcagaucucuguguugggggaugaacguggccgcacauuuaguuaucauuauggacacccaauacuauaauggaaaaauccacgcuuacguggauuacccaauauaugacguccuacagauggugggccaugccaaccgcccucugcaggaugacgaggguaggugcguaauuaugugucaggggagcaagaaggauuuuuucaaaaaguuucucuacgaaccccuuccaguggagucccaccuggaccacugcaugcaugaucacuucaaugcggaaaucguuacuaaaacaauugagaacaagcaagacgccgucgauuauuugaccuggacguuucuguaccggcguaugacucagaauccuaacuauuacaaucuccagggaaucucacauagacaccugagugaccaucuuagcgagcucguggaacaaacccugucugauuuggagcaguccaaauguauaucaauugaagacgagauggacguggcaccccugaacuuaggcaugaucgcugccuauuacuacaucaauuauacaaccauugaacuauucaguaugagccugaacgcuaagacuaaagucaggggucucaucgagauuauauccaacgcagccgaguacgaaaauaucccaauucgccaccacgaggauaaccuucugcggcaguuggcccagaagguaccgcauaagcugaauaacccuaaauuuaaugacccccacgugaagacaaaccuccugcuucaagcucauuuaucucgaaugcagcugucggcggaacuccagagcgauaccgaggaaaucuugucaaaagcaaucagacugauucaggccugcguugacgugcuauccaguaauggcuggcugucuccagcucucgccgcaauggagcuugcccaaauggucacacaggcuauguggagcaaggauuccuaucugaaacaguugccccacuucacuucagagcacauaaagaggugcaccgacaaggggguggaaucuguuuuugauaucauggagauggaagacgaggaacgcaacgcgcugcuccagcugacggauagccaaauugccgacguggcacgguucuguaauagauacccuaacaucgaguuaaguuaugaggucguggauaaagacuccauucguagcggaggcccaguagugguucuuguccagcuggaaagggaggaagaggugacagggcccgugaucgcuccucucuuuccgcagaagcgggaggaaggauggugggucguuauaggcgaugccaaaucuaauucacuaaucuccauuaagcgccugaccuugcagcaaaaagcaaaggugaagcuggacuucguagccccagcuacuggugcccauaacuacacccucuauuuuaugagugacgcguacauggggugcgaucaggaguacaaauucagcguggacgucaaggaagcagagacagauucggacucugauuga

SEQ ID NO: 62973 - RNA, 468 nt, Artificial Sequence
  derived and/or modified sequence opt3 from SNRNP27__Homo_sapiens__NP_006848
augggcagaagcaggucccggucuccccgccgagagcguagaaggucacggaguaccagccgcgaaagagagaggcggcgccgagaaagauccaggucucgggagcgugaccgcagaaggucgcggucacgaagcccucaccgcagaaggagucgguccccacgcagacauaggucuacaagcccgucccccucacgucugaaggaacggcgagaugaggagaagaaggaaacuaaagagacgaagaguaaagaaagacagaucaccgaggaggaccucgaagggaagacagaggaagagauugaaaugaugaaacuuaugggauucgccagcuuugauucuacuaaggguaagaaaguggacggcuccgucaacgcuuacgcaauaaauguuucacaaaagaggaaauaucgccaguacaugaaccggaaagggggauucaauagaccucuggauuuuaucgccuga

SEQ ID NO: 62974 - RNA, 1287 nt, Artificial Sequence
  derived and/or modified sequence opt3 from SNRNP70__Homo_sapiens__NP_001287998
augacccaguuccugcccccuaaccuccuugcccuguuugcuccaagagacccgauccccuacuugccuccauuagagaagcugccccacgaaaaacaucacaaucaaccuuauugcggcauugcaccauacauaagggaguucgaagauccccgggacgccccuccaccgacacgcgcggagacucgagaagaacguauggagagaaagaggcgggagaaaaucgagcgcagacagcaggaaguggagacggagcuaaagaugugggauccccauaacgacccuaaugcucagggggaugccuuuaaaacccucuucgucgcaaggguuaacuaugacacaacugaaagcaagcugcggcgcgaguuugaaguguacggaccaauuaagcgaauccacaugguauauuccaaaagaucugguaagcccaggggcuacgccuucauugaguaugaacaugagcgggauaugcacucagcuuacaaacacgcagacgggaagaaaaucgauggacgucgcgugcuugucgacguggagagaggcaggaccguuaaggguuggcggccucgacgccugggagggggcuugggcgggacaagaaggggaggugccgaugugaauauacggcauaguggccgcgacgauaccagcagauacgacgaaagggaccgugaucgggaccgagagagagaaaggcgcgagcgguccagagaaagggauaaggagcgcgagcgacggcguucuagaucgagggaccgccggagaaggucacgaagccgcgauaaagaggaacggagaaggagucgugaacgcuccaaggacaaagaucgggacagaaagaggcgaucuagccggucccgcgagagagcuaggcgggaacgagagagaaaagaggaacuccgcgggggaggcggugauauggccgagccaucagaagcgggggacgcacccccggaugacggaccucccggcgagcugggcccagacgggccugauggacccgaggaaaaggguagggaccgugaucgggagagaaggcgcagucaccgaagcgaaagagagcggaggcgcgaccgugauagagaccgggauagggaccgcgaacauaaacgaggcgagagagggucugagcggggaagggaugaagcccgcggcggugggggcggacaagacaacggccuggaggggcucggaaaugauuccagagacauguauauggaaucagaggguggcgauggguacuuagcuccagaaaacggauaucugauggaggccgcacccgaguga

SEQ ID NO: 62975 - RNA, 849 nt, Artificial Sequence
  derived and/or modified sequence opt3 from SNRPA__Homo_sapiens__NP_004587
auggccgugcccgagaccagaccuaaccacacaaucuacauuaauaaccugaaugaaaagaucaaaaaggacgagcucaaaaagagccuuuaugcuauauucucccaguuuggccaaauucuggauaucuuggucucuaggucauuaaaaaugcgggggcaggcauucguuauuuuuaaggaagugaguagcgccacuaacgcgcugcgcuccaugcagggauucccauuuuacgacaagccgaugcgaauccaguaugcuaaaacggauucugacauaaucgccaagaugaaagguaccuucguagagcgugauagaaagagggaaaaacggaagcccaagucgcaagagacaccagcaacuaaaaaggccgugcagggcgggggagcuaccccugucgugggcgcaguucagggucccgugccugggaugccacccaugacacaggccccucgcauuaugcaucacaugccaggacaaccgcccuacaugccuccacccggcaugaucccuccacccggccuagcuccggggcagauuccucccggagccaugccaccucagcagcucaugcccggucaaaugccacccgcgcagccucugucagagaauccaccgaaccauauccuuuuucugaccaauuugcccgaagagacuaacgaacucaugcugagcaugcuguucaaucaguuuccuggcuucaaagaggucagacucgugccagggaggcacgacauagcauuuguagaguucgauaacgaaguucaagccggagcugcccgggacgcauuacagggcuuuaagauuacacagaauaacgcuaugaaaaucaguuucgccaagaaauga

SEQ ID NO: 62976 - RNA, 696 nt, Artificial Sequence
  derived and/or modified sequence opt3 from SNRPB__Homo_sapiens__NP_003082
augaccgugggcaagagcuccaaaaugcugcagcacaucgacuacagaaugaggugcauucuccaagaugggcggauauucaucggaacauuuaaggccuucgacaaacauaugaaccuuauucugugugauugcgacgaguuucgcaagaucaaacccaaaaauucuaagcaggcugaacgagaggaaaagcgugucuuggguuuaguucugcuaagaggcgagaaccucgugucaaugacuguagaagggccuccaccgaaggauacgggaauugcaagggugccccuggccggcgcggcuggugggccuggaaucggccgggccgcaggccgcgggauaccagccggaguccccaugccucaggcuccagcaggucuugccggccccgugagagggguuggaggcccuagucagcaagugaugaccccacaggguagggggacagucgcugccgcggcagccgcugccacugcaagcaucgcuggagccccgacccaguaucccccuggccggggcgggccacccccuccaaugggacgcggugcgcccccgccuggcaugauggggcccccaccuggaaugcgacccccaaugggucccccuaugggcauuccaccggggagaggcacacccaugggaaugccuccacccggcaugaggccuccacccccggggaugcggggacuguuguga

SEQ ID NO: 62977 - RNA, 480 nt, Artificial Sequence
  derived and/or modified sequence opt3 from SNRPC__Homo_sapiens__NP_003084
augcccaaguucuacugcgacuauugugauaccuaccugacacacgacagcccuuccgugagaaaaacucauugcucuggcaggaagcacaaagagaacgucaaggauuauuaccagaaauggauggaggaacaagcccagucacucaucgacaagacgaccgcugcauuucagcaggggaagauuccaccgacacccuucagugccccuccacccgcgggagcuaugauaccuccacccccuagccuuccagguccgccccggccuggcaugaugccagcaccccauaugggagggccuccaaugaugcccaugaugggcccgccucccccagguaugaugccuguugggcccgccccaggaaugcgacccccuaugggcggccacaugccaaugaugccggggcccccuaugaugcgcccacccgcccguccuaugauggugccaacuagacccggaaugaccaggccggaucgguga

SEQ ID NO: 62978 - RNA, 360 nt, Artificial Sequence
  derived and/or modified sequence opt3 from SNRPD1__Homo_sapiens__NP_008869
augaagcuggugagauuccucaugaaacuuagccacgagaccgucacaaucgaacugaagaacggcacucagguucaugggacgauuaccggaguggacguauccaugaauacacacuugaaagccgugaagaugacucugaaaaacagggagcccguccaauuagaaacccuaucuauacgggguaauaacauccgcuacuuuauucucccugauucacugccacuugacacacuguugguggauguugagccgaaggugaagaguaaaaagcgagaagcugucgcaggccgugggagaggaaggggccggggucgcgggagaggaaggggccggggccgcgggggaccccgaagauga

SEQ ID NO: 62979 - RNA, 381 nt, Artificial Sequence
  derived and/or modified sequence opt3 from SNRPD3__Homo_sapiens__NP_004166
augagcaucggcgugcccauuaagguccugcacgaggccgaagggcauauaguuaccugcgagacaaacacuggagaaguguacagagguaaacucaucgaggcugaagacaauaugaacugucagauguccaauauuacgguaaccuauagggauggccggguggcacaacuugagcaggucuacauccgcgggucuaagauucgauuccugaucuugccugacaugcugaaaaacgccccaauguuaaagucaaugaaaaauaagaaccagggaaguggcgcgggucgugggaaggcugccauacuaaaagcacagguggccgcuagaggaaggggccggggcauggggcgcggaaauaucuuucaaaagagaagguga

SEQ ID NO: 62980 - RNA, 255 nt, Artificial Sequence
  derived and/or modified sequence opt3 from SNRPE__Homo_sapiens__NP_001291393
augagcggccugggggccaccgugguccagaaccucaucuucagauaccuucaaaauaggucccggauucagguuuggcuguaugaacaggugaacaugcgcauagagggaugcaucauugguuuugacgaguacaugaauuugguauuagaugacgcugaagagauccacucuaagacaaaaucacgaaagcagcugggccguauuaugcuaaaaggggauaacaucacucuccugcaaagugugagcaauuga

SEQ ID NO: 62981 - RNA, 261 nt, Artificial Sequence
  derived and/or modified sequence opt3 from SNRPF__Homo_sapiens__NP_003086
augagccugccccucaacccuaagccauuccuuaauggccugaccgggaaaccggugauggucaaguugaaauggggaauggaguacaaggguuauuuaguuuccguggacggcuacaugaacaugcagcuggccaauacagaagaguauaucgauggggcucuaucuggacaccucggcgaaguacugauuagaugcaacaaugugcuuuacauaaggggugucgaggaagaggaggaagacggggagaugcgggaauga

SEQ ID NO: 62982 - RNA, 723 nt, Artificial Sequence
  derived and/or modified sequence opt3 from SNRPN__Homo_sapiens__NP_073719
augaccgugggcaagagcuccaaaaugcugcagcacaucgacuacagaaugaggugcauucuccaagaugggcggauauucaucggaacauuuaaggccuucgacaaacauaugaaccuuauucugugugauugcgacgaguuucgcaagaucaaacccaagaaugcuaagcagccugaacgagaggaaaaacgugucuuggguuuaguucugcuaagaggcgagaaccucgugucuaugacuguagaagggccaccgcccaaggauacgggaauugcaagggugccucuggccggcgcggcuggugggccaggagucggccgggccgcaggccgcggggugcccgccggaguuccuaucccacaggcucccgcaggucuugccggcccugugagaggggucggaggcccaucacagcaagugaugaccccgcaggguagggggacaguagcugccgcggcaguugccgcuacugccaguauagcaggagcucccacccaguauccuccaggccggggcacacccccuccacccguggggcgcgccaccccgccucccggaaucauggcgccaccucccgguaugcgaccacccaugggcccuccaauugggcugccgcccgccagaggaacuccuaucggcaugccacccccugguaugaggccacccccgccugggauucggggcccacccccucccggaaugcguccaccucgccccuga

SEQ ID NO: 62983 - RNA, 1518 nt, Artificial Sequence
  derived and/or modified sequence opt3 from SNTA1__Homo_sapiens__NP_003089
auggccagcggcagaagggcuccccggaccgggcugcucgagcuucgcgcaggagccgguuccggcgcugggggagaacgauggcagcgugugcuguugucuuuagcggaggacguccugacaguuaguccugccgauggcgacccagguccggaacccggggcaccuagagagcaagaaccagcccagcuaaacggagcugcagagcccggcgccggcccuccacagcuccccgaggcucugcuucugcagaggcggcgcgugacuguaagaaaggccgaugcagggggauuggguaucucaauuaaaggcgggagggaaaauaagaugccuauacucaucagcaaaauuuucaagggacuggcggccgaccaaacggaggcucuguuugugggcgaugccauccucuccgucaacggugaagacuuaucuucggcaacccacgaugaggcugugcagguucugaaaaagacagggaaggaggugguccuugaagugaaauacaugaaggacguaucaccauauuucaaaaauagcacuggaggcaccaguguuggcugggauuccccgcccgccucuccuuugcagcggcagccaagcucccccgggccuacaccacgcaacuuuucagaggcgaagcauaugagucugaaaauggccuacgugagcaagcgaugcacccccaaugacccggaaccuagauaucuagagauuuguucugcagauggacaagacacucucuuccugagggcuaaggaugaagccuccgcucggucaugggccacagcaauccaggcccaggucaacacccuuacgccccgugugaaagacgagcugcaggcuuugcucgcggcaacuagcaccgccgguagucaagacauaaagcagaucggcuggcugacagagcaguuaccaucugggggaacugcuccuacccuggcccuccuuacagaaaaagagcuguugcuauaccugucccuccccgaaacccgcgaggcacugagcagaccagccaggacggcuccccuuauugccacucggcuggugcacucgggcccuucuaaggguuccgucccauaugaugcagaauugucauuugcgcuccgaacagggacccgccauggcguugacacucaccuguucaguguggagagcccgcaagaguuagcugccuggacaagacagcugguagauggaugccauagggcagccgaaggcgugcaggaggucuccaccgcuuguacguggaaugggcggcccugcucucuaagcgugcacaucgacaaaggauuuacccucugggccgcagaaccuggugcugcccgcgcgguucugcuuagacagccauucgagaaguugcaaaugucaagugaugacggcgccucccugcucuuucuggauuucgggggagcugaaggcgagauucagcuugaccugcacagcugucccaaaacaaucguguuuauaauucauucuuucuugucagcaaaggucacuaggcucggucuguuagccuga

SEQ ID NO: 62984 - RNA, 1617 nt, Artificial Sequence
  derived and/or modified sequence opt3 from SNTB1__Homo_sapiens__NP_066301
auggccguggcugcagccgcggcugccgcaggccccgccggggcuggagguggcagagcacagaggagcgggcugcucgagguccuuguucgggaccgcuggcacaaggugcugguaaacuuguccgaagaugccuuagugcugucuucagaggaaggagcugccgcguacaauggcaucgguaccgcaacaaacgggaguuucugccgaggagccggcgcuggccauccuggggccggaggugcacaaccaccggacagccccgcuggcguccguacugccuuuacggaucuaccugaacaggugccagaguccauuucuaaucagaaaagagggguuaaggugcucaaacaggagcugggaggccuugguauaucgaucaaggguggaaaagagaacaagaugcccauucugaucucaaagauuuucaaaggcuuggcggccgaccaaacccaggcacucuaugucggcgaugcuauccugagcgugaauggggccgaccugagggaugcuacacacgacgaagccguacaggcacucaagcgggccggaaaagagguuuuacuggaagugaaguacaugcgcgaggcuacuccuuaugucaaaaaggguaguccaguguccgagauaggcugggaaacacccccuccagagucuccgagacuugggggaagcaccuccgaucccccuucaagucagagcuuuucuuuccauagggaccggaaguccaucccauugaaaauguguuacgugacccgcucaauggcgcuggcagaucccgaaaaccgacaacuagagauucacagcccugacgccaagcauacugucauccucagaaguaaagauucugcuacagcccaggcaugguuuuccgccauucacagcaauguuaacgaccugcuuaccagggugaucgcugaaguacgggagcagcugggcaagacggguauagccgggucgcgugagauucgccacuugggcuggcucgcagaaaaagugccaggagagucuaagaaacaguggaagcccgcgcuggucguguuaacugaaaaggaccugcucaucuaugauuccaugccgagaaggaaagaggcuugguucucaccuguucauaccuacccccuucuggccacacgguuggugcacaguggcccagggaagggaagcccucaagcaggggucgaccuauccuuugccacucgaaccggcacacgccaggggauugaaacccaucuguucagagcugagacgucuagggaucucagccacuggacucggucaaucgugcagggaugccacaauagugccgagcugaucgcagaaauuuccacagcuuguaccuauaaaaaccaagagugccgccuuacuauacauuacgaaaauggcuuuagcaucacaaccgagccccaggaaggugccuucccaaagacgauuauccagucucccuacgagaaacugaagaugucaagugacgaugggauaagaauguuguaucucgacuuuggcggaaaggauggcgagauucagcuggacuuacacagcuguccuaaaccaaucguauucaucauucauuccuuucugucugcgaagaucaccaggcuagggcucguugccuga

SEQ ID NO: 62985 - RNA, 1443 nt, Artificial Sequence
  derived and/or modified sequence opt3 from SNTG1__Homo_sapiens__NP_001274743
auggacuucagaaccgccugcgaggaaacaaagacuggcaucugucugcuccaggaugggaaccaagagcccuuuaaagugaggcuucaccuggcuaaggacauuuugaugauacaggaacaggaugucaucugcguuagcggagagccuuucuacuccggugaacggacggugaccauucgccgacagacaguaggcggguuuggauuaucuaucaaaggcggugcagagcauaauauuccaguggucgugucaaagaucaguaaagagcaacgugccgaacugagcgggcuacucuucauaggagacgcgauccugcagauuaacggcaucaauguuagaaaguguaggcacgaggaagugguccaggugcuucggaacgcuggcgaggagguaacucugaccguuuccuuuuugaagcgcgccccggcauuccucaaacugccccugaaugaagauugcgccugugcuccuucugaccagucgucagggacaagcaguccacucugcgauuccggauuacaucugaacuaucaccccaauaacaccgacacucuuucuuguagcuccuggccuacaucaccagguuugagaugggagaagagguggugcgaucugcggcuaauuccccuccugcauagucgcuuuagccaauacgugccuggcaccgaccuuucucgacagaaugcauuccaggucaucgccguggaugggguguguacgggaauaauucagugccuguccgcugaagacugugucgauugguugcaagccaucgcgacuaacauuucaaaucucaccaaacacaacaucaagaaaaucaauagaaacuuuccaguuaaucagcagauuguguauaugggcuggugcgaggcaagggaacaagacccgcugcaggaccggguauacagccccacauucuuagcccugcgugguaguugccucuauaaguuucuugcuccuccagugacuaccugggauuggacacgcgccgagaagaccuucucugucuacgagauaauguguaaaauccugaaggacuccgauuugcuagacagaaggaaacagugcuuuacggugcagagcgaaucgggggaggaucuguauuucucuguugaacucgaguccgaccuggcacaaugggaacgggcuuuccagacugccacauuucuugagguggagcgaauccaguguaagaccuacgcgugcguccuggaaucacacuugaugggacucacuauugauuucaguacaggcuuuauauguuucgacgccgcaaccaaagagcuggaauuuagcaacuuauucgcugugcugcauugcauucacuccuuuuucgccgcuaagguagccugucuagauccccucuuucugggcaaccaggcaacggccucuaccgcugcgagcucagcaacaaccaguaaagccaaguacacuacauga

SEQ ID NO: 62986 - RNA, 1620 nt, Artificial Sequence
  derived and/or modified sequence opt3 from SNTG2__Homo_sapiens__NP_061841
augggcaccgaggggcccccuccaccggccgcuagcagaggaaggcaggguugccugcucgugcccgcacggacaaagacuacgaucgcccuucuguacgacgaagaguccgaaaacgcguaugauauucgcuugaaauuaaccaaggagguccugacaauacaaaaacaggacguuguguguguaggcgggucucaccagggacgaaaucguagaacugugacccuaaggcggcagccugucggcggucucgggcugucaaucaagggaggcagugaacauaacgugccaguugugauuagcaaaaucuucgaggaucaagcugccgaccagacaggcaugcuuuuugucggggaugcagugcugcagguaaaugguauucacguugagaacgccacccaugaagaggugguccacuugcuccgcaaugcuggagacgaagugacuaucacaguggaguaccugagagaggcacccgccuuccugaagcucccuuuaggcuccccagggcccucuucggaucauucaagcggagcuaguuccccucuguuugacucuggccuucacuugaacgguaauagcuccaccacggccccaucaaguccgagcucucccauagcgaaggauccuagguaugaaaaacgguggcuggacacucuauccgucccacucucaauggcacgcaucagccgauacaaggccgggaccgagaaacugagauggaacgcuuucgaaguucuugcccuggauggagugaguucuggcauuuugagguuuuauacagcacaggacggcacugauuggcuccgggcuguauccgccaauauccgugagcugaccuuacaaaacaugaagauggcgaauaaaugcuguagccccucggaccaggugguccacauggggugggugaacgaaaagcugcagggagccgacucuucccagacauuccgcccuaaguuucucgcacuuaaagguccaucauucuacguuuuuaguacgcccccggugagcaccuucgauugggucagagcugagaggacuuaucaucugugcgagguguuguuuaagguacacaaauucuggcuaacagaagacuguuggcugcaagccaaucucuaccugggccuucaggauuuugacuucgaggaucagcggccuuacugcuucuccauuguugcugggcauggaaagucucacguguuuaacgucgaacugggcagcgaguuggccaugugggaaaaaucauuccaacgagcaaccuuuauggaggugcagcgcacugguaguagaacauauauguguuccuggcagggggagaugcucugcuucaccgucgacuuugcccugggcuucacguguuuugaaagcaagaccaaaaauguguuauggagguucaaguuuucucagcugaagggaucaagugaugacggcaaaacacggguuaagcuacucuuccaaaaccuggauacuaaacagaucgagaccaaggaacuugaguuucaggacuugcgcgcugugcugcacugcauacauagcuucauugcggcaaaaguagccuccgucgaucccggguuuauggacucucagucgcucgcuagaaaguacauguauagcuccuga

SEQ ID NO: 62987 - RNA, 1083 nt, Artificial Sequence
  derived and/or modified sequence opt3 from SNUPN__Homo_sapiens__NP_005692
auggaggaacugagccaggcccucgcuuccucuuucucagugagucaagaccuuaacagcaccgcagcgccccacccuagacugucccaguacaagucuaaauauucgucauuggagcagagcgaaaggcggcgccgauuacuggagcuacagaagaguaaacgucucgauuacgucaaucaugccagaaggcuggcugaagacgauuggacaggcauggaguccgaggaagagaacaagaaagacgaugaagagauggacaucgauacuguuaagaaacuuccaaagcacuaugccaaucaacugauguugucugaguggcucauugacgugccgagcgaucuggggcaggaauggauaguaguggucugccccgugggaaagcgggcacugaucguugccucccgcgguucaacgagugcuuacaccaaaagcggcuauugugugaacagauuuucuucccucuuaccugggggaaauaggcggaacucaacagcaaaggacuacacuauucuggauugcaucuauaaugaggucaaccagaccuacuacgugcuugacguaauguguuggcgcggccauccauucuaugauugccagacagacuuucgauucuacuggaugcacagcaaauugcccgaagaggaaggucugggggagaagaccaagcuaaauccuuuuaaauucguuggacucaagaacuuuccauguacucccgagagucugugcgacgugcuuucuauggauuucccuuuugaagucgacggccuguuguucuaucauaaacaaacacacuacuccccaggcagcaccccgcucgugggguggcugagacccuauauggugucggaugucuuaggaguugccgugccugcugguccacugacgacuaagcccgacuacgccggccaccagcuccagcagauuauggagcauaaaaagucucaaaaagaagggaugaaggagaaacuuacccacaaggcguccgaaaauggacauuaugagcuggagcacuugucaacaccuaagcuaaaaggcaguagccacuccccagaucaucccgguugucugauggaaaacuga

SEQ ID NO: 62988 - RNA, 216 nt, Artificial Sequence
  derived and/or modified sequence opt3 from SNURF__Homo_sapiens__NP_005669
auggagagagccagggaccggcugcaccuccgccgaaccacagaacagcaugugcccgaggucgaaguucaagugaagcguagaaggacugcuagccuuuccaaccaggagugccagcuguacccucggcgcucucagcaacagcagguaccaguggucgauuuccaggcagaauugagacaagccuuuuuagcggagacgccgaggggcggguga

SEQ ID NO: 62989 - RNA, 1611 nt, Artificial Sequence
  derived and/or modified sequence opt3 from SNW1__Homo_sapiens__NP_036377
auggcccugaccagcuuccuccccgcuccuacacagcuuucccaagaccagcuggaggcagaagagaaggccagaucucagaggucacggcagacuuccuuggugagcucccgccgagaaccaccgcccuacggcuaucguaaaggguggaucccuagauuacuggaggauuuuggagacgguggcgcguucccagaaauucacgucgcucaauacccccuagauauggggaggaagaaaaagaugucuaacgcccucgcaauacagguugacucggagggaaaaaucaaguaugaugccauugcucggcagggccagucaaaggacaaagugaucuacagcaaguauacggaucugguaccuaaagaggugaugaaugcagacgauccagaccuucaacgccccgaugaagaggccauuaaggaaaucaccgagaaaacaagagucgcucuggagaagagugugucccagaagguugccgcggcaaugccugugagggccgcugacaaauuggccccagcacaguacauacgguauacuccgucucagcaaggugucgcuuuuaacagcggggccaagcagcgcgugauccgaaugguagaaaugcagaaagaucccauggagccuccaagauucaagauuaauaaaaagauccccaggggaccuccaagucccccggcgccuguuaugcauucacccagucggaaaaugaccgugaaggaacaacaggaguggaagauuccaccuugcaucagcaacuggaaaaaugccaagggcuacacaauaccccucgacaaacgucuggcagcugacggccgcgggcugcagaccguccacauuaacgaaaauuuugccaagcucgcugaggccuuauacaucgcagauagaaaagccagggaggcuguggaaaugcgggcacagguggagcgaaagauggcgcaaaaggaaaaagagaagcaugaagagaaacugcgcgagauggcccagaaggcuagagaaaggcgggccggaauuaaaacucacgucgagaaggaagacggugaggcacgcgaaagagaugagaucaggcaugaccgucggaaggagcgacagcacgauagaaaccuuucuagggccgcuccagacaaacgcuccaaguugcagcggaaugaaaacagagauaucucagagguuauugcccugggcgugcccaauccuaggacaagcaacgaaguacaauaugaccagcgccuauucaaucagaguaaagggauggauucuggauuugcaggcggugaggacgagauauacaacguguaugaucaggcguggcgagggggaaaggacauggcucaauccaucuaccggccaagcaaaaaucucgacaaggauauguauggcgacgaucuggaagcccguauuaagaccaacagauucgucccggacaaagaguuuucgggcucugauaggcgccagcgggggagagaaggacccgugcaguucgaggaagacccuuuuggucuugauaaguuccuggaggaggcaaaacagcacggcggguccaagaggccaucagacaguagccgacccaaagaacaugagcacgaaggaaagaaacgccggaaggaguga

SEQ ID NO: 62990 - RNA, 606 nt, Artificial Sequence
  derived and/or modified sequence opt3 from SNX10__Homo_sapiens__NP_001186764
auguuccccgagcagcaaaaggaagaguuugugagcgucuggguuagagacccuaggauccagaaagaagauuucuggcacuccuacauugacuaugagauaugcauccauaccaacucuauguguuuuacaaugaagacuucaugcgugcggcgccgauaccgugaguucguauggcugagacagaggcuccagaguaaugcccuucuggugcaauugccagaauuaccgagcaaaaaccuguuuuucaauaugaacaaucggcagcacgucgaucagcgcagacagggccuagaggacuuucucaggaaggugcugcaaaacgcacuucuguuguccgauucuucgcuccaucuguuccugcagucacaccucaauagcgaagacauugaggcuuguguuagugggcagacgaaauauuccguggaagaggccauccauaaguuugcguuaaugaaccggcgcuuccccgaggaagaugaggaaggaaagaaagagaaugacauugauuacgacucugaaagcuccucaaguggucugggccacagcucugaugacuccucaagccacgggugcaaggucaacaccgcuccucaggagaguuga

SEQ ID NO: 62991 - RNA, 477 nt, Artificial Sequence
  derived and/or modified sequence opt3 from SNX12__Homo_sapiens__NP_001243117
augagcgacaccgccguggcugauacaagaaggcugaacuccaagccccaggaccucacugaugcauacggcccuccaucuaauuuccuugagaucgacauuuuuaacccgcaaacggucgggguuggacgggcccgcuucaccacauaugaaacuaaucugcccauauuuaaauugaaggagucaugcgugcgacguagauacagugauuucgaauggcugaaaaacgaguuagaaagggacagcaagaucguagugccuccacuacccgguaaagcgcucaagcggcagcugccuuuucgcggcgaugaggggauuuucgaggaauccuuuaucgaggaaagaaggcagggacuugagcaguucauuaauaagaucgcuggccacccacuggcccaaaacgagcgguguuugcauauguuucuccaggaagaggcaauagaccgcaauuauguccccgguaaagugcgacaguga

SEQ ID NO: 62992 - RNA, 2814 nt, Artificial Sequence
  derived and/or modified sequence opt3 from SNX14__Homo_sapiens__NP_001284543
auggugcccugggucagaaccaugggccagaagcugaaacaaaggcuccggcuugacguugggcgcgagaucugccgacaguacccucuguucugcuuuuuguuacugugucuaagcgccgcuucccuccugcuuaaccguuauauucacauacugaugaucuucuggucuuuuguggcaggaguagugacauucuacuguucauuggguccagauagucuccugccgaauaucuuuuucacuauuaaguauaaacccaagcagcugggccuccaggaauuauuuccucaagggcacagcugcgccgucuguggaaaagugaagugcaagagacacaggccaucccugcuuuuggagaacuaccagcccuggcuggaccuaaaaauuucuucgaagguugaugcgucacucagcgaagugcuggagcuuguccuggaaaauuucguguauccuugguaccgggacguaacggaugacgagaguuuuguugaugaguugcgcaucacccucagauucuuugcuuccgugcugauaaggcggauccauaaagucgacauuccaucuaucauuacaaagaaauuacugaaggccgcaaugaagcacaucgaagugauagugaaagcccgccagaaggucaaaaacacugaguuccuccagcaagcugcacuugaagaguauggccccgagcugcauguugccuugcgaagcagaagggaugaacuacacuaccugcggaagcucaccgagcugcuuuuuccuuacauucugccaccgaaagcuacagacugucguuccuugacccuccugauccgcgaaauuuuaucagguaguguguuccugcccagccuagauuuccucgccgacccugauacuguaaaucaucugcuuaucaucuuuauugacgacucuccacccgagaaggcgacagaaccugcauccccauuggugcccuuccugcagaaauuugccgagccgagaaacaagaagccuucaguccucaaacuggagcuuaagcagauaagggaacagcaagaucuguuguuccgguuuaugaauuuccucaaacaggagggggcugugcacguucugcaguuuugcuuaaccguggaagaguucaacgaccgaauccugcgccccgaacuaagcaaugaugagaugcucagucugcacgaggaacuucaaaagauuuauaaaacguacuguuuggacgagucuaucgauaagauaagauuugacccauucauugucgaagagauccagaggaucgccgaaggaccuuauauugaugugguaaagcugcagacuaugcggugccucuuugaggcauacgagcauguucuguccuuacuggaaaacguguucacccccauguuuugucacagcgacgaguauuuccgccagcuuuugagaggcgcugaaucgccaacaaggaauaguaaacucaaccguaauacucaaaagcggggcgaguccuucgggaucucacgaauuggaaguaaaauaaagggugucuuuaaaagcaccacaauggagggcgccaugcugcccaacuacgggguggcggaaggagaggaugacuucaucgaagagggcauugucgugauggaagaugacuccccuguugaggccgugucuaccccaaauacgccgagaaaccuagcagcuuggaagaucagcauccccuauguagacuuuuucgaggauccuucaagugaaaggaaggagaaaaaggaacgcauuccagucuuuugcauagacguggagcggaacgauagaagggccguuggucacgaacccgagcauugguccguguaccgccgauaccuggaguucuauguccucgaaagcaaacugacugaguuucacggggcuuucccugacgcccagcuuccaucuaagcggaucauuggacccaaaaauuacgaauuuuugaagucaaagcgugaggaguuccaggaauaucugcagaaauuacuccaacauccggagcugaguaacagccagcuucuggcagacuuuuuguccccuaauggcggcgaaacacaguuccucgauaagauccugccagaugugaaccuagggaaaauuaucaagucuguacccggaaaacugaugaaggagaaaggucagcaccucgaaccuuuuauaaugaauuucaucaacucgugcgagagccccaagccaaagccuuccagacccgagcugaccauucuuucaccaacuucugaaaauaacaaaaaguuguucaaugaccuguuuaaaaacaaugccaacagggcugagaauacagaacgcaagcaaaaccagaauuacuucauggaggugaugaccguugaaggcgucuaugauuacuuaauguauguggggcggguggucuuucagguuccggacuggcuccaucaucugcuuaugggaacgagaauccuguucaaaaacacccuagagauguacacagauuacuaucuccaguguaagcuggagcaauuguuucaggaacacaggcuggugucuuuaauuacucuccugcgagacgcgaucuucugcgagaacaccgaaccucgcagccuucaggauaagcaaaaaggcgcaaagcagacauuugaggaaaugaugaauuacauacccgaccuguuggugaaauguauuggugaggagacuaaguaugaauccauccggcuccuguucgacgggcuacagcagccaguacugaacaaacaacuuaccuacguccuccuggauauugugauccaggaguuguuucccgaacugaauaagguucagaaggaggugacaucagucaccagcuggauguga

SEQ ID NO: 62993 - RNA, 1035 nt, Artificial Sequence
  derived and/or modified sequence opt3 from SNX16__Homo_sapiens__NP_690049
auggccacccccuacgugccugucccaaugccgaucggcaacagcgcuuccucuuucacaacuaauagaaaccagaggucaaguagcuuuggguccguuucuacgucgucaaauagcaguaagggacaacuggaggacuccaacauggguaauuucaaacagaccucugugcccgaucagauggacaacacaagcuccguaugcucaaguccucucauucggacuaaguuuaccggcacagcaagcucuauagaauauuccacccgcccacgagauacugaggaacagaaucccgagacagugaacugggaagaccguccuucaaccccaacgauccuuggguacgaggucauggaggaaagagccaaauucacuguguauaagauucugguuaaaaagacccccgaggaaagcuggguggucuuuaggcgguacacagauuucagucgcuugaaugacaaguuaaaagagauguuuccuggauucagacuggcgcuaccaccgaagaggugguuuaaagauaacuauaaugcugacuuccucgaggaucggcaacugggccuucaggccuuucugcagaacuugguggcacacaaggacaucgccaauugucucgcuguacgcgaguuccugugccuggaugaucccccugguccauuugacucucucgaagaaucccgagcauucugugagacuuuagaagagaccaacuacagacugcagaaagagcuuuuggaaaagcaaaaggagauggaaagccugaaaaagcuacucucggagaaacagcugcauauugacacacuugaaaauaggauccggacccugucuuuggagcccgaggaaucccucgacguuucagagacggaaggggagcagauacugaagguggaaaguagcgccuuagaggucgaucaggacgugcuggaugaggaaucccgugcugacaacaaaccuugccucucuuucagcgagccagaaaacgccgugucagagaucgaggucgcggaaguugcauaugaugccgaggaagacuga

SEQ ID NO: 62994 - RNA, 1875 nt, Artificial Sequence
  derived and/or modified sequence opt3 from SNX18__Homo_sapiens__NP_001096045
auggcccugagagcuagggcacucuacgacuuccggagcgagaaccccggcgaaaucucccuucgcgagcacgaagugcugucuuugugcucagagcaggauauugaagggugguuagagggagucaauagucgaggugaccguggccuguuuccugccagcuauguucaagugauaagagcgccagagccggggcccgcuggagauggcgguccuggggccccagcaagguacgccaacguacccccuggaggcuucgaaccacuacccguggcuccuccagcauccuuuaagccgcccccugacgccuuccaggcucuccugcagccacagcaagcucccccuccaucuaccuuucagcccccgggcgcgggguucccuuauggagguggcgcacuucagcccucgccacagcaacuguacgggggauaucaggccucacagggcagcgaugacgauugggacgaugagugggacgauaguuccacagucgcugacgaaccuggugccuuggggucuggagcauaccccgaucucgacggcagcuccucagcuggcgugggggccgcgggacgguaucgccugaguacuagaagcgaccugucucucgguuccaggggcgggucaguuccaccccagcaucacccuagcggaccaaaaaguucugccacggugucccggaauuuaaaccgcuuuagcaccuucgucaagucgggcggugaggcauuugugcugggggaggcuucuggcuucguaaaagauggagacaagcuguguguuguguugggcccguacgggcccgaauggcaagagaauccuuacccauuucagugcacaaucgaugaccccacuaaacagaccaaguucaagggaaugaaauccuauauuucauacaagcuggucccuacacauacccaagugccagugcaccgaagauauaaacauuuugauuggcuauacgccaggcucgcugaaaaguuccccgucaucaguguuccgcaccuuccugagaaacaggccacuggucgguucgaagaggacuuuauuagcaagcgucgcaagggccuuaucugguggaugaaccacauggcaucccauccagugcuggcccagugugauguauuccagcacuuuuugacaugccccucuagcaccgacgagaaagccuggaagcaagggaaaagaaaggcggaaaaagaugagauggugggagcaaauuucuuucucacgcugucaacuccucccgccgcugccuuagaccugcaggaagucgagaguaagauagauggcuucaaauguuuuaccaagaagauggacgacuccgcacuccagcuuaaccauacagccaaugaguucgcuaggaaacaggugacugguuuuaagaaagaauaucaaaagguugggcagagcuuccggggccugucucaggccuuugaguuggaucagcaagcauucucagugggacuaaaccaggcgaucgcuuuuaccggcgacgccuacgaugcaauuggggaacuguucgccgagcagccacgacaggaccucgauccugucauggaccugcuugcucuguaucaaggacacuuggccaauuuccccgauaucauucacgugcagaaaggugcacucacaaagguaaaggaaagucgcagacauguugaggaaggcaaaauggaggugcagaaggcugacgggauccaagauaggugcaacaccauuagcuuugccacgcuggcggagauacaccauuuccaccagauccggguccgcgacuuuaaaucccagaugcagcauuucuuacaacagcagauuaucuuuuuccagaaggugacucaaaaacuggaagaggcccuacacaaguacgauucugucuga

SEQ ID NO: 62995 - RNA, 1119 nt, Artificial Sequence
  derived and/or modified sequence opt3 from SNX19__Homo_sapiens__NP_001288018
auggacagcgauagaguggaggccaggaagucccugcucgaaucuuuccuuaaacagcugugcgcuauccccgagauugcaaacucagaagagguccaagaauuuuuggccuuaaauaccgacgcgcggauagcuuucguuaagaaaccuuuuauggugagucgcaucgauaagaugguagugagcgccauugucgacacacugaaaacugcauucccacgauccgagccgcagucucccacggaggaacuaucggaggccgaaaccgagucaaagccucagacagagggcaagaaagcuagcaagagucgucucagauuuuccucuagcaaaaucuccccagcacugucagugacugaagcccaggauaagauucuuuacugucugcaagaggggaacguugaaagugagaccuugagcaugucugcuauggaauccuucaucgagaaacagacaaagcuccuggagaugcagcccaccaaggccccugaaaaagacccagagcagcccccuaagggaaggguggauucaugcgucagcgacgcggcagugccagcccaagauccgaguaauucugaccccgguacugaaacagagcuggcugauaccgcccucgacuuacugcuuuugcugcuaacggaacaguggaaauggcucuguacugagaacaugcagaaguuucugcggcuuauauucggcacccugguacagcgcugguuggagguucaaguggcaaaucucacauccccucagagauggguccaguaucuguuacugcuccaagaaagcaucuggccagggggagugcuucccaaauuuccuaggccagugcggacucaggagcagaagcuggcugccgaaaaacaggcguugcaaucgcuaaugggcguccugcccgaucucguuguggagauucuggguguaaacaagugccgccuuucuugggggcugguguuggaaucccuccagcagccgcugaucaaucgacacuuaauuuacugucugggagacaucauacuagaguuccucgaccugucagccagugucgaggaaagcgcagcuaccacauccgccucugauaccccuggcaacagcaagagaaugggcgugucaaguuga

SEQ ID NO: 62996 - RNA, 1569 nt, Artificial Sequence
  derived and/or modified sequence opt3 from SNX1__Homo_sapiens__NP_003090
auggccagcggcggcggagguugcuccgcuucugagagacugcccccuccauucccgggccucgaacccgagucagaaggggcagccggaggcagugagccugaagcgggugacagcgauaccgagggggaggacaucuuuacaggagcugccguggucuccaagcaccagucuccaaaaauuacuacgucgcuucugcccauaaacaauggcucaaaggaaaacggcauccaugaggaacaagaucaggagccucaggacuuguucgcagaugccaccguugaguuaagccuggacaguacacagaauaaccaaaagaaggugcuagcuaaaacucucauuucccugccaccccaggaagcaaccaauucuagcaagccucagccaacauacgaggaacuugaggaagaggagcaggaagaucaauuugaccugaccguagggaucacugauccggagaagauuggagacgguaugaacgccuauguggcuuacaaagucacaacccagacguccuugccccucuucaggucaaagcaguuugccgugaaacggcgcuucagugauuuucugggccuguaugaaaagcucagcgagaaacacucucagaauggguucaucguuccuccacccccugaaaaguccuuaauaggaaugacuaaggugaaagucggcaaggaggacucaagcagugcggaguuucuggaaaaacgacgugcagcccuugagagauacuugcaaaggaucgugaaccauccaaccaugcugcaggaucccgacguacgggaguuccuagagaaggaagaacucccgcgcgcuguugguacacagacucugucuggggccggacuucugaaaauguuuaauaaggcaaccgacgcuguguccaaaaugacaauuaagaugaacgagagcgauaucugguucgaagagaaguugcaagaagucgagugugaggaacagagacucaggaaacugcacgccgugguggagaccuuagucaaucaucggaaggaacuggcgcucaacacggcccaguuugcaaaaucgcuugcuaugcuggggucuuccgaggacaauacugccuugucacgcgcucuaagucagcuggccgaaguugaggagaagauugaacaacuccaccaggagcaggcaaacaaugauuucuuccugcuugccgaacuguugagcgacuauauccgacuccuggcuauagugagagcggcauuugaucagaggaugaaaacauggcaacgguggcaggacgcccaggcuaccuuacagaagaagcgugaggccgaagcacgccugcuaugggccaacaaaccugauaagcuccaacaggcuaaagacgagauucuggagugggaauccagaguaacucaguacgagagggauuucgaacggaucucuacagugguccgaaaggaggugauucgcuuugaaaaagagaaaagcaaggacuucaaaaaccacguuaucaaguaucuugagaccuugcuguacucacagcaacagcucgccaaauacugggaagcauuucugcccgaggcgaaggcuaucaguuga

SEQ ID NO: 62997 - RNA, 309 nt, Artificial Sequence
  derived and/or modified sequence opt3 from SNX20__Homo_sapiens__NP_001138444
auggccagccccgagcacccuggcuccccagggugcaugggaccgaucacccaguguacagcuagaacucaacaggaagcacccgccacggguccugaccugccacaucccggcccugaugggcaccucgacacccauucuggacuuucaaguaacagcuccaugacaacuagggagcugcagcaguacuggcaaaaucagaagugccgguggaaacacgugaaguuguuauucgaaauugcgucugcucgcauagaggaacgaaaagucucgaaguuuguugccccagcacccgaugccaccccuuga

SEQ ID NO: 62998 - RNA, 510 nt, Artificial Sequence
  derived and/or modified sequence opt3 from SNX24__Homo_sapiens__NP_054754
auggagguguacauucccagcuucagauaugaagaguccgaccuggaaaggggcuacaccgucuuuaagauugagguucucaugaacgggcggaaacacuucguggaaaagcgcuauucugaguuucaugcccuucacaaaaagcugaaaaagugcauaaagacaccugagaucccaucaaaacauguacgaaauugggugccgaaggucuuggaacagcguagacaaggauuagagacuuaccugcaggcugugauucuagaaaacgaggagcuccccaaacuguuccuugauuuucugaauguuaggcacuugccuagucucccaaaggcagaaagcugugguuccuucgacgagacggaaucugaggaaucgucaaaacugagccaucagcccgugcugcucuuuuuacgggauccuuauguccugccagccgcgagugacuuccccaacgugguaaucgagggcguucuucacgggaucuuuuacccucacuugcagccacgcuga

SEQ ID NO: 62999 - RNA, 3015 nt, Artificial Sequence
  derived and/or modified sequence opt3 from SNX25__Homo_sapiens__XP_005263324
augcaccccgacgccaccgauagcggcggggcuggaccuuccccagcaagagccgcgggugcuggcgggaggccggugucuggauuccggggcgagcgccgacccgaaucaccuggugacgccgaggcagccgcugcagccgcuccaggggcccccggaggccguaguugguggaagccugucgcgguugcagcccuggcugccguggcacucagcuuucuuggcccaggguccggagaagcugccggugcggccggccugucuucgguauuguucagauuaucacuguaccuaagcugcgcagcugccgcuuuucuccuggggauccuuuucgcccugguguguaggaguccccgggcacagccuccagauuuugccgcugcguggucccgcuuggcagccacaucugcugccagaaggccgcccggaagcccugucuauggcaacucccaugagucagcacaaagucggcgcgugguuauuagccacaauauggacaaagcccucaaggaaguguucgauuacucuuaucgagacuacauacuguccugguaugguaaccugucaagagaugaggggcagcucuaccauuuacugcuugaggacuuuugggaaaucgcuaggcaguugcaccaucggcugagccacgucgaugugguaaaaguugugugcaaugacgucgugcguacucuacucacgcacuucugugaucugaaggccgcaaacgcgcgccaugaggaacagccaagacccuuugugcuucacgcuugccugaggaauagugacgaugagguccgguucuugcaaaccuguucucgaguucucguguuuugccuguuaccuuccaaagacguacagagccugucgcuccgcauuaugcuugccgagauccugacaacuaagguguugaagccagucguggaacuacugucuaaccccgacuauauuaaucagaugcuccuggcacagcuugccuacagagagcaaaugaacgaacaucacaaaagggcuuacaccuaugccccguccuacgaggauuucaucaagcugauaaauucaaacagugacguugaauuuuugaaacagcuccgguaucagaucguggucgagauuauccaggcaacaaccauuagcuccuucccucaacugaagcgccacaaaggaaaggagacugcugccaugaaggcggauuuacugagagccaggaauaugaaacguuacaucaaccagcuaacaguggcuaagaaacagugugaaaagcggauacgaauccucggcggccccgcauaugaccaacaggaggauggggcccuggacgaaggagaggguccacagucucagaaaauucuucaauucgaagauauuuuggcuaauaccuuuuacagagagcauuucggcauguauauggagaggauggacaagcgcgcccugaucagcuuuugggaaucaguagagcaccucaaaaacgcaaauaagaacgaaaucccucagcugguuggggagauuuaccagaacuucuuuguggaaaguaaggagauauccgucgagaaaagccuuuacaaggaaauccagcaaugccuggugggaaauaaaggcauugaggucuucuauaagauccaggaagauguguacgagacguugaaagaccgguauuaccccucuuuuauaguuucagaucucuaugagaagcuguuaauuaaggaagaggaaaaacaugcgagucagaugaucagcaacaaggacgagauggguccaagagacgaagccggggaggaggcuguggaugacggcacuaaucagaucaacgaacaagccuccuucgcaguaaauaaacugagggagcuaaacgaaaagcucgaguacaaacgccaggcucuuaauucuauucagaacgcccccaagccugauaagaaaaucgucucgaagcugaaagacgaaauuauauugaucgagaaggagcgaaccgaucugcagcuccacauggcacggacagacugguggugugaaaaucugggaauguggaaagccagcauuacuuccggcgaggugaccgaagagaacggggaacaauuaccaugcuauuuuguuauggugucacugcaggaggucggagguguggagacaaagaauuggaccguaccgcguagacuuagugaguuccagaacuugcauaggaagcucucugaaugugugcccagccugaaaaagguucaacuaccuucccugucaaaacucccauuuaagagcaucgaucagaaauucauggaaaagucuaaaaaucagcugaacaaguuucuucagaauuugcuguccgacgagcgcuuaugccaaagugaggcucucuacgcguuccugagccccucuccugauuaccuuaaggucaucgacgugcagggcaaaaagaacuccuucucacugaguagcuuuuuggaacggcucccaagagauuucuuuucgcaccaggaggaagagacggaagaggacuccgaucugucugacuauggggacgauguggacggaaggaaagaugcccuagcagagcccugcuucaugcugauuggcgaaauauuugagcuccgagguauguucaaguggguccgccggacucugaucgcucuuguucaggugacauuugggagaaccauuaacaaacaaaucagggacacugugagcuggauuuucucagaacagauguugguauacuauaucaauauauuucgugaugccuucuggccgaacggcaagcuggccccuccaacaaccauccgcaguaaggagcagucccaggaaacgaaacaacgggcucagcagaaguuacucgagaauauucccgacaugcugcaaucucuugucggacagcagaacgcaagacacggcaucauuaaaaucuuuaaugcccugcaggagaccagggcgaacaagcaucuacucuacgcucugauggaauugcuguuaauagagcucuguccugaacugcgagugcaccuugaucaacugaaagccgggcagguuuga

SEQ ID NO: 63000 - RNA, 2442 nt, Artificial Sequence
  derived and/or modified sequence opt3 from SNX29__Homo_sapiens__NP_115543
augagcggcucccagaacaaugacaagagacaauuccugcucgagaggcuucuggaugccgugaaacagugccagauccgguuugggggacgcaaggaaauugcuucugacucagauagucgagucaccuguuugugcgcacaguucgaggccguuuuacaacacggucugaaacguagcagaggccuagcgcucacagcugccgcaauaaagcaggccgcuggguuugcauccaaaacugaaacggagcccguguucugguacuauguaaaggaagugcugaacaagcaugagcuucagagguuuuacucucugcggcacaucgccucggacgucggacgcggcagagcuugguugaggugugcccucaaugagcauucacuggaacgguaucugcacaugcucuuagcggaucgcugccgacugagcaccuucuacgaggacuggaguuuugugauggaugaagagagauccucuaugcuuccuacaauggcagccgguuugaacagcauucuguucgcuaucaauauugacaacaaagaucuaaaugggcaguccaaguuugccccaacuguuucagaccuccugaaagagaguacccaaaacgugacaagccuucugaaggaaucuacccagggagucuccucauuguucagggagaucacugcaagcagugcugugucuauacucaucaaaccggaacaggagacagauccccugccuguaguuucccggaaugugagcgccgacgcgaaguguaagaaagaacguaagaaaaagaaaaaggucaccaacauuaucucguuugaugacgaggaggacgaacaaaauucuggcgauguguucaaaaagacgccaggcgccggggaguccucagaagacaacagugaucgcagcuccgugaauauuaugucugcauuugagagccccuucggaccuaacucaaaugguagucaauccagcaacucuuggaagaucgacucauuaagucugaacggcgaguucggguaucagaaacucgaugucaagagcauagacgaugaagacguugaugagaaugaagacgauguguacggaaacuccucuggcagaaaacauaggggucacucggagagcccagaaaagccccuugaggggaauacuugccugucccagaugcacucaugggcuccuuugaaaguacuacauaacgacagugacauucuguuuccagugucuggagucggcagcuauuccccggccgaugcuccccucggcucacuggaaaaugggaccggaccugaggaccacgugcuuccagaucccggucugcgguacagcguugaggccucuuccccuggccaugggaguccauugagcucucuccugcccuccgcaucagugccggaaaguaugacaaucagcgaguuacgacaagccacugucgcuaugaugaaccgcaaggacgaacuggaggaggaaaauagaucgcuaaggaaccuccuggauggagagauggaacacuccgcggcacuucggcaggagguggacaccuugaagcgcaaaguagccgaacaggaggagagacagggcaugaagguucaagcucuggccagggaaaaugaggugcucaaaguccagcugaagaaauacgugggugcaguccagaugcuuaagcgugaagggcagacagccgaggugccuaaccuguggucuguugauggcgaagugaccguagcugagcaaaagcccggagagauugccgaagaguuggcaagcucauaugaacggaaacucaucgaggucgcggaaaugcacggcgagcugaucgaguucaaugaacgauuacauagagcucugguggccaaggaggcccuaguuagucagaugaggcaggaacucauugaccugcgcgggccagugccuggagaucuuucccagacgucugaggaccagagcuuguccgauuuugagauaucaaaccgggcacugaucaaugucuggauucccagcguguuccucagagguaaagcugccaacgcauuucacguauaccagguguauaucaggauaaaggacgaugaauggaauauuuaccgccgauauacugaguuccggagucugcaucacaaauuacagaacaaguacccacagguucgugcuuauaacuuucccccuaagaaagccaucggcaauaaggacgcgaaauucgucgaagagagaaggaagcaacugcagaacuaccuucgcucugugaugaauaaagugauccagauggucccagaauuugccgcuuccccgaagaaagagacauugauucaacucaugcccuucuuuguugacaucaccccuccaggggagcccgugaacagccggccuaaggcagccucgagauucccaaagcugucaaggggacagccccgagaaacucgcaauguggagccgcagucuggcgaucuauga

SEQ ID NO: 63001 - RNA, 1560 nt, Artificial Sequence
  derived and/or modified sequence opt3 from SNX2__Homo_sapiens__NP_003091
auggccgcugagagagaacccccuccacugggcgacgggaagccgaccgauuucgaggaccucgaagauggagaggaccuuuuuacaagcacuguguccacgcuggaaucuucacccaguagcccugagccagcauccuugcccgccgaggauaucucugcgaacucgaaugguccuaaaccaaccgaagucguuuuagacgaugacagggaggaucuguucgcugaagccacagaggaggugucacuagacagccccgaacgggagccuauucucaguuccgaaccaucuccggcaguaacucccgugaccccuacaacccugauagccccacgcaucgagagcaaguccaugucagcucccgucauuuuugaucgaagucgugaagagaucgaggaagaggcaaacggcgacauuuucgauaucgaaauaggggugagcgacccugagaaaguuggagacggcaugaaugccuacauggcuuauagagugacuacaaagaccucucuuuccauguuuucaaaaagcgaguucagugucaagaggcgguuuucugauuuccuggguuugcacuccaagcucgccagcaaauaccugcaugugggguauaucguaccacccgcgccggaaaagucgauuguuggaaugacgaaagugaaggucggcaaagaggacucuuccucaacugaauuuguggagaagcgcagagcagcccuggaaagguaccuccagcggaccgugaagcacccuacauuacugcaagaucccgaccuucgccaguucuuggagaguagcgaacugccacgagcugucaacacucaggcccuauccggcgcagggauccucagaaugguuaauaaagcugccgaugcggugaacaagaugaccauuaaaaugaaugagucugacgccugguuugaggaaaagcagcaacaguucgagaaccuggaucagcagcuuaggaaacugcauguaagcguggaagcauuggucugccaccggaaggagcucucagcuaauacagccgcuuuugccaaaagugcagccaugcugggaaacuccgaggaccauaccgcuuuaagccgugcgcugucucaacucgcagaaguggaggaaaagaucgaucagcuucaccaggagcaggccuucgcugacuucuauauguuuucagaacuguugagugauuacauacgccuaauugccgcaguuaaggguguguucgaccacagaaugaaauguuggcaaaagugggaggacgcccagaucacgcugcucaaaaagagggaggcugaagccaaaaugauggucgcaaauaagccugauaagauucagcaagcgaaaaacgagauccgggaaugggaggcuaaggugcagcagggcgaacgagacuuugagcagaucagcaaaacuauucgcaaggagguagggagauucgaaaaagagaggguuaaggauuuuaagacagugauaaucaaauaucuggaaucccuuguccaaacccagcagcagcugauuaaguacugggaggccuucuugcccgaagcaaaagccaucgcuuga

SEQ ID NO: 63002 - RNA, 1314 nt, Artificial Sequence
  derived and/or modified sequence opt3 from SNX30__Homo_sapiens__NP_001013012
auggccggcgggcccccuaaggcucugccaagcaccggaccgcacucccucagagacaugccccauccucuugcagguucuucaagugaggaagccgugggcggggauagcacaccaucccccgaccuguugauggcgaggucuuucggagauaaagacuuaauccugccuaacggcgguacuccagcugggacgucgucacccgccagcaguuccucucuacucaaucggcugcagcuugaugacgauauugacggagagacccgcgaucuguuugucauaguugacgauccuaagaaacacgugugcacaauggaaacuuacaucaccuaucgaauuacaaccaagagcacucguguagaguucgacuugccagaauacuccgugagaaggcgguaucaagauuuugacuggcuccgcucaaaacuggaggagagucagccgacacaucugauucccccucucccagaaaaguucgucgugaagggcguuguggacagauuuagcgaggaguucgucgaaaccaggcggaaagcauuagauaaguuucugaaacgcaucacggaccaccccgugcuuucuuucaacgagcauuuuaauaucuucuugacugccaaggaucugaacgcuuacaaaaagcagggcauagcacuacucacccgaaugggggaauccguaaagcacguuacaggagguuauaaacugagaacuaggccucuugaguuugccgcuaucggcgacuaccuggauaccuucgccuugaagcucgggacaauugaccggaucgcgcagcguauuaucaaagaagagauagaauaucugguggaguuacgcgaguacggaccagucuacucaaccuggagcgcacuggaaggcgagcucgccgaaccccuugagggugugagugcuuguauugggaauugcucuacggcccuggaagaguugacugaugacaugacagaggauuuucuaccggugcugagagaauauauccucuacuccgacagcaugaagucgguccugaaaaagagggaucaaguucaggcagaguaugaagcuaaacuugaggccguggcgcugcggaaggaagaccgaccuaagguacccgccgacguggagaaaugucaggaucgcauggagugcuucaacgcagacuugaaggcugauauggaaagauggcagaauaacaaaaggcaagacuuccggcagcuccugaugggaauggccgauaagaauauucaguacuaugagaaauguuuaauggcuugggaaucuaucaucccacugcuacaggagaagcaagaggccaaguga

SEQ ID NO: 63003 - RNA, 318 nt, Artificial Sequence
  derived and/or modified sequence opt3 from SNX3__Homo_sapiens__NP_001287857
auggccgagaccguggcugacacaagaaggcugaucacuaagccccagaaccucaaugaugcauacggcccuccaagcaacuuccuugaaauugacgucuccaauccgcaaacgguuggggugggacggggucgcuuuaccacauaugagauacgaguaaaaacuaaccugcccaucuucaaguugaaagaaucuaccgugcguagaagguacucagauuuugagugguuacggagugaacuggagcgcgagagcaagggcagaugguccucuucggggacagaaaggacccuaucaagccacgucuucacucgguga

SEQ ID NO: 63004 - RNA, 1215 nt, Artificial Sequence
  derived and/or modified sequence opt3 from SNX5__Homo_sapiens__NP_689413
auggccgcugugcccgagcugcuccagcaacaggaagaggacagaagcaaacuuagguccgucucuguugaucugaacguggacccuucauugcagaucgauauuccagacgcauuaagugaacgggauaagguaaaguucaccgugcacacaaaaacuacgcugccgaccuuucagagccccgaguucuccgucacacgccaacaugaagacuuuguguggcuacacgauacucucauagagaccacagacuacgccggccugaucauuccuccagcgcccaccaagccugauuucgacgggccacgagagaaaaugcagaaacuuggagaaggugagggcucuaugacuaaggaagaguuugcuaagaugaagcaggagcuggaagccgaguauuuggcaguuuucaaaaagacagugucgucacaugaagucuuucuccagcgucugagcagucaccccgugcuguccaaagauagaaauuuccauguauuucucgaguacgaccaagauuuaucuguuaggcggaagaacaccaaggaaauguucgggggauuuuucaaaagcguggucaaguccgccgacgaggugcuguuuacgggcgugaaagaggucgacgauuucuucgaacaggagaagaauuuucuuaucaacuauuacaaucgcauuaaagacucaugcguuaaggcugauaaaaugacuagaagucacaagaacguggcagacgauuauauccacaccgccgcuuguuugcauagccuggcccuagaggaaccuacaguaauaaagaaauaccuccugaagguggcggaacuuuucgagaaacugaggaaggucgagggucgggugucuuccgacgaagauuugaaacucacugagcuguuacgcuauuacaugcugaauaucgaagcagccaaggaccuccuuuaccgaagaaccaaggcucugauugauuaugagaacucaaauaaagccuuggacaaggcaaggcuaaaaagcaaggauguuaaacuggcugaagcccaccagcaggagugcugucaaaaguuugagcagcucagugaaucugcgaaggaggaacugaucaacuucaaacggaagcguguggccgcauuucgcaaaaaucuuauugagauguccgagcuggaaaucaagcaugcuagaaacaaugucagcuugcuccagucgugcauagaccuguucaaaaacaauuga

SEQ ID NO: 63005 - RNA, 1788 nt, Artificial Sequence
  derived and/or modified sequence opt3 from SNX9__Homo_sapiens__NP_057308
auggccaccaaggcuagagugauguacgacuucgcagccgagcccggcaacaaugaacugacagucaacgagggggaaaucauuacuauaacgaauccugauguuggagguggcuggcucgaggggaggaacaucaaaggagaacggggccuugugccaaccgacuauguagagauucugccgagcgaugguaaggaccaguuuuccugcggaaauucuguggcggaucaggcuuucuuggacucauuaagugccagcacagcacaggccuccucuucggcugcaucaaacaaucaccaggucgggagcggcaacgaucccuggagugccugguccgcuucuaaaagcggcaauugggaguccucagaaggguggggagcccagccugagggugcgggcgcacaacgcaacacuaauaccccaaacaauugggacacagccuuugggcauccccaggcuuaccagggaccugccaccggcgaugacgaugacugggaugaagacugggacgguccaaagaguagcucuuauuucaaagauuccgagucagcagacgcugggggagcccagcgaggcaacagccgugcgaguucuuccagcaugaagaucccccugaauaaguuuccuggcuucgccaaaccagggacugagcaauaccuacucgcaaagcagcuggcuaaaccgaaggagaaaauucccaucauagugggagauuaugguccuauguggguuuacccaacaucgaccuuugacuguguggucgccgaucccagaaagggcucuaagauguaugggcuuaaauccuacaucgaauaccagcugacgccuacuaacaccaacaggucagugaaucaccgguauaagcauuucgacugguuguacgaacgccuccugguaaaauuuggaagugcuauuccaauccccagccugccggauaagcagguuacaggcagauucgaggaagaguuuauuaaaaugaggauggagcggcuccaagccuggaugacucgcaugugccgacacccugugaucuccgaaucugaggucuuccagcaguuuuuaaacuucagagacgaaaaggaguggaaaaccgguaagaggaaggcagaacgggaugagcuggccggggugaugauauucagcacaauggagcccgaagcuccagaccuugauuugguggagauugaacaaaaaugugaggcggucggcaaguuuaccaaagcaauggacgacggaguuaaggaacugcuaacggugggccaggagcauuggaaacguugcacugggccucuccccaaggaguaucagaagaucggaaaagcccugcagucacuugcuacaguauucaguuccagcgguuaccaaggcgaaaccgaucugaaugacgccauuacugaggcagggaagacauaugaagagaucgccucuuugguggcugagcagcccaaaaaggaucuccacuuucugauggaauguaaccacgaguacaaaggauucuuaggcugcuuuccagacaucauugguacccauaagggggccauagaaaaggucaaagagucagauaagcugguggcaacgaguaaaaucacccuccaggacaagcagaauaugguuaaacgcgugagcauuauguccuaugcgcuucaagcugaaaugaaccacuuccauucuaauagaaucuacgauuacaacucggucauaaggcuguauuuggagcaacaggugcaguuuuacgagacaauugccgaaaagcuacggcaagcacugagccgauucccuguaauguga

SEQ ID NO: 63006 - RNA, 1479 nt, Artificial Sequence
  derived and/or modified sequence opt3 from SOAT1__Homo_sapiens__NP_001239440
auggagcugaagcccuucuuuaugaaagaagugggcagccacuucgacgauuuugucaccaaccucaucgagaaguccgccucucuugacaaugggggaugcgcucugacaacuuucucaguuuuggaaggugagaaaaacaaucauagagcaaaggauuuaagggccccuccagaacagggcaaaauuuuuauagcgcggcgcagucugcuagacgagcuccuggagguggaucacauccgaacgauuuaccauauguucaucgcuuugcugauuuuguuuauccucagcacccugguaguggacuauauagaugaagggcgucugguccucgaguucuccuuacugucuuacgccuuuggaaaguucccgacagugguuuggacuugguggaucauguuucuuucgaccuucucagugcccuauuuucuuuuccaacacugggcaacaggcuacagcaagaguucccauccucugauuagaucucuauuccacgguuuucucuucaugaucuuucagauugggguccugggauucggcccaaccuaugugguacuugccuacacucugcccccugcuagcagguuuaucauaauuuucgaacagauccgguuuguuaugaaagcacacuccuucgugcgcgagaacgucccaagagugcuuaauucagccaaggagaaaaguagcacagugcccauuccuaccgucaaccaguaucucuacuuucuguucgcuccaacguuaaucuacagggacucuuauccgcggaaucccacuguucgcuggggcuacguggccaugaaguuugcgcaaguauucgggugcuuuuucuauguguacuauaucuucgaacgacugugugcaccucucuuuagaaacauuaaacaggagccauucuccgccaggguccuugugcuguguguuuuuaauucaauauugcccggagugcuaauccuguuccucaccuuuuucgcuuuucugcauugcuggcuuaacgccuucgcagaaaugcugcgguuuggugaucguauguucuacaaggacugguggaauagcacaaguuauucuaacuacuaccgcacuuggaaugucgugguacacgauugguuguauuacuaugcuuacaaggacuuucucugguucuuuuccaaaagauucaagagcgccgcgaugcuggccguuuucgcagugucggcugucgugcaugaguaugccuuagcugucugucuguccuuuuucuacccugugcuauuuguucucuucauguuuuucggcauggccuuuaacuucauugugaaugauucuaggaaaaagccaaucuggaacguacugauguggaccucauuguuuuuggggaacggaguccugcucugcuucuauagucaggaaugguacgcacggcagcacuguccccugaaaaauccgacauuucuugacuacgugcgaccucgcagcuggaccugcagauauguuuucuga

SEQ ID NO: 63007 - RNA, 1569 nt, Artificial Sequence
  derived and/or modified sequence opt3 from SOAT2__Homo_sapiens__NP_003569
auggagcccggcggggccagacugaggcuccagcggaccgaaggacuugguggcgagcgcgaacgacaaccuugcggggacggaaacacagagacucaccgugcuccagaucuggugcaguggacgagacauauggaagcagucaaggcccaguuguuagagcaggcgcaaggccagcugagggagcuacucgaccgggcuaugcgcgaagccauccagagcuacccgucccaggauaaaccccugccuccacccccuccagguucucuuucaagaacccaagagcccagucuggggaagcagaaaguuuucauuauaaggaaguccuugcucgacgaacugauggaggugcagcacuuucggacaaucuaucauauguucauugcaggacuguguguauuuaucauuagcacucucgccaucgauuucauagacgagggccgcuuacugcuugaauuugauuugcugaucuucucuuuuggccagcuaccucucgcucuggugaccugggucccaauguuccuuucgacacuguuggcaccguaccaagcccuccgacugugggcuagagggaccuggacucaggccacaggauuagguugcgcgcugcucgcagcccacgcugugguucuuugugcccugcccgugcaugucgcaguggagcaccaguugccuccagcuucaaggugcguucuaguauuugaacaagugcgguuccugaugaaaagcuauaguuuucuccgugaggccguccccggcacccugcgcgcgagaaggggagaagggauucaggccccuuccuucucuagcuaccuuuauuuucuguucuguccaacguugaucuaccgggagacuuauccccgaaccccguacgugcgcuggaauuacguggcaaagaacuucgcucaggcccucggcugcguccuguaugcuuguuuuauuuuagguagacugugcguuccuguguucgccaauauguccagggagcccuuuucaacacgggcccuaguacucaguauccugcacgcaacucuuccagggauauucauguugcugcucauuuucuuugcuuuucugcauuguuggcuuaacgcguucgcagaaaugcugcgcuuuggagacagaauguucuacagggauugguggaauagcaccucuuuuuccaacuauuaccguacauggaauguggucgugcacgacugguuguauucauacguuuaucaggauggccuccggcuguuaggcgcccgagcuagagggguggccaugcugggagucuuccuagugagcgcaguagcccaugaguacaucuuuugcuucguucucgguuucuuuuacccugugaugcugauucuuuucuuggucaucggcgggaugcugaacuuuaugaugcacgaccaaaggaccggacccgcuuggaaugugcucauguggacgaugcuguucuuaggccaggguauccaggucagucuguauugucaggaaugguacgcccgccggcacugcccacuuccccaagcaacuuuuuggggguuggugacaccuagaucuugguccugccauaccuga

SEQ ID NO: 63008 - RNA, 2622 nt, Artificial Sequence
  derived and/or modified sequence opt3 from SOBP__Homo_sapiens__NP_060483
auggccgagauggaaaaggagggcagacccccugaaaacaaaaggagccggaagccagcucacccggugaaacgcgagaucaaugaagagaugaagaacuucgcagagaauaccaugaacgaacugcucgggugguacggauaugacaaagucgagcuuaaggauggugaagacauugaguuucgauccuaccccacagauggcgagucucgucagcauauaucaguucugaaggaaaauaguuugccuaaaccaaaguuacccgaggacagcgugaucuccccuuauaacauuucuacuggguacucgggacuggccacgggcaauggucuaucagauagcccagcggggaguaaagaccacggauccguacccaucauugugccucucaucccaccgcccuucauaaagccuccagcugaagaugacgucucuaacgugcaaaucaugugcgccuggugucagaaaguuggcauuaagagauauagccuguccaugggcucagaggugaagaguuuuugcagcgaaaaauguuucgcagccugcaggcgggcuuacuuuaagcgcaauaaagcaagagaugaggacgggcaugccgagaacuucccccagcagcacuaugcuaaggaaaccccuaggcuugccuuuaaaaauaacugugagcuguuggucugcgauugguguaagcauauccggcacacaaaagaauaccucgacuucggagauggugagcgccgacugcaauuuugcucugcgaagugucugaaucaguacaagauggacauuuucuauaaagaaacucaggcaaaccucccagccggcuuaugcuccacccugcaucccccgauggagaauaaggcugaggggacaggagugcagcuuuugaccccugacucauggaacaucccccugacugaugccagaaggaaagcaccaagcccuguagcuacagccggccaaagucagggucccgggccaucugcguccaccacgguuagccccucggacacugccaacuguucugugaccaagauaccuacaccagucccgaaauccauucccaucucagaaacuccuaauauuccacccgugagugugcagccuccagcaagcaucggacccccgcuaggcgucccuccacggucucccccuaugguuaugaccaaccguggccccgugccacucccuaucuuuauggagcagcaaauuaugcagcagauaagacccccauucauccgcgggccgccucaccacgcuuccaaucccaacagcccacugucaaaucccaugcuuccuggaauugguccacccccuggcgggccgaggaaccugggaccaacaaguucccccaugcaucggccuauguugagcccacacauccaucccccuucuaccccgacgaugcccggcaauccaccuggucuccugcccccaccucccccaggggccccguuaccuucacugcccuuuccacccguaaguaugaugccuaacggcccaaugcccgugccucaaaugaugaauuucggacucccgagccuugcuccacuggugcccccucccacuuugcuagucccauacccuguuauagugccccugccagucccuauuccgauccccaucccaauuccucacguguccgauucuaagcccccaaacggcuucucgagcaauggggaaaacuuuaucccuaaugcccccggagacuccgcagccgcugguggcaagccgucagggcacagucucucuccacgagauagcaaacagggauccucaaagagcgcggacucuccucccggcugcuccggucaggcacugagucuugccccaacacccgcugagcaugggcgcagcgaaguaguugaucugaccagaagggccggcucuccuccgggacccccaggcgcagggggacaguuggguuucccuggcgugcuccaagggccccaggacggagucauugaucugacugugggccaccgggcccgcuuacauaacgucauacacagagcucugcacgcccaugugaaagcagagagggagccuuccgcggcugaacgucggacaugcggugggugucgagacggccacugcucaccacccgccgcaggagauccuggcccaggggcccccgcuggaccggaggccgcagcugccuguaauguuaucgugaacggcaccagaggugcggccgcugaaggggcaaagagugccgagccuccacccgagcagccuccacccccgccucccccagcuccucccaaaaagcuacucagcccagaggaacccgccguaucggaacuggaguccgucaaggaaaacaauugcgcaucuaacugucaucuugacggagaggcggccaaaaaguugaugggcgaggaagcucuggccgguggcgacaaaagcgauccuaaucucaacaauccagcagacgaggaucacgcuuaugcccugaggaugcuuccgaagacggggugcgugauucagcccguuccuaaaccagcagaaaaggccgcuauggcgcccuguaucaucucaaguccuaugcuguccgccggaccagaggacuuggaacccccucucaagcgccggugccugagaauuaggaaccaaaauaaauga

SEQ ID NO: 63009 - RNA, 636 nt, Artificial Sequence
  derived and/or modified sequence opt3 from SOCS1__Homo_sapiens__NP_003736
augguggcccacaaccaggucgcugcagacaaugccguuagcaccgcggcugagcccagaaggcggccugaaccauccucuucaaguagcuccucuccggccgcacccgcccgcccucgaccaugccccgcugugccugcaccagcccccggcgauacacauuuccguacuuuuagaucgcacgcugacuacaggcggaucacgcgcgccucagcgcugcucgaugcauguggguucuauuggggaccucuuagcguacauggugcccacgagagacugagggcugaaccagugggcaccuuuuugguccgggacagucgccaacgaaacugcuucuuugccuuauccgugaagauggcaucugggccgacaagcauuagaguucauuuccaggcuggaagguuucaccuggauggcucccgggagucauucgacugucuauuugaacuccuggagcacuacguggccgcgccccgucgcaugcuuggugccccucugagacagaggcggguccgaccauugcaggagcucugccgccaaagaauaguggcaacuguagggagggaaaaucuggcucggaucccccugaacccuguucuccgcgauuauuuaaguagcuucccauuucagauuuga

SEQ ID NO: 63010 - RNA, 597 nt, Artificial Sequence
  derived and/or modified sequence opt3 from SOCS2__Homo_sapiens__NP_001257400
augacccugagaugccucgagcccagcggcaacgggggagaagguacaaggucccaguggggcacugccgggucugcugaggaaccuucaccacaagcagcccggcuugcgaaggcucugcgcgaguugggacagacgggcugguacugggguaguaugaccgugaaugaagccaaagagaaguuaaaagaggcaccggaagggacauuccugauccgagacagcucccacucugauuaucuacucacuauuucggucaagaccucagccggacccacaaaccugcguauagaguaccaggacggcaaauuuagacuugauagcaucauuuguguuaagaguaagcugaaacaguucgacuccgugguacauuugaucgauuauuacgugcaaaugugcaaggacaaaaggaccggcccugaagcuccacggaaugggacuguccaccucuaucugacaaagccccuguacaccucugcaccuagccuccagcauuuaugucgccugacgauuaacaaaugcacuggagccaucuggggucuuccauugcccaccagacugaaggauuaucuagaggaguacaaguuucagguguga

SEQ ID NO: 63011 - RNA, 678 nt, Artificial Sequence
  derived and/or modified sequence opt3 from SOCS3__Homo_sapiens__NP_003946
auggugacccacagcaaguuccccgccgcuggcauguccagaccucuggacacaucucucaggcuuaaaacuuuuucaaguaagagcgaguaccagcuggucguuaacgcagugcggaaauugcaagaauccggguucuauuggucugccguaacgggaggugaggcgaauuuacugcuaucggcugaaccagccggcaccuuucucauccgcgauucaagcgaccagcgacauuucuuuacacugagugugaagacucaguccgggaccaaaaaccuucguauucagugcgagggaggcucuuucagccugcaauccgauccgagaucaacacagcccgucccuagguuugacuguguguugaagcucguucaccauuacaugccacccccuggugcaccaaguuuccccagcccuccaaccgaaccgucuuccgaggugcccgagcagccuucagcccagccacugcccgggagcccuccacggcgcgcuuauuacauauauaguggaggcgaaaagaucccccugguccucucuagaccguuauccagcaauguggcaacucugcaacaccuuugcaggaaaacaguaaacggccauuuggauucguacgagaagguuacccagcugccugggcccauucgggaauuucuagaccaguaugaugccccacucuga

SEQ ID NO: 63012 - RNA, 1323 nt, Artificial Sequence
  derived and/or modified sequence opt3 from SOCS4__Homo_sapiens__NP_543143
auggccgagaacaaugaaaacaucagcaagaauguggacgucagacccaaaaccuccaggucucggucagcugaucgcaaggacggcuacguuuggagugggaaaaagcugagcugguccaaaaagucugagucguauucagaugcagaaacagugaacggaauugagaagacugaaguaagccuccgaaaucaggagcguaaacacaguugcuccucuauagagcuugaccuggaucauagcuguggucacagauucuugggcagguccuuaaagcaaaaacugcaggacgccguggggcagugcuuuccuaucaagaacuguucaagucggcauagcucuggacuaccauccaaacgcaagauucacaucucagaacucaugcuggauaagugcccguuucccccuagaagcgaccuugcguucagguggcauuucauuaaacggcacacggcuccaaucaauaguaagucugaugagugggucuccaccgaccugagccagacagaauugcgcgauggccaacucaaacgaagaaacauggaggagaauauaaacuguuuuucgcacacuaaugugcagcccugcguuaucaccacagacaacgcccuguguagggaagguccuaugaccgggucugugaugaaucuggucuccaacaauucaauugaggauagugacauggacagcgaugacgaaauccucacuuuaugcacauccucucggaagcguaacaaaccaaagugggaucuggacgaugagauucuucaguuggaaacgcccccuaaauaccauacccagaucgacuaugugcacugucugguaccagaucuacuccaaauaaacaauaacccgugcuacuggggaguuauggacaaguaugcagccgaggcucugcuugagggcaagcccgaaggcacuuuccuguugcgcgauagcgcacaggaggacuaccucuuuucagugaguuucagaagguauucccggagccugcaugcccgaauugaacaguggaaucacaacuuuucuuucgaugcucacgacccuugugucuuucauucaccagacaucaccggguuacuggagcacuacaaagaucccagugccugcauguucuuugaaccucuccuuagcacaccacugauucgcacuuuccccuucuccuugcagcauaucugcagaaccgugaucuguaauugcacaaccuacgacggaauugaugcgcuaccgauaccuucuucgaugaagcuguaucucaaagaguaccacuauaagagcaaagugaggguccugcggaucgacgcacccgagcaacaguguuga

SEQ ID NO: 63013 - RNA, 1611 nt, Artificial Sequence
  derived and/or modified sequence opt3 from SOCS5__Homo_sapiens__NP_659198
auggacaaggugggcaaaauguggaacaauuucaaguacagaugccagaaccuguuugggcacgagggagguagcagguccgaaaaugucgauaugaacucuaaucggugucucucaguuaaagagaagaacaucaguauuggcgacagcacaccccaacagcaguccucuccucuucgcgaaaauauagcccugcaguugggguuaucgccaagcaaaaacucaagucgacguaaucaaaacugcgcuaccgagaucccgcagauuguggaaaucuccauugagaaggauaaugacucuuguguaacucccggaacgagacuggcaaggcgggauagcuauucccgccaugccccuuggggcgguaagaaaaagcacucaugcaguaccaaaacacagagcucucuagacgcggauaagaaauucgggagaacuagguccggacuccagcggcgcgagcgaagauacggcgugucaagcguccaugacauggauagugugucuuccaggaccguuggcagccggucgcugcgucaacgccuucaggacacaguggggcuguguuuuccaaugagaaccuauucuaagcaguccaagcccuuguucucaaacaaaaggaagauccaccucagugaacugaugcuggagaaaugcccuuuuccagcuggaagcgaucucgcccagaaguggcauuuaauaaaacaacacacugcacccgucuccccucacucuacauucuuugacaccuucgauccaagccuggugucaacggaagacgaggaggaccggcuucgagaacgcagaagguugaguaucgaggaagguguagauccgcccccuaaugcccagauucauacuuuugaggcuaccgcacagguuaacccacuguacaagcuaggccccaaacucgccccugggaugacagaaaucuccggagacagcucugcuauuccacaagccaauugugauucagaggaggacacuaccacacugugccuucagagucggcgccagaagcagagacaaaucagcggcgauucccacacccaugugucuaggcagggugcguggaagguccacacgcagauagacuauauucacugucuggugcccgauuugcuccagaucacugggaacccgugcuacuggggagugauggaccguuaugaagcagaggcccuguuagaaggcaaaccugagggcacauuccugcuccgggauucggcucaagaagacuaccuuuuuagcgucuccuuccgaagauacaacaggucacugcaugcccgcauugagcaguggaaucacaacuuuaguuucgaugcacaugaccccuguguuuuccacucuagcaccgugacuggguugcuagagcauuauaaggacccauccucaugcauguuuuucgaaccucugcucacaaucagccugaaucggaccuuucccuucucucuucaguacaucugcagagcuguaauuuguaggugcacgaccuaugauggaauagacggucugccauugcccuccaugcuccaggauuuucugaaagaguaccacuauaagcaaaaagugcgcguccgaugguuagaacgggagccugugaaggccaaguga

SEQ ID NO: 63014 - RNA, 1608 nt, Artificial Sequence
  derived and/or modified sequence opt3 from SOCS6__Homo_sapiens__XP_005266840
augaagaaaaucagccugaagacccucagaaaauccuucaaccuuaauaagucuaaagaggaaacagacuuuauggugguccagcaacccucacuggccagugauuucggcaaggacgauagcuuguuuggguccugcuacggaaaggacauggcuucuugugauauuaacggugaggacgaaaaaggcgggaagaauaggucgaaaucagagagcuuaaugggaacucugaagcggcgccuaagugcaaaacagaaguccaagggcaaagccgguacgccuucugggagcuccgcggaugaagacaccuucucaaguagcucugcuccaauaguuuuuaaggaugugcgagcccagcguccgaucagauccacaucacucaggagccaccauuauagucccgcaccuuggccacugcggcccacuaacucugaggagaccugcauuaaaauggaaguacgcgugaaggcccuuguccacuccagcucgccuucuccagcucugaauggagugagaaaagacuuccaugauuugcaguccgagacaaccugucaagaacaggcaaacucacucaagaguagcgccucccacaauggcgaccugcaucugcaccucgaugagcacguucccguggucaucggcuuaaugccucaggacuacauucaguauacugugccacuggacgaggggauguacccgcuugaaggaucuaggagcuauugcuuggauucaaguucccccauggagguaagcgcuguuccuccacaaguggguggccgggccuuucccgaagacgagucucaggucgaucaggaccuggugguggcgccugaaaucuucgucgaucagucaguuaacgggcuacucauaggaacaaccggcgugaugcugcaaaguccacgcgcaggucaugacgauguacccccgcuuagcccucuguugcccccaaugcagaauaaccagauccaacgaaauuuuuccgggcucacgggaacugaggcccacguggcugagucuaugagaugucaucugaacuucgacccuaauucggcccccggcgucgcaaggguguacgauagcguucaguccucaggcccaaugguggucaccaguuuaacagaggaacugaaaaagcucgcuaagcaggggugguauuggggacccauuacucggugggaagccgaggguaaacuugcgaacgugccugacggcucuuuucugguacgugauagcuccgacgaccgcuacuugcuaucacugagcuucagaucucacgggaagacccuccacacaaggaucgaacauuccaauggacgguuuaguuucuacgagcagccagauguugagggccacaccagcauuguggaccugaucgaacauucuauacgagauuccgagaacggugccuucugcuauucacgcaguagacuuccggggagcgcaacguaccccgucaggcugacuaacccugugucgcgguuuaugcaaguccgcuccuugcaguaucucuguagauucgugauuaggcaguacacacguaucgaccugauucagaaauuaccacugcccaauaagaugaaagauuaucuacaagaaaagcacuacuga

SEQ ID NO: 63015 - RNA, 1746 nt, Artificial Sequence
  derived and/or modified sequence opt3 from SOCS7__Homo_sapiens__NP_055413
augguguucagaaacgucggcaggcccccugaggaagaggacguugaagccgcuccagagccggggcccagcgaacugcucugcccucggcaccgcugugcacuugauccaaaggcccugcccccuggauuggcguuagagcgaaccugggguccagcugccggccuggaggcacagcuagccgcucucgggcugggacaacccgcaggcccuggugugaaaacaguagggggaggcugcuguccaugcccgugucccccucagccacccccuccacagccccagccgccugccgcugcgccccaagccggcgaagacccaacugagacguccgaugcacuucugguguuggaagggcucgagucugaggccgaaucacuggagaccaauaguugcagcgaagaggaacuguccucuccuggacgugguggcgggggaggcgguagacucuuacugcagcccccagggcccgagcuuccuccagucccguuucccuugcaggaccuggugccucuaggaaggcucucgcggggcgagcagcaacagcagcagcaacagcagccacccccuccacccccgccuccaggcccccugcgcccucuugcugggcccucaagaaaggguagcuucaaaaucaggcugagucgguuguuucgcacaaaguccuguaacggaggcucugggggaggcgaugguacugggaaacgaccaagcggcgaacucgccgcauccgcugccucacugaccgacaugggaggcagugcggggagagaguuagaugccggaaggaagccuaagcugacacggacccaaagcgcauucucucccguuuccuuuucaccacucuucacuggugaaacagugagccuugucgacguggauauuagucagcguggccugaccucuccgcauccucccacgccacccccuccaccccgcagauccuugagccuacuggacgauauaucggggacucucccuaccucuguacugguugcuccgaugggauccucacuucagaguuuuccacugcccccuccacccccuccgcacgcccccgacgcuuucccaaggaucgccccuauucgggcagccgagagcuugcauucccagcccccacaacaccuccagugcccucuguaccgacccgauucuagcucauuugcugcgaguuuacgcgaacuggagaaauguggcugguauugggguccaaugaauugggaggacgcagaaaugaagcuaaaagggaagccggacggcuccuuccucgugagagauagcucugacccuagguacauccugucacuuaguuuucggagccagggaauuacacaucacacucgcauggagcacuauagaggcaccuucuccuuguggugccaucccaaauuugaagauaggugucagucugucguggaguucaucaagcgugccauaaugcacucgaagaacgggaaauuccuguacuuucuccggagccgagugccaggacugcccccuacaccaguccaacuucuguaucccguuuccagauucucaaaugugaagaguuugcagcaucucugcagguuucgcauccggcagcugguaagaauugaccacaucccugauuuaccgcugccaaaaccccuaauuucuuacaucaggaaguucuauuacuacgacccucaggaagagguguaucucagccugaaagaggcucaacuuauauccaagcagaaacaggaagucgagcccucaaccuga

SEQ ID NO: 63016 - RNA, 465 nt, Artificial Sequence
  derived and/or modified sequence opt3 from SOD1__Homo_sapiens__NP_000445
auggccaccaaggcugugugcguccugaaaggcgacgggcccguucagggaaucauuaacuucgagcaaaaggaaagcaaugguccugugaaaguauggggcuccauaaaggggcucacagagggacuucacggcuuucaugugcacgaguucggugauaacacugcaggguguacgucugccggaccacauuuuaauccgcugucaagaaaacacggcggccccaaggacgaagaaaggcaugucggggauuugggaaacgugaccgcggacaaggaugguguugcugacgugaguaucgaggauagcgucauuuccuuaucuggcgaccacugcaucauugggcggacacuggugguacacgagaaagccgaugaccuaggaaagggcgguaaugaagagucgacuaaaaccgggaacgcaggaucacgccucgccuguggcguuaucggcauagcucaguga

SEQ ID NO: 63017 - RNA, 669 nt, Artificial Sequence
  derived and/or modified sequence opt3 from SOD2__Homo_sapiens__NP_001019636
augcugagcagagccgugugcggcaccuccaggcagcucgcucccguccuuggguaccugggaucucggcaaaagcacucauugccugacuuaccauaugauuacggugcacuggagccgcauaucaacgcccagauuaugcagcuacaccauaguaaacaccaugcggcuuauguuaauaaccucaaugugacagaagagaaguaccaggaagcccuggcaaaaggcgacguaacugcccaaauagcacuucagcccgcucugaaguucaacgggggaggccacaucaaucacagcaucuuuuggacgaacuuguccccuaauggugggggagagccaaaaggcgaacuccuggaggccauuaagcgcgauuucggcucuuuugacaaguucaaagagaagcugaccgcugccucgguggggguccagggaucagguuggggcuggcucggguuuaacaaagaacgaggacauuuacagauugcggcaugucccaaucaagauccucugcagggcacaacuggucuuaucccauugcuggggauagacgugugggagcacgccuauuaccuacaguauaagaacguucgucccgauuaccucaaagcuaucuggaaugugauuaacugggaaaaugucaccgagagauacauggccugcaagaaguga

SEQ ID NO: 63018 - RNA, 723 nt, Artificial Sequence
  derived and/or modified sequence opt3 from SOD3__Homo_sapiens__NP_003093
augcuggcccuccuuugcagcugucuguuguuagcugcaggcgccuccgacgcguggaccggggaggauucugcugaacccaacucagacagugccgaguggaucagagauauguacgcaaaggugacagaaauuuggcaggaggucaugcaaaggcgggacgaugacggagcccugcacgcugcaugccagguucagccuagcgccacucuagaugcugcccagccacgcgugacggguguaguccucuuccgacaacuggcgccgcgugcaaaacuugacgccuuuuucgcucuggaaggcuuucccaccgagccuaauuccucuucgagagccauacaugugcaccaguucggggauuugucacagggaugugagagcacaggcccacauuauaacccccucgcagugccucacccacagcaucccggugacuuugggaauuucgcuguuagggauggaagucuguggcgguaccgcgccggccuggcggccucccucgcaggcccucacucuaucguggggagagcugucgugguacacgccggagaagacgauuuagguaggggcgggaaccaagcuagcguugagaauggaaacgccggccggcgccuggcaugcuguguggucggugugugcgggccaggacuuugggaacgacaggccagagagcauuccgagaggaagaaacggcgucgcgaaucagaguguaaggcugcguga

SEQ ID NO: 63019 - RNA, 987 nt, Artificial Sequence
  derived and/or modified sequence opt3 from SOHLH1__Homo_sapiens__NP_001012415
auggccagcagaugcuccgagcccuacccugaagugucuaggaucccaaccguccggggcuguaacgggucacugaguggagcucucagcugcugugaggacuccgcacaggguucuggcccgcccaaggccccuacaguugcggaagggccaucgucaugccuucgccgaaaugugauuagcgagcgugaaagaaggaaacggaugagucuguccugugagcgcuugagagcuuuacugccccaauucgauggaaggcgggaggacauggccucuguacuagaaaugagcgugcaguuucuccgccuggcauccgcccuuggcccuucacaggagcagcacgcuauacuggcaaguagcaaggaaauguggcauucuuugcaagaggauguccuccagcugacucuguccucacagauccaggccggugugccagaccccgggacgggagcuagcaguggcacccgaacaccugauguuaaagccuuccucgagucuccaugguccuuagacccggcgagcgcaucgcccgaaccugugccacacauucuggccucuuccagacaaugggaucccgcuucaugcaccagucuuggcacugacaagugugaggccuugcuggggcuaugccaggucaggggaggucucccuccauuuagcgaacccuccucucuggugccguggccucccggccggagccuuccaaaagcaguacguccuccccugucauggccacccuucagucagcagcaaacauugccuguuauguccggggaggcucucggauggcugggccaggccgguccauuagcgaugggggccgcaccgcugggagaacccgcuaaggaggauccuaugcucgcccaggaggcuggcagcgcccuuggcucugacguggaugacgggaccucauuucuguugacugcaggaccaaguagcuggcccggugaauggggcccuggguuccgcgccggaccacccgcuuga

SEQ ID NO: 63020 - RNA, 1278 nt, Artificial Sequence
  derived and/or modified sequence opt3 from SOHLH2__Homo_sapiens__NP_060296
auggccagcuccaucauuugccaggagcacugucaaauaucuggccaggcuaagaucgacauucugcucgugggggaugucaccguuggauaccuugcagacacagugcagaaacuguucgccaacaucgcggaaguaacuauuacgaucucagauaccaaggaggcugccgcauuguuagacgauugcauauuuaauauggugcugcuaaaaguccccaguagccucuccgccgaagaacuggaagcuaucaagcugauuagauucgguaaaaagaagaacacacauucucuguuuguguucaucauuccugagaauuuuaaaggcuguaucucggggcacggaauggacauagcauugacugagccacucaccauggaaaagaugucaaacguugugaaauauuggacaaccugcccgagcaauacugucaagacagagaacgccaccggccccgaggagcugggucugccucuccagaggaguuacuccgagcauuuaggguauuucccaacggaucuguuugcuuguucugaaagccuucggaauggaaacggcuuggagcugaaugccucccuaucagaauuugagaaaaacaagaagauuagucuccugcacagcucuaaagaaaaacuucgccgagagcguaucaaguacugcugugagcaacugagaacuuugcuccccuaugugaagggcaggaaaaaugacgcggcauccguacuggaagccaccguugauuacgugaaguauauucgggagaaaaucagcccugcugucauggcccagaucacagaagcauuacagucaaacaugcgcuucugcaagaagcagcaaacuccaauugagcugagucuccccgggaccgugauggcucagagagaaaauucugugauguccacauacagcccugagaggggacuucaguuccugaccaacacguguuggaaugguugcucgacuccagacgccgagucuuccuuggaugaagcgguccggguuccgucaaguagcgccuccgagaacgcaauaggcgaccccuacaaaacacauaucucuagcgcugcccuaucacugaacagucuccacaccgugcgcuauuacuccaagguaacuccuagcuaugaugcuacagccgugaccaaucagaacauuucuauccaccuuccaucagcaaugcccccugucaguaaacuucugccacgacauuguacgagcggguugggacaaaccugcacaacucaccccaauugccuccagcaguuuugggccuacuga

SEQ ID NO: 63021 - RNA, 6327 nt, Artificial Sequence
  derived and/or modified sequence opt3 from SON__Homo_sapiens__NP_001278340
auggccaccaacaucgagcagauuuucagaagcuuuguggucuccaaguucagggaaauacaacaggagcugucuucaggccggaaugaagggcagcucaacggagagacaaauacucccaucgaagguaaccaggcuggcgacgcagccgcgagugcucgcagccuuccuaaugaggagauuguucaaaaaaucgaagaggugcuguccgggguauuggauacggaauuacgauacaagccagaccugaaagagggaucucguaagucgagaugcgugucaguccagaccgauccgacagacgagauucccacuaaaaagagcaagaaacacaagaaacauaagaacaaaaagaagaaaaagaaaaaggaaaaagagaagaaauauaagaggcagccugaagagagugaauccaagaccaaaucucacgaugacggcaauaucgaucuagagagcgacuccuuucucaaguucgauucagagccaagugccguggcacuggaacuucccacacgggccuuugguccuagcgagaccaacgaaucuccagcuguugugcuggagcccccugucguguccauggaaguaucagagccacauauauuggagacucucaaaccggcaacaaagaccgccgaacugagcguugugaguacgucugucaucuccgagcagagcgaacaaucgguggcugugaugcccgagccuucuaugacuaaaauucuggacuccuucgccgcggcaccaguccccaccacaacucucguuuuaaagucaagugaaccugugguaaccaugagcguggaguaccagaugaaguccguccugaaaucuguggagagcacaucaccagaacccaguaagaucaugcuuguugagccgccuguggccaaagucuuggaacccuccgagacccuggugguaagcucugagacgccaacugaaguuuauccugagcccucaacaaguaccacuauggauuuuccagaaagcuccgcuauugaggcccuacgccuccccgaacagccuguggacgucccaucugagaucgcagauucgagcaugacaagaccgcaggagcugcccgaacuuccuaagaccacggcucuggaguugcaagaauccucaguggccagugcgauggagcucccagggcccccugccaccucuaugccagaacugcagggacccccggucacaccuguguuagagcugccaggccccagcgcaacuccuguucccgagcucccaggcccucuuuccacccccgugccagaacugccggggccucccgcuacagccguaccagaguugcccggaccuucagucacuccagugccccagcuaagccaagaacugccuggucucccggcuccaucuaugggccuggagcccccucaggaaguuccagagcccccugugauggcccaggagcuuccggggcugcccuuggucaccgcagccguggaacucccagagcagccugcuguaacaguggcgauggaacugaccgagcaacccguuacuacgacagaguuagaacagccagucggaaugaccacuguggagcacccuggccaucccgaagugaccacagcaaccggucugcuagggcagccagaggccacuaugguccucgaacugccgggacagccuguugcuacaacggcccuugaguugcccggccaaccauccgugaccggcgugcccgagcugccugggcucccaagugcaacuagggcccuggaacuuagcggacagcccguagcuacaggugcccuggaguugccuggcccgcucauggcagcgggggcucuggaauucucuggacaguccggcgccgcaggugccuuagagcugcuagggcagccacucgcuaccggcguccuggaacuucccggacaaccuggcgcccccgaguugccagggcagccuguggcaacaguugcucuggagauaucagugcagagugucgugacuaccagcgaacucucgacgaugaccguuucccagucucuggaggugcccagcacaacugccuuagaaucauacaauaccguagcgcaagagcugccaacaacucuugucggagaaaccagugugacggugggugucgacccuuugauggccccggagucccacauucucgcuucuaacacaauggagacccacauccuggcaagcaauacuauggacucccagaugcuagccucaaacacaauggauagccagaugcuggcuaguaauaccauggacucucaaaugcucgccuccagcacuauggauucgcagaugcuggcaaccucaucuauggacagucagaugcuugcgacauccagcauggauucucagauguuggccacgagcaccauggacucccaaaugcuggcuacuucaaguauggauagccagauguuagccacaucuuccauggacucacagaugcucgcaaccaguagcauggauucccagaugcuggcuacaucuucgauggacagccaaaugcuugccacuucaaccauggauucccagaugcuggcaacgaguacaauggacucucagauguuggccaccagcuccauggacucacagaugcucgcuucuggcacuauggauagccaaaugcuggcgagugggaccauggacgcccagaugcuagcauccggaacaauggaugcucagaugcuggccagcucuacucaagacucagccaugcucggcuccaaaagucccgauccauaucggcuggcucaggacccuuaccgccuugcacaggaucccuaucgauugggucaugacccauacagacuggggcacgaugccuacagguuaggccaggacccuuaucggcucggacaugaucccuaccgucugaccccggacccauaucgcaugagcccuagacccuacaggauugcgccacggucguaucgaaucgcuccccgcccuuacagacuugccccgaggccccugaugcuagcaucucggcgcuccaugaugaugagcuaugccgcugaaagaucaaugaugaguucuuacgagagguccaugaugagcuacgaacguucaaugaugaguccaauggcagagcggagcaugauguccgccuaugagcgaucuaugaugagcgcguacgaaagauccaugaugucaccuauggcugagaggucuaugaugagugccuaugaacgcucgaugaugagcgcauacgagcgguccaugaugucucccauggccgauagaucaaugaugagcaugggcgcugacagguccaugaugaguucuuauagcgccgcagaccgcucaaugauguccaguuacagcgcugccgaucgaucuaugauguccucauauacagcggaccggagcaugaugucgauggccgcagauucuuacacggacaguuacaccgauacuuauacagaagcuuacaugguuccuccacuccccccugaggagccacccaccaugccgccucugccacccgaagagccuccaaugacucccccguugccucccgaagagccaccugaagggcccgcccugccaacagagcaauccgcuuuaaccgcagagaacacguggcccacugaagugccuagccucccaucagaggaauccguaucucagccggagcccccugugagccagagugaaaucuccgagccaagcgccguccccaccgacuauucugugucagccagugauccuuccguucuggugagcgaggcugcggucacagugccagaacccccuccggagccagaaucuucgauuacccuuacucccguugagucagcaguggucgccgaggaacacgagguagugccugaacgucccguuacauguauggugagcgagaccccagcuauguccgccgaaccuacaguccuggcaagugagcccccagugaugucugagacugccgaaaccuuugacagcaugagagcuuccggacacguagcgucagaggugaguacgucuuugcucgucccggccguuacaaccccugugcuggcagaaagcauacuagagcccccagcuauggccgcacccgaauccucagccauggcugugcuggagagcucugccgucacugugcuugaguccaguaccguuacaguacucgaaagcucgacugugaccguccuggagccuuccgugguuacggugccagaacccccugucguggcggagccggauuacguaacaaucccaguccccgugguuucugcauuggaaccuucagugccaguccuggagcccgccgugagcguuuuacagccuaguaugauuguguccgagcccucugucagcgugcaagaaucaaccguaacuguguccgagccagcuguuacagucagugaacagacccaggugaucccgacugagguggccauagagagcacaccuaugauucucgaaucuucaaucauguccagccaugucaugaaggguaucaaucugucuaguggcgaccagaaccuugcucccgagauugggaugcaagaaaucgcacugcacucgggagaggaaccacaugccgaggagcacuugaagggcgauuucuaugaauccgagcaugguauuaacauagaccucaauaucaacaaucaccugauugcuaaagaaauggagcacaacaccguaugcgccgcagggacgagcccugugggcgaaaucggagaggagaagauccuacccacuucagaaaccaaacagaggacaguucuggauaccuacccaggcgugucugaggcggacgccggggaaacacuuagcuccacuggaccuuuugcucucgagcccgacgccaccggcacgaguaaggguauugaauucacaacugcaucaacccugucuuuggucaauaaauaugauguggacuuaagccugacaacccaggauacugagcaugacaugguuauauccaccaguccgagcgggggauccgaggcugauaucgaaggcccacucccugccaaggacauucaccuggaucuucccucuaacaauaaccuggugucaaaggacacagaggaaccauugcccgucaaagagagcgaucagacgcuagcagcccugcucucgccuaaggaguccagugguggcgaaaaagaggugccgccacccccuaaggaaacucugcccgacucuggguuuagcgcuaauaucgaggauauuaacgaagcggaccuuguacgcccauuacugccuaaagacauggagcggcucaccucauugagagccggaaucgagggcccccugcucgcauccgauguggggagggaccgaucugcugccaguccaguugucagcuccaugccugaacgcgccucagagagcucuagugaagagaaggaugacuacgaaauauucgugaaagugaaggauacacaugagaaguccaaaaagaauaaaaaccgggacaagggagagaaagaaaagaagagagauagcucacugaggucucguuccaaacgcucgaagagcagugagcacaaaucucggaagagaaccuccgaaagcaggucacgagcacggaaacgcaguuccaagagcaagucucacagaucacaaacuaggagccggucccgaucuagacgcaggcgucggaguucgagaagcagguccaaaucacgcggccgaagaucugucagcaaggagaaacggaagaggaguccgaaacaucgcuccaagucacgugaaagaaagcggaaaaggucuagcucccgcgacaaucgaaagacaguuagagcucggaguaggacccccagccgcagaucuaggucacacacgccaucccggcgucgccgaagcagaaguguggguaggcggcgcucuuucuccaucucgccuagcagaaggucacggacucccucccgaagaucucgcacaccaaguaggcggagccguaccccuucaagaaggucccgcacccccagccggcgaucuagaacuccgaguaggcgcucccggacaccaagcagacguaggcggucacgcucuguagugcgaagaaggucguuuagcauuuccccuguccggcuucgcagaaguaggaccccccugcgacggcguuucucuagaucaccaauccgcaggaaacggagcagauccagugagcgcgggaggucucccaagcgauugacagaucuagacaaagcccagcugcucgagauugcgaaggcuaacgccgcagccaugugugcuaaagcaggagugccuuuacccccaaaucugaagccugccccgcccccaacuaucgaagagaagguugcgaaaaagagcggcggugcuacgauagaagagcuuaccgaguuuuga

SEQ ID NO: 63022 - RNA, 3456 nt, Artificial Sequence
  derived and/or modified sequence opt3 from SORBS1__Homo_sapiens__NP_001030127
augagcuccgagugcgacggcgggucuaaggccgugaugaacggacuggcucccgguucaaauggccaggauaaagcaaccgccgacccucucagagcgaggaguaucagcgcugucaagauuauaccaguuaaaacagugaagaacgccuccgggcuuguacugccgacugauauggaccccacgaaaaucuguaccggaaagggcgcagugacauugcgggccucuucgucauaccgcgaaacuccuagcaguuccccagcuucuccccaagagacccgacagcacgaaagcaagccugguuuagagccagaacccuccucagcagaugaguggcgucugaguagcucugccgacgcuaaugggaacgcccagccuuccucacuagcggcaaaaggauauagaagcguccauccaaaucucccgagugauaagucucaggacgccacauccagcucggcugcccaacccgaggugauuguugugccucuguaccuugucaacaccgauaggggccaggaaggcacugcacggccacccacaccucuggggccauugggaugcgugcccaccaucccggcuacggccucugcggccuccccucucacuuuccccacccuggacgauuuuauuccaccucaucugcagcgcuggccccaccacucacagccagcaagagcuagugguagcuucgcccccaucucccaaacaccuccaucuuuuagcccgcccccuccacucguacccccugcuccagaggacuuaaggcggguuucagaacccgaucugacuggcgccgugaguuccaccgacagcucuccgcuuuugaaugaggucucaaguagccugauagggacagacucccaggcauucccuucugugucgaaaccaagcuccgccuaucccucaaccacgaucgugaacccuacuauuguccuacuccagcauaaucgcgagcagcaaaagcgacugaguucucuuagcgaucccguuuccgaaagaagggugggagagcaggacucagcuccaacacaggaaaaaccuaccagccccggcaaggcgaucgagaagcgggcaaaagaugacucucgucgcguagugaaguccacucaagaucugagugacgucagcauggaugaaguggguauuccauugagaaacacagagaggucuaaagacugguacaagaccauguuuaaacagauccacaagcucaaucgggauacgccggaggaaaacccuuauuuccccaccuacaaauuuccagagcugcccgaaauacagcagacauccgaggaaacuaagucauguaguguuaugagcccucgauuagagugcucggggaccgugauugcccacuguucccugaagcuccuugacucuagcaauccacccacaucagcuagucaagucgccggaacugcagaugacgacuccgaucuguauucuccucgcuacagcuucuccgaggacaccaaaucaccguugagcgugccaagaaguaagucugaaauguccuacaucgauggcgagaaaguaguuaagaggagcgccacacuaccccugccugcucggucgucaucucucaaaaguuccagcgaacgcaacgacugggagccacccgauaagaagguggacaccagaaaauauagggccgaaccuaagucuauuuacgaguaucagccgggcaaaagcuccguccugacuaaugagaagaugucacgugauaucagucccgaagagaucgaccuuaaaaacgaaccaugguacaaguuuuucagcgagcuggaguuugggaagccucccccuaaaaagauuugggauuauacgccaggagacugcucuauauugccccgggaagaucgaaaaacaaaccucgacaaggaucuguccuuaugucagaccgagcuggaagcagaccuagagaaaauggaaacucucaauaaggcgccaucagcuaacgugccgcagaguagcgccaucuccccuacccccgagauuucuucggagacaccagguuacaucuauagcucaaauuuccaugcagucaagagagaauccgacggcgcccccggggaucugaccagucuugagaacgaaaggcaaauauacaaaucuguguuggagggaggcgacauuccucugcagggucucagcgggcugaagcgcccauccucaucugcuagcacuaaagauagugaaagcccccggcacuuuaucccugccgacuaccuugaguccacagaggaguucaucagaaggcgccaugaugacaaggaaaaacuguuggcagaucagcgacggcucaagcgugaacaggaggaagcugacauugccgcgagaaggcacacgggcguuaucccgacccaccaucaauucauuacuaaugagcgcuuuggagaucuguuaaacauagacgauacagccaaacggaagucuggcucagagaugagaccagcuagggcaaaguucgacuuuaaagcccagacccugaaggaacuaccccuccagaaaggggauaucguguauauuuacaagcagaucgaccaaaauugguaugagggagaacaccauggucgaguaggcaucuucccucgcacauacauugagcugcuucccccagcugagaaagcccagccuaagaaguugacucccguccaggugcuggaauauggggaggcaauagcgaaauuuaacuucaauggagacacccaaguugaaauguccuuucggaagggcgagagaaucacgcuccugcgucagguggaugaaaacugguacgaggguaggauuccagggaccagucgccagggcaucuucccuauuacauaugucgacgugaucaaacggccguuaguaaagaaucccguggauuacauggaccugccauuuagcucgucuccuuccagaagcgccacugcuucaccccagccauggagggaggaaaguggacaauacgagcgaaaagccgaacggggcgcaggggagcgcggaccugguggccccaagauaucuaagaaauccugccuuaagccgagcgauguugucagauguuugucaaccgaacagaggcucagugaccugaacacaccagaggagagccggccugggaaaccccuaggauccgcuuucccaggcucugaagccgagcagacugaacgacacagagguggggagcaggcaggccgcaaggccgcuaggcguggaggcagccaacagccccaggcgcagcaacggagagugaccccugauaggucccagacgucacaggaccuguuuucuuaucaagcccucuacaguuauaucccgcagaaugaugacgaacuggagcuucgcgauggggacauuguggacgucauggagaaaugcgaugacggaugguucguuggcacaucgcgaagaaccaagcaguuugguacuuuccccgggaacuacgugaagccauuguaucuguga

SEQ ID NO: 63023 - RNA, 1935 nt, Artificial Sequence
  derived and/or modified sequence opt3 from SORBS2__Homo_sapiens__NP_001139142
augagcgugacccugacauccgucaagagaguucagucuucacccaaccuccuugccgcuggcagggacagucaaagcccugauuccgcauggcggucuuacaaugacgggaaccaggagacucugaauggagaugccacguauucgucauuggcggcuaaagguuuccgcagcgugcgaccaaacuuacaggacaagcguaguccgacccagucccaaaucacaguaaauggcaacucugggggagccgugagccccauguccuacuaucagagaccuuuuucaccaagugcauacagccugcccgccucucuaaauuccucaauugucaugcagcacggcacuagccucgauaguaccgacacauauccucagcaugcucaaucucuggaugguaccacuuccagcucgauaccacuuuacaggucuuccgaagaggaaaaacgggugacaguuaucaaggcaccccacuauccugggauuggaccaguggacgagucaggcaucccgaccgccauucgcacgacugucgauagacccaaagacugguacaagaccauguucaagcagauccauauggugcacaaaccuggccuguacaacccacccuauagugcucagagccauccugccgcgaagacacagacuuacaggccauuguccaaaucucacagcgauaauucacccaacgcauuuaaggacgccaguuccccgguaccucccccacacguuccucccccagugcccccucuccggccacgcgaucgaagcucuaccgaaaaacaugacugggacccgcccgauagaaaggucgacacaaggaaguuccggucagagccucguaguauauuugaguaugaaccagggaaaagcuccauccugcaacacgagcgccccgcuucucuguaccagucgagcauugauagaucccucgaaaggccuaugucaagugccucuauggcaagcgacuuccggaagcgacgcaaauccgagccagcugugggacccccgagagguuuaggcgaucagucagccagcaggaccucuccugggcggguggaccugccaggauccaguacgacucuuacaaagagcuuuaccucuuccucacccaguagcccuucgcgcgcgaaagauagagagucccccaggucuuauagcucaacuuugacagacaugggccguagugccccacgggaacgaagagguaccccugagaaggaaaaacugcccgcaaaggcugucuacgauuucaaggcccaaacguccaaagagcuaucuuuuaagaaaggggacaccguuuauauccucaggaagauugaucagaauugguacgaaggagagcaucacggccgcgugggcaucuucccaauaagcuacguagagaaacugacaccgccugaaaaggcucagcccgcccggccacccccuccagcacagcccggggagauuggagaagccaucgcuaaguauaacuuuaaugcggacacuaacguggagcuuucccugagaaaaggugacagggucauuuugcucaagcgcguggaucaaaauugguacgaaggcaaaaucccugggaccaaccgacagggaaucuucccgguuucauauguggaggucgugaagaaaaacacaaagggcgcagaggacuacccagaucccccuauuccacacagcuauaguucugaccggauacauucccugagcucgaauaagccccagcguccuguauuuacucacgaaaacauccagggugggggcgagccguuccaagccuuauacaauuauacccccagaaacgaagaugagcuggaacucagggagucagacguuauugaugugauggagaaaugcgacgauggaugguucgucggcacaucucgccggaccaaguuuuucgggacuuuuccaggaaauuacgugaaaagacuuuga

SEQ ID NO: 63024 - RNA, 2016 nt, Artificial Sequence
  derived and/or modified sequence opt3 from SORBS3__Homo_sapiens__NP_005766
augcagggcccaccuagaagccugagggccgggcucucccuugacgauuucaucccaggacaucugcaaucucacauugguucaaguagccggggcacccgcgugccggucauacgaaacgggggauccaauacauugaacuuucaguuccacgaccccgcuccucguacuguuugcaauggcgguuacacgccaagaagggaugcaucucagcaucccgacccugccugguaucagaccuggccagggcccggaucgaagccuucagcgagcacaaaaaucccagcuagucaacacacucagaacugguccgccaccuggacaaaggauucuaaacggcgcgacaagagaugggugaaauacgagggcauuggcccgguagaugaaagcgggaugcccaucgcaccuagguccucaguggaccggccacgcgauugguaucgaagaauguuucagcagauucauaggaagaugcccgacuuacaacuggauuggaccuucgaggaaccuccacgggacccccgucaccuaggagcccagcagcgcccggcucacagaccuggucccgcaacaaguagcucuggcagguccugggaucauucagaggaacucccacggagcacuuuuaauuaccgaccuggggccuucaguaccguccugcagcccucuaaccaagugcuucgcagaagggagaagguugacaauguguggacggaggaauccuggaaccaguuucugcaggaguuggaaacuggacaacggcccaaaaagccccucgucgacgauccuggcgagaaaccaagccagccgaucgaggugcugcuggaacgcgagcucgcugaauuaucggccgagcuggacaaggaucuuagagcgauagaaaccagguugcccucuccuaaauccucaccagcaccccgucgggccccugagcagcgaccacccgcugguccggccagugcauggagcuccucuuauccucacgcuccauaccuggggagcgccagaucacuaaguccccauaagauggcggacggaggcuccccuuuccucggcaggcgcgauuuuguauaucccagcucuacacgggacccaucagccaguaaugggggagguagcccugcaagaagggaggaaaagaaacgcaaggcugcccgacugaaauucgauuuucaggcucaaucccccaaggagcuuacucugcagaaaggcgacaucguuuacauucacaaggaaguggauaaaaacugguuggagggggaacaccauggacggcucggcaucuucccagccaauuacgucgaggugcugccggcagacgagauuccuaagcccaucaagccacccaccuaucagguguuagaauacggugaggccgucgcucaguauacauuuaaaggggaucuggaaguugagcucucuuuccguaagggcgaacacauaugucuuauuagaaaagugaacgagaauugguacgagggaaggaucaccggcacggggcgccaaggaauuuucccugcgucguauguacaggugagccgggaaccaagacugagguugugcgacgacgguccccagcuaccuacuuccccgcgacugacagcagccgcucgcucagcccggcauccaaguucucccagcgcacucagauccccugccgauccaaucgaccugggcgggcagaccucacccaggcguacuggauuuagcuucccuacacaagagccgcgcccccagacccagaaccuuggcacgccagguccugcucugucucacucccgggggcccagucauccauuggaucucggcaccagcucuccuaauacaucccagauccacuggacucccuacagagccauguaucaauacaggccacagaacgaagacgagcuggaguuacgagaaggagaucgggucgacgugaugcagcaaugugaugacggcugguuuguuggggugucacgcagaacccagaaguucggaacauuuccggguaacuacgucgcaccuguguga

SEQ ID NO: 63025 - RNA, 3597 nt, Artificial Sequence
  derived and/or modified sequence opt3 from SORCS1__Homo_sapiens__NP_001013049
augggcaaggugggggccggagguggcagccaggcuagacuguccgcacuccuugccggggcgggacuguugaucuuaugcgcucccggcgucuguggugggggaucuugcuguccuucaccacacccgaguagcgcccccagguccgcaucuaccccucggggcuucucgcaucaaggccgcccagggcgagcccccgcuacaccucugccacugguugugcguccccucuuuucaguagcaccuggagacagagcccugagccuugagagggcucgggguacuggcgccaguauggcgguggcagcccgcuccgggagaaggcggcgcucuggagcugaucaggaaaaagccgagcgaggcgaaggugcaagcagauccccaaggggaguccugcgggacgggggccagcaggagccgggcacgcgugaacgcgaucccgacaaggcuaccagauucaggauggaggaguugcggcucacaucaacuaccuuugcccugacaggggauagugcgcacaaccaagccauggugcauuggagcggacacaauucuuccguuauucugauacucaccaaauuauacgacuauaaccuggguucaaucacugaaagcagucuuuggcgaucuacagauuacggcaccacguaugagaaguugaaugacaaaguggggcugaagacuauucuauccuaccucuaugucugcccuaccaacaagcgcaaaaucaugcugcuuacagauccagaaauugagagcucgcuguugaucucuuccgacgagggagcaacuuaccagaaguauagacucaauuucuacauacagucacuguuauuucaucccaaacaggaagauuggauccuggcuuacagucaagaccagaagcucuauagcuccgccgaguucggcaggcgguggcagcuuauucaggaaggugugguaccuaaccgcuuuuacuggucuguuauggggagcaauaaagagccagaucuggugcacuuggaagcuagaaccgucgacggccacucacauuaucuaacauguaggaugcaaaacugcaccgaggccaaucguaaccagcccuucccgggauacaucgacccugauagucugauugugcaggaccacuauguguuuguccaacucacguccggcgggcggccccauuacuauguuagcuaccgaagaaaugcauucgcccagaugaagcugccaaaguacgcucuaccuaaagauaugcacgugaucucuacugacgagaaccagguauuugcggcagugcaggaauggaaucaaaacgauacauauaaucuguacauaucagacaccaggggagucuauuucacuuuggcccucgagaacgugcagaguagccgcggucccgaaggcaacauuaugaucgaucuguacgagguugcugggauuaagggaauguuuuuagccaauaaaaagaucgacaaccaggugaaaacauucaucaccuauaauaagggccgggauuggagacugcuacaggcaccagacacggaucucaggggugaccccguccacugucugcuuccuuacugcuccuugcaucugcaccucaaagugucugaaaacccauauaccucggggauuauagccagcaaggacacagcuccguccaucauuguagccucaggcaauaucggaagugagcugucugauacugacauaagcauguucguuuccucagaugcaggcaacaccuggcgccaaauuuuugaggaggaacauagcgugcuuuaccuggaccaagggggagucuugguggcgaugaagcacacaucucuccccauccgacaucugugguuauccuucgaugaaggucggaguuggagcaaauacucuuuuacuuccaucccucuguucgucgacggcgugcuaggggagccaggagaagagacccucauuaugacaguuuuuggccacuucucacaccguagugaguggcagcuggugaagguagauuauaaaagcaucuuugacagaaggugugcugaagaggauuaccgccccuggcagcuucauucgcagggugaagccugcauuaugggggcaaagcggauauauaaaaagagaaaguccgagaggaaauguaugcagggcaaguacgccggagcuauggagucugaaccuugcgucugcaccgaggccgacuucgauugugacuauggcuacgaacgacacagcaaugggcagugcuugccagcauuuugguucaaccccucaagucuguccaaagauuguucucucggacagagcuaucuaaauuccacuggcuaccgcaaggugguuucaaacaauugcacggacggugugcgggagcaauacacagcuaaaccgcagaaguguccugggaaggccccaagaggauuaaggaucgucaccgcggacggcaaacugacugccgaacagggucauaacgugacccuuaugguacaauuggaggagggcgaugugcagcguacacucauucagguugacuuuggggauggaaucgcugucagcuaugugaaucugaguucuauggaagacggcaucaagcacguguaccagaacgucgggauuuuccgcguuaccgugcaaguggauaauucccuaggaagcgacucggcaguacuguaucuccacgucacuugcccccuggagcaugugcaccuuucauugccuuuuguuacaacgaaaaacaaggaagugaacgccaccgcuguccuguggcccucucaggugggcacuuuaacauacguuuggugguaugguaauaacaccgagccacucauaacacuggaagggaguaucuccuuccgguucacuagcgagggaaugaauaccauuacggugcagguaucugccggcaacgcaauccuucaggauaccaaaacaauugcggucuacgaggaauuuagaagccugagguuguccuucucaccuaaucucgacgauuauaaccccgacaucccagaguggcgacgggauauaggucgcgugaucaagaagagucugguggaagccacuggcgucccggggcaacauauucuaguugcugugcugccuggacuccccaccacagccgagcuguuuguacuuccauaccaggaccccgcaggcgaaaauaaaagaagcacugaugacuuggagcagaucucugagcuguuaauucacacccucaaccaaaauuccgugcauuucgaacugaagccuggggucagggugcuuguucacgcugcccaccugacggcagccccacuuguggaccucacacccacccauucaggaagugcuaugcugauguugcugagcgucguguuuguuggcuuagcgguguucgucaucuacaaauuuaagcggaaaauaccugguauuaacguauaugcccagaugcagaaugagaaggaacaggagaugaucuccccggugucucacucggagagccgaccaaacguuccccaaacugaacucagacgcccugggcagcugauugaugagaaaguggaaucacagcuuaucggauccauaaguaucgucgcagagaaucagucuacaaaggaaauuccaaccuacgugaacguauga

SEQ ID NO: 63026 - RNA, 3480 nt, Artificial Sequence
  derived and/or modified sequence opt3 from SORCS2__Homo_sapiens__NP_065828
auggcccacagaggccccagcagggcuuccaaggggccuggaccaaccgcacgggccccgucucccggugcgccuccacccccucgcucaccacgaagucguccccugcuccuucuguuguuacugcuaggcgcuugcggggccgcaggaagaagcccugagccaggcaggcucgguccgcaugcccagcugacacgggugccccgcuccccuccagcugggagagcagaacccggaggcggcgaggacaggcaagcccgggggacugaaccuggagcuccaggucccucuccgggcccugcccccgggccaggagaggauggcgcgccugcagccgguuaccgccgaugggaaagagcugcaccccuugccggggucgcuucgagggcccagguuucacugaucagcacgaguuucguguugaaaggagacgcgacccacaaccaggccaugguacauuggacaggcgaaaauuccucugugauucucauacugacuaaguauuaccacgcagauaugggcaaaguccuggagagcucccucuggcggucaagugacuuugggaccagcuauacaaaguuaacccugcagccaggagugacuacaguuaucgauaacuucuacauuugucccaccaauaaacguaaggugauccuugucucuuccucauugagcgaccgcgaucaaagucuguuucuaucugcugacgaaggugccacguuccagaagcagccuauuccauuuuucguggagacucucaucuuucauccgaaagaagaggauaagguacuggcuuauaccaaagaguccaagcuguacguuagcucggaccugggcaaaaaguggacauugcuccaggaaagagugacuaaggaucacgucuucuggucuguguccgggguggacgccgaucccgaccugguccacguugaggcacaagacuuaggaggcgauuuuagguaugugaccugcgccauacauaacuguucagagaaaaugcugacagcuccuuucgcggguccaaucgaccacgggagucucaccguacaggaugacuacaucuuuuucaaggcaacgagcgccaaucagacuaaauacuauguguccuaccggcgaaacgaguuuguccuuaugaagcugcccaaauaugcuuugccuaaggaucuacagauuauuucuacagacgaaagccaaguguucguugccgugcaggagugguaccagauggauaccuauaaucuguaccaaucagacccacgcggcgucagauaugcacucgugcugcaggauguaaggaguucccggcaggccgaggaaagcguucuuaucgacauacuggaggugcgcggagucaaaggcguguucuuggcuaaccagaagauugaugggaaggucaugacucucaucacauacaauaaaggaagagacugggacuaccugaggcccccgucuauggauaugaacgguaagccuaccaauugcaaaccacccgacugucauuuacaccuucaccuacguugggccgauaacccuuaugugucaggcacgguucauaccaaggacacagcacccgggcucauuaugggagcgggcaaucuggguagucaacuuguggaauacaaagaggaaauguauaucacuagcgauugcgggcacaccuggcggcagguauuugaggaggaacaucacaucuuguaccuggaccauggcggagucauuguggcuauaaaggauacauccaucccacucaagauucugaaauucucuguugacgagggccuuacuuggucgacccacaacuuuacaagcaccuccguguucgucgaugggcuguugucagaaccuggagacgagacucucgugaugacgguauuuggucacaucaguuuccgaucugauugggaacuggugaagguugacuuuagacccagcuucuccaggcaguguggcgaggaggauuauucaagcugggaauuaucuaaucugcagggggaccgcugcauaaugggacaacagcgguccuuuagaaaaaggaagaguacaagcugguguauuaaaggccgcucuuucaccuccgcccuaacuucacgagucugcgagugucgggacagugauuuucucugcgacuacgguuucgaacguagcucguccucugagagcucaaccaacaagugcagugcaaacuuuugguucaauccacuguccccgccugaugacugugcccuugggcagacauauaccucuagcuugggcuacagaaaggugguguccaacgucugcgagggaggcguugauaugcagcaaucacaggugcagcugcaguguccccucacuccacccagggggcugcaagugagcauccagggagaagcuguagccguccgcccuggcgaggacguguuauucguugugcggcaggaacaaggugauguccugacaacgaaauaccagguggaccuuggggauggauuuaaggcaauguauguuaauuugacccucacuggcgagccaaucagacauagguacgaaagucccgguauuuaucgagugucuguacgcgcugagaacacagccggccacgacgaggcgguccuguucgugcaggucaauuccccucuacaggcccuguaccucgaagugguuccggugaucgggcugaaccaagagguaaaucuuaccgcuguguugcugccauuaaaccccaaucucacagucuuuuauugguggauuggacauagccugcagccucuucugucguuggauaacucagugacuacccgguucucugacacgggcgauguuagagugaccguccaggcagccugcgggaauagugugcuccaggacuccaggguucugcgugugcuagaccaauuucaggucaugccacugcaguucagcaaagaacucgaugcuuacaaccccaauacaccugaguggcgcgaagacguaggacuggugguuacucggcuuuugucuaaggagaccagcgugccgcaggagcuguuagucacagugguaaaacccggccucccaacucuggccgaucuuuaugugcugcuaccucccccaagaccuaccaggaagcgaucccucucaagugacaagcggcuggcagcgauacaacaggucuugaacgcccagaaaaucagcuuucuguuacgcggugggguuagagugcucguggcucugagggauacgggaacaggcgccgaacaacuugguggcgggggaggcuacugggcagucgugguucuguucguaauuggguuguuugcugccggagcauucauccucuacaaguuuaaacggaagcgacccggcagaaccguguaugcccagaugcacaaugagaaagaacaggagaugacuucuccagucucccacucagaagacgugcagggugcuguucaagggaaccauaguggagugguccugagcaucaacucccgcgagaugcacucuuaccuagugucguga

SEQ ID NO: 63027 - RNA, 3669 nt, Artificial Sequence
  derived and/or modified sequence opt3 from SORCS3__Homo_sapiens__NP_055793
auggaggccgcuagaaccgaaaggcccgcaggccggccuggggccccacuggugcgcacaggacuccuucuguugagcacuugggucuuagcgggugcugagaucacgugggacgccaccggcgggccgggacgacccgcagccccugcuucccguccacccgcacugucuccucuaucaccaagagccguugcuagucaguggcccgaggaacucgccagcgcgaggcgggcagccgugcugggccgcagagcugguccugaacuucugccacaacagggaggaggcaggggcggggagaugcagguagaggccggagguacauccccggcaggcgaacggcgcgggcgagggauucccgcuccugccaaguugggcggugcgagaaggucucggcgugcccagccacccauaacucaagagcgcggggaugcaugggcuaccgccccugcugacggaucgagaggcucaaggccacucgccaaaggcagccgggaagaggugaaggcaccccgagccgggggaagugcugcggaggaucugcgccugccguccacaucuuucgcacucaccggugacagcgcccacaaccaggcuaugguccauugguccggccacaauucaagugugaucuuaauucugacuaaacuuuacgauuuuaacuuggggagcguuacagaaucuucccuguggagaucaaccgacuauggaacgacuuacgagaagcuaaaugauaaagugggccucaagaccguccugagcuaucuuuacgugaacccuacaaauaagaggaaaaucaugcuguugagugaccccgaaauggagucuuccauucucaucagcucggaugaaggugccacuuaucagaaguaccggcugaccuucuauauacagucuuuacuguuucauccaaaacaagaggacuggguacucgcauacucccuugaucagaagcuguacucaaguauggacuucgggcgcagauggcaguugaugcacgagaggaucacaccuaaccguuuuuauuggagcguugccggccuagauaaagaagcugaccuggugcauauggagguccggaccacggacggauacgcccacuaucucacuugccgaauccaggaaugugcagagacaaccagauccggccccuucgcgaggucuauugauauuagcucacugguggugcaagacgaauacaucuuuauacaggucacuacaagugggcgcgcuuccuauuacguuagcuaucggagagaggccuucgcacagauuaaacuuccaaaguacucucugcccaaggauaugcacaucauuucaaccgacgagaaucaaguguuugccgcuguacaggaauggaaccagaaugauacguacaacuuguauaucagugacaccaggggaaucuacuucacacucgccauggagaauauuaagagcucccgcggucugaugggcaacauaaucauugaauuauaugagguggcagggaucaaaggaauauuucuggcuaauaagaaagucgaugaccaggugaagacuuacauuaccuauaacaaaggccgagauuggcggcuacuccaagccccugacguugaucugcgugguucuccagugcauugccuuuugccguucuguucgcugcaccuccaucugcagcuuagcgaaaaucccuacuccucagggagaaucaguucuaaggagacagcgccuggccuggucguggccacuggaaacaucggcccagaguugagcuauaccgacauugggguauuuaucuccucagacggagguaacacauggaggcagauuuucgaugaagaguacaauguuugguuccucgacuggggcggggcucugguggcaaugaagcacacccccuuaccuguccgccaccugugggugagcuuugaugaaggacauucuugggacaaauacggcuucacuuccgucccacuauuuguggauggugcccucguugaggcugggauggagacgcacauaaugacaguguucggccauuuuagucugcggagcgaauggcagcuuguaaaggucgacuauaaaucuaucuucuccagacacugcaccaaggaggauuaccaaacuuggcauuugcugaaccagggagaacccugugugaugggcgagaggaaaauuuuuaagaagcgaaaaccgggggcccagugcgcacucggacgcgaccacucaggcaguguugugagcgaaccuugugucugcgcgaauugggauuucgagugugacuaugguuacgagcggcacggggaaucgcagugcgugccagccuuuugguauaaccccgcuuccccuucuaaggauuguagccugggacaaucauacuuaaauaguaccggcuauagaaggaucguauccaacaauugcacagacggucugcgugagaaauacaccgccaaggcacagaugugccccggcaaagcuccacgcgggcuucaugugguuacuacagauggacgguuggucgccgaacagggccacaacgcaacguucaucauucucauggaggaaggggaccugcagagaaccaauauacaacuagacuuuggagauggcaucgccgugucuuacgcuaacuucagcccuauugaggacgguaucaagcauguguauaaguccgcggggauuuuucaggucacugccuacgcagagaauaaccugggaucagauacagcuguucucuuccugcacguggugugucccguagaacacguccaucuuagggugccauucguugccauccgaaauaaagaggugaacauaagcgccgucguguggccgagucaguugggcacccugacauauuuuuggugguucgguaauucuacuaagccuuuaaucacccucgacuccagcauuucguuuacguuccuggcugaaggcaccgauacaaucacuguucaaguggcagccgggaacgcgcuuauucaggacaccaaagagaucgcuguacacgaauacuuucagucacagcuguugucuuucagucccaaccucgauuaucauaauccagacauacccgaguggcggaaggauauuggaaacgucaucaaacgcgcccuggugaaggugacauccgucccugaggaccaaauucuaaucgcaguuuuuccaggccugcccacuagcgccgaacucuucauacugccuccgaagaaucuuaccgagagaaggaaagggaacgaaggagauuuggagcagaucguggagacgcuguuuaaugcuuuaaaccagaaucucguacaguucgaacugaagccaggcgugcaagucauuguguacguuacacagcuuacccuggcaccccuaguggacucuagcgccggucacuccucaagugcgaugcucaugcuguugagcgucguguuuguugggcuggcuguguucuuaaucuauaaauuuaagcggaaaauuccuuggaucaacauauacgcccagguccagcaugauaaggagcaagaaaugauuggaucuguaucccagucagagaaugcaccaaaaaucacucucagugacuucacagaacccgaggagcugcuugacaaggaacuggauacccgagugaucggcgguauugccacuaucgcuaacagcgaguccaccaaggaaauuccuaauugcacaucuguuuga

SEQ ID NO: 63028 - RNA, 1074 nt, Artificial Sequence
  derived and/or modified sequence opt3 from SORD__Homo_sapiens__NP_003095
auggccgcugcagccaagcccaacaaucugagccucgugguccacggcccuggggaccuuagacuggagaacuacccaaucccggaacccggaccuaaugagguuuuguuaaggaugcauuccguggguauuugcggcucugauguacacuauugggaauacgggcggauaggaaacuucaucgugaaaaagccaaugguccugggccaugaggcgucagguaccguggaaaaaguugggaguagcgugaagcaccuaaaacccggagaccgcgucgcuauugagccuggcgccccacgagagaaugaugaauuuuguaagaugggccguuauaaccucucccccucuaucuucuuuugcgcaacaccuccagacgaugggaaucuguguagauucuacaagcauaacgccgcuuuuugcuauaaacuuccggacaaugugacuuucgaggaaggagcacugauugagcccuugucgguagguauccacgccuguaggcggggcgggguuacgcucggacacaaggugcuggucugcggcgcugguccuauagggauggugacccugcucguggccaaagcgaugggagcagcccaggucguugugacagauuuaucagcuacucgccugagcaaggccaaagagaucggcgcagaccuuguauugcaaauuaguaaggaauccccacaggagaucgcuagaaagguggaaggccagcugggguguaaacccgaggucaccauugaaugcacaggagccgaggcgucuauccaggccgguauauacgcaaccaggagcggcgggaaccuagugcucguuggacugggcuccgagaugacuacagugccucuucugcaugcugccauucgggaagucgauaucaaggguguguuucgcuauuguaauaccuggccaguagcuauuucaauguuggccaguaaaagcguuaacgugaagccccucgucacgcaccgauucccgcuggagaaagcauuagaagccuuugagacuuucaagaaagggcugggccucaagaucaugcuuaagugcgacccuucugaucaaaaucccuga

SEQ ID NO: 63029 - RNA, 6645 nt, Artificial Sequence
  derived and/or modified sequence opt3 from SORL1__Homo_sapiens__NP_003096
auggccacacggagcuccaggcgggaaucucgccugcccuuccucuuuacacuuguggcucuguugccuccaggcgccuuaugcgaagucuggacucagcgacugcacgggggaucagccccgcugccccaagaccgugguuuccucguugugcagggcgauccuagagaacugaggcuuugggcgagaggggacgcucgcggagccagcagagcagaugaaaagccacugaggcggaagcgcagcgccgcuuugcagcccgagccuaucaagguauacggccaggugucccucaaugacucucauaaucaaauggucgugcacugggccggugaaaaaucgaacguuauuguggcacuggcucgagauucacuggcccucgcgagaccaaagagcagugacgucuauguguccuacgauuaugggaaaucuuuuaagaagauuagcgacaaauuaaauuucggacugggcaacagguccgaggcaguaaucgcccaguuuuaccauucacccgcugauaauaagcgguauauuuucgccgacgcauacgcucaguaucuuuggaucacguuugauuucuguaacaccuugcagggcuuuaguauuccuuuccgugccgcggaccugcuucuccacagcaaagccucuaaucugcuucugggguuugaucgcucccauccaaacaagcaauuguggaaaucagacgacuucggacagacauggaucaugauacaggagcacguuaagagcuuuaguugggguaucgauccguacgacaagcccaauacuauuuacaucgaaagacacgagccuucuggcuauuccaccguguucaggagcacagauuucuuucagucgcgggaaaaccaagaggucauucucgaggaagugcgagacuuccagcugcgcgauaaauacauguuugcaaccaaggugguccauuuacuggggucugagcagcaauccucaguucagcucugggugaguuucggaagaaaaccaaugagggcugcccaguuuguaacucggcaccccaucaaugaauauuacauagcugacgccagcgaggaucagguguucgucugcgugucccauucuaacaaucgcacaaaccuuuauauuagcgaagcagagggccugaaguuuucauugagucuagagaauguucuguacuauuccccugguggggccggaagcgacacccucgugagauacuucgcuaacgaaccauuugcggauuuccacagggucgagggccugcaaggcguguacaucgcaacgcuuauuaacgggucuaugaaugaagagaacaugcguucaguaaucacuuuugacaaaggagguaccugggaguuccugcaggcccccgcuuuuacaggcuauggggagaagaucaauugcgaguugagucagggaugcagccuccaccuggcccagcgguuaucccaacugcuaaaccuccagcugcgaagaaugccgauucuuucuaaagaaucggcaccuggcuugauaaucgccacugguagcguugggaagaaucuggcuuccaagaccaacguguacauuucaaguucugccggcgcaagguggcgcgaggcgcuccccggaccacauuauuacacauggggcgaucacgggggaaucauaaccgcuauugcccaggguauggaaacgaaugagcugaaauauagcacuaacgaaggcgagacauggaagaccuucaucuucuccgagaaaccugucuuuguguacgggcuucugacugaacccggagagaagucaacagucuucaccaucuuuggcagcaauaaagaaaacgugcauucuugguugauucuccagguuaaugcaacggacgcccugggugugccauguaccgagaacgacuauaaguuauggucccccagugaugagcgggggaaugaaugccugcuaggccacaagacaguauucaaaagaaggacuccucaugcuaccuguuuuaacggagaggacuucgaucgcccagucgugguuagcaauugcucuuguacacgagaagacuacgagugcgauuuuggcuucaagauguccgaagaccucucacuggaggugugugucccggaucccgaguuuagugggaaaagcuacucgccuccagugcccugcccuguaggauccacuuaucggcguaccagagguuacaggaagaucucuggcgacacaugcagcgggggagauguggaagcccgccuugagggcgaauugguuccauguccccuggcagaggaaaacgaguucauucucuaugcuguccggaaaucaauauacagauaugaccuggccaguggugcgaccgagcaauuaccgcugacugggcuuagggccgcuguggcauuggauuuugacuacgaacacaacugccucuauugguccgaucuggcccuagacgugauccagcgacugugucucaauggcucuacgggacaggaggucauuaucaacagcggccuggaaacaguugaggcucuugccuucgaaccuuugucccagcuguuauacuggguggacgcaggguuuaagaagaucgagguggcgaauccagauggagacuuccgccucaccauuguaaacucaagcguccuggaucggcccagagcccuugugcugguuccucaagagggcgugauguucuggacugacuggggugauuugaaacccgggauauacaggaguaauauggacggaucugcugccuaucaccucgucuccgaagaugugaaguggccaaacggcaucagcguugacgaucaguggauuuacuggaccgacgcauaucuggagugcaucgaacguauuacauuuucgggucagcaacgcucagugauccuagauaaucugccucaucccuacgcuauagccguauucaaaaacgagaucuauugggacgauuggucucagcucaguauuuuucgggcauccaaguacagcggcucucagauggagauccuggccaaucagcuuaccggguugauggacaugaaaauuuucuauaagggaaagaacacuggcagcaaugcuugugucccaagaccgugcucccuguuaugucucccuaaagcgaacaauucaaggaguugccgaugucccgaagacgugaguucuuccgugcugccaucaggggaucuuaugugcgacuguccccaaggauaccagcugaagaacaauacaugcgucaaagaggaaaacacgugccuacggaaccaguaccgcuguaguaauggcaacugcaucaauagcauaugguggugugauuuugacaacgauugcggugacauguccgaugagagaaauuguccuaccacuauuugcgaccucgauacacaguucaggugucaagaaucugggaccugcaucccacugucguauaagugugacuuggaggaugacugcggagacaacagcgaugagucacacugugaaaugcaucagugccgguccgacgaguacaauugcaguucuggcauguguauucgaagcuccuggguuugcgauggugacaacgauuguagagacuggucagaugaagccaauugcacagcaaucuaucacacuugugaggcuucuaacuuucagugccgcaauggccacuguauaccccagaggugggccugcgacggggauaccgacugucaagauggaagcgacgaagauccugugaacugcgagaaaaaguguaauggcuuccguugcccgaacgggacgugcaucccaaguuccaaacauugugacggacugcgggacugcagcgauggcucugacgagcagcacugugaacccuuaugcacccauuuuauggauuucguauguaagaauagacagcaaugccucuuucacucaauggugugugacgguauuauccagugcagggauggguccgacgaggaugccgcuuucgcaggauguagucaggacccugaguuccauaaggucugcgaugaguuuggcuuccagugucaaaacggugugugcauuagccugaucuggaaaugcgacggcauggaugacuguggggauuacucggacgaagccaacugcgagaauccaacagaggcgcccaacuguucucgcuauuuucaguuccgaugcgaaaauggacacuguauaccuaacagauggaagugcgaccgggagaaugauuguggcgacugguccgaugaaaaagacugcggggauagccacauucuuccguuuucaacucccggaccaaguaccugucugccuaacuacuauagguguucuuccggcacauguguuauggacacuugggugugcgaugguuaccgcgacugcgcugaugggagcgacgaggaggccugucccuugcucgcaaaugucaccgccgcuucaacgccaacacagcugggacguugcgauagauucgaauuugagugucaucagccuaagaccugcauccccaacuggaaacggugugacggccaccaagacugccaggauggcagggacgaagcaaauuguccaacucauaguacacuaaccugcaugagccgcgaguuccagugugaagauggggaggccugcaucgugcuguccgagcgaugugacggauuucuugauugcucugacgaaagcgaugagaaggcguguuccgacgaacucacuguuuacaaggugcagaaccugcaauggaccgcugauuucucaggugacgucacauugacguggaugagaccgaaaaagaugccuucugccaguugcguauauaauguguacuaucggguugugggcgagucgauuuggaaaacccuggaaacucacagcaacaagacaaauaccgucuuaaaagugcucaagcccgauacaacuuaccagguaaaggugcagguccagugccuguccaaagcacauaacaccaaugacuuuguuacgcuuaggacaccagaggggcugcccgaugccccucgcaacuugcaacucucucugccaagagaggcugaaggagugaucgugggccacugggcacccccuauucacacccauggucuaauaagggaguauaucgucgaauacucacggagcggguccaagaugugggcaagucagcgugcugccucuaauuucacugagauuaaaaaccugcuugugaacacccucuauacaguucgcguagcggccgugacuagccgaggaaucggcaauuggucagacuccaagaguauuaccacaaucaaaggcaaggucauaccgccacccgacauccacauugauagcuacggggaaaacuaccugucuuuuacguugaccauggaguccgacaucaaggugaauggauauguugugaacuuauucugggcauucgauacucauaaacaggagagaaggacacugaauuuucgggguucaauucucagccacaaggucggcaaccugaccgcucacacuucguacgaaaucucugccugggcuaaaacagaccuuggggauaguccucuggcauucgagcaugugaugacccgcggaguaagacccccagccccuuccuugaaggccaaagcuauaaaucaaacggcggucgaauguacuuggaccggccccaggaacgugguuuaugguauauuuuacgcaaccagcuuccuagaccuguaucggaauccaaagucacucaccacuucccugcacaacaaaacagugaucgucucuaaggaugagcaguaccuauuuuuagugcgaguuguggucccuuaucaggggccgagcagugacuacgugguagugaagaugauccccgauuccagacugccaccucgccaucuccacguuguccauaccggaaaaacaagcguggugauuaagugggagucucccuacgacucaccagaucaggacuugcuguaugccauagcugucaaagaccucaucaggaagacugaucggaguuacaaaguaaagucccguaauagcaccguggaauauacgcugaacaaacuugagccuggcggcaaauaccacauuaucguucaacuggggaauaugucuaaggacucgucaauuaaaaucacaaccgugagcuuguccgcccccgaugcacuaaagauaaucacugaaaacgaccacguccuacucuucuggaaaaguuuagcccugaaggagaagcauuuuaaugaaucuagaggauaugagauucacauguucgauagcgcuaugaacaucaccgcguaccuugguaacacaacugacaacuuuuucaaaauuuccaaccugaagaugggccauaauuauaccuuuacggugcaggccaggugccucuucgggaaccagaucuguggagagccggcaauauugcuguacgaugaacucggcucaggugcugacgccagugcaacacaggccgcucgcucuaccgauguugccgcgguggucgugccaauucuguuucuuauccuacugagcuuggggguaggauucgcaaucuuauacacuaaacaccggcgacugcaauccucauucacagccuuugcuaauagccacuauucuuccagacucggcagugccauuuucagcucgggcgacgaucugggggaggacgaugaagacgcuccuaugaucaccggauuuuccgacgaugugcccaugguuauagcauga

SEQ ID NO: 63030 - RNA, 4002 nt, Artificial Sequence
  derived and/or modified sequence opt3 from SOS1__Homo_sapiens__NP_005624
augcaggcccaacagcugcccuacgaguucuuuagcgaagagaacgcuccuaaguggagaggccuccuugugccagcacugaaaaagguccaggggcagguucacccgaccuuggaauccaaugacgaugccuuacaauauguggaggaacugauccuacagcuccugaacaugcuuugccaggcgcagcccaggucugcuucagacguagaggagcgggugcaaaagaguuucccucauccaauugauaagugggccauagcagacgcccagagcgcuaucgaaaaacgcaagcgacguaauccccuguccuugccugucgagaagauucacccacuccugaaagaagugcugggauacaagaucgaucaucagguuucuguguauauugucgcagugcucgaguacaucucggccgacauauuaaaacugguagguaacuauguuagaaauaucaggcacuacgagauuacaaagcaggauaucaaaguggcuaugugugccgacaagguccuuauggauauguuucaucaagacguggaagauauuaacaucuugucacugacugacgaggaacccagcacgaguggcgagcagaccuauuacgaucuagugaaggcguucauggcagaaauacggcaguacauucgcgagcucaaucugaucauuaaagucuuuagagagccuuucguuuccaacucuaaacuuuuuagcgccaaugacguggaaaacaucuucuccaggaucguagacauucacgagcugucagugaaauugcucgggcacauagaagauacagucgagaugacugacgaaggaaguccacauccgcuggugggcagcugcuuugaggauuuagcugaggaacuggccuucgaccccuaugagucuuacgcacgggauauccuccgcccugguuuucacgaccgauuccuuucccaacugucaaagccaggggcugccuuguaucuacagagcauuggagaaggcuuuaaagaggcgguucaguacgugcugcccagacuccugcuugccccugucuaucauugucugcacuacuucgaauugcucaagcagcuggaggagaaaagugaagaucaagaggacaaggaaugcuuaaagcaggcaaucaccgcucugcuaaaugugcagucuggcauggagaaaauauguuccaagagccucgccaaaaggcggcugucggagucugcuugccguuucuauucccagcaaaugaaggggaaacagcuugccauuaagaagaugaacgaaauccagaaaaauaucgauggaugggaggguaaggacauuggccaguguugcaacgaauuuaucauggaggggacauugacccgcguaggagcaaaacacgaaagacauauuuuccuguuugauggccucaugauauguugcaagucaaaucacggucaaccaaggcugcccggggccaguaacgcugaguaccggcuuaaagagaaguucuuuaugcgaaagguucagaucaacgacaaagacgauacuaaugaauacaagcaugcguucgagauuauccugaaagacgaaaacagcgugaucuuuuccgcaaagucugccgaggaaaagaauaacuggauggcugccuugauuagccuccaguaucgcucaacacuggagagaauguuagaugucaccaugcugcaggaggaaaaggaggaacaaaugaggcuaccgagugcagacguguaccgguucgccgagccugauuccgaagagaauauaaucuuugaggaaaacaugcagcccaaggcuggcauuccaaucauuaaagccggaacggucaucaagcucauagagcgccugacuuaucacauguacgcagacccuaauuucgugagaaccuuucuuacaacuuauaggagcuucuguaaaccccaggaauugcugucucucaucauugagcguuuugagaucccagaacccgagccuaccgaagcggaucggauugcuaucgagaacggcgaccaaccacugucagccgaauuaaagcgauucagaaaagaguacauacagccgguucagcugagggugcuuaauguaugccgccauugggucgagcaccacuucuaugauuuugaacgggacgcauacuugcuccagagaauggaggaguucauugggacagugaggggaaaggccaugaaaaaguggguugaaaguaucaccaagauuauccaacgcaaaaagauagcucgagauaacggucccggccauaauaucacguuucagagcuccccuccaacuguggaauggcacauuucucggcccgggcauaucgagacauucgaccugcuaacccugcacccuauugagaucgcccgucagcucacucugcuugaaucggauuuguacagagcaguccagccaagcgagcuggugggauccguauggacaaaagaagacaaggagauaaacucacccaauuuacucaaaaugauuaggcacaccacgaaccugacccuuugguuugaaaagugcaucguggagacagagaaucuggaggaacgcguugcugucgugagucggaucauugaaaucuugcaaguguuccaggagcucaacaacuuuaauggcguccuggagguugugucugccaugaacagcuccccgguguauagacuagaccauacuuucgaacagauuccuucaaggcagaagaaaauacuggaggaagcgcacgagcucagcgaagaucauuacaagaaauaucuggccaaacuucgaucuaucaauccacccuguguacccuuuuucgguauuuacuugaccaacauccugaaaacagaggaggggaaucccgaagucuuaaagcgccacggcaaggagcucauuaacuuuuccaaacggagaaagguggcugaaaucacuggagagauacaacaguaucagaaucaaccauacugccugaggguugaaagugacaucaaacguuucuuugagaaccuuaauccuaugggcaacagcauggagaaggaguucaccgauuaucuguucaauaaaucucuagaaauugaaccccgcaacccaaagccgcucccucgguuucccaagaaauacuccuacccacugaagucacccggggugagaccuaguaauccaaggcccggaacaaugcgacauccuaccccguugcagcaggagccacggaaaaucagcuauucgcgcauucccgaauccgagacugagucuacggcaagcgccccuaacucaccaagaacaccccugaccccuccgcccgcuaguggugccuccucuacuaccgacgucuguagcguguucgauuccgaccacucaagcccauuucacaguucuaaugauacaguuuucauccaggugaccuuaccucauggccccagguccgcaagcguaucgucaauaucucucacuaaggggacagacgaagucccagugccucccccagugccgccucggcgaagacccgagagugcgccagccgaauccagccccucuaaaauuaugagcaagcaccuggauuccccuccagcuaucccuccucgccaaccgacgucaaaagccuacaguccaagguauagcaucucugaccguaccuccauuucagaucccccugagagucccccacuucugccuccccgggagccagucagaacuccugacguuuuuagcuccucuccguugcaucuccagcccccaccucugggaaagaagucggaucacggcaacgcauucuuucccaacagcccaucaccuuucacacccccgccaccucagacccccuccccacaugguacaaggcgccaccuacccaguccuccgcugacucaggaaguggaccuucacucuauagcugggcccccaguaccuccccgacaaagcaccucccagcauaucccuaaacucccacccaagacguacaaaagagagcacacccauccuucaaugcaccgggacggcccaccccuguuggaaaaugcccacucuagcuga

SEQ ID NO: 63031 - RNA, 3999 nt, Artificial Sequence
  derived and/or modified sequence opt3 from SOS2__Homo_sapiens__NP_008870
augcagcaagcuccccagccuuacgaguucuuuagcgaagagaacuccccaaaguggagaggccugcucgugucugcccuuaggaaaguccaggaacagguucacccgacccugucagcaaaugaggaaaguuuguauuacaucgaggaguuaauuuuccaacugcuaaacaagcucugcauggcccagccccggacagugcaggacguagaagaacgcgugcagaaaacuuuuccucauccaauagauaagugggcgaucgcugacgcccaaagcgcaauugaaaaacgaaagcguagaaauccccugcuucugccugucgauaagauccacccauccuugaaagaggugcucggguauaagguugacuaccaugugucucuguauauugucgccgugcuggaguacaucucggcugauauacucaaauuagcaggaaacuauguauucaauaucaggcacuacgaaauuucacagcaggacaucaagguuagcaugugugccgauaaagugcugauggacauguuugaucaggacgauauuggucuugucaguuugugcgaggacgaacccuccucuagcggcgagcugaacuacuaugaucuagugcggacggaaaucgcugaggagcgccaauaccucagagaacugaauaugauaauuaagguguucagggaggccuuucuuuccgaccggaagcuguucaaaccuucagacaucgaaaagauuuuuaguaacaucagcgauauccaugaguugaccgucaaacuccugggguuaauugaagacacaguugagaugacugaugagucuuccccacacccgcuggcgggaucauguuucgaagaccucgcagaggaacaggccuuugaucccuaugagacccuuagccaggacauacugaguccugaguuccacgagcauuuuaauaaguugauggcucgcccagccguggcacuacacuuccaaucuaucgcugauggcuucaaagaggccguacgauacgugcugcccagacucaugcuggucccuguguaucauugcuggcacuacuuugaacuucugaagcaguugaaagcguguuccgaggaacaggaggacagggagugccucaaccaggccauuacagcacugaugaauuuacaagguagcauggaucggaucuauaagcaguacucgccacgucgcagacccggggacccgguuuguccuuucuacucucaccagcugagguccaagcaucuagcuauuaaaaagaugaacgaaauacagaaaaauaucgauggaugggagggcaaggacaucggccaaugcuguaacgaauuuauuauggaggggccccucacccggaucggagccaaacacgaacgacauauuuuccuguuugacggucuuaugauaucaugcaagccaaaucacggccagacucgcuugccuggguauaguagcgcugaguacagacugaaggagaaauucgugaugaggaagauccagauuugugauaaagaagacacaugcgagcauaagcacgccuuugaacucgucuccaaagaugagaacucuaucaucuucgcagccaagagcgcugaagagaagaacaauuggauggcggcacugauuucacuucacuaucggaguacccuggaccgcauguuggauuccgugcuccugaaagaggaaaacgagcagcccuuaagacugccaagccccgaaguauacagguuuguugugaaggacucugaggaaaauauagucuucgaggauaaccuacaaucacguaguggaaucccuauuaucaaaggcgguacgguggucaagcucauugagcggcugacuuaucauauguacgccgacccaaauuuugugcgaaccuuccuuacaacuuauaggagcuuuugcaaaccgcaggaauugcugucccuccugaucgagagauucgaaauacccgagccugagccaaccgaugcugacaaguuagccaucgaaaagggggagcagcccauuucugcagaucugaaacgcuuccggaaggaauacguucagccugugcaacuuagaaucuugaacguauuuaggcacugggucgagcaucacuucuacgacuuugaacgcgaucucgagcugcuagagcgacuggaaucguucauuagcuccgugcggggaaaagccaugaagaaauggguugagucaaucgcuaagauaauucguaggaaaaagcaggcccaggcaaauggcgugagucacaacaucacauuugaaucuccacccccgccuauugaguggcauaucagcaagccaggccaauucgaaaccuuugaccucaugacgcugcaccccauagagaucgcgagacagcuuacuuugcuggaguccgacuuauaucgcaaaguccagccuucagaacucguggggagcguauggacaaaggaggauaaagaaauuaauucucccaaccugcuuaagaugauccggcauaccacuaaucugacauugugguucgagaaauguauuguggaagcugagaacuuugaggaaagaguugccguccucuccaggaucauagagauucuacagguguuccaagaccugaauaacuuuaauggagugcuggaaaucgucagugcaguuaacagcgugucuguguaccgacucgaucacaccuucgaggcccugcaggagcgcaagcggaagauccuugacgaagcuguagaguugucccaggaucauuuuaaaaaguaucuggucaaauuaaagucaauuaacccaccuugcgugcccuucuucgguaucuaccucacgaauauucugaaaaccgaagagggcaacaaugacuuucuuaagaagaaagggaaggaucugauaaacuucaguaaaagaaggaagguugccgaaaucacaggagagauucagcaauaucagaaucagccauacugucuacguaucgagccggacaugcgccgguuuuucgaaaaccucaauccuaugggcagcgcaucggagaaagaauuuacugauuaucuguucaacaaguccuuggagauugaacccagaaauugcaagcagccacccagguuuccucgaaaaucuaccuucagccugaagucaccagguauccggcccaacacagggcgccacggcaguacuuccggaaccuuaagaggccacccuacaccgcucgagagggagccauguaaaauaucuuuuagccggaucgcugaaaccgagcuggaauccacugugucagcccccacgagcccuaauacaccaaguacucccccugucucugcguccagcgaccuuucgguguuccuggauguugacuugaacucaucuugcgggaguaauuccauuuuugccccggugcuccugccccauagcaagucuuucuucagcuccuguggaucacuacacaaacugagugaggaaccacuuaucccucccccacucccuccccgaaagaaauuugaucaugacgcuagcaacucuaaggguaauaugaaguccgacgaugacccaccggcaauuccucccagacaaccacccccuccaaaaguaaagccccgcgucccugugccgaccggcgccuucgaugggccacugcacucacccccucccccaccucccagggacccauugccugauaccccgcccccagugccucugcgucccccagagcauuuuaucaacugcccuuucaacuuacagcccccgccacucggacaucugcaccgggacagugauuggcuuagagacauaagcacauguccuaauucccccucuaccccacccucgacuccuagcccgagggucccccgccgaugcuacguucugucauccagucagaacaauuuggcucacccuccagcacccccugugccacccagacaaaacucuagcccucaccucccaaaacugcccccgaagacauacaaacgggagcuaucccauccuccacuguauaggcuuccccuccuggaaaaugccgagacgccucaguga

SEQ ID NO: 63032 - RNA, 621 nt, Artificial Sequence
  derived and/or modified sequence opt3 from SOSTDC1__Homo_sapiens__NP_056279
augcugcccccugccauccacuucuaccuccuuccacuggcuugcauuuugaugaaaagcuguuuagcauuuaagaacgacgccaccgagauacuguauucccauguggucaagccgguucccgcgcacccuucuucaaauaguacacuaaaccaggcuagaaauggcgggaggcauuucagcaacacuggacucgaucggaauacgcgcgugcaaguagguugccgagaacugcguuccaccaaauacaucucugacggccaguguacaucgauuucaccacuuaaggagcuggugugcgccggggaauguuugccccucccuguccugccaaacuggaucggaggcgguuaugggacuaaauacuggagcagaaggaguucccaggaguggcggugcgugaaugauaagacccgcacacagaggauucaacugcagugucaggacggaucuaccagaacuuauaagaucacaguugugaccgcaugcaaauguaagcgguacacgcgccagcacaacgaaagcucccauaauuuugagucaaugagucccgccaaaccuguccaacaccaccgagagagaaagagggcuagcaaaucuuccaagcauucaaugagcuga

SEQ ID NO: 63033 - RNA, 642 nt, Artificial Sequence
  derived and/or modified sequence opt3 from SOST__Homo_sapiens__NP_079513
augcagcugccccucgcccuuugccugguguguuuguuaguccacaccgcuuucagaguuguggagggccaaggguggcaggcauuuaagaacgacgccacagaaaucauuccugagcugggagaauacccagagccgcccccugaacuagagaauaacaaaacuaugaauagggcggagaacgguggccggccaccccaucacccuuucgaaacgaaggauguaagcgaguauuccugccgcgaacuccauuuuacccgauacgugacagacgggccaugucguucugcuaaacccgucacugagcuggugugcucaggacaguguggcccugccagacuucugccaaaugcaauagguagggggaagugguggcggccgaguggacccgauuuccgcugcaucccugacagauauagggcccagcggguucaauugcucuguccaggcggcgaggcuccccgcgcacgaaaagugagacuggucgccagcugcaaguguaagaggcugacccgguuucacaaccaguccgaacucaaagauuucgggacagaggcugcccguccucagaagggacgcaaaccaagacccagggcgcggucugcaaaggccaaucaggcugaauuagagaacgccuacuga

SEQ ID NO: 63034 - RNA, 1401 nt, Artificial Sequence
  derived and/or modified sequence opt3 from SOX10__Homo_sapiens__NP_008872
auggccgaggaacaggaccugagcgagguggaacucucccccgucggcucugaggaaccuagaugccuuucaccagggagugcuccgagccugggacccgaugguggcgggggaggcuccgguuugagggcaucuccugggccaggagaguuaggcaagguuaaaaaggagcaacaggacggcgaagccgaugacgauaaauuccccguguguauccgggaggcgguaucgcaagugcugucaggguacgacuggacccuagucccuaugccagugcgcguuaacggagcuagcaagaguaaaccccacgugaagcgaccuaugaaugccuuuauggucugggcacaggccgcucguagaaagcucgcagaucaauauccacaucugcacaacgccgaacuuuccaaaacacuggguaaguuguggaggcuccugaaugagucugacaaacggccguucauugaggaagcugagcgccugagaaugcagcauaagaaagaucaccccgacuacaaguaucagccuaggcggcgcaagaacggcaaagccgcgcagggggaagcagagugcccaggaggcgaagccgagcaaggugggacugcugccauacaggcacauuacaagagcgcucaccucgaucaccgacaucccggagagggcuccccuaugucagacggcaauccagaacaccccagugggcagagccauggaccgccuacgcccccaaccacaccuaaaacugaguuacagucugguaaggccgaucccaaaagagacggcagguccaugggggaaggaggcaagccacacaucgacuuugguaacguggauauuggggagaucucacacgaaguaaugagcaauauggagaccuucgacguugcggagcuggaucaauaucuucccccuaacggccauccaggacacgugaguucuuacuccgccgcaggcuauggguugggaagcgcucuggccgucgcuucgggucauucugccuggauuuccaaaccgcccggcguggcacuaccuacagugucaccacccggggucgacgccaaggcucagguuaagaccgaaacugcgggaccucagggcccaccccacuacacagaucaaccgaguaccagccagaucgcauacacgucccucucucugccucauuaugguagcgccuuuccaucaauaagucggccccaguucgacuacuccgaucaccagccuagcgggcccuauuacggccacucuggacaggcuucaggccuuuauagugccuuuagcuacauggggccaucccagcguccucuguauacugcaaucucugaccccucgccaagcggaccgcagucccauucaccuacccacugggagcagcccguguacacaacuuugagucgcccauga

SEQ ID NO: 63035 - RNA, 1326 nt, Artificial Sequence
  derived and/or modified sequence opt3 from SOX11__Homo_sapiens__NP_003099
auggugcagcaagccgagagccuggaagcugaguccaaccuccccagagaagcacuugacaccgaggaaggcgaguucauggccugcucuccugucgcgcuggaugagucagacccagauugguguaagacagcuagugggcacaucaaaaggccgaugaaugccuuuaugguuuggagcaagauugaacggcgcaaaauaauggagcagucccccgacaugcauaacgcagaaaucucuaagcgauugggaaaacguuggaagauguuaaaggauucggagaaaauuccuuucaucagagaggccgaaaggcugcggcuaaagcacauggcugacuacccagauuauaaauaccgccccagaaagaaaccuaagauggacccaucagcaaagcccagcgccagucaguccccugagaaaucugcugccgguggcgggggaggcagcgcgggugggggagcaggcggcgccaagacuuccaaagggucaaguaagaaaugcggaaagcucaaagcuccagccgcagcuggugccaaggcgggcgccgggaaggcagcucagagcggagauuauggcggugccggggacgauuacgugcugggaucucuuaggguauccggcucaggcgggggaggugcuggcaaaacggugaagugugucuuucuggacgaagaugacgacgaugacgaugacgaugacgaguugcaacuccagauuaaacaggaaccggaugaggaggacgaggaacccccucaucagcaacugcugcagccacccgggcagcagccuagccaacucuuacggcgcuauaauguggccaagguuccagcaagucccacccugucuuccagcgccgaaucgccggagggagcuucucuuuacgaugaagugcgagcgggcgcaacauccggugccgggggcggaucaagauuguauuacaguuucaaaaacaucacuaagcagcacccucccccacuggcucagccugcccuaagccccgcauccucuaggagcgucucaaccaguuccucuagcucaaguggcagcuccucugggucgagcggagaggacgccgaugaccucauguuugaccugucccuuaauuucucacaaagugcucauucugccagcgagcagcagcuggguggcggggcagcggcuggaaacuugucccucucacugguggauaaggacuuagauagcuuuucugaaggcucccuggguagucacuucgaguuuccagacuacugcacacccgaacucagcgagaugauagccggggauuggcuugaagcaaauuucucugaccugguauuuaccuauuga

SEQ ID NO: 63036 - RNA, 948 nt, Artificial Sequence
  derived and/or modified sequence opt3 from SOX12__Homo_sapiens__NP_008874
auggugcagcaaagaggcgccagggcuaagcgggacgggggacccccuccaccgggucccggcccugcagaggaaggggcccgcgagccaggauggugcaaaacccccagcggccacaucaagcgaccuaugaacgcguucauggucuggucccagcaugaacguagaaaaauuauggaucaguggccagacaugcacaaugcugagauaucuaagaggcugggucggcgcuggcagcuccuucaagauucagagaaaauccccuuuguuagagaggccgagaggcugcgguugaagcauauggcagacuacccugauuauaaguaccgcccacgaaagaaaaguaaaggggccccggcuaaggcaagacccaggccuccaggaggcagcggcgggggaucccgguuaaaacccgguccucagcugccaggccgugggggacgcagagccgcuggcgguccccuagggggaggcgccgcggcaccggaagacgaugacgaggaugacgaugaagaacuccuggaggugaggcuuguagaaacaccuggccgggagcuguggcgaauggugcccgccgggcgcgcugccagaggacaggcagaaagggcucaggguccaucuggcgagggggccgcggccgcagcugccgcuucgccuacucccucagaagacgaggagccagaagaggaagaggaagaggccgcagccgcugaggaaggagaggaagagacggucgcgagcggcgaagagaguuuggguuuccucucccggcugcccccugggccagcaggccuggauuguucugcccucgaccgcgacccggauuuacaacccccuagcggaaccucccacuuugaguucccagacuauugcacacccgaagugacugagaugauugcuggcgauuggagaccuucaaguaucgccgaccugguuuuuaccuacuga

SEQ ID NO: 63037 - RNA, 1869 nt, Artificial Sequence
  derived and/or modified sequence opt3 from SOX13__Homo_sapiens__NP_005677
augagcaugagaucccccaucucugcccagcuggcucucgacggcguggggaccauggucaacugcacaauuaagucagaggaaaagaaggagccuugucacgaagcaccacaaggaagugccacugcggcugagccgcagcccggugauccugccagggcaagccaggacuccgccgauccacaggcucccgcacaaggcaauuuccgggggucuugggacugcucgucaccugaaggaaacggcagcccagagcccaaacgcccugguguuagugaggccgcuuccgggucucaggaaaaacuugauuuuaaucgaaaccugaaagaggugguaccagccauagaaaaguuguuaagcuccgacuggaaggagcguuuccugggaagaaauucaauggaggcgaaagaugugaagggcacgcaggaaagucuagcagagaaagaacuccagcugcuugucaugauccaucaacugagcaccuugagggaccagcuccugacagcccacucugagcagaagaacauggcugccaugcuguuugaaaaacagcaacagcagauggagcucgcacggcaacagcaggagcagauugcuaagcaacagcagcaguuaauccaacagcagcauaagauuaaucugcuucagcaacagauccaacaggugaacaugccguacguuaugauacccgccuucccuccaucccaccagcccuugccugugacuccagauucacagcuggcgcuacccauccagccgauuccuuguaaacccgucgaauauccacuccaacugcuucauagcccucccgccccagugguaaagcgccccggcgcaauggcuacccaccacccucugcaggagccaagucagccguugaaucucacagccaaacccaaggcuccugaacugccaaacaccucuuccagccccucguuaaaaaugucuuccugcguuccuagaccacccucacaugggggaccgacuagggaccugcagaguagcccuccaucccucccccuugguuuucugggcgagggggaugccgugacaaaggcaauccaagacgcccggcaguugcuacacucucauagcggagcucuggauggcucaccuaauacccccuuccgcaaagaccucauuagucuggacuccagcccagcgaaggaacgacuugaggaugguuguguccacccucuggaggaagcaauguugucuugcgacauggaugggucaagacacuuucccgagaguaggaacagcucccauaucaagcggccaaugaaugccuucauggugugggcuaaagacgaacgucgcaagauacuccaggccuuuccggauaugcacaacucuucgauuagcaaaauccugggauccagauggaagucaaugacgaaucaggagaaacaaccuuacuaugaggaacaggcaagguuaagucggcagcaucuggagaaguaccccgacuauaaguacaaaccacgacccaagcgcacuuguauuguggaaggcaaaagacuaagggucggcgaguauaaggcccucaugcggacccgcagacaggaugcuaggcaaucuuacguuaucccuccacaggccggacaggugcaaaugagcuccucagacguacuguacccccgugcagcggggaugccucuugcucagccguugguggaacacuaugucccacggagccuggaucccaacaugccugugaucguuaacacaugcucucuccgagaggagggugaaggcacugacgauagacauuccguggccgacggggagauguacagguauagugaagacgaggauagcgaaggagaggagaaaucugacggcgaacuggucgugcuuaccgauuga

SEQ ID NO: 63038 - RNA, 723 nt, Artificial Sequence
  derived and/or modified sequence opt3 from SOX14__Homo_sapiens__NP_004180
augagcaagcccuccgaccacaucaaaagaccuaugaacgccuucaugguguggucuaggggccagcggcgcaagauggcucaagagaauccaaaaaugcauaacucagaaauuaguaagcgacugggggcagaguggaaacuccuuagcgaagccgagaagcguccguacauagaugaagcgaagagacugagggcucagcacaugaaagagcaucccgacuauaaguaccggccucgcagaaaaccaaagaauuugcugaaaaaggauagguaugucuuucccuuaccuuaccuaggagacaccgauccacucaaggccgcaggucugcccguuggcgccuccgacgggcuucugucugcuccugagaaagcacgggccuucuugccaccggcuucggcccccuauucacuccuggauccugcgcaguuuagcaguuccgcaauccagaagaugggagaagugccacacacacuggccacuggcgcucuccccuacgccucuacguuagguuaucaaaacggggcauucggaagccuguccugcccuucacagcauacccacacacacccaagucccacuaauccgggcuacguagugccuuguaacugcaccgcuuggagcgccucuacacuucagcccccagucgcguacauuuuguuuccuggcaugaccaaaacugggaucgaccccuauuccucagcccaugcaacagcuauguga

SEQ ID NO: 63039 - RNA, 702 nt, Artificial Sequence
  derived and/or modified sequence opt3 from SOX15__Homo_sapiens__NP_008873
auggcccugcccggcagcucccaggaccaggcuuggucucucgagccuccagcagccaccgcggcugccucaaguagcuccgggccgcaagaaagagagggagcagguucucccgccgcuccuggcacacuuccacuggaaaaggugaaaaggcccaugaacgcauucauggucuggucgucagcccagcggcgccagauggcucaacagaacccuaagaugcacaacagcgagaucaguaaacgauugggggcccaguggaaguuacuggaugaagacgagaaacguccauuuguugaggaagcgaagagacuaagggcacggcaucuccgcgauuaccccgacuauaaguacagaccuaggcggaaagccaaguccucuggagcuggcccaagccgcugcggucaggggcgaggaaaucuggccuccggcggcccgcuuugggggcccggauaugcaacuacgcaaccuucaagagguuucggcuacaggccacccaguuauagcaccgcuuaccugccugggucuuauggauccucacacuguaaauuggaggccccaagccccugcagucucccgcagucugauccucggcugcagggcgaacugcuccccacauacacucauuacuuaccaccugguucccccaccccauauaaucccccucuggcgggggccccaaugccgcuuacacacuuguga

SEQ ID NO: 63040 - RNA, 1245 nt, Artificial Sequence
  derived and/or modified sequence opt3 from SOX17__Homo_sapiens__NP_071899
augagcucccccgacgccggcuacgcuucugaugaccagucacaaacccagagugcacugccugccgugauggcggggcucggaccaugcccgugggcugagagccuuucccccaucggugauaugaaggucaaaggcgaagccccugcaaacucuggggccccagcuggagcagccggcagagcuaagggugagucgaggauucggcgccccaugaaugccuucaugguuugggcgaaagacgaacgaaagcgucuggcacagcagaacccugauuugcacaaugccgaguuaucaaaaaugcuggggaaaagcuggaaggcucuaacacucgccgaaaagagaccauuuguggaggaggcagaaaggcugcggguacaacauaugcaggaccaccccaacuauaaguaccgcccuagaaggcggaaacaggugaagcgccuuaaacgagucgagggaggcuuccugcauggcuuggcugaaccacaggccgcggcccucgggccggagggagguagaguggcaauggauggccuggggcugcaauuucccgagcagggauucccugcuggcccaccccucuuaccuccacacaugggugggcauuauagggacugucagagucugggagcgcccccgcuugauggcuacccuuugcccacuccagacacguccccucuggauggcguugaccccgauccagccuuuuucgcugcacccaugccuggggacugcccagccgcuggaaccuauucuuacgcccaggugagcgacuaugcagguccgcccgaaccuccagccggccccaugcacccucggcuagggccagagcccgcuggaccguccauaccuggccuccuggccccacccucagcacuucacgucuacuacggugccauggggaguccuggcgcuggaggcgggcguggauuucaaaugcagccccagcaucaacaccagcaucagcaccagcaccauccaccuggucccggccaaccaagcccgccucccgaagcccugccaugucgcgaugggacagaccccucucagccugcagaguugcucggagaaguggauagaacugaguucgagcaguaucugcacuuuguaugcaagccagaaaugggcuuacccuaccagggucaugacuccgggguuaaucugccugauucacacggcgcgaucagcaguguggucucugacgcuuccagcgccguguauuacuguaacuauccggauguguga

SEQ ID NO: 63041 - RNA, 1155 nt, Artificial Sequence
  derived and/or modified sequence opt3 from SOX18__Homo_sapiens__NP_060889
augcagagaagcccaccuggcuacggggcccaagacgauccaccggcuaggcgggacugcgcaugggcccccggacacggugcggcugccgauacccgcggccuggcagccgggccugcugcacucgccgcuccagccgcgcccgcauccccuccaucuccccagcgaucaccuccacguaguccggagcccggaagauauggccuuagcccugccgguaggggagaacggcaggcugccgacgagucccgcaucagaaggccaaugaacgcauucauggugugggcuaaggaugaacggaaacgccuggcccagcaaaaucccgacuugcauaacgcggucuuaucuaagaugcuggggaaagccuggaaggagcuaaaugcagcugaaaaacgaccuuuuguugaggaggccgaaagacucagggugcagcaucugcgggaucacccaaacuacaaguaucguccccgcagaaagaaacaggcuaggaaggcccggcgacuugagccgggccuguugcucccuggccuggcacccccacagccucccccagaacccuucccugccgcuucggggucagcgcgcgcauuuagagagcugccaccgcucggagccgaguucgacgguuuaggccugcccacaccugaaaggagcccacuugauggguuggagcccggagaagcugccuuuuucccuccacccgcagccccggaggacugugcucugcggccuuuucgcgccccauacgcacccacugaacuaaguagagauccuggcgguugcuauggggcgccccucgcugaggcccugaggacggcacccccugccgcuccccuugccggacuguacuauggcaccuugggcacaccagggccguacccuggaccccucuccccacccccugaggcaccaccccuggaaucugcugagccuuuagguccggccgcggaccugugggccgauguagaccucacugaguucgaccaauaccuuaauuguagccguacccggccagaugcucccggccugccuuaucacguggcauuggccaaacuagggccacgagcuauguccugccccgaagaaucaagucugauuagcgcccucucugacgcauccucagcggucuacuauagcgccuguauaaguggauga

SEQ ID NO: 63042 - RNA, 1176 nt, Artificial Sequence
  derived and/or modified sequence opt3 from SOX1__Homo_sapiens__NP_005977
auguacagcaugaugauggagaccgaccugcacucccccggcggggcccaggcuccuacaaaccucucuggaccagccggugcaggcgggggaggcggugggggaggcggcgggggagguggcgggggagcgaaggcuaaucaagauagagugaaaaggccgaugaacgccuucauggucuggucacggggccagcgccgaaagauggcacaggaaaaucccaaaaugcauaacagugagaucagcaagcgucuuggugccgaauggaaaguuauguccgaggcugaaaagagaccuuuuauugacgaggcaaagaggcugcgggccuugcacaugaaagagcauccagauuauaaguaccgccccagaaggaaaacuaagacguuacugaaaaaggacaaguauucucuagcugggggacuccuggccgcgggcgcaggcgggggaggugccgcuguggccaugggcguaggggugggagucggcgcagcugccgugggucagcggcuugaaucgccugggggcgcggccggaggcggguacgcacacguuaauggaugggcuaacggugccuauccaggcucaguggcugccgcagccgcugcggcagccaugaugcaagaggcucagcuggccuacgggcagcaucccggagcaggcggugcccacccucacgcucauccagcccacccgcauccccaccacccucaugcacacccacauaauccccagccuaugcaccgcuaugauaugggggcguugcaauacagcccaauaaguaacucccagggcuacaugucugcuagccccuccggauauggcgggcucccguacggagccgcagccgcugccgcagcugccgcggguggcgcccaucagaauagcgcugucgcagccgcugccgcagcggccgcugccaguagcggggcacugggagcucugggcucucucgugaaauccgaaccuucagguucacccccagccccugcacacagucgagcccccugcccaggggacuuaagagagaugaucucuauguaucugcccgcuggcgagggaggcgauccugcggccgcagcugccgccgcugcacaguccaggcuucacagcuugccacaacauuaccagggggccggagcgggcguaaacgguaccguuccgcugacacacauuuga

SEQ ID NO: 63043 - RNA, 831 nt, Artificial Sequence
  derived and/or modified sequence opt3 from SOX21__Homo_sapiens__NP_009015
augagcaagcccguggaccacgucaaaagaccuaugaacgccuucaugguuugguccagggcucagcggcgcaagauggcacaagagaauccaaaaaugcauaacucugaaaucucaaagcgacugggcgccgaguggaaacuccuuaccgaaagugagaagcguccguuuauugaugaagcgaagagacugagggcuaugcacaugaaagagcaucccgacuacaaguaucggccucgcagaaaaccaaagacauugcugaaaaaggauaaguucgccuuucccgugccuuacggguuaggagguguagcagacgccgagcacccagcucuaaaagcaggcgccgggcuccaugcuggagccggcggugggcuggugcccgaaagccuucuggcgaauccugagaaggcagccgcugccgcagcugccgcggccgcaagggucuucuuuccacaguccgcugccgcugccgcagccgcugcggcagccgcugccgcaggaucuccguauucguugcucgaucugggcucaaaaauggccgaaauaagcaguuccucuagcggccugcccuacgcuuccucacucggguauccuacugccggagcgggugcauuccacggcgcugccgcagccgcugccgcagcugccgcggccgcugggggacacacgcauagucacccaagccccggcaacccugguuacaugaucccaugcaauuguucugcauggcccuccccgggguuacagccuccccuggccuauauucuuuugccaggaaugggcaagccucagcuggaccccuacccagcugccuacgcagcggcccuauga

SEQ ID NO: 63044 - RNA, 954 nt, Artificial Sequence
  derived and/or modified sequence opt3 from SOX2__Homo_sapiens__NP_003097
auguacaacaugauggagaccgaacugaagcccccuggcccacagcaaacaagcgggggagguggcggaaauuccacugccgcugcagccgggggcaaccagaaaaauucuccggacagagugaagaggcccaugaacgcguucauggucuggucacggggucagcgccgaaaaauggcucaggagaauccuaagaugcacaacagugaaaucagcaaacgucucggggccgaguggaaacuucuguccgaaacggagaagagaccauuuauugaugaggcaaagagguugcgggccuuacauaugaaggaacaccccgacuauaaauaccgcccuagaaggaagaccaaaacacugaugaagaaggauaaauauacucuaccaggaggccuccuggcucccggcggaaauucuauggcaucggggguuggugugggcgccgggcuuggagcuggcguaaaccaacggauggacucauacgcccauaugaaugguuggagcaacgggaguuauuccaugaugcaggaucagcugggauacccucagcacccaggcuugaaugcgcauggcgcagcccaaaugcagccgaugcaccgcuaugacgugucugcucuccaguacaacagcaugaccuccucacagacauacaugaaugggagucccaccuauagcaugucuuacucccaacagggaacuccugguauggcccugggcucaauggggagcgucgugaagagugaggcaucuuccagcccacccguugugacaucgucuucccacucacgagcuccuugccaggccggagaucugagagacaugauaaguauguaucucccaggcgcggaaguccccgagccggccgcaccuagcagguuacauaugucccaacacuaccagucuggucccgugccagggaccgcuaucaacggcacgcugccucuuagccauauguga

SEQ ID NO: 63045 - RNA, 1341 nt, Artificial Sequence
  derived and/or modified sequence opt3 from SOX3__Homo_sapiens__NP_005625
augagacccgugagggagaacagcuccggcgcccggucuccucgcgucccagcugaccuggcacgaucaauccucauuagucuuccguuucccccugauagccuggcccaccguccacccuccucugcgccuaccgaaucgcagggguuguucacaguugcugccccagcacccggagccccuucaccaccggcuacuuuagcacaucugcuacccgccccugcuauguacagccuccuggagacggaacuuaagaauccaguggguacccccacacaagccgcgggcacugggggaccugcagccccaggcggugcugggaaaaguuccgccaacgcagcuggaggcgccaauucuggcgggggaagcuccgguggcgcgucagggggaggcggugggaccgaccaggauagaguaaagaggcccaugaacgccuucaugguguggagucggggacagcgcagaaaaauggcacuggagaauccgaagaugcacaacagcgaaauaucuaaaagguugggcgcugacuggaagcuccugacagaugccgagaagcggccuuuuaucgacgaggcuaaacgccugcgagccguccauaugaaggaauaucccgauuacaaauauagaccaaggcggaagaccaaaacucucuuaaagaaggacaaauacucccugccuucaggccuuuugcccccaggggcagccgcugcggcagccgcugccgcagccgcugccgcagcggcuagcagucccgugggaguuggucagcgucuggauacauauacccacgugaauggcugggccaacggggcauacucucuaguccaagagcagcucggauaugcccagccuccauccaugagcucgccgcccccuccacccgcucugccuccaaugcaucgcuacgacauggccggccuucaguacucucccaugaugccgccuggugcacaauccuauaugaauguggcugccgcggccgcugcagccucaggguacggcggaauggcuccaagugccacggcagcggccgcugccgcauauggccagcagcccgcuacugccgcagccgcugcggccgcagcugccgccaugagccuggggccuaugggauccguaguuaagucugaacccagcucaccaccucccgcuauugcaagucacucccagagagccugcuugggugaucucagggacaugaucagcauguaccugccaccgggcggggaugcggcugacgccgcaucuccuuuacccggaggccggcugcacggugugcaucaacacuaucagggggccggcaccgcugucaacggaacagugccacucacucauauuuga

SEQ ID NO: 63046 - RNA, 1425 nt, Artificial Sequence
  derived and/or modified sequence opt3 from SOX4__Homo_sapiens__NP_003098
auggugcagcaaaccaacaaugccgagaacacagaagcucugcucgcaggcgagagcuccgacucuggggccggacuugaacuggguaucgcgucaagucccacuccuggcagcacggcuuccaccgggggaaaggccgaugacccaucuuggugcaaaacaccgucgggccacauuaagagacccaugaaugcauucauggucuggucacagauagagaggcggaaaaucauggaacagagcccugauaugcauaacgccgagauuaguaagcgcuuggguaaacgauggaaguuacugaaggacuccgauaaaaucccauuuauucgugaggcugaaagacuaaggcucaagcacauggcagacuaccccgauuauaaauaccggccucgcaagaaaguuaagucugggaaugccaacagcuccucaagugcugccgcgagcucuaagccaggagagaaaggcgacaaggugggcggguccggagguggcgggcauggaggcggugggggaggcggcucaagcaaugcagggggagguggcgggggagccaguggcgguggggcuaacucuaaacccgcccagaagaaauccuguggcagcaagguagcaggaggcgcugggggaggugugucgaaaccucacgccaagcugauccuugcgggcgggggaggcggugggaaggccgcagcugccgcugccgcaucuuucgccgcugaacaagcgggcgcagccgcucuguugccacucggagccgcagccgaucaucacucccuguauaaagcuagaacuccgucagccagugcaagcgcguccucugcugccagcgcaucagccgcucuggccgcacccggcaagcaccucgcugagaaaaaggucaaaaggguguacuuauuugggggacuggguaccaguuccagcccuguuggcggggugggagccggcgcggacccaucugauccccuugguuuguaugaggaagagggggccggcugcucaccugacgcuccaagucugagcggacgguccucugcagccucgagccccgcugccggccgcuccccggcagaucaucgaggguacgcgucacuaagagccgcuaguccugcccccucuagcgcaccaucccacgcuucaagcucugccuccagucauucuagcuccucaaguagcucgggauccucuagcucagacgacgaguucgaagaugaccuccuggaucuuaauccuaguuccaacuuugaaucuaugagccugggcuccuucucaagcaguucugcauuggacagggaucucgacuuuaauuucgagcccgguuccgggagccacuuugaguucccagauuauuguacacccgaagucucggagaugauaucaggagacuggcuggaaucuaguaucuccaacuuaguguuuaccuacuga

SEQ ID NO: 63047 - RNA, 1929 nt, Artificial Sequence
  derived and/or modified sequence opt3 from SOX5__Homo_sapiens__NP_001248343
augagcuccaagagacccgccucuccuuacggcgaggcugacggggaaguggcaauggucaccucaaggcagaaaguugaggaagaggaaagugauggacugccagccuuccaccucccgcuucaugugagcuuucccaacaagccucacuccgaggaguuccaaccaguaucucuguugacacaggaaacuugcggucaucggacgcccaccucgcagcacaauacaauggagguggacggcaacaaagucaugagcucauuugcgccucauaauaguuccacuucuccacagaaggcugaagaagggggacgccaaagcggcgaguccuuaucaaguaccgcccuggguacacccgagcgacguaaagggagccuagcagaugugguugacacccucaagcagagaaagauggaggaacugaucaaaaacgagccugaagagacuccaucuauugagaaacuucuguccaaggauuggaaggacaaauugcucgccaugggaucaggcaauuucggcgaaauaaaggggacaccggagagccuggcugaaaaggagaggcagcugaugggaaugaucaaccagcucaccaguuuacgggaacaacugcuugcagcccacgaugagcagaaaaaguuggcugccucucagauugagaaacagcgccaacagauggaacuggcgaagcagcaacaggagcagaucgcaagacagcaacagcagcuacuccagcaacagcacaaaauuaaucugcuucagcagcaaauccaggugcagggucagcugcccccuuugaugauaccagucuuucccccugaccaaaggacgcucgccgcugccgcacagcagggcuuccuguuaccacccggguuuuccuauaaggcuggauguagcgauccguacccugugcaacugauccccacuaccauggccgcggccgcagcugccacaccaggccucgguccucuucagcugcagcaguuguaugcugcccaacuagcagccaugcagguaucgcccgggggaaaacugccaggcauuccccagggcaaccucggggcugcgguuucuccuacuuccauccauaccgacaagucaacaaauaguccaccgcccaagagcaaagaaaagaccacgcuggagucccuuacucagcaacuggcagugaaacagaacgaagagggaaaguucucucacgccaugauggauuuuaauuugagcggugacucagauggcagugcuggggucuccgagagccggauuuaccgcgaaucucgaggaagaggcucaaacgagccucauaucaaaaggccaaugaaugccuucauggugugggcaaaggacgaacggcguaagauacuccaggccuuucccgacaugcacaacaguaauauuagcaaaauccuggguucccgcuggaaggcuaugacaaacuuagagaaacagccuuauuacgaggaacaagccagacugucuaagcagcaccuagagaaauauccagauuacaaguacaagcccaggccgaaacggaccugccucguggacgggaagaaacugcgaauuggcgaauauaaggcaaucaugcgcaacagaaggcaggagaugcggcaauacuucaaugucggacagcaggcgcagaucccuauugcuacugccggcguuguguauccaggggcaauagccauggcuggaaugcccucgccucaucuucccagcgaacacuccucaguaaguucuagcccagagccugguaugcccgugauccaauccacauacggcgucaaaggggaggaaccacauauuaaggaggaaauccaggccgaggauauaaacggagaaauuuaugacgaguacgaugaggaagaggacgauccggacguggauuauggcucagacagcgaaaaucacaucgcaggucaggcuaacuga

SEQ ID NO: 63048 - RNA, 2406 nt, Artificial Sequence
  derived and/or modified sequence opt3 from SOX6__Homo_sapiens__NP_001139283
augagcuccaagcaggccaccucucccuucgcuugcgcagccgacggcgaggaugcgaugacacaagaccugacuucaagagaaaaagaggaagggagugaucagcacguggcuagccaucucccucuucacccaaucaugcauaacaagccgcacuccgaggaacugcccacguuggucucuaccauucagcaggacgccgauugggacucgguuuuaucaagccaacagaggauggagagugagaauaacaaacuguguucccuauacucuuuucggaauacaagcacuuccccucauaagccagaugaaggaucacgcgaccgagagauaaugaccagugugacauucgguacccccgaacguagaaaaggcagccucgcagauguaguggacacucugaagcagaagaaacuugaggagaugacaaggaccgaacaggaggauucuuccugcauggaaaagcuguugucaaaagacuggaaggagaaaauggaacggcucaacacgagcgagcugcugggggagaucaagggaacuccugaaagucucgccgagaaggaacgccaauuaucuaccaugauuacacagcugaucucccuuagagagcaguugcuggcugcacacgaugaacagaaaaagcuagccgcuagccaaauugagaaacagaggcagcaaauggaccucgcccggcagcagcaggagcaaaucgcgcgccagcagcagcaacugcuucagcagcagcacaagauaaaucuguugcaacagcagauccagguccaaggccauaugccaccccucaugauuccuaucuuuccacacgaccagcgaacucuggcagccgcugccgcagcucagcaagguuucuuauuuccgcccgggauuaccuauaaaccuggagauaacuacccagugcaguucauccccucgacaauggccgcggccgcagcuucuggccuguccccucuccagcuucagcaacuguaugccgcucaguuggccucaaugcagguuaguccaggcgcaaagaugcccagcaccccgcagccucccaauacggccgggacuguguccccaacaggaauaaagaacgaaaagagagguaccucuccugucacucaagugaaggacgaggcugcggcacagccccuaaaucugagcucaaggccaaaaacagccgaacccguaaagaguccuaccuccccaacgcagaaccucuuuccggcuagcaaaaccucucccguuaaucugccuaacaagucaaguauuccaagccccaucggcgggucccuuggacggggcuccucgcuggguaaauggaaaagccagcaucaagaggaaacauacgaguuggauauucucuccucacugaauaguccugccuuauucggggaccaggauacugugaugaaggcaauccaggaggcccguaaaaugcgcgaacaaauccagagagagcagcagcaacagcagccacacggagucgacggcaagcugucuagcauuaacaauaugggccuaaacuccuguaggaacgaaaaagagcggacccgauuugagaaucucgggccccagcugacaggaaagucaaacgaagaugguaaacuuggcccgggggugauagacuugacucgcccugaggaugcugaaggaagcaaggccaugaauggcucugcagcgaagcugcaacaguauuacugcuggccaaccgguggggcuacaguggccgaggcaagagucuauagggacgcccggggccgcgcuuccagugaaccccacaucaaaagaccuaugaacgccuucaugguuugggcaaaggaugagaggcguaaaauucuccaggcuuuucccgacaugcauaauagcaacaucucuaagauacugggaucccgguggaaaucaaugaguaaucaggagaagcaaccauacuacgaggaacaggcccgacuuagcaagauucaccuggaaaaauauccuaacuacaaguauaaacccagaccaaagaggaccuguaucguggacggcaaaaaguugcgcaucggggaguacaaacagcucaugcggucgagaaggcaggaaaugcgccaauucuuuacuguaggacagcagccgcaaauuccuaucacgacagguaccggcguggucuaucccggggcgauuacuauggccaccacaaccccaucuccccagaugacuucugauugcagcucaacaagugcuuccccugagccaucucugcccgugauacagagcacguacggaaugaagaccgacggcgguuccuuagcagggaaugagaugaucaacggcgaagaugagauggaaauguaugacgauuacgaggacgauccuaagucagacuacagcagugaaaaugaggccccggaggcuguuucugccaacuga

SEQ ID NO: 63049 - RNA, 1167 nt, Artificial Sequence
  derived and/or modified sequence opt3 from SOX7__Homo_sapiens__NP_113627
auggccagccugcucggcgcuuaccccuggccugaggggcuugaaugcccagcacuggacgccgaguuguccgauggacagucuccgcccgcggugccuagaccacccggugacaagggcucagaaaguaggauccggcgcccuaugaacgcuuucauggucugggccaaagaugagcgaaagcguuuagcaguucaaaauccagaccugcacaacgccgaacuaagcaaaaugcucgggaaguccuggaaagcucugacccuuucucagaagagacccuauguggaugaggcagagaggcugcgguugcagcauaugcaggacuacccuaauuauaaguaccgcccaagaaggaaaaagcaagccaaacggcucuguaagcgcguagauccgggauuucugcugucgucacucagccgagaccagaacgcuuuacccgagaaaagaaguggcuccaggggugcccugggggaaaaggaagaucggggagaguauucuccuggcacagcgcuucccagcuugcguggcugcuaccacgaggggccagcaggagguggcgggggaggcacuccuuccucaguggacacguauccauacggucugcccaccccgccugaaaugaguccccuagauguccucgagccagaacagacauucuuuagcucuccuugucaggaggaacaugggcacccccgcaggauuccacaucugcccggacacccuuacuccccagaguaugccccgucaccccuucacugcagccauccucugggcaguuuggcucucggccaaucuccagggguguccaugaugagccccguuccuggauguccacccucgccggccuacuauucuccugcaacuuaccacccacugcauuccaauuuacaggcucaccugggucagcucucacccccucccgagcacccaggcuucgacgcccuugaucagcugagucaaguggaauugcuaggggacauggacagaaacgaguuugaucaguaucugaauaccccuggacaucccgacagcgcgacaggcgccauggcacucuccggucacgucccagugucucagguaaccccgacugggccuacagaaaccagccugauaucaguucuugcugaugccacggcuacuuacuauaacaguuacuccgugagcuga

SEQ ID NO: 63050 - RNA, 1341 nt, Artificial Sequence
  derived and/or modified sequence opt3 from SOX8__Homo_sapiens__NP_055402
augcuggacaugagcgaggccagaucccagcccccuugcucuccaucaggcaccgcuaguagcaugucccacguggaagauucugacucggaugcaccgcccucacccgccgggagcgagggacucgguagggcgggcgucgcuguugggggagcccggggcgacccagcagaagccgcugaugagcgcuuccccgcauguauccgagacgccgugagucaaguacuuaaggguuacgauuggucccuggugccuaugccaguccgugggggaggcggcggggcuuugaaagccaagccccaugugaaaagaccuaugaacgcguuuaugguuugggcacaggccgcuaggcggaaguuagccgaccaguauccacaucugcacaaugcagaacuaucuaaaacacucggaaagcuguggcgccuucugagcgaguccgagaagagaccguucguggaagaggcugaaagguugcggguccagcacaaaaaggaucaucccgacuacaaauaucaaccucgccgaagaaagucagccaaagcgggucacagugauagcgacucuggcgccgagcucgggccacaccccggaggcggugcaguguacaaggcugaggccgggcugggagauggccaucaccauggcgaccacacugggcagacgcacggaccuccaaccccuccgacaacuccuaagaccgaacugcagcaggcuggugccaaacccgagcucaaguuagaaggcaggcggccaguagacuccgggcgucaaaacauugauuuuucaaauguugacauaagcgagcugaguucugaagugaugggaacaauggaugcauucgacguccaugaguuugaucaguaucuuccuuugggcggucccgccccacccgagccugggcaggcuuacggcggagcguauuuccacgcaggcgccuccccagugugggcucauaaaagcgccccgucggcaucugccucccccaccgaaacugggccuccacgcccccacaucaagacagagcagccuucaccaggacauuacggugaccaacccagaggcaguccggauuacgggagcugcuccggacagucuagcgcuaccccugccgcaccagcgggccccuuugcugguucacagggggacuauggcgaucugcaagccaguuccuacuauggagcauacccuggcuaugcccccgggcuauaccaguauccauguuuccacagcccuaggcggcccuacgcuucuccacuccugaacggacuugcccugccgccugcacacucacccacgagucauugggaccagccaguguacacuaccuugacacgacccuga

SEQ ID NO: 63051 - RNA, 1530 nt, Artificial Sequence
  derived and/or modified sequence opt3 from SOX9__Homo_sapiens__NP_000337
augaaccugcucgaccccuucaugaagaugaccgaugagcaggaaaaaggccuuagcggggccccuuccccaacaaugucugaggacucagcuggaaguccgugccccagcgguuccggcucugauacugaaaauacgagaccucaagagaacaccuuuccaaagggggaacccgaccugaaaaaggagucggaggaagauaaauucccuguguguaucagggaggcagucucacagguuuugaagggauacgacuggacauuagugccaaugcccguacgggugaauggcagcaguaagaacaaaccucacgucaagcgcccaaugaaugccuuuauggugugggcgcaggcugcccgacguaaacuggcagaucaguauccgcaucuacacaacgccgaacucuccaagacucuggguaaacuuuggagacuguugaaugagucugagaagaggcccuucguugaagaggcugaacggcuccgcgugcaacauaagaaagaccacccugauuacaaguaucagccaagaaggcggaaaagcgucaagaacgggcaggcagaggccgaagaggcuaccgagcagacacauauuucccccaaugccauauuuaaagcgcugcaagcagacucaccucacaguagcucuggaauguccgaagugcacucaccaggcgagcauagcggccagagucaggggcccccgaccccucccacuacaccaaagaccgauguacagccuggaaaagccgaccugaagcgcgaaggucgaccccucccagagggcgggagacaacccccuaucgauuucagggacguugacauuggagaauuaucuuccgaugugaucagcaacauugagacguuugacgucaaugaguucgaucaguaccugccaccgaacggccaccccggugugccugcuacucauggacaggugaccuauacagggucguacggcaucucuuccacugccgcaaccccagcuucagccggccacgucuggaugaguaagcaacaggcgcccccuccacccccgcagcagccuccacaagccccucccgcaccccaggcuccaccucagccccaggccgcuccaccgcaacagccugccgcacccccacagcagccccaagcccacacacuuaccacguugagcuccgaaccugggcagucucagcggacucauauaaaaacagagcagcugagcccaucacacuauagugaacaacagcagcauagcccccaacagaucgcuuacuccccuuuuaaucuaccgcacuacucuccaucauaucccccuauuacccguagucaguacgacuauacugaucaucagaacagcuccucuuacuauucgcacgcggcaggacaagguacaggccucuacagcaccuucacguauaugaauccagcccagcgccccauguacaccccuaucgcugacacauccgggguuccgucaauuccccagacucacaguccacagcauugggagcaaccuguguacacccagcugacaagacccuga

SEQ ID NO: 63052 - RNA, 2658 nt, Artificial Sequence
  derived and/or modified sequence opt3 from SP100__Homo_sapiens__NP_001073860
auggccggcgggggaggugaccugagcaccagaaggcucaacgaguguaucucccccguggcuaaugaaaugaaccaccuuccugcacauucucacgaucugcagcggauguucacagaggaccaaggcgucgaugaccgcuuguuauacgauauuguuuuuaagcauuucaaacgaaauaagguggaaauaucaaacgccaucaaaaagacuuuuccauuccuggaggggcuacgugacagagaucucauuacgaauaaaauguuugaagacagucaggauagcuguaggaaccugguaccggugcagcgggucguguauaauguucuuuccgagcuggagaagaccuucaacuugcccgugcucgaagcgcuguuuucugacgucaauaugcaggaguacccugaucugauccacauuuauaagggauucgaaaacgugauccaugacaaacucccauuacaagagucggaggaagaggaacgcgaggaaagaucaggccugcagcuuagcuuggagcaggguacaggggagaauaguuuuaggucccugacuuggcccccuucuggaagcccaucccacgcuggcaccacacccccugaaaacggccuaucagagcacccaugcgaaaccgagcagauaaaugccaagcggaaagauacuacaagugacaaggacgauagccucgggucucaacagaccaacgaacagugugcacagaaagccgagccgacggaguccugcgaacaaaucgcuguacagguuaauaacggagacgcaggucgcgagaugcccuguccucugccaugcgaugaagagucacccgaagccgagcuucauaaccacggcauucagaucaauagcuguagugugcgacuggucgacauuaagaaggagaaaccuuucucuaacuccaagguggaaugccaagcucaggccagaacucaucacaaucaggcgagcgauaucauagugauuucgucugaggacuccgaagggucaaccgaugucgacgagccauuggagguuuuuaucagugcacccaggagcgaaccggugauuaacaaugauaacccucucgaguccaaugacgaaaaagagggacaggaagccacauguucucggccccaaaucguaccagagccuauggauuuccguaagcugagcacuuuucgcgagucauucaaaaagagagugaucggccaggaccacgacuucagugaauccagcgaggaagaggcucccgccgaagcaucuucaggugcuuuaaggaguaaacauggggagaaggccccaaugaccagccgguccacaucuaccuggcgcauucccucgcgaaagagaagguuuagcuccucagauuucagugaccugucuaacggagaggaacuccaggagacgugcagcuccucacuucggcgcggcagcggcucucagccucaagaaccagagaauaaaaaguguuccugcgucaugugcuuuccgaaaggggugcccagaagucaggaagcgaggacugagagcucucaggccuccgauaugauggacacaauggauguugagaacaauucaacccuggaaaagcacaguggaaaacgucggaagaagcgaagacauaggagcaaagugaacgguuugcagcgcggccggaagaaagacagaccuaggaagcaccuaacucugaauaacaaaguccaaaagaagcgcuggcagcagcgagggcggaaagcaaauacacguccacucaagagaaggcgcaaacggggacccagaauaccuaaggaugagaacaucaacuucaaacagucggaacugccagugaccuguggcgagguaaaggguacgcuuuacaaggagagguuuaaacaagggaccuccaagaaaugcauucagucugaagacaagaaaugguucacaccccgagaguuugaaaucgagggcgaucgcggagcuagcaagaauuggaaacugucaauacgguguggcggguauacuuugaagguucucauggaaaacaaguuccugccggagccuccaaguaccagaaagaaaaggauuuuagagucccauaauaacacacugguggaccccugcccugaaaauucuaacaucugugaggucugcaauaaauggggacgucuauuuuguugcgauacuuguccccgcagcuuccacgaacacugccauaucccauccguggaggccaacaagaauccuuggucauguaucuuuugccggauuaaaaccauucaggaaagaugccccgagagccaaaguggucaccaggagucugaaguccucaugaggcagaugcugccagaggaacagcuuaagugugaguucuugcugcucaagguguacugcgacuccaaaagcugcuuuuucgcuucggaaccguauuacaaccgagagggcucacaagggccucagaagcccauguggcugaauaaaguuaagacaucucuuaacgagcagauguacacccggguggaaggauucguacaggauaugcgccugauauuucauaaucacaaagaguucuauagagaagacaaguuuacuagguugggcauccaaguccaggacauuuucgagaagaacuuucggaauaucuucgccauccaggagacgaguaaaaacauuauaauguuuaucuga

SEQ ID NO: 63053 - RNA, 1668 nt, Artificial Sequence
  derived and/or modified sequence opt3 from SP110__Homo_sapiens__NP_001171944
augggcagaggguucaggauguuuaccaugacacgggccauggaggaagcucuguuccagcacuuuaugcaucaaaagcucggaaucgcauacgccauucacaaacccuucccauuuuucgagggucuucuggacaacagcauaaucacuaagcgcauguauauggaauccuuggaggcgugccgaaauuuaauuccugugucucgugucguucauaacauccugacgcagcuagaaagaaccuuuaaucucucacugcuugugacacuguucagucagauuaacuugagggaguacccgaaucucguaacuaucuaucggagcuuuaaacgcgugggcgcuuccuacgaguggcagucuagagauacccccauacugcuggaagccccuacagggcucgcagagggaucgucauuacacaccccacuggcccuucccccuccacaacccccucagccaagcuguaguccgugcgcucccagggucuccgaaccuggcacuucuagccagcaguccgacgagaucuugucagagaguccaagccccucugauccugugcugccacuacccgcacucauucaagaaggucgguccacaucaguuaccaacgacaagcugacgagcaaaaugaaugccgaggaagauagugaggaaaugccgucucuucugacuuccaccgugcaggucgcuagcgacaacuugaucccucagauucgcgauaaggaggacccccaggagaugccacauucgccucucgggucuaugcccgaaauccgagauaauuccccagagcccaacgacccugaggaaccacaagaagugucaaguacaccgagcgauaagaaaggaaagaaaagaaagagguguauaugguccacucccaaacggcgucacaagaagaaaucucugccuggcggcaccgccagcucacgccacgggauucagaagaaauuaaagagaguagaccagguuccacagaaaaaggaugacaguacaugcaauuccaccguggagacgagggcgcagaaagcacggacugagugugcccgaaagagccgcucugaagagaucauugacggaacaucagaaaugaacgaggguaagagaagucagaaaacccccagcacuccuaggcgggucacacagggcgcugccuccccagggcauggaauccaagaaaagcugcaagugguggauaaagucacccagcgcaaggacgauucuacguggaacucggagguuaugaugagagugcagaaagcaaggaccaagugcgcucguaagagccggcucaaagagaagaaaaaggaaaaagacaucuguuccucaaguaagcgaagauuccaaaagaauauucacaggcgcggcaaacccaagucugauacaguagacuuucauugcagcaaacuuccggugacuuguggugaggccaaggggauacuguauaaaaagaagaugaaacacggauccucagucaagugcauccggaaugaagauggcaccugguugacaccuaacgaguucgagguggaaggcaaagggagaaacgcgaagaauuggaaaaggaacauucgcugugagggaaugacucuaggugaacugcucaagagcggccugcuucugugcccaccccgaaucaauuugaaacgggagcucaacucuaaguga

SEQ ID NO: 63054 - RNA, 519 nt, Artificial Sequence
  derived and/or modified sequence opt3 from SP140__Homo_sapiens__NP_001005176
auggcccagcaaggccagcaggggcagauggcuagcggagacuccaaccugaauuucagaaugguggcagagauccaaaacgucgaaggucagaaucuccaggagcagguuugccccgaaccuauuuuuagguucuuucgggagaacaagguggaaauagccucugcgaucacccgcccauucccguuucuuaugggccugcgagaucguucauucauuagugagcaaauguacgagcacuuucaggaggcuuucagaaauuugguacccgugacaagggucauguauuguguguuaagcgaacuggagaaaacuuuuggguggucccaucuagaagcccucuucucucggaucaaccugauggcauacccugaccuuaaugagauuuaucgcucguuucagaacgaaaaucugucaagcagugccguuuugugccagcucguguccccaaacaaggauuggagaucucacgaggaaagccuggcucauacgggaacccugaggcgguccuguauguga

SEQ ID NO: 63055 - RNA, 2358 nt, Artificial Sequence
  derived and/or modified sequence opt3 from SP1__Homo_sapiens__NP_612482
augagcgaccaggaucacuccauggacgagaugaccgccguggucaagaucgaaaaaggcguugggggaaacaaugguggcaacgggaauggaggcggugcuuucucucaagcaagaucaaguagcacaggguccucuucgucaacuggaggcggcgggcaggagagccagcccaguccucuggcccuccuugcggcuacgugcuccaggauugaaucuccaaacgagaauagcaacaauucccagggaccgucacaaagugguggcaccggggaacuggauuugacagccacucaguuaagccagggagcaaacggcuggcagauaaucucuuccucaagcggugccacccccacaaguaaggagcaaucuggguccagcaccaauggaucgaacggcucugaguccagcaaaaaucggacugugaguggcgggcaguacguaguggcugcagccccuaaccugcagaaucagcaaguccuaacaggacucccaggugugaugcccaacauucaguaucagguuaucccucaauuucagaccguggacggccagcagcugcaauucgcugccacgggggcgcagguccagcaggauggaagcggccaaauucagaucauaccaggugcaaaucagcagaucauuacuaaccgcggguccggcggaaacaucauugccgcuaugcccaaucuucugcaacaggccgugccuuugcagggccucgcaaacaauguacugucugggcagacccaauacguuacaaacgugccagucgcucugaauggaaacaucacucucuuaccggugaauagcgugucagccgcgacccugacacccaguucccaggccgucaccauaucaucuucagguagucaggaaagcggcucccaaccuguuacgucugggacuacaauuucgagcgcaucccuugugucaagucaggcuucuagcuccucauuuuucaccaacgccaauagcuauucuacuacaaccacgaccuccaacaugggaaucaugaauuuuacaaccaguggcagcucugguacuaacucccaggggcagacaccacaacgaguaucaggcuugcagggaagugacgcucugaauauucagcagaaccaaacuagcggcgggucgcuacaggccggacagcagaaggagggugaacaaaaucagcagacccaacagcagcagauccucauccaaccccagcuggugcagggcgggcaggcacuucaagcccugcaggcugcgccuuuguccggacagacauucaccacucaggcaauuucucaagagacgcuccagaaccugcaguuacaggccgucccaaacagcggccccauaaucauucguacaccgaccguggguccuaaugggcaaguuucauggcagacucugcagcuccaaaaccuucaggugcagaauccccaggcucaaaccaucacacuggccccaaugcagggcgucaguuugggacagaccuccucuagcaacacuacacuaacgccuauagcauccgccgcuucaauucccgccggcaccgugacuguaaaugcagcgcagcugagcaguaugccagggcuccaaacaaucaaccugucugcucuuggaaccuccggcauccagguucaucccauucagggucugccuuuggccaucgcaaaugccccaggggaucacggagcucagcucggccugcauggugccggcggggacggcauucacgaugacacagcaggaggggaggaaggagagaacagcccggaugcucaaccccaggccggcagaaggacucggcgcgaagcguguaccugcccuuacuguaaagacucggaggguagagggucaggagauccaggcaagaagaaacagcauauaugccacauccaagguuguggcaagguguaugggaaaacgucucacuuaagggcccaucugcgguggcacaccggagaacgccccuuuaugugcacauggaguuacuguggcaagcgauucacuagauccgacgagcuacagaggcauaaacggacccacacaggggagaagaaguuugcuugcccugaauguccaaaacguuucaugcgcagcgaccaccucucuaagcauauuaaaacucaccagaauaagaaaggaggccccggugucgcacugagcguggggacccuuccguuggauuccggagccggcucagaggguaguggcacggcuacaccuagcgcccugaucaccacuaacauggucgcaauggaagcgaucugcccagaggggauugccagacucgcuaauucuggaauaaacgugaugcagguugccgaccugcaauccaucaauauuucaggcaacggguuuuga

SEQ ID NO: 63056 - RNA, 1842 nt, Artificial Sequence
  derived and/or modified sequence opt3 from SP2__Homo_sapiens__NP_003101
augagcgacccccaaaccuccauggccgcuacagcagccgugucuccuucagauuaccugcaaccagcggcuaguacuacgcaggacagccagccgucuccccucgcccuucuggcagcuaccugcuccaagaucggcccuccagccgucgaggcagccguuacacccccugcuccaccccagccuacuccaagaaaauuggugccgauuaagcccgccccuuuaccacugucgcccgggaaaaacucauucggaauacuaagcaguaaggguaauauccuccaaauucagggcucccagcugucugcgagcuauccugggggacagcuuguauuugcaauccaaaacccaaccaugauuaauaaaggcacaagguccaacgccaauauccaguaccaggcugugccccagauacaagccucaaacagucagaccauccagguccaaccgaaucugacuaaccagauucagaucauuccugguacaaaucaggcaaucauaacccccagcccaucuucccacaagccugugcccauuaagccagcucccauccaaaaaucaagcacgacuaccacaccuguucagaguggggccaacguggucaaguugacuggaggcggcgggaaugugacccucacacugccaguaaacaaucugguuaacgcgucugauaccggagccccgacgcagcucuuaacugaauccccucccacaccacugagcaaaaccaauaagaaagcacggaagaagucgcuucccgcuucucagccuccaguggccgucgcugagcaaguggaaacuguguugauugagacaaccgccgacaacaucauccaggcagguaacaaucugcuaauuguccagucccccggcgggggacagccggccguugugcaacagguacagguggucccuccaaaagcugaacagcaacaggugguucagauaccccaacaggcgcuccgcgugguccaggcagccucagcuacgcugccuaccgugccccagaagccaagucaaaacuuccagauccaggccgcagagccuacacccacucagguauauauucgaaccccaagcggcgagguucaaacagugcuuguccaggauuccccgccugccacugcugccgcaaccucuaauacaaccuguagcucacccgcgagucgugcuccacaucuguccgguacuagcaaaaagcacucugccgcaaucuugagaaaagaaaggccccucccuaagauagccccagcugggucaauuaucagucugaacgccgcacaguuagcugccgcggcccaggcuaugcaaacgaucaauauuaacggagugcagguccagggcgugcccguuacaaucaccaauacuggcgggcaacagcagcugaccgugcagaacguaagcggaaauaaccucacaauuuccggucuuucuccuacccaaauacagcugcagauggagcaggcauuggccggcgaaacucaaccgggggagaaacggcgcagaauggcuugcacauguccaaauugcaaggacggagagaagaggucgggcgaacaggguaaaaagaaacaugucugucacauccccgauugcgggaagacguuucggaaaaccagccuacugcgcgcccaugugcgacuccacacuggcgagagaccuuucguuuguaacugguuuuucugcggaaagagguuuacacgguccgacgaacugcagcgucacgcacgcacccauacaggcgauaagagauucgagugugcgcagugccagaaaagguuuaugcggucagaccaccuuacuaagcauuacaaaacccaccuggugacgaagaauuuguga

SEQ ID NO: 63057 - RNA, 2142 nt, Artificial Sequence
  derived and/or modified sequence opt3 from SP3__Homo_sapiens__NP_001017371
auggggcccccuagcccaggcgacgaugaggaagaggccgcugcagccgcgggagcuccggccgcagccggugcuaccggcgaccuggcauccgcccagcucgggggagcucccaacagaugggaagugcuuucugccacaccuacuacgaucaaggaugaggcgggcaaucugguccaaauuccaucagcagccaccaguagcggucaguacguuuugcccuuacagaaccugcagaaucaacagauauucuccguggcuccugggucugacucgucaaacggaacaguaagcagugugcaguaucaggucaucccacaaauucaguccgccgauggccaacaggugcagaucggcuuuacugggucuagcgacaauggagguauuaaccaggaauccucacagauccaaauaauccccggcaguaaucagacccuacucgcaagcgggacaccuucugcuaacauucagaaucugaucccacagaccggacaaguucaggugcagggcgucgccauugguggguccucauucccgggacagacucaagugguagcgaacguuccccuuggccugccuggcaauaucacauuugugccaauaaacagcgucgauuuggacagucucgggcugucuggauccagccagaccaugacggccgguauuaaugcagauggccaccugaucaacacugggcaggcuauggacucgucugauaauuccgagaggaccggagagcgggugucacccgacauuaacgaaacaaacacugauaccgaccucuucgugccuacaaguagcuccucucaguuaccagucaccaucgacagcacgggcauccugcaacagaauacuaacucacuuacaaccaguuccggucagguucauagcucugauuugcaggggaauuacauucaaucacccgugagugaggaaacucaggcccagaacauacaaguaagcacagcucagccggugguccagcaucugcagcuacaagagucccagcagccuaccucucaggcccaaaucgugcagggcauuacgccccagaccauccacggaguucaggcaucgggccaaaauauaagccagcaggcccuccaaaaccugcagcuucagcugaauccagggacauuuuugauucaggcucaaacugugaccccuuccggacaggucacauggcagacuuuccaggugcaagguguacagaaccuccagaaucugcagauccaaaacaccgcggcacagcagaucacauuaacccccguucagacucugacgcucggccaaguggccgcugggggagccuuuacaucaaccccagucagucuuucuacuggccagcugcccaauuugcagaccgugacagucaacagcauugacuccgcagguauccaacuacacccuggggagaaugccgauucaccagcugacauucgcauaaaagaagaggaaccggaucccgaggaauggcagcugagcggcgacucuacccucaacacuaaugaucugacacaucuucgagugcagguuguggacgaggagggagaucagcaacaccaggaaggcaagcgucugagaaggguagccugcacguguccuaacugcaaagaagggggaggucggggcaccaacuuggggaagaaaaagcagcacaucugucauauuccaggaugcggcaaggucuaugguaaaacuucccaccuccgcgcacaucugagauggcacaguggggaaaggcccuucguguguaauuggauguacugcggcaagcgguuuacacgcagcgacgaguuacagcgacacagaaggacccauacaggagagaaaaaguucguuuguccugagugcucuaaacgguuuaugcguuccgaucaccuggcgaagcauaucaagacucaccaaaacaaaaagggcauccauucaaguagcaccgugcuagcuucggucgaggccgcacgcgacgacacgcucauuaccgccgggggaacaacucugauacuugcuaauauccagcagggcuccgugucugguauugggaccguaaacacaagcgccacuucaaaucaggauaucuugaccaacacggaaauuccacugcaacucgugacaguuaguggaaaugagaccauggaauga

SEQ ID NO: 63058 - RNA, 2355 nt, Artificial Sequence
  derived and/or modified sequence opt3 from SP4__Homo_sapiens__NP_003103
augagcgaccagaagaaagaggaagaggaagaggccgcugcagccgcggcuauggccaccgaaggcgggaagacauccgagcccgagaacaauaacaaaaagccuaaaacuucuggaucacaagauagucagccaagcccgcuggcacuccuugccgcuacgugcuccaagaucgguacccccggcgaaaaucaggcaacagggcagcaacagauuauaaucgacccuucucagggacuggugcaguugcaaaaccagccacagcaguuagagcuggucacuacccaacuagccggcaaugcuuggcagcucguugccucgacacccccugcgucaaaggaaaacaaugugagccagccagcaaguuccucuagcuccucaaguagcucuaacaaugguuccgccucacccaccaaaacuaagagcgggaacaguucuacaccuggacaauuccagguaauucaggugcagaauccauccggcagcguccaauaccaggugaucccgcagcugcagaccguugagggccaacagauucagaucaaccccacgucgucuuccucacuucaggaucugcaagggcagauacaguugaucagugcuggaaauaaccaggccauucucacugcagcuaauagaaccgccagcgguaacauccuggcgcaaaaccuggccaaucagacagugccuguccagauuaggccaggcguguccaucccccuccaauuacagacucugccugggacccaggcacagguaguuacaacccuuccaauaaacauuggaggcgugacguuggcucugcccgucaucaauaacguggccgcuggugggggaacuggccaagugggccagccggccgcaacagccgacucugggaccagcaauggaaaccagcuagucucaacuccuacaaauaccacgaccagugcuuccacaaugcccgagagcccaucuucaaguacuaccuguacaacuaccgcgagcacaucccucaccucuucggauacucugguuagcuccgcagacacgggucaguaugccucaacaagugcuucuagcuccgaacggaccauugaggaaucacaaacuccugccgcaaccgagagcgaagcccagucuuccagucagcuucagcccaacggcaugcaaaaugcucaggaucagagcaacucucugcaacaggugcagaucguagggcagccaaucuugcaacagauucagauacagcaaccccagcagcagaucauucaagccaucccuccacaguccuuucagcuccagucaggacaaacaauacagaccauucagcaacagccgcugcagaaugugcaguuacaagcagucaaccccacucaggugcugauccgcgcgccuacacucacgccaaguggccagaucagcuggcagaccguucaagugcagaauauucagucgcuuuccaaccugcagguccaaaaugcugguuugucucagcagcuaacuaucacacccgugagcucaagugggggcaccacacuggcccaaauugcaccuguagccguugcuggagccccaauaacucucaacaccgcacagcuggcuuccgugcccaaccuucagacggucucuguggccaaucugggcgcggccgggguccaggugcaaggaguuccggugaccaucacaagcguagcuggucagcagcagggccaagacggggucaaagugcagcaggcaacuauugccccuguuaccguggcugucggaggcaucgccaacgcaacaaucggugcgguguccccagaucaguugacucaaguacaccuccagcaggggcagcaaaccucagaccaggaggugcagcccggcaagcgacugcguagaguugccugcagcuguccuaauugcagggagggagaaggccgggggaguaacgagcccggaaagaagaagcaacauauuugucacauagaagguugcggcaaagucuacgggaagacgucucauuuacgcgcucaccugagauggcauacaggagagaggccauucaucuguaauuggauguuuugcggcaaacgguucacccgcuccgaugaacuacagcgacacagaaggacucacacaggugagaagcgguuugaguguccugaaugcagcaaacguuucaugcgcucggaccaucucucaaagcacgugaaaacccaucagaacaagaaagggggcggaacugcccuggcaauugugaccucuggcgagcuugauaguuccgucacagaaguuuuggggagccccagaaucgugacgguggcugccauuucucaggacagcaauccagcaaccccgaacguauccacuaauauggaggaauuuuga

SEQ ID NO: 63059 - RNA, 1197 nt, Artificial Sequence
  derived and/or modified sequence opt3 from SP5__Homo_sapiens__NP_001003845
auggccgcuguggcaguccugagaaacgacagccuccaggccuuccuucaagauaggacccccuccgcgucuccugaccugggcaagcacucaccauuggcuuuacuggccgcaacaugcagucggaucgggcagccgggagccgcugcacccccugauuuucuacagguuccauacgaccccgcccucgguagcccuucccgccuguuccauccauggacugcugauaugcccgcccacucuccuggcgcgcuuccaccgccccauccuucgcugggguugacgccacagaaaacccaccuccaacccucauuuggagcagcccaugagcugccucugacaccacccgcugacccgagcuauccuuacgaguucagucccgugaagaugcucccauccucuauggccgcauuaccugcuagcugugcccccgcguauguaccauacgccgcacaggcugcccugcccccuggcuauuccaaucuuuugccaccgcccccuccacccccuccacccccgacuugccgacagcugucaccuaacccagcucccgaugaccuaccuugguggaguauuccccaggccggugcagggccaggagccagcggcgugccuggcucugggcucuccggagcuugugcgggugcaccccacgccccacguuuuccggcuucagccgcagccgcugccgcagcggcugccgcacugcaaagaggccuuguccuggggccuagcgauuucgcccaguaccagagucagauagcugccuugcuccaaaccaaagcaccccuggcugccacagcgaggcggugccgcagauguaggugcccaaauugucaggccgcuggaggcgcacccgaagccgaaccugguaagaaaaagcagcacgugugccauguuccaggguguggaaagguguauggcaaaaccucucacuuaaaggcucaucugcgguggcacacuggcgagcgccccuuugucugcaacuggcuuuucugugggaaauccuuuacacgaagcgacgaacuccaaagacaccugaggacccauacgggagagaagcgguucgccugcccugagugcgguaaacguuuuaugcgcucggaucacuuggcaaagcaugugaagacucaccagaauaaaaagcuaaaaguagcggaagccggcguuaagagagaggacgcuagggaucuguga

SEQ ID NO: 63060 - RNA, 1131 nt, Artificial Sequence
  derived and/or modified sequence opt3 from SP6__Homo_sapiens__NP_954871
augcugaccgccgugugcggcagccucgggucccagcacacagaggcuccccaugcaucuccuccaagacuugaccugcaaccguugcagacuuaccagggacacacgucacccgaagccggugauuauccuaguccauuacagcccggcgagcugcaaagccuaccucucgggccagaagucgacuucucccagggauacgagcugcccggcgcgucuucgaggguuaccugugaagaucuugagucagacagcccucuggcuccagguccguuuaguaaguugcuccagcccgauaugucccaucacuaugagucuugguuccggccuacacauccaggggccgaagacggaagcuggugggaucugcaccccggcacuuccuggauggaccugccucacacccagggcgcacucacaucaccagggcaucccggagccuuacaagcuggucugggcggguacgugggagaucaccagcuuugcgcaccgccuccccauccacacgcccaccauuugcugccugcugccggcggucagcaccuacucgggcccccagacggagcgaaagcacuggagguagccgcucccgaaagucagggccuugauagcucucuggacggcgccgcacgcccuaaggggucccgacguucagugccaagaagcaguggacaaaccgucuguaggugcccgaacuguuuggaggcugagcggcucggugcccccugcggcccugaugggggcaaaaagaaacaucugcacaauugucauaucccaggaugcgguaaggcguaugccaagacuucucacuuaaaagcacaccuccgcuggcauuccggggacagacccuuuguguguaacuggcuguucugcggcaagagguuuacacggagcgacgaacuucagcgccaucugcagacccacacgggaacuaaaaaguucccuugugcuguuugcucgcgaguguuuaugagaucugaucacuuggccaaacacaugaagacccaugagggcgcuaaggaagaggccgcaggggccgcuuccggagaagguaaagcgggcggggcagucgagccacccggaggcaaggguaaaagggaggccgaagggucaguggcuccgaguaauuga

SEQ ID NO: 63061 - RNA, 1296 nt, Artificial Sequence
  derived and/or modified sequence opt3 from SP7__Homo_sapiens__NP_690599
auggccagcucccugcucgaggaagaggugcacuacgggucuucaccccuugcuaugcugaccgcagccugcaguaaguucgggggaagcuccccuuugagagacucuacaacuuuagguaaagcgggcacgaagaaaccauauucggucgggucagaucugagcgcuaguaagaccaugggagacgccuacccggcacccuuuacauccacuaacggccuacucucuccugccgguagcccacccgcuccuaccuccggguaugcaaaugauuacccacccuucucacauaguuuuccuggaccaacaggcacccaggacccgggccugcuuguucccaaagggcacucaucuuccgauugucugccuucaguguauacuagcuuggacaugacacauccauacggaaguugguauaaggccgguauccacgcuggcauuucucccgggccuggaaacaccccaacgcccuggugggauaugcauccgggcgguaauuggcucgggggaggccaaggccagggggacggacugcaggguacucugccuaccggccccgcccagccaccucucaacccccaauuaccaacauaccccuccgauuucgcgccucugaauccagcaccguaccccgccccucaccuuuugcagccagggccccagcacguacugccucaggacguguauaagccaaaagcugucggaaacagcggccaacuagaagguucgggcggcgccaagcccccgaggggagcaucuacuggcggguccggagguuacggcgggucaggagcuggccggaguagcugcgauuguccuaauugccaggagcucgaacgccugggugccgcggccgcagggcuucguaaaaagccaauacauuccugucacauccccggcugcggaaaaguguauggcaaggcuucucaucugaaggcccacuugcgauggcacaccggggagagaccuuuuguuuguaacuggcuguucugcggaaaaagguuuacacggagcgacgagcucgaacgccaugugagaacccacacgagggagaagaaauucacuuguuuacugugcucaaagcgguuuacacgcagugaucaucucuccaaacaccagcgaacccauggugaacccggcccagggccucccccaagcggaccgaaggagcuuggcgaggguagaucuacuggggaagaggaagcuagccagacaccuaggcccagugccagcccagcaacccccgagaaagccccuggcggauccccagaacaaucuaaucuguuggagauuuga

SEQ ID NO: 63062 - RNA, 1527 nt, Artificial Sequence
  derived and/or modified sequence opt3 from SP8__Homo_sapiens__NP_874359
auggccaccagccugcucggcgaggaacccagacuuggguccacaccucuggcuauguuggcagccacuugcaacaagaucggaucuccaucaccgagucccagcuccuuaucugacucgucaagcaguuucgguaaaggcuuucacccuuggaagagguccucuagcuccucaagugcgagcuguaauguggucgggucuucccuguccagcuucggaguuaguggcgcuucucggaacgguggguccagcucggccgcagccgcugcagccgcugccgcggcagccgcugccgcucuagugucugauuccuuuucaugcggaggcaguccaggcagcuccgcauucucucucacgagcucaagugccgcggccgcagcugccgcugccgcagccgcugcguccagcucucccuuugcaaaugacuacucaguauuccaggccccuggggugaguggagguagcggcgggggaggcggugggggaggcggcggguccucugcucauucgcaagauggaagccaccagccagucuuuauuuccaaagugcauaccucaguugacggucugcagggcauauauccccgcguggggauggcccacccuuacgagaguugguucaagccaucucauccgggacuuggcgcagccggugaagucgggagcgcuggcgccuccucauggugggaugugggagcaggcuggaucgacguacagaaccccaauagcgcggcugcccugccugggucuuugcacccagcagccggaggucuccaaacaucccugcacaguccccugggcggguauaacagcgauuacucuggacucucccauucagcuuuuaguagcggcgccucgucccacuuacugucuccugcaggucagcaucuuauggacggguucaaaccaguuuugcccggcagcuauccggauucagcuccuaguccccuggccggagcgggcggguccaugcuaucugccggaccaagcgcuccucucgguggcucaccccgaucaagcgcacguagauacagugggagggccacuugugacugcccaaauugucaggaggcugaacggcugggacccgccggcgcaucucuucgcagaaagggucugcacuccugccacauuccuggguguggcaagguguauggaaaaaccagccauuugaaggcgcaccucagguggcauacaggcgagcggccauuugucugcaacuggcuguucugugggaaacgcuuuacccgaucggaugaguuacagagacaccugaggacucauacaggagaaaagcgguucgccugcccgguguguaauaaacguuucaugcgcucagaccaccucucuaagcacgugaagacccauaguggcggugggggaggcgguggcuccgcugggagcggaucuggcgggaaaaagggaagcgauacggacuccgagcacucagccgcaggcagucccccuugccauagcccagaacuucugcaacccccugagccaggucacagaaacggguuggaguga

SEQ ID NO: 63063 - RNA, 456 nt, Artificial Sequence
  derived and/or modified sequence opt3 from SPA17__Homo_sapiens__XP_011541172
augagcauccccuucuccaacacccacuacaggauuccucagggcuuugggaaucugcucgagggacuuacaagagaaauacugcgggagcaaccagacaacaucccggccuucgcugcagccuauuuugaaucuuuguuagagaagcgcgagaaaacuaauuucgaucccgcggagugggguucaaagguggaggaccgauuuuacaacaaucaugcuuucgaagaacaggaaccuccagagaaaagugaucccaagcaggaggaaagccagauuuccggcaaagaggaagagacgucugucaccauccuggacucgucagaagaggauaaggagaaggaagagguugccgcagugaaaauucaagccgcuuuucgugggcacaucgcaagagaagaggccaagaaaaugaagacaaacagccuacagaaugaagagaaagaggaaaacaaguga

SEQ ID NO: 63064 - RNA, 885 nt, Artificial Sequence
  derived and/or modified sequence opt3 from SPACA1__Homo_sapiens__NP_112222
augagccccagaggcaccgggugcuccgccggacugcucaugacaguggguuggcuucuguuggcuggcuuacagucugcaagggggacuaacgucacggccgcgguucaagacgcuggacuggcccacgagggcgaaggugaggaagagaccgaaaauaacgauucagagacagcagagaauuacgccccuccagaaacugaggacgugaguaaccggaauguagugaaggaagucgaguucgggauguguaccgugacaugcggaaucggcguucgcgaggugauucuaaccaacggcugucccgggggagaaagcaaaugcgucgugcgaguagaggaaugucgugguccgacugauugcggcugggggaagccuauauccgagucucucgaaucgguuagacuggcuuguauccauacaucaccacuuaauagguuuaaauauauguggaagcuguugcggcaggaccagcagagcauuauccucgugaacgauagugcaauucuggagguccgcaaagagucccacccccuggccuucgaaugcgacacccucgauaauaacgagaucguggcuacgauaaaguuuacuguguacaccucuagcgaauuacaaaugagaagguccucacugccugccacagacgcggcacuuaucuucgucuugacuauuggaguuaucauuuguguguuuaucauauuccugcuaauuuuuaucauuaucaauugggccgcuguaaaggccuucuggggcgcaaaagcuaguaccccagaggugcagagcgaacagucuuccguccgguauaaggauucaacaagccucgaccagcugcccaccgagaugccuggugaggaugacgcccuuagugaauggaacgaguga

SEQ ID NO: 63065 - RNA, 648 nt, Artificial Sequence
  derived and/or modified sequence opt3 from SPACA3__Homo_sapiens__NP_776246
auggugagcgcccugagaggcgcuccccucaucaggguccacuccucuccuguuucaaguccaagcguguccgggccgcggcgccuuguaucuugccugucgucacagagcagugcauugucccaaucuggagguggcagcaccuccgccgcggggauugaggcucgaucacgugccuuaagaaggcgguggugucccgcaggaauaaugcugcuagcccucgugugccugcuuaguugucuguugccuagcucugaagcuaagcucuacggccgcugcgagcuggcaagaguccugcaugacuucggucucgauggguauaggggauacuccuuagccgacugggugugucuggcuuauuuuacaucaggcuucaacgccgcggcacuugauuacgaagccgacggcagcacuaauaacgggaucuuucagauuaauagucggcgcuggugcucuaacuugacgccaaauguucccaacgugugucgaauguauugcuccgaucugcuaaauccuaaccucaaagacaccgucaucugugcuaugaagauuacacaggagccacagggacuggguuacugggaagccuggagacaccauugccaaggcaaagaucuuacugaguggguggacgggugugauuucuga

SEQ ID NO: 63066 - RNA, 327 nt, Artificial Sequence
  derived and/or modified sequence opt3 from SPAG11A__Homo_sapiens__NP_001075021
augagacagaggcugcuccccagcgugaccucccuucuguuggucgccuuacuguucccugggucuucacaagcucggcacguuaaccauagugcaacagaggcccuaggcgaacuccgcgagcgagcgccaggacaggguacuaauggcuuucagcugcuucgucacgcugugaagagagaccuguugccgcccaggacgccuccauaccagggggauguaccccucggaauccggaacaccauuugccgcaugcaacagggcauauguagacuguucuuuugccauagcgguacagggcagcagcacaggcaacgguguggauga

SEQ ID NO: 63067 - RNA, 312 nt, Artificial Sequence
  derived and/or modified sequence opt3 from SPAG11B__Homo_sapiens__NP_057596
augagacagaggcugcuccccagcgugaccucccuucuguuggucgccuuacuguucccugggucuucacaagcucggcacguuaaccauagugcaacagaggcccuaggcgaacuccgcgagcgagcgccaggacaggguacuaauggcuuucagcugcuucgucacgcugugaagagagaccuguugccgcccaggacgccuccauaccagguacauaucagccaccgggaagcccgcgggcccuccuucagaauuugcguggauuuucucggaccuaggugggcacggggcuguucuaccgguaacuga

SEQ ID NO: 63068 - RNA, 552 nt, Artificial Sequence
  derived and/or modified sequence opt3 from SPAG16__Homo_sapiens__NP_001020607
auggccgcucagagaggcaugcccagcuccgcagugaggguccuggaggaagcccucgggaugggacuuaccgcggcuggugacgcccgggauacagcagacgccguugcugcagagggcgccuacuaucuggaacaagugacuaucacggaggcuucugaagaugacuacgaguaugaggaaauuccugaugacaacuucucaauaccagagggggaagaggauuuggccaaggcgauccagauggcacaggagcaggccaccgacacagaaauuuuagagcgcaaaacuguacugccgaguaagcacgcugugcccgaagucaucgaggauuuucuaugcaauuuccucauuaaaaugggaaugacccgaacacuggacuguuuucaaagcgaaugguacgagcuuauccagaagggcgugaccgagcugcguacuguugguaacgugccugaugucuauacacagauaauguugcucgaaaaugagaacaaaaaucugaagaaggaccugaaacauuacaagcaggccgcagaauaugugaucuucuga

SEQ ID NO: 63069 - RNA, 2781 nt, Artificial Sequence
  derived and/or modified sequence opt3 from SPAG1__Homo_sapiens__NP_757367
augaccacaaaggacuaccccagccuguggggcuucgggacuacgaaaaccuuuaagaucccuauugagcaccucgauuucaaauauauagaaaagugcuccgacgugaaacaucuugagaagauccugugugucuugagaucuggagaagaggguuacuauccagaauuaacagaguuuugcgagaagcaucugcaggcccuagcuccggaaucaagggcacuccggaaagauaagcccgccgcgacugcugccaguuucaccgcagaggaaugggagaaaauugacggcgauaucaagagcuggguuuccgagauuaaaaaggaagaggacaagaugcacuuucacgaaacagagaccuucccugccaugaaagauaaccugccacccgugcgcgggucuaauucgugucuucauguaggaaaggaaaaauacucaaagcgaccuacuaaaaagaaaacaccacgugacuaugcugagugggauaaguuugacguggagaaggaaugccugaaaaucgaugaggacuacaaggagaaaaccgucauagauaagagccacuugaguaaaaucgagacgagaauugacacugcaggccucaccgaaaaggagaaggacuuccuggccacaagggagaaagaaaaggguaacgaggcuuuuaauuccggggauuaugaagaggccgugauguacuacacucggucuaucagcgcgcugcccaccguuguggcauauaacaaucgcgcccaagcugaaauuaaacuccagaacuggaacuccgccuuccaggacugugagaaggucuuagagcuggaaccuggaaaugugaaagcacuuuugagaagggcuacaaccuacaagcaccagaauaagcugcgggaggccacggaagaucuaucaaaaguacucgacguugagccagauaacgaccuggcgaagaaaacucuuagugagguggaacgcgaucugaagaauagcgaggccgcaucugaaacacaaaccaaaggcaagcgaauggucauccaggagauagaaaacuccgaggacgaggaaggcaagucagggagaaaacaugaggauggagguggcgacaagaaaccggcugaacccgccggggcugccagggcagcccagccuugcgugaugggaaauauucagaagaaauugacuggcaaggcugagggugggaaacggccagcgcguggagcaccccaacgcggccagacaccugaagccggcgcugauaagagaagcccaaggcgggccagugcagccgcugccgcagggggaggugcgaccggccaccccgggggaggccagggugcugagaacccggccgggcucaagucucagggcaaugagcuguuucgauccggacaauucgcagaagccgcuggcaaauauagcgccgcaaucgcuuuacuggagccugccgggucggaaauugcggacgaccucucuauccuuuacuccaaccgcgccgcuuguuaucugaaggagggaaacugcucagguuguauccaggauugcaauagagcauuggaacuacaucccuuuaguaugaaaccacugcucaggcgggccauggcuuacgagacgcuggagcaguauggcaaggccuacguggacuacaaaaccguccuucaaauugauugugggcugcaguuggcaaacgacagcguuaaucgccucuccagaauacugauggaauuagauggaccuaacuggagggagaagcugucucccaucccagcggugcccgccagcguaccucuacaggcuuggcacccagccaaggaaaugauuucaaaacaggcaggcgacaguuccagccaccgucaacaggguaucacagaugagaagacuuucaaagcucucaaggaggaagggaaucagugcgugaacgacaaaaauuauaaggaugcccugucuaaguacucagagugccuuaaaauaaacaauaaggaaugugcaauuuauaccaaccgggccuugugcuaccugaaacucugucaguucgaggaagcuaagcaagacugcgaucaggcgcugcagcuugccgacggcaaugucaaagcauuuuauagacgagcucuggcccauaagggauugaagaacuaccagaaaagucucaucgaucugaauaaggugaucuuacuggacccgagcauuaucgaggccaaaauggagcuagaagagguuacaaggcuccugaaccuuaaggacaaaacugcucccuucaauaaggaaaaagagcgccggaagauugaaauacaagaggugaacgagggcaaggaagaaccugggagaccagcaggagaagucuccauggguuguuuggccucugagaaaggcgggaagucgagcaggucccccgaagauccugagaaacugccaaucgcgaagcccaacaaugcuuaugaguuuggacagauuaucaacgcccucucaacccgcaaagacaaggaagcaugcgcccaccuguuagcuaucacagcaccgaaggaucugccuauguuccuuaguaauaaauuggagggcgacaccuuucuccugcuaauucagucucugaagaacaaucucauagaaaaagauccaagccugguguaccagcaucuuuuguaccuguccaaggccgagcgauucaaaaugauguuaacucucaucucaaagggucaaaaggagcugauugaacagcuuuuugaggaccugagcgauacgcccaacaaucacuucacauuggaagacauccaggcgcucaaacggcaauaugagcuguga

SEQ ID NO: 63070 - RNA, 1314 nt, Artificial Sequence
  derived and/or modified sequence opt3 from SPAG4__Homo_sapiens__NP_003107
augagaaggagcucccggcccggcucugccucaaguagccgcaagcacaccccuaacuucuuuuccgaaaauucuucgaugucaaucacaagcgaggacaguaaagggcugcgauccgcugagccaggaccgggugaacccgagggccguagagcaagggggccuucuugcggagaaccagcccucagcgcgggcgugcccggugggacuacgugggcuggauccucacagcaaaagccugccccacggagucauaacuggcagaccgcauguggcgccgcuacaguccgcggcggggcaagcgagcccacuggaucuccuguuguguccgaggaaccacuugaucuguugccgaccuuagaccugagacaggagaugcccccuccaaggguauucaaaucauuucuaagccuccuguuccagggucuuagugugcuguugucucucgccggcgauguccugguguccauguaccgggaaguuugcagcauucgcuuucuguucacagcugugucgcucuuaucucuguuucuuuccgccuucugguuggggcugcuauaucucgucucaccccuggagaaugagccuaaggaaaugcuuacccugagugaguaccacgaacgagugagaagccaaggacagcaguugcagcaacuccaggcggagcuggacaaauuacauaaggaaguauccacuguuagggcagccaacucugagcggguggcuaagcuggucuuucagcgucucaaugaggauuucgugcgcaaaccagacuaugcccuuagcucagugggcgcaaguauagaucugcagaagacaucccacgacuacgcugauagaaacaccgccuauuuuuggaauagguucagcuuuuggaacuacgcgcggcccccgacggucaucuuggaaccucauguuuuccccgguaauuguugggccuucgagggggaccaaggacaggugguaauucagcuaccaggccgagugcaacugucugauaucacucuccagcacccucccccaucagucgaacacaccggcggggcaaacagugcuccccgcgacuuugccguguucggacugcagguuuaugaugagacagaagugagccuugguaaauuuacuuucgacgucgagaaguccgagauucagaccuuucaucugcaaaaugacccuccagcugccuucccgaaagugaagauccagauauugucuaacuggggccaccccagauuuacaugccucuacaggguacgggcacaugggguucgcaccucggaaggagccgagggcagcgcucaggguccucacuga

SEQ ID NO: 63071 - RNA, 3582 nt, Artificial Sequence
  derived and/or modified sequence opt3 from SPAG5__Homo_sapiens__NP_006452
auguggagagugaagaaacugagccucucccuuucucccucaccucagaccggcaagccaaguaugaggacaccgcugcgggaauugacuuuacaacccggggcccugacgaacagcggaaaacgcuccccugcuuguucuucgcuaaccccaucacucugcaagcugggucuucaggaaggcagcaauaacaguucccccgucgacuucguuaauaacaaacgaacagaucugucuagcgagcacuuuucccauucaaguaagugguuggaaacuugccagcacgagagcgacgaacagccucucgauccaaucccccaaauuucuuccaccccuaagacaucagaggaggcaguggacccacuggggaauuacaugguaaaaaccauagugcuggucccgagcccccucggacagcagcaggauaugaucuucgaagcccguuuagacacuauggcggagacaaacaguauuucucugaauggcccucuuagaaccgaugacuuggugagggaagagguugcuccauguaugggugaucgguuuuccgagguggccgcagucagcgaaaagcccaucuuccaagagucgccuucucaucugcuagaagaguccccacccaacccgugcucagaacagcuccacuguaguaaagagagccuguccucucgcacggaggccgugagagaagaccuuguaccuagcgagucaaaugcuuuucugcccaguuccguuuuguggcucagcccaucuacugcacuggccgcugauuucagggugaaccaugucgacccugaagaggaaauuguggagcacggggccauggaggaacgggagaugcgcuuucccacccacccaaaggaaucagagacagaagaucaggcguuagugaguagcgucgaggacauccuguccacuugccucacccccaaucuuguugagauggaaucucaggaggcaccuggaccagccguggaagacguaggccgaauacugggcucggauacagagagcuggauguccccguuggcuuggcuagagaaaggggugaacaccucagucaugcuggaaaaucucagacaaagucugucucuucccagcaugcugagggacgccgcaaucggaacgacuccuuucuccacauguucaguggguaccugguuuacuccaagcgcuccccaggagaagucuacaaacaccucccagacgggcuugguugggaccaagcauaguacaagcgaaacugagcaacuccugugcggacggccuccagauuuaaccgcccugucucgucacgaccuagaagauaaucuccuguccucacuugugauuuuggagguccugagucgccagcucagagacuggaaaagccagcuggcggugccccauccggagacacaggauucguccacucaaaccgacacaucucacagcggcaucaccaacaaguugcagcaccugaaagaaucacaugagaugggucaggccuugcagcaagcaaggaacguaaugcagaguuggguucucauuuccaaggaacugaucucuuuacugcaccuaagccuccugcaucuugaggaagauaaaacuacggugucccaggagucacggcgagcugagacauuggucuguugcuguuucgaccugcucaagaaacugcgcgccaaguuacagagccugaaggcugaaagagaggaagccaggcaccgggaggaaauggcacuucgcgggaaagaugccgcugagauaguguuggaggcguuuugcgcacaugccagucaaagaauuucucagcucgaacaggaccuggcuuccaugagggaguuccguggacuacugaaggacgcccagacccaacucgucggccugcacgcaaaacaggaggaacuugugcagcaaacuguuagcuugaccucgacacugcagcaggauuggcggucaaugcaguuagacuauaccacuuggacagcccuccugucucgaaguagacaacuuacggagaagcugaccgugaaaucccagcaggcuuugcaggaaagggauguagccaucgaggaaaagcaagaggucagccgcgugcucgaacagguuucugcacagcuggaggagugcaagggccagacugaacaacuagagcuggaaaauagccggcucgcgacagaccugagagcucagcuucagauuuuggccaacauggauucccaacugaaagaguuacagucacagcacacccauugugcacaggaccucgccaugaaggaugaacugcuuugccaacugacacagaguaaugaggagcaggcugcccaguggcaaaaagaagagauggcacuaaagcacaugcaggcugaacuccagcagcaacaggccgugcuggcgaaagaggucagggacuugaaggaaacucuggaguuugccgaucaggagaaccagguggcucauuuagaacucgggcaaguagagugucagcugaagaccacgcuugaagugcugcgcgagcgaagccuucagugcgagaaucucaaagacaccguugaaaaccugacagcaaagcuagccucuacuaucgcugauaaucaagagcaggaccuggaaaagacccggcaguacucccagaaacuuggacuccugacagagcaauugcagucacugacuuuauuccuccagaccaaacugaaggaaaagacggagcaggagacacuucuguugaguaccgccuguccuccaacucaagaacacccccucccuaacgaucguacauuccuggguagcauccuaaccgcagucgcggacgaggaacccgaguccacuccagugccucugcuuggcucugacaaaucggccuuuaccagaguggcuagcauggucucacuccagcccgccgaaacaccagggauggaggagucccuggcagaaaugaguauuaugacgaccgaguugcagucuuuaugcagccugcuccaggaauccaaggaggaagcuauaaggacucugcaacgcaaaaucugugagcuucaggcccggcugcaggcacaagaggaacagcaccaggagguucagaaggccaaagaagcugauauugagaaguugaaucaagcgcuaugccugagauauaaaaacgagaaggaacuccaggaggugauccagcagcaaaaugaaaagauacuggagcagauugacaaaucaggagaacuuaucucuuuaagggaggaggugacacaucugacccgaagccuccgccgggccgaaacagagacuaagguauugcaggaagcacuggcuggccagcucgauaguaacugucaaccgauggccaccaauuggauccaggagaaagucuggcugucccaggaaguggacaaacuuagaguuauguuccuggagaugaagaacgagaaggaaaaguugaugauuaaauuucagagccacaggaauauccuagaggaaaaccugcgucgcucugauaaggagcucgaaaaauuagacgauauugugcaacauauauacaagacgcugcuuucaaucccugaggucgugcgggguugcaaagagcugcaggggcucuuggaguuccuguccuga

SEQ ID NO: 63072 - RNA, 1455 nt, Artificial Sequence
  derived and/or modified sequence opt3 from SPAG6__Homo_sapiens__NP_001240783
augcacagccugaccauggaccucuggauccccaacggccaggccggggugaugucccuucugagaacauuguuacuggaugucguuccuacuauucaacagacggcugcacuagcccucggaaggcuggcgaauuacaacgacgaucuugcugaggccgugguaaagugcgacauacugccacaguugguguauucucucgcagaacagaaucgguucuacaaaaaggccgcugcauuuguccugcgcgccguggguaaacauucaccgcaacuggcucaggccaucguugauuguggcgcgcucgacaccuuagugauuugccuggaggauuucgaccccggggucaaggaagcagccgcuugggcccuucgauauaucgcacgucacaacgcugaguugagucaggccgugguagaugcgggagccguuccucugcuagugcucuguauucaggaaccagagaucgcacugaaaagaauagcugccagcgcucuuuccgacaucgccaagcauucucccgagcuggcacaaacagucguggaugccggcgcuguggcgcacuuggcacagaugauucucaauccugacgccaagcugaaacaucagaucuuaucggcucugucacaggucagcaagcacaguguugaucucgccgaaauggugguagaggcagaaauuuuuccagugguccuuacuugccugaaagacaaggacgaguacgugaaaaagaacgccuccaccuugaucagggagauagcuaagcacacacccgaacuaucucaacugguugugaaugccgguggggucgcagcggugauugauuguaucggaagcugcaaaggcaacacccggcucccuggcauuaugaugcugggguauguagcugcccauuccgagaaucuugcaauggccguuaucaucucaaagggagugccacagcugagugucuguuugagcgaggaaccggaagaccacauuaaagcugccgcagcuugggcccucggucagauaggccgccauacucccgagcacgcgagagccguggcugucacaaacacccugccuguguuacugucucuauacauguccacggagucaagcgaagaucuccaaguuaagaguaaaaaggcaaucaaaaauauucugcagaagugcacuuaucuuccagccuuggagcccuuccuguacgacgcuccuccaaacauccucaagcacgugguagggcaguuuucuaaaguccugccccaugauuccaaggccaggcggcuuuucgugaccagcggaggccugaaaaagguucaggaaauaaaagcagagccggguucguugcuccaagaauacauuaauucuaucaacuccuguuauccugaggagaucgugcgcuacuauucacccggguacagugacacacuguuacagcgagucgauagcuaucagccacugaauaacuga

SEQ ID NO: 63073 - RNA, 684 nt, Artificial Sequence
  derived and/or modified sequence opt3 from SPAG7__Homo_sapiens__NP_004881
auggccgaccugcucggcagcauccuuuccucuauggagaagcccccuucacugggggaucaggaaaccagaaggaaagcucgggagcaagcagcccgcuugaagaaauuacaggaacaggagaagcagcaaaaaguggaguuccgaaagcguauggaaaaggaggucagugacuuuauucaggauagcggacagaucaaaaagaaauuccagccaaugaacaagauagaaagauccauucugcacgacguuguggagguagcgggucuaacaucuuuuucguucggcgaagaugacgauugcagguacgugaugaucuuuaaaaaggaguucgcuccgucagacgaggaacucgauagcuaucggcgcggggaggaaugggacccccaaaaggccgaggagaaaagaaagcugaaagaacuugcacagaggcaggaggaagaggccgcucagcaaggaccugucgugguuaguccagcauccgauuacaaggacaaauauucucaucugauuggcaagggugccgcuaaagaugccgcgcacauguugcaggcaaauaagacuuacgggugugugcccgucgccaacaagcgggacacgcgcagcaucgaagaggcuaugaaugaaauacgagccaaaaagagacucaggcaguccggagaggagcugccuccaaccucauga

SEQ ID NO: 63074 - RNA, 1458 nt, Artificial Sequence
  derived and/or modified sequence opt3 from SPAG8__Homo_sapiens__NP_001034681
auggagaccaacgaaagcacagagggcuccagaucuaggucacggagucuggacauccagcccagcuccgaagggcucggaccuacuucugagccauucccgucgucagaugacagcccccgcagugcccuugcugcagccacggcggcugccgcagccgcugcauccgccgcugccgcgaccgcagccuuuacaacugcuaaggccgcagcucugucuaccaaaacacccgccccaugcagcgaauuuauggagcccuccucagauccuaguuuguuaggugagccaugugcgggccccggguuuacccacaauauugcccauggaagccugggcuucgaaccuguguacgucucuugcauagcacaagacacuuguacaaccacggaucacuccucaaacccagguccgguucccgggagcaguucuggaccugugcuaggcuccagcucgggcgcugggcauggaucugguuccggcucagggccaggaugcggcaguguacccgguagcggguccggaccuggcccaggcucugggcccggaagcgguccgggccacgggucaggaagucauccuggccccgccuccgguccagggccugacacuggccccgauagcgagcucucuccauguaucccuccuggauuucgaaaucugguggcugaccgugucccaaacuauaccucauggagucagcacugcccgugggaaccccagaagcagccuccaugggaguuccuucaagugcuggagcccggcgccagaggguuguggaaaccuccagauauuaagggaaaacucaugguuuguuacgaaacacugcccaggggucagugccugcucuauaauugggaggaggaacgggcaacuaaccacuuagaccaggugccgagcaugcaggauggcuccgaaucuuucuucuuucgccaugggcacagaggacugcuuaccaugcaauugaagucgccuaugccaagcuccacaacccagaaggacucauaccagcccccuggcaaugucuauuggccccugagggguaaacgggaggccaugcuagagaugcuccugcagcaucaaaucuguaaggaagugcaggcugagcaggaaccaacgcgcaaacuuuucgagguagaaaguguuacucaccacgauuaccgaauggagcuggcgcaagcagggaccccugcccccacaaagccacaugacuauagacaggagcagccggaaacuuuuuggauucagagggcuccucaauugcccggcgugucuaacauccggacacucgacaccccauuccguaaaaauugcagcuuuuccacgcccgucccucugucauuaggaaagcugcucccauacgagcccgaaaacuacccuuaucagcuuggcgagauaagcucucugccguguccagggggacgcuuggguggcgggggaggcagaaugacccccuucuga

SEQ ID NO: 63075 - RNA, 3936 nt, Artificial Sequence
  derived and/or modified sequence opt3 from SPAG9__Homo_sapiens__NP_001123999
auggagcuggaagacggcguggucuaccaggaggaacccgggggaagcggugccguuauguccgagagagugucuggccucgcugggucaaucuauagggaguucgagcggcuuauuggacgcuacgaugaggaaguagugaaggagcugaugccuuuggucguggcaguuuuagaaaaccuggacaguguguuugcccaggaucaggagcaccaggucgagcuagaacuccugcgagacgauaaugagcagcuuauaacccaauaugaacgugagaaagcgcugagaaagcaugcugaagagaaauucaucgaguuugaagacagccaggagcaggaaaagaaagauuugcagacaaggguggagucccucgaaucucaaacucggcagcuggagcugaaggccaagaacuacgcagaccagauuucgcgccucgaggaaagagaggccgaacugaaaaaggaguauaaugcuuuacaccagaggcauacggaaaugauccacaacuacauggagcaucuugagcggaccaaauugcaccaacugucaggcagcgaucagcuagaaaguacagcacacucccgcauucgaaaggagagaccaaucucucucgguauauucccgcugcccgccggggacggacuucugacuccugaugcucagaaaggcggcgaaaccccagggagcgagcaauggaaguuucaggaguugucccagcccaggucacauacaagucucaaggacgaacugagcgauguaucucagggagguuccaaagccaccacuccugcgucaacagcaaauagcgacguugccaccaucccaacggacacucccuuaaaggaggaaaacgagggcuucgugaaagucaccgaugcuccuaauaagagugaaauuucuaaacacaucgaggugcaaguggcccaggagacacggaacgucuccacugggagcgcagaaaaugaggaaaagucggagguucaggcuauuaucgaaucuaccccagagcuggacauggauaaagaccucuccggauauaagggcucaaguacaccgaccaaggguauagagaacaaagccuuugaucguaauacggaaagccuuuucgaggaacuguccucugcggggagcggauugauuggcgacguggaugagggcgccgaccuacuggggaugggacgcgaaguagagaaccucauccuggagaauacucagcuucuggaaacaaagaacgcauugaauauugugaaaaacgaucucaucgcuaaggucgacgagcugaccugcgaaaaagauguguuacaaggugagcuggaggccguuaagcaggcuaagcuaaaacucgaagagaagaacagagaacuggaggaagaacuuaggaaagcccgggcagaggccgaagacgcucgacagaaggcgaaagacgaugacgauucagacauccccacugcacagcgcaagagauuuacaaggguggagauggcccgggucuugauggaacgcaaucaauacaaggagagacugauggaacuccaggaggcugugagguggaccgagaugauucgugccagucgggaaaacccugcaaugcaggagaaaaagcgauccagcauauggcaguucguaccaacgagauuuucuaggcuguucucaaguagcuccaauaccacuaaaaagcccgaaccuccaguuaaccuuaaauacaaugcccccacaucucaugugaccccgucggucaagaagcgcagcuccacacugucacaauugccuggcgauaaaaguaaggcuuuugacuuccucucugaggaaacugaggccagccuggcaucccggagagagcagaaaagggaacaguaucgccaagugaaggcgcacguccagaaagaggaugggcgagugcaggcuuucggauggucauuaccccagaaguacaaacaaguuaccaacggccagggugaaaauaagaugaagaaccugccagugccuguauaucuacggccccucgacgagaaagauacaagcaugaagcuguggugugccgucggggugaaucuuucuggcggaaaaacccgugacggcggguccguugugggagcaagugucuuuuacaaggauguggccgguuuggacacugagggcagcaaacagagaucugcuucccagucaagucuggauaagcucgaccaagaacugaaggagcagcagaaagaauuaaagaaccaggaggaacugagcucgcuuguauggaucugcacguccacacacucugccaccaaaguguugauuaucgacgcaguucaaccagggaauauacucgauagcuucacugucuguaacucacaugugcugugcauugcuagugugcccggagccagggagaccgacuauccugcgggcgaggaucuauccgaaucuggucaggucgacaaggccagccuguguggguccaugacaucaaauagcagugcugagaccgauucucuccugggcggaaucacuguugugggcugcuccgcagaaggggugacaggagccgcuacgagcccaucgaccaacggugccucaccgguaauggacaaacccccugagauggaagcagagaauagcgaggucgaugaaaacgugccaacugcggaggaagccacagaggcuaccgaaggcaacgccgggagugcagaggacacaguugauaucucccagacuggaguguacaccgagcacgucuuuacggacccccuuggcgugcaaauuccugaagauuugagcccaguuuaucagucuagcaaugacuccgaugcuuacaaggaccagaucucagugcugcccaacgagcaggacuuaguacgcgaagaggcccaaaagaugaguagccuccugccgaccauguggcuuggugcacagaaugggugucuguacguccauucuuccguggcccaguggcggaaaugcuugcacucaauuaagcucaaagauaguauacugagcaucgugcaugucaagggcauuguucuaguggcucuggcggacggaacacucgccaucuuccacagaggcguagaugggcagugggaccuguccaacuaucaccuuuuggaucugggaaggccucaucacucuauccgauguaugacugugguccaugacaaaguguggugcggcuaccgcaauaagauuuauguugugcaaccaaaggcaaugaaaauagagaagucguuugaugcucacccccggaaagaaagccaggucagacaguuagccugggugggugacgggguuugggugucaaucaggcucgauuccacccugcgucuuuaccacgcccauacauaucagcaucugcaagacgucgauauugagccuuacguaaguaagaugcuaggaacuggcaaacucgguuucucuuuugugcgcaucaccgcucugaugguuagcuguaaccgguugugggugggcacggggaauggagucauuaucuccauaccccugacagaaaccaacaagacuucaggcgugccagggaauagaccuggaucuguaaucaggguguauggcgacgagaacagcgacaaagucacacccgguaccuucauuccauacugcaguauggcacacgcccaguuaugcuuucacgggcaucgagaugcgguuaaguucuuuguggcugugccgggacaggucaucuccccucagucuucuucauccggcacugaccucaccggugauaaggccggccccagugcacaagaaccagggagccagacaccccugaaaucgaugcuugugauuucuggaggcgagggguacaucgacuuccggaugggagaugagggcggugaauccgagcuguugggggaagaccucccucuggagccaagcguuacgaaggccgaacgcucacaccuaauaguauggcaagugauguauggaaaugaguga

SEQ ID NO: 63076 - RNA, 1536 nt, Artificial Sequence
  derived and/or modified sequence opt3 from SPAM1__Homo_sapiens__XP_011514825
augggcgugcugaaguucaaacacaucuuuuucaggagcuuugucaaguccucugggguuucacagauuguguucaccuuucuccuuauacccugcugucugacauugaacuucagagccccuccaguaaucccgaaugugcccuuuuuaugggcuuggaacgcaccuagugaguucugccugggaaaauuugacgaaccacuagauaugagccucuucuccuuuauugguucuccccggaucaaugccacuggccaaggggucacgauuuucuacguggaccgccugggauauuacccuuauaucgauucgauaaccggcguuacagugaacggugggaucccacagaagauuucacuucaggaccaucuggauaaagcgaagaaggacaucacuuuuuacaugcccgucgauaauuugggaauggcugugauugacugggaggaauggcgaccuaccugggcccguaacuggaaaccaaaggauguauauaaaaauagaagcaucgagcucguucagcaacagaacgugcagcugagucugacagaagcaaccgagaaggccaaacaggaguucgaaaaggcuggcaaggacuuccucgucgagacuauaaaauuaggcaagcugcuuaggccgaaucacuuguggggguacuaucuguuucccgauuguuacaaccaucacuacaaaaagccuggauauaaugguuccugcuucaacguggaaauuaaacggaaugacgaucuaucuuggcucuggaacgagagcacagcacuguacccauccaucuaucuuaauacccaacagucacccguggccgcuacgcuguacguccgcaacagaguuagggaggccauucgggugaguaagaucccugacgcgaaaagcccauugcccguauuugcauauacucgcaucguguucaccgaccagguccucaaguuucugucucaggaugaauuaguguacacauucggcgagacuguugcccugggggcuuccggaauugugauauggggcacccucucaaucaugcgaagcaugaagaguugucuucuguuggacaacuauauggaaacaauucuaaauccguacaucauaaacgucacccuggccgcaaaaaugugcucucaagugcucugucaggagcaggguguaugcauuagaaagaauuggaacuccagcgauuaccugcaucuuaauccugacaacuuugcuauccaacuggaaaaagggggaaaguucacgguuaggggcaaacccacuuuggaggaucucgagcaguuuucggaaaaguucuauuguucuugcuacuccacacugucauguaaggagaaagccgacgugaaggauaccgacgcggucgaugugugcaucgccgacggcgucugcauugaugcauuuuuaaaaccaccuauggaaacugaggaaccccagaucuucuauaaugcuaguccaagcacacuguccgccaccauguuuauuuggcggcuagaggugugggaccaggggauaucucguaucggauucuucuga

SEQ ID NO: 63077 - RNA, 294 nt, Artificial Sequence
  derived and/or modified sequence opt3 from SPANXA2__Homo_sapiens__NP_663695
auggacaagcagagcuccgccggcggggugaaaagaucuguccccugcgauucaaacgaggcuaaugaaaugaugccugagaccccaacaggagacagugauccgcaacccgcaccuaagaaaaugaagacuagcgaauccucuacgauccugguugugagguaccggcgcaacuucaaacgaaccucgccagaggaacuccuuaaugaccacgcccgugagaacagaauuaauccccugcagauggaggaagaggaauuuauggagauaaugguagagaucccugcgaaguga

SEQ ID NO: 63078 - RNA, 312 nt, Artificial Sequence
  derived and/or modified sequence opt3 from SPANXB1__Homo_sapiens__NP_115850
augggccagcaaagcuccgugagaaggcugaagcggucuguccccugcgagucaaacgaagccaaugaggcuaacgaagcaaauaaaaccaugccugagacaccaacuggggacagugauccgcagcccgccccuaagaaaaugaagacgagcgaauccucuaccauccucguugugcgcuaccgacguaacguaaaaagaacaucgccagaggagcuucugaaugaccacgcgagggaaaaccggauuaaucccgaucagauggaggaagaggaguucauagaaaucacuaccgagcgcccuaagaaguga

SEQ ID NO: 63079 - RNA, 294 nt, Artificial Sequence
  derived and/or modified sequence opt3 from SPANXD__Homo_sapiens__NP_115793
auggacaagcagagcuccgccggcggggugaaaagaucuguccccugcgauucaaacgaggcuaaugaaaugaugccugagaccaguagcggauacuccgacccacaaccggcacccaagaaacugaagacaucugaaucgucaacuauccucguugugagguaucggcgcaacuucaaacgaacgagcccugaggaacuuguaaaugaucacgcccguaagaacagaauuaauccacugcagauggaggaggaagaguuuauggaaauaaugguggagauccccgcgaaguga

SEQ ID NO: 63080 - RNA, 300 nt, Artificial Sequence
  derived and/or modified sequence opt3 from SPANXN4__Homo_sapiens__NP_001009613
auggaggaacccaccagcuccacaaacgagaauaagaugaaaucuccuugcgaaucaaacaagagaaaaguggacaagaaaaagaagaaucugcacagggccagugcuccagagcagagccucaaagaaacugagaaggcaaaauacccgacgcuugucuucuauugucggaagaacaaaaagcgcaauuccaaccaacuggagaauaaccagcccaccgaaucuucgacagauccuaucaaggagaaaggcgacuuggauauuucagccgggagcccacaggacggaggucagaauuga

SEQ ID NO: 63081 - RNA, 912 nt, Artificial Sequence
  derived and/or modified sequence opt3 from SPARC__Homo_sapiens__NP_003109
augagagccuggaucuucuuucugcucugccuugcuggcagggcacuggccgcgccccagcaagaggcuuugccugacgaaaccgagguggucgaagagacaguugccgaagugacugagguaagcgugggggcaaacccaguccagguggagguuggagaauuugaugacggugccgaggaaacggaggaggaaguggucgcugagaauccgugucagaaccaccauugcaagcacggcaaagugugugaauuagaugagaauaacacccccaugugcguaugucaggacccuacauccugcccagcacccauuggggaauuugagaagguuuguucuaaugauaacaaaacuuucgacucaaguugccauuucuucgccaccaaguguacacuggagggaaccaaaaagggccacaagcuacaucucgauuacauagguccuugcaaauauaucccacccugucuggacagcgaacuuacugaguuuccucugcggaugcgcgauugguugaagaaugugcucgucacacuguacgaacgagacgaggauaacaaucugcucaccgaaaaacaaaaguuacgugugaaaaagauucacgagaacgagaagagacuggaagcuggggaccacccaguggagcuuuuggccagggauuucgagaaaaauuauaacauguacaucuuuccgguccauuggcaguucggacagcuggaccagcaccccauugacggcuaucuaucccauacggaacucgcgccucugcgggcaccacuuauccccauggaacacugcacuacccgcuuuuucgagacaugcgaucuggacaaugauaaguacauagccuuggacgagugggcuggcuguuuugggaucaaacaaaaggauauugacaaagaucucguuaucuga

SEQ ID NO: 63082 - RNA, 1995 nt, Artificial Sequence
  derived and/or modified sequence opt3 from SPARCL1__Homo_sapiens__NP_001121782
augaagaccggccuguucuuucucugccuucuggggacagccgcugcaauccccacuaacgccagauuguuaagcgaccacuccaaaccuacggcggagaccguggcuccagauaauacagccauuccgucucugagggcagaagccgaggaaaacgagaaggaaacugcugucucaaccgaggacgauagucaucacaaagcagaaaagagcuccguucuaaaaucuaaggaagagucgcaugaacagucagccgagcaaggaaagagcaguucccaggagcucggucugaaagaccaggaagauucugacggccaccuuagcgugaaucuggaguacgcucccacagaagggaccuuggauauaaaggaggacauguccgaaccucaggagaaaaagcucucagagaacacugauuuccuggccccaggaguaaguagcuuuacagacucuaaucaacaggaauccaucaccaaacgggaggaaaaccaggagcagccccgcaauuauucacaucaccaacugaaccgaagcaguaagcacucucagggccuccgugaucaggguaaucaggaacaagacccuaacauuuccaauggggaggaggaagaggaaaaggagccaggagaagugggcacgcauaacgauaaucaggagagaaaaacugaguuacccagggaacacgcgaacagcaagcaggaggaagacaauacccaaucggacgauauccuggaggagucugaccagccuacacaggucuccaaaaugcaggaagaugaguucgaccaaggcaaccaggaacaggaggauaacucaaaugcagaaauggaggaggaaaacgccaguaaugugaacaagcauauucaggagacugaauggcaaagccaggaggggaaaaccggacuugaagcuaucuccaaucacaaggagacagaggagaaaaccguuucugaggccuugcugauggaaccaacggacgaugguaacacuacaccgcggaaucacggcguggacgaugacggggaugacgacggagaugacggcgguaccgaugggccccgccauagcgcaucagacgauuacuuuauaccuagucaggcuuuccuagaggccgaaagagcgcaguccaucgccuaucaccucaagauugaggagcaaagggaaaagguccaugagaacgaaaauaucggaacuacagagccaggcgagcaccaggaagcuaaaaaggcagagaacagcucuaaugaagaggaaaccucaagugagggcaacaugcgggugcaugccguagacagcuguauguccuuucagugcaaacgcgggcacauuuguaaggcugaucagcaaggaaaaccccacugcguuugucaggacccugugacgugcccacccaccaagccgcuggaucaggucugugguacagacaaucaaacuuacgccucuucgugccaucuuuucgcaaccaagugucgacuggagggcacuaaaaaggggcaccaguugcagcucgauuauuuuggagccugcaaaagcaucccuacauguaccgacuucgaagugauacaguuuccccugagaaugagggauugguuaaagaacauucugaugcaacucuacgaggcuaauuccgaacaugcgggcuaucuuaacgagaaacagcggaacaaggugaagaaaaucuaccuggacgaaaagcguuugcuagccggugaccacccaauugaucugcuccugcgcgacuucaaaaagaauuaccacauguaugucuacccuguucauuggcaguuuucagagcuugaucagcaccccauggacagagugcugacacauagugaguuggcaccacucagggcuucucugguacccauggaacacugcaucacccgguucuucgaggaaugcgauccuaacaaagacaagcauaucacuuuaaaggagugggggcacuguuuuggcauuaaagaagaggauauagacgagaaucugcuauucuga

SEQ ID NO: 63083 - RNA, 1851 nt, Artificial Sequence
  derived and/or modified sequence opt3 from SPAST__Homo_sapiens__NP_055761
augaacagccccggcgggagaggaaagaaaaaggguuccggcggggccucuaauccugugccaccgaggcccccuccacccugccuggcuccugcaccacccgccgcgggaccugcuccaccgcccgagucaccucacaaacggaaccucuacuauuucaguuacccacuuuuugucggcuucgcccuguugcgcuuaguugcauuucaucugggucuacucuucguguggcugugucagcgauuuagccgugcccuuauggcugcaaagagauccucuggggccgcucccgccccugcgucggcaucagccccagcucccguaccgggaggcgaagccgagagggugcgggucuuccacaaacaagcauuugaauauaucagcauugcucugcgcauagacgaggaugaaaaggccggccagaaggagcaggcgguggagugguacaaaaaggggaucgaagaguuggaaaaaggaauugccguuaucgugaccggucagggcgagcaaugcgagagagcaaggcggcuccaggcuaagaugaugacaaaucuggucauggccaaagaccgccugcagcucuuagaaaagaugcagccugugcugcccuucaguaagucccaaacugauguauauaacgacucuacgaaucuugcuugucgaaacgggcauuugcagagcgaguccggagccguuccaaaaagaaaggauccucugacccacacaucaaauagucuacccaggagcaaaacugugaugaagaccggcucugcaggucucuccgggcaucaccgggccccaucauacagcggacugaguauggucucuggcgugaaacagggcuccgggcccgcuccuacaacccacaagggaacuccaaaaacaaaccguaccaauaagccgagcacgcccacuaccgcgacacgcaagaaaaaggaccuuaaaaacuuuagaaauguggauucgaaccuggcaaauuugauuaugaacgaaaucgucgacaaugguacugccguuaaguucgaugacauagcuggccaggaucucgccaaacaagcacugcaggagaucgugauuuuaccuucucugaggccagaacucuuuaccgggcuucgggcccccgcucgaggacuguugcuauucggcccuccagguaacgggaagacaaugcuggccaaggcaguagcggcugaguccaacgccaccuuuuucaauaucucagcagccagucucacgagcaaauaugugggcgagggagaaaagcugguccgcgcucuuuucgccguggcaagagagcugcagcccuccauuaucuuuauagacgaaguugauucuuugcucugcgagaggcgggaaggcgagcaugacgcuagccgcagacugaaaacugaguucuuaauugaauuugacggggugcaaucagccggagaugacaggguccuggugaugggugcgacaaaccguccgcaggagcuagaugaagccguacuccggcgauucaucaagagaguuuacgugagucugccuaaugaggaaaccaggcuuuugcugcucaaaaaccugcuuuguaagcagggcuccccacugacucagaaggaguuggcucaacucgcacgcaugacagacggguacagcggaucugaucugaccgccuuagcuaaagacgccgcacugggccccauucgggagcuaaagccugaacaggucaaaaauaugucagcgagugagaugagaaacaucaggcucagcgauuuuacggaaucccugaagaaaaucaagcgcucugugucgccccagacccuugaggccuauauucgauggaauaaggacuucggugauacaacugucuga

SEQ ID NO: 63084 - RNA, 3834 nt, Artificial Sequence
  derived and/or modified sequence opt3 from SPATA13__Homo_sapiens__NP_001159743
augacccaggccgcugugagacccugggcaccuugccuggagaacaugacaacugccccaaauggccucgggccgggacccgcggcuccuugugccgguagcgaccuuaaggaugcaaaaauggucacgucccuggccugcggcaacgggguuuguggaugcucuccaggcggugacaccgauacacaagaagcuaaguugucacccgcaaaauuagugaggcuguucaguacuagccggaagcgcaccggggcccacccugagcgaccacauuccaugguccuagugggaaauucuucgacauggaacacccucgcuucauuucguaaaaugggcagcuucaagaagcugaaaaguuccguccuuaagggcauccagucuagagaagggagcaaugccuguuccaaaggagaggcgucagaacacggucugggcaagaguauucccaacggggcagugccuggagcccaggcuagcaggggcucuccauuggccccgggucccgcaugcggggcucuccggccugccgaguggggaacucuggacggcuccgaucuggaggacacagaugacgcguuucagcgcucaacccauagaagcaggagucuccggcgcgccuacggcuuagggcgaauaugucugcuugaugcaccacaaaaucacgcuacgcccacuaucgccaccggacagguuccugcugugugcgaaauuuuggucagagacccagagaacaauucuauggguuauaggcgguccaaaagcacagauaaccuggccuuccuaaagaagucgucuuuuaaacguaaguccacuucaaaucucgcagaccugcgcaccgcccaugaugcuagagugccccagaggacacuuaguagcuccucuaccgacagccagaaacugggcucagggcggacgaagcgauggcgcaguccgaucagagcgaaagacuucgauaggguauuuaaguugguuuccaacgugacugaagcagccuggcggcgcgagagcccuagaucuggagcucccucaccaggcgaggccagucucaggcugcaagcacacagccguuuacacgacgauuacucccggcgagucucuagaucgacagaacaggacagcaggcgcgguggggccgugaugcauggcaccacugcuacauguaccguggccccuggauucggcuccgcaacgucaaaagggccccaccuggaugcggacaccgcugucuuuccacucgagacaaagaguucuugggccguugaaagcgauuccucaugcacuuguagcucucuucccuccccuauugugcaggacguacugaguaaggauagcugcgacccaaaugcaggaucucaguugaccuucgauccggagcaacccccuacaccacuacggcccacuaccccuaaaccacagaguccccagucaccgcaaaguccuggugccggcagcgcuucgugccauuccaaccacucugcccugagcgcaaauucagaagagagugaggggagagcugaagaaccagcccagagggaacccggaccugugucccuccaggacccccuggaggcgacacacggcgacgaagguucuaaggaucuucuggucaacaucgggguggccgcuggcccagaggagaaagaaaaggaggaaguugugccugacggacccuggcgccgaagcuccucacaggaugaggaacggaccgaggcacaacguacuccaaaaagaagguggggcagcgggcgccggccgagaccuaggcccuuuagugacuauggacaguuggccucucgaucccucagcauaccagaggauucggucgcugccgacccccagaaggaagaucgcguggacgaggauccucaggcaucaaugacgucugcgaguccagaagaccaaaacgcccccguagguuguccuaagggcgcucggagaaggcguccgaucuccguuauugggggagugagccuguacggcacaaaucagaccgaggaguuagauaaccugcuaacucagccagccucucggcccccuaugccagcacaucagguacccccuuauaaagcugugagcgcccgcuucagaccguuuaccuucucccaaucaacacccaucggucucgacagggucgggcgacggcgccagaugagagcaaguaaugugagcucugauggcggaaccgaaccauccgcccugguugacgacaacggcucagaggaagauuucaguuacgaggaccuuugccaggcuagcccuagguauuugcagcccgggggagaacaacuggcgauuaaugagcucaucuccgauggcaacgugguaugugccgaggcacugugggaccacgucacuauggaugaccaggaacuugguuuuaaggcuggggaugugauacagguucuggaggccucuaauaaagacuggugguggggacggucggaagauaaggaggccugguucccagcuagcuuugugcgauugagagucaaccaagaggagcucucagaaaauuccaguucuacaccuagcgaggagcaggacgaagaggcaucccagucacgccauaggcacugcgaaaacaaacagcaaaugcguacgaaugugauucgggagaucauggauaccgagagaguauacauuaagcaucugagggacaucugugaaggcuacauccgccagugccgaaagcacacugguauguucacaguggcccaguuagcgaccauuuuuggcaacauagaggauaucuauaaauuccagagaaaguuucugaaagaccuagaaaagcaauacaauaaagaggagccccaccucucugaaauugggagcuguuuccugcagaaccaggagggauuugcuaucuauagugaauacugcaauaaccauccaggcgccugucuugaguuggcaaaccugaugaagcaggggaaguaucggcacuucuuugaagccugcaggcuccugcaacagaugauagacauugcuaucgauggauucuuacugacaccgguucagaaaaucuguaaguacccucuucaauuggcagagcuccugaaauauacuacccaggagcauggcgacuacuccaauauuaaggccgcguacgaagcuaugaaaaacgucgccugccuaaucaaugagcgcaagcguaaacuggaaagcauugauaagauagcaagauggcaagugucuaucguggguugggaggggcucgacauucuggaucggucauccgaacuuauccacaguggagaguugacgaagaucaccaaacagggcaagagccagcagaggacauuuuuccuguucgaccaccaguuagucucgugcaaaaaggaucuccugcgccgagacaugcuuuauuacaaagguagacuggauauggacgagauggaauugguugaucucggcgacgggcgggacaaggauuguaaccugucugugaagaaugccuuuaaacugguguccaggacuaccgacgagguauaucuauucugcgcuaagaaacaggaagauaaggcccgcuggcuccaagcaugugcugacgagagaaggcggguccaggaagauaaagagaugggaauggagauuagcgaaaaccagaagaagcuggccaugcuuaaugcgcagaaagccggccaugggaagucaaaaggauacaaccguugccccguggcaccaccccaccaaggcuugcauccuauacaccagcgccauaucacaaugccaacuuccguuccccagcagcaaguguuuggucuggcugagccuaagcgaaaaucuuccuuauucuggcacaccuuuaauagacucacgccguucaggaaguga

SEQ ID NO: 63085 - RNA, 1710 nt, Artificial Sequence
  derived and/or modified sequence opt3 from SPATA16__Homo_sapiens__NP_114161
auggacgccggcagcuccagaucucuggagaacgcugugaauaggaucuaccacgaucagcucguccccaagauuaacaccucaaagaagaugaguacacuugcacauccuccaaauauacuggaaaugagccaagagaucaaaaagaacugcgggggaaaacagguugaaauuacuuuggagcggacgaagaugaccaaggguaucaaagaaaagcaguccaaugacuuagagaaagccgcguucaagcgcaaagcugagggcgaagagaagccgacacgaaagaaacaggccaagauuacugaacuggauaaccaacuaaucaccaugccccucccucacauaccacugaaaaauaucauggacguggagaugaaacuuguauauauugaugagaugggggugcguuacgaauuugucgagucuuucaugucgacaggaucacagcccaccugucaggcagccgaaaucguggacccucugagcguucauaacuuuaguuucuugccacagauugauaaauggcuccaaguggcucugaaggacgcauccucuugcuauagacagaaaaaguacgcccuggcugccggccaguuuaggacugcgcucgaguuauguagcaagggugcaguccugggggaacccuucgaugccccugcugaggacaucgccuccguggcaucauuuauagagacaaaacuuguaaccugcuauuugcggaugcgcaagccagaucuggcucuaaaucacgcccauagaaguauuguucucaacccggcguacuucaggaaucaucugcggcaggccacgguguuucgcugucuugaacgauauagcgaggcagcuagaucugccaugaucgcugacuacauguucuggcugggaggcggcagggaagaguccauuucaaaauugaucaagcucuacuggcaagccaugaucgaagaggcaauuacucgggccgagagcuuuagugucauguauacccccuucgcuacaaaaauacgugcggauaagaucgaaaaggugaaagacgcauuuacuaagacccacccugccuacgcugaguauauguacacagaccugcaggccuuacacaugcugccacagaccguggauuggucuuccuuucccccucaacaguaucuccuuacgcugggguucaaaaacaaggacgauggaaaauucuuggaaaagauuagcucgcgcaagcuaccaaucuucacugagcacaaaacacccuuuggucugaccagagaagacacugucaggcagauggagacaaugggcaagcggauacucccgauucuggauuucauccgaucuacccagcuuaauggguccuuuccugcaucaaguggaguuauggagaaacugcaauacgccagcuugcucucccagcugcagcgcgugaaggaacagucucaaguaaucaaccaggcuauggccgaguuagcaacgauucccuaucugcaggacaucagccagcaagaagcggagcuacuccagucacugauggcugaugccauggacacccuugagggcagaaggaauaacaacgaacggguguggaauaugauucagaaagucggucagauagaggauuucuuguaccaacuggaagacaguuuucucaagacaaagaaacugcgcacugcaagaaggcagaagaccaaaaugaagcgucuucagacagugcaacagcgguga

SEQ ID NO: 63086 - RNA, 1086 nt, Artificial Sequence
  derived and/or modified sequence opt3 from SPATA17__Homo_sapiens__XP_005273109
auggccacccuggcuagacuccaggcaaggagcuccacagugggcaaccaauacuauuuccgcaauucugucguugaccccuuucggaagaaagagaacgaugccgcggugaagauccagucaugguuccgagggugccagguacgugcuuacauuagacaccuuaauaggauagugacuaucauucagaaaugguggcggaguuuucugggacgcaagcaauaucaguugacgguccagguggccuacuauaccaugaugaugaacuuauacaaugcaauggccguuagaauccagaggcgguggcgcgguuaucgagugagaaaauaccuguucaacuacuauuaccuaaaggaauaucucaaggucgugagcgagacaaaugacgcuauuaggaaagcacuggaagaguuugccgaaaugaaggagcgggaggagaaaaaggcuaaccuugagcgugaagagaaaaagcgcgauuaccaagccagaaagaugcauuaucuguuguccacuaaacagaucccuggcauauacaauucuccauucaggaaggagccggaccccugggaacuccagcugcagaaagcgaagccucugacccaccggcgaccaaaaguaaagcaaaaagauucgacaucacucaccgacugguuagcauguacuagcgcccgcaguuuucccagauccgagauccugccuccaauuaacaggaagcagugccaggggcccuuccgggauaucacagaaguucuugagcaacgcuauagaccuuuggaaccaacccugaggguggcugagccgauugacgagcuaaagcucgcccgugaagaacugcggcgagaagaguggcuucagaaugucaacgauaauauguuucugcccuucucuagcuaccauaaaaacgaaaaguacaucccuuccaugcacuugucaaguaaauauggaccaauaagcuacaaggagcaguuuagaucugagaaucccaaaaaguggauuugugacaaggauuuccagacggugcucccuuccuuugaacuguucucaaaauauggcaaguuauacagcaaagcaggucaaaucguguga

SEQ ID NO: 63087 - RNA, 1617 nt, Artificial Sequence
  derived and/or modified sequence opt3 from SPATA18__Homo_sapiens__NP_660306
auggccgagaaccugaagagacucgugagcaaugaaacccuuaggacacugcaggagaaauuggacuucugguuaaaggaauacaacacuaauacgugcgaucaaaaccugaaucacugucuagagcucaucgaacaggucgcuaaaguucagggccagcuguuugggauucuuaccgcagccgcgcaagagggaggucggaacgacggcguggagacaauaaagucccgccuguugcccuggcucgaggcuucuuucacugccgcaucacuggggaaaaguguagauagcaaggugccuucccugcaggacaccuuugaucgagagcgucauaaggacccaucuccgagagauagggacaugcagcagcucgauucgaauuuaaacucaacacggagccaaugcaaucagguccaggacgaucugguggaaaccgagaaaaaccuugaggaaaguaagaaucgcuccgccaucucuuugcuggcugcagaggaagagauuaaccagcucaaaaagcaacuaaaaagccugcaggcccaggaagacgcuagacacaggaauacugaucaacgguccucagagaaccgccgaagugagcccuggagccuugaagagagaaagagggaacaguggaacucucugaagcagaaugccgaccagcaagacacagaggcgauguccgauuauaaaaagcaguugcggaaccucaaagaagagaucgcaguucugucagccgaaaagagcgcuuuacagggacguaguucucgcuccagaagcccuucgccagcccccaggucucgguccuguucacgaagucgcagcgcauccccuucuaccgcugugaaagucagaaggccaagccccaaucggucaaagcugaguaacguggcccgcaaagcggcccuccuuuccagauucagcgacucuuacucacaggcaaggcuggaugcucaaugcuugcuacgucgguguauugacaaggccgaaacgguacagcgaaucauauauaucgcuacuguugaggccuuucauguggcaaagauggccuucagacacuuuaaaauucaugucaggaagagucugaccccuagcuacgugggcuccaaugauuucgaaaacgcugugcucgacuaugucaucugccaccuggaucuuuacgacucucagucgagcguuaaugaugugauucgcgcgaugaacguaaauccaaaaaucuccuuuccgcccguggucgacuucugucuguugucagauuuuauacaggagauuugcuguaucgcauucgccaugcaagcucucgaaccuccacuggacauugccuauggugcagacggggagguguuuaacgauugcaaguaccggagaaguuacgacucugauuucacagcccccuuaguucuguaucacguguggccugcucuaauggagaaugacugugucaucaugaaaggagaagccgugacuaggcgcggcgcauucuggaacagcguacgauccguuucacggugccguagcagaucucucuccccaaucugccccaggagucagauuggccugaauaccaugagccgcucucgguccccgucaccuauaagaugugggcuucccagguuuuga

SEQ ID NO: 63088 - RNA, 504 nt, Artificial Sequence
  derived and/or modified sequence opt3 from SPATA19__Homo_sapiens__NP_001278921
augaucauuaccacauggauaguguacauccuggccagaaagggcgucgggcuccccuuccuuccuauuacuagcuccgacaucgauguuguggagucugaagcuguaucagugcugcaccauugguugaaaaagacggaggaagaggcaaguaggggaauuaaagaaaaguuaagcaucaaccacccaucccaggguguccgggagaaaaugucuaccgacucgccgcccacacauggccaagauauacacgugacucgcgacguugugaagcaucaccugucaaagagcgaucuacucgccaaucagagucaggagguccuggaggaacgaacccguauccaguuuauuagauggucccacacaaggaucuuccaagugccuucugaaaugaccgaggacauuaugcgggaucgcaucgagcagguaagaaggagcauaucccggcuuacugacguuucagcgcaggauuuuaguaugcgcccaucuagcuccgacugcuga

SEQ ID NO: 63089 - RNA, 2361 nt, Artificial Sequence
  derived and/or modified sequence opt3 from SPATA20__Homo_sapiens__NP_001245301
augcugggcgccagagcuuggcucgggagggugcuucuguugccccgggcaggagccgguuuagcggcuagccgccgaggcuccucuucacgugacaaggauagaagugccaccgucagcuccucuguuccuaugccagcagggggaaagggcucgcacccgucaagcacaccccagagggugccuaaccggcugauccaugagaagaguccauaccuacuccaacacgccuauaaucccguagacugguacccuuggggucaggaggcuuucgauaaagcacgcaaggaaaacaaaccaauuuuucuguccgugggguauucuacuugccauuggugucacaugauggaagaggagagcuuccagaaugaagagauaggaagacuucuguccgaagacuuugucucagugaagguugauagggaggaacggcccgacguggauaaggucuacaugacguucgugcaggccaccaguagcggcggcggguggccuaugaacguaugguugacaccaaaucuccaaccguuuguuggagguacuuauuuucccccugaggacggccugacccgcgugggguuccgaacaguccugcucagaaucagggagcaguggaaacagaacaagaauaccuuacuggaaaacucucagcgggugacuacagcucuuuuggcccguuccgagauuucagugggagaucgccaacugccacccagcgcggcaaccgucaauaacagaugcuuccagcagcuagacgaaggcuacgaugaggaauaugguggguuugccgaggcuccuaaauucccaacgcccguuauccucaguuuucuguucucuuacuggcuuucccauaggcugacucaggacggaagccgggcccaacagauggcauugcacacccucaagaugauggcuaauggcggcauucgagaucacguggggcagggauuucaucgcuacucgacagacagacaauggcacguaccgcauuucgagaaaaugcuguaugaccaggcccaguuagcgguggccuacucucaggcauuccaacuguccggugaugaauuuuauucagacgucgcuaagggcauccuccaguacguggccaggagucuuagccaccgguccgggggauucuauucugcugaggaugccgacagcccucccgaacgcggccagagaccaaaggagggugcauacuauguuuggacugugaaagaaguccagcaacuguugccugagcccgugcuaggggccaccgagccacugacaucaggccagcuccugaugaagcacuacggacuuaccgaagcuggcaacauaagucccucccaggauccuaaaggggagcugcagggacaaaauguauugacgguuagguacagccucgaacugacugcggcacguuuugguuuagacguggaggccguccggacacugcuaaacucuggccucgaaaagcuguuccaggcucgaaaacauagaccaaagccgcaccuugauucaaaaauguuggccgcauggaaugggcugauggugaguggauaugccgucaccggcgcugugcucggucaggacaggcugaucaacuacgccacuaacggggcaaaguuucuuaagcgccauauguucgauguugcgagcggccggcugaugagaacauguuauaccggacccggcgggacgguggagcacuccaauccuccaugcuggggauuuuuggaggacuacgcuuucguagucaggggucuccuggauuuauaugaagccucucaggagucggcauggcuggaaugggcccuacgccuccaagacacccaggacaaacuguuuugggauagccagggcgggggauacuucuguuccgaggcugagcuuggcgccgguuugccccugcgacucaaggacgaucaagacggggcagaaccuucagcuaacagugugucugcccauaaucuguuacggcugcacggcuuuacaggacacaaagauuggauggacaagugcguuugucuuuugacugcguucagcgagcguaugagaagggugccagucgcccuccccgaaauggugcgcgcucuguccgcacagcagcagacccuaaaacaaauuguaaucugcggcgaucggcaggccaaggacacaaaggcucuggugcaguguguucauucagucuauauuccgaacaaagugcucauccuggccgauggggacccuagcucuuuucuuuccagacaguugccauuccugaguacuuuaaggcgacucgaggaucaagcaaccgcguacgugugcgaaaaucaggccuguagcguccccauaacagacccuugcgagcugcgcaaacuucugcaccccuga

SEQ ID NO: 63090 - RNA, 2088 nt, Artificial Sequence
  derived and/or modified sequence opt3 from SPATA21__Homo_sapiens__XP_011539714
auggacaacagaaauacccagauguacacagagggcaggacuaaggcccccgggacgcaaccuagcccaggacugcggaucaccauuaaacgcgcugguguggaaccgauaauccccggcgucuccaagguuauguucccugaugcaucugagguggggucaaagaagcaccucaguagcgccucccgaggaccagaaaaaggcccccgucuuagagacgcguuugagaaggguccuucugaacugaggauucaggagcaggggccacccgcucggccuggaaagaaacagccaucguggguaccgcaagagggcucacaggaauugcaggccggccaggaucaaagcgaguuagggcugcuacccaguugggugccugaagucccagagggacuccagcagcuggguuccggcaaggagaucaaagggcagcaaggacgccagagaaacaggggcauuggugaagaccagcccccugagucuugccaagggagcggauaucaguccacaccaucacaucaggcagauauggugcagcccgccgaaccguguugccggcuugcuagucacggccaaccucugggcgggaagcaucccaaagaggcaggaguuccacacauccgcccucaggaagcucccccagagcccagcccugguggccauggggacucuucccaggaggccaugccaccgaugucaguggucgcccccgaagagaagacugugaauccuuucuugccaagcacccccggaccuaagaaagcgaagggcgguggggaagcaguagagacacacccagcccccggcccgcucccuccacccgaaguucgagauauaggagagagaagggagccugaccgggcucagcaacagccccagaaaccagccguggcagcuggcacccagagucuggggaacuuucgucaaggauucaugaagugucugcucgaagucgagaaaauggaagccucucaccgcagagcguccaaggccaggagccagacugcacagaaaucgccucggacauuaacccccgugccaacgucugcuccgucccugccucagacucccgccucagugccagcuaguggucccagcugggcccgacuuccugcaccaggccccgagccugccccgaugggggcuccaguccccaccuccaugccuugcccaguuuugcugggacccgcgcuagaucucggcuggcgcagaauggaacugcuucaucaaucuagcgagaggacacugucauacgcaaaggcccggcaggagccugaggaacagaguuugcaaaagcucuaucagaaucgcgaaaaauccgaggagcagcugacuuuaaagcaggaagaggcuuuuagaagcuacuucgaaaucuuuaacgguccgggggagguggacgcccaaucucugaaaaauauucuccuucugaugggcuucucaguaaccuuggcacagguggaagaugcccuaaugagugcugacgucaacggagauggcaggguggacuuuaaggacuuccuggccguuaugacagauacccgucgguuuuucuguagcguggagcagaaugcacucuccgacauggcgccccacaacccacauacgcugcuuuuugagauccugucuuugcucgucgaaaugcuggcuuuaccugaggccgugcuggaagagauuacuaauuauuaccagaaaaagcuaaaggaagggacaugcaaagcacaagagauggaggccgcuguaggacgacucagacugcagaaacuucccuauaacccacagcaggaagagucgagcgaaguuccugagaggaaaguguuguccauccugucacgccucaagcaacagaauuacgcccccaaccugcagaguccauacgcacaagucccguguauacuucugugcccucaguuggauaaaaagauggugcggagacagcccucuaaucacuaugcucucgaccaguguaccccacccggucuggauccugacauuaggagcccauucuuccaauccggcucacaggggaaccgcgaacacaacagcgauucucgaaagugguuauccaguguccccgcccggacucauuga

SEQ ID NO: 63091 - RNA, 1092 nt, Artificial Sequence
  derived and/or modified sequence opt3 from SPATA22__Homo_sapiens__NP_001164166
augaagagaagccugaacgaaaauuccgccaggucuaccgcuggcugccuccccgugccucuuuucaaccagaaaaagcggaaucgccaaccacugacaucaaacccguugaaagacgauagugggaucagcacucccuccgacaauuacgauuuuccuccauuacccacggacugggcaugggaggccgucaacccugagcuggcgccaguuaugaagaccguggauacaggacagauuccccacucuguaucgcgaccucuacguucacaggacagcguguucaauaguauacaguccaacacugguagaucucaaggcggguggagcuauagggauggaaauaaaaacaccucccucaagacauggaauaagaacgacuuuaaaccacaguguaagcggaccaaucuggucgcuaacgauggcaaaaauucaugcccggugaguagcggugcccagcagcaaaagcagcuucgcauccccgaaccuccaaaccugucuagaaacaaagagacugaauugcucaggcagacacauuccucaaagauuagcggguguaccaugcggggacuggacaagaauagugcacugcagacgcucaaacccaacuuccaacagaaucaguacaagaaacaaauguuagaugacaucccugaggauaacacucugaaggagaccucucuuuaucaguugcaguuuaaagaaaaggccuccagccugcgcauuaucucggcuguuauagagucuaugaaauacuggcgagaacacgcacagaagacagugcuacucuucgagguccuggccgugcuugacuccgcuguaacuccaggccccuauuacucaaagaccuuucugaugagagacggcaaaaauacauugccgugcguuuucuaugagaucgauagggaacucccucggcugauucgugggcgcgugcauagaugugucggaaacuacgaccaaaagaaaaauaucuuucagugcgugagugugaggcccgccagcgucuccgagcagaagaccuuccaggcguuuguuaaaauugcagauguggaaaugcaauacuauaucaacguaaugaaugagacguga

SEQ ID NO: 63092 - RNA, 684 nt, Artificial Sequence
  derived and/or modified sequence opt3 from SPATA25__Homo_sapiens__NP_542175
augagcuacuucagaacaccccagacccacccuggcccacugccguccgggcaaggaggugccgcuucucccggccucucacuugggcugugcaguccuguggagccagucguuguggcaagcggaggcacuggucccuugucccagaaggccgaacagguagcgccugcugcccaggcaugggggccagccuuagcuaugccccaagcaaggggauguccuggcggcacgucuugggagacccugcggaaagaauauucgcgcaacugccauaaguuuccacacgugcgacagcuagagucacucgggugggacaauggauacagccguaguagagccccggaucuggguggccccuccaggccucggccacuuaugcuguguggguugucuccccgcguccucccugugccaagcgaagcuguuggaaaagaggccuccucacagcccgacaucugcauucugacacuggcgaugaugauagcaggcaucccgacugugccuguccccggugugagagaggaagaucucauuugggccgcucaggccuucaugauggcacauccagagccugaaggggcuguagagggagccaggugggagcaagcgcacgcccauaccgcaaguggcaagaugcccuuaguucggagcaaacgcggccagccacccgggucuugucuguga

SEQ ID NO: 63093 - RNA, 1563 nt, Artificial Sequence
  derived and/or modified sequence opt3 from SPATA2__Homo_sapiens__NP_001129245
augggcaagcccagcuccauggacaccaaauucaaggaugaccuguuuagaaaauacgugcaguuccacgagucuaaggucgauacaacuacgucaaggcaacggccugggagugacgaaugccuccgcguugccgcuagcacccuucuguccuugcauaaaguggauccauuuuaucgauuccguuuaauccaguuuuacgagguaguggaaucuucgcugagaucacuaagcaguuccucucucagggcacugcacggagccuucagcaugcuugagacagucgguauuaaccuguuuuuguauccguggaagaaggaguuccgguccauaaaaacuuacaccggccccuuuguguauuacguuaagucaacacuccuggaagaggacauccgcgcgauucugaguuguaugggguauaccccugaacucggaacugcuuacaaauuaagagagcugguggaaacacuucaggucaagauggugagcuucgaguuguuucuggccaaaguagagugcgaacagaugcuagagauccauucucaaguuaaggauaagggcuacuccgaacucgacauugugucagagaggaaaagcagugcagaagauguccgggguuguucugacgcccugcgcagacgagcugaggggagggagcaccuuaccgcauccaugagccggguggcccugcagaagucggcuucugaacgugccgcgaaagauuauuacaagccacgcgugacgaaacccuccagaucagucgacgcauaugauaguuacugggagagcaggaagccuccauugaaagccucccucucucugcggaaggaacccguugcuacugacgugggagacgauuuaaaggacgagaucauacgaccuagcccaucacugcucaccauggccaguuccccgcauggcagccccgauguacuuccuccagcaucucccucaaauggcccugcucuguugcgcgggacauauuucaguacucaggacgauguggaccuauacaccgauagcgaaccaagagccacauauaggcggcaggacgcgcugcgccccgaugucuggcuccugagaaacgacgcccacucccuuuaccacaaaaggucuccgccugcaaaggagucggcucugagcaaaugccaauccuguggauugucaugcaguucuagccucugucagcguugcgauucccuguuaaccugucccccagccucaaagccuagcgcuuuucccucuaaagccuccacgcaugacagucuggcacacggugccagccuacgggagaaguacccaggccagacucaggggcucgaccgacugccccaucuucacucuaaguccaaaccuucaacaaccccaaccaguagaugcggauucuguaauaggccgggcgcuacaaacacuugcacgcaaugcagcaaggugucgugugaugcgugcuuguccgcauaucacuacgaccccuguuauaaaaagucugaacugcauaaauucaugccuaauaaccagcucaauuacaagagcacccagcugucacaccuuguuuaucgcuga

SEQ ID NO: 63094 - RNA, 2682 nt, Artificial Sequence
  derived and/or modified sequence opt3 from SPATA5__Homo_sapiens__NP_660208
augagcuccaagaaaaacagaaagaggcugaaucagucugccgagaacggcucaagucuccccagcgcugcauccucuugcgccgaagcgcgggcuccuucggccgggucagacuucgcagccaccagcggaacacuuacugugacgaaucuguuggagaaagucgaugacaagaucccaaaaaccuuucaaaacaguuuaauucaccugggucuaaauacaaugaaguccgcuaacauauguaucggccgcccgguucuccugacuucucuuaaugggaagcaggaaguguacaccgcauggcccauggccggauucccuggcgguaaaguagggcugagcgagauggcucagaagaacgugggaguccgaccaggcgaugccauucaggugcaacccuugguuggcgcggugcuccaggcagaagagauggacgucgcccuguccgauaaagacauggagaucaaugaagaggaacugacagggugcauucuccguaaguuagauggaaaaaucgugcugccugguaacuuucuuuauuguaccuucuacggcagaccauauaaguugcagguacugaggguuaagggggcugacggaaugauacuaggcgguccccagucagauagugacacugaugcccaacggauggcauuugagcagagcucuauggagacauccucacucgaacugagccuucagcugagucaguuggaccucgaggauacccaaaucccuacgucucgcuccacuccauacaaaccgauugacgacagaaucaccaauaaggcuagcgaugugcuguuagacgucacacagucgcccggggauggaucuggccugaugcucgaagaggugacuggccuuaaaugcaacuucgaauccgccagggaggggaaugagcagcugaccgaagaggaacgguugcuaaaguuuucaauuggagcgaaauguaacacagacaccuucuauuuuaucaguagcacgacucgcgugaauuucacagagauagauaagaacuccaaagaacaagacaaccaguuuaaggucaccuacgauaugauugguggccugucuagccagcucaaggccauccgagagauuaucgagcugccucuuaaacagccagaacuguucaagucauaugggauccccgcaccuagaggaguuuugcucuacggcccacccgguacugggaaaacaaugauugcuagggccguggcuaaugagguaggcgccuacgugagugucauaaacggaccggaaaucauuuccaaguuuuauggcgagaccgaagcaaaacugcggcaaaucuucgccgaggcuacguuacgucauccuagcauaauuuucaucgacgagcuggaugcgcuaugccccaagcgcgaaggggcacagaaugagguggaaaagagaguuguggccucucuccugacccuuauggacggaaucgguucagaggucagugagggccagguguugguacugggggcuacaaacaggccacacgcccucgaugcagcccugcggcgaccuggacgcuuugacaaagaaauugagaucggcguucccaaugcucaggacagacuugauauucugcaaaaguugcucaggcgggugccacaucuguuaacugaagccgagcugcuacagcucgcaaacagcgcgcacgguuacgucggggcugaccugaaagugcuuuguaaugaagccggcuugugcgcacugcgcagaauacucaagaaacagcccaaccugccugaugucaagguggccggauuaguuaagaucacccugaaagacuuccuucaggcuaugaaugauauuaggccauccgccaugcgugagaucgcaaucgacgugccgaacguaucuuggucggauauuggcggguuggagagcauaaagcucaaacuggaacaagcugucgaguggccccuaaagcauccugaauccuuuauccggauggguauucagccacccaaaggagugcugcucuauggcccuccaggguguucaaagacaaugaucgccaaggcgcuggccaaugagaguggacuuaacuucuuggcuauuaaaggccccgaacugaugaauaaguacguuggugagucugagcgagcagugagagaaacuuuuaggaaagcccgcgcugucgccccgagcaucauauucuuugacgaguuagaugcacucgcgguggaacggggguccucacugggcgccggaaacguagcugacagagugcuugcccagcuguugaccgagauggauggcaucgaacagcucaaggacguuacaauucuggcagcuaccaauaggccugaucgcaucgacaaagcccuaaugcgaccagggcggauugaccguaucauauaugucccccugccugaugcagccacuagaagggagauuuucaagcuccaauuucacagcaugcccgugucuaacgagguggaccuggaugaacuuaucuugcagacggacgcuuacuccggagcggagauugucgccguuugccgcgaagcagcucuguuagcccucgaggaggauauccaggccaaccugauaaugaaacggcacuucacacaagcucuuaguaccgugacuccaagaaucccugaaagccugaggcgauuuuaugaggacuaccaggaaaagucuggccuacauacccucuga

SEQ ID NO: 63095 - RNA, 1704 nt, Artificial Sequence
  derived and/or modified sequence opt3 from SPATA7__Homo_sapiens__NP_001035518
auggacggcagcagaagggugcgggccaccuccguccugccccgcuacgggccuccaugccucuucaagggacaccuuucuacaaaaucaaacgcugcaguugauuguagugugccgguaagcguguccacuucuaucaaguaugccgaccagcaacgacgugagaaacugaagaaagaauuggcgcagugcgagaaggaauuuaaguuaacgaaaaccgcuaugagagccaauuacaagaacaauucgaaaucacuguucaacacacuacagaagcccagcggugagccucagauugaagaugacaugcucaaagaggagaugaauggcuuuaguuccuucgcaaggucucuggucccaagcuccgaacggcuucaucugucauugcacaagaguagcaaggugauaacuaacgggcccgagaaaaauucuuccucaagcccuaguucuguugauuaugccgcuuccggaccacgcaagcucagcucgggcgcacuguacgguagaaggccccggucuaccuuuccuaacucccaucgcuuccaacuggugaucucaaaagccccaaguggggaccucuuagauaagcacagcgaacuguuuuccaauaaacagcuuccguucacaccccgaaccuugaagacugaggcuaaaucuuuucugagccaguauagauacuauaccccugccaagaggaagaaagacuucacagaucagcggauugaggcggaaacgcaaacugagcuaucauuuaagagugaacucggaaccgcagagacuaaaaacaugacagacuccgaaaugaauaucaagcaggccagcaacugugucaccuacgaugcuaaagagaagauugccccacugccccuugagggccaugacucuacaugggaugaaaucaaggacgacgcacugcagcacucaaguccucgugcuaugugccaguacagcuugaaaccacccuccacccgcaagauauauucugaugaggaggagcuccuguacuuaucguucaucgaagacgugacggaugagauucugaaacucggccuuuuuagcaauagauuccuggagagguuguucgaacggcacaucaagcaaaacaaacaucuagaggaagagaagaugcgacaucugcuccacguacugaagguugaccuuggguguacuuccgaagaaaauucagugaaacagaacgaugucgacaugcugaacguguuugauuucgagaaggccggaaauagugaaccgaacgaguugaaaaaugaaucugaggugacaauucagcaagagcgccagcaguaucagaaggcgcucgacaugcuguuaagcgccccuaaagaugaaaacgagaucuuucccuccccaaccgaguucuuuaugccuauauacaagucaaagcacagcgaaggugucauuauccaacagguuaaugacgaaacuaaccuggagacaucuacccuagaugagaaucaccccuccauuagugacagccucacggacagagaaaccucugugaacguaaucgagggcgauuccgacccagaaaaaguggagaucucaaaugggcugugcggacuuaacacaagucccagccagucgguccaguucuccucugugaagggcgauaauaaccaugacauggaauugagcacucugaaaauuauggagaugucaauagaggauuguccucucgacguuuga

SEQ ID NO: 63096 - RNA, 318 nt, Artificial Sequence
  derived and/or modified sequence opt3 from SPATA8__Homo_sapiens__NP_775770
auggcccccgcuggcaugagcggggcacaagacaacuccugccuguaccaagagaucgccccuucuuuccagagacucccauguccgaggaccucaagucggcacuuuagcgaagcgaugacaugccccuguggauggcgcccuuucaaggguggcccagggggacuuaaaggccccguguggccugcuaaggaggaaaauuccugcucucauggucguauucagcgaguccagagaaggcggguuccaucggccucaccccugauacagaaaaucaaccgcagaagcguguuguuucacccuuauuguuggaguuga

SEQ ID NO: 63097 - RNA, 765 nt, Artificial Sequence
  derived and/or modified sequence opt3 from SPATA9__Homo_sapiens__NP_114158
augcccaucaagccugugggcuggauuugcgggcagguccugaaaaacuucagcggaagaauagaggguauccaaaaggccauuauggaccucguugaugaauuuaaagacgaguucccaaccauccuuaggcugucccagucuaaucagaagcgggaaccggcucagaaaacaucaaagauucgcauggcaaucgccuuggcgaagauaaaccgagcuacuuuaauccguggccugaauaguauuagcagauccucuaaaucgguggccaagcuacuccacccccaacuggcauguaggcuucuggaguugcgggauaucucagggcgccuccugagagaaguaaacgccccuaggcagccacuguacaauauucaggugcggaaaggaagccucuuugagaucauaaguuuccccgcuaagacggcauuaaccuccauuaucuaugccucuuacgcugcccugauuuaucuugcggucugcgugaacgcaguuuugaaaaaggugaagaauaucuuucaggaggaagagagcauccgccaaaaccgagaagaguccgagaauuguagaaaagccuucucagaaccuguccugagugagccaauguuugcugaaggcgagauuaaggccaaacccuacaggagccuaccugaaaagccagacauaucugauuauccgaaacuccuggcaaacaagcaguccaauaacauccaggugcuucauucaguauucgaccagagcgcugagaugaaugagcaaauuuga

SEQ ID NO: 63098 - RNA, 1326 nt, Artificial Sequence
  derived and/or modified sequence opt3 from SPATC1__Homo_sapiens__NP_001127846
augagccugcucacuaacuacgagggccuuagacaccagaucgaaaggcuggugcgggagaaugaagaguugaagaaauuaguccgccugauucgagaaaaccaugagcuaaaguccgccauaaaaacacaagcugggggacucgguaucucuggcuucacuucagggcugggagaggcaacggccggccuuaguagccgucagaauaacgguguuuuucugcccccuuccccagcgguggcuaaugaaagaguauuggaggaaguggggauuauggcccucgcaccgcuggccgagaugcugaccucucuccagcccucggcuacaccuggaucauuaaugagcccacugacuggcacccuuaguacauugcuguccggccccgcaccuaccucucagagcuccccacuaacuucauuccucacaagucccaucgccgggccucugaccggaacgcuugcuagcucucuggguuugccauccacuggcacccucacaccgucaagccuggucgccgggcccguggcgaugagucaaucuuccccuuuaauugcaccaguuaugggaacuguggccgucagccugucgucuccccuccuuuccucaaccgcuacaccuccaggcgugagucagaaccuguuggccaaucccaugagcaaccuaguacugccggaggcaccuaggcuccggcuggcugaaccccuucgcggugggccaaccggaccucagucccccgccugcguugugccaacggcgacuacaaaggucccccugucuaccgagccuccacagagcacucaagacccggaacccuugucaauggccuuugcaggcgcuccucuccagacaaguaccccaaucggcgccauggggacgcccgcuccuaaaaccgccuucuccuuuaauacaagcgauacucaggcacagccaucugccgcucaagaacagguggugcccgcgucagucccgaccaguccuacaacuagcccaaccguuacagugcuggcauccgcccccgcuuuagccccucagguagcaaccucuuauacucccucgagcacgacacacauagcccaaggagcuccacauccucccuccagaaugcacaacucaccaacccagaaucugccggugccucauugucccccacacaacgcccacagucccccuaggacuucuagcuccccagcaucagucaaugacagccgggguccccgcaccacagagccuucuaccaaguccaugauggagguggagcgaaagcuagcgcauagaaaaaccaguaaguucccggaaaacccaaggggcuuucccgagccucaguga

SEQ ID NO: 63099 - RNA, 594 nt, Artificial Sequence
  derived and/or modified sequence opt3 from SPC24__Homo_sapiens__NP_872319
auggccgcuuucagagacaucgaggaagugagccagggccugcucucccuucugggggcaaacagggccgaggcgcaacagcggcgcuuguuaggacgacacgaacaggucguugagcgucugcuagaaacccaggauggugcugagaagcaacucagagagauucugacaauggaaaaagagguggcccagucucuucugaaugcaaaggaacagguacaucagggcgggguggaguugcaacagcucgaggccggacugcaggaagcuggcgaggaagacacuaggcugaaagcaucacucuuacagcugacgcgggagcuugaagaguugaaggagauagaagccgaucuggagcgccaagaaaaagaggucgacgaagauaccacagugacuauccccagugcuguuuacguggcccagcuauaucaccaggucagcaagauugagugggacuacgagugcgaaccugguauggugaaggggauccaucacggaccauccguagcgcaaccgauucaucucgauucuacccagcugucgagaaaauuuaucucagacuaucuuuggagccugguugauacagagugguga

SEQ ID NO: 63100 - RNA, 675 nt, Artificial Sequence
  derived and/or modified sequence opt3 from SPC25__Homo_sapiens__NP_065726
augguggaggacgaacuggcccucuucgauaagagcaucaacgaguuuuggaauaaauucaaguccaccgacacaucuugccagauggcuggccuuagagauacuuacaaagacucaauuaaggcauuugccgaaaaacugagugucaaguugaaggaggaagagaggaugguugagauguucuuagaauaucaaaaccagauaagccggcagaauaaacugauccaggagaagaaagauaaccuacucaagcugauugcggaagugaaagggaagaagcaagagcuugagguacugacggcuaauauccaggacuugaaagaagaguacucccgcaagaaagaaaccauuucuacagccaacaaggcaaaugccgagcgacucaaacgucugcagaagucggcugaucuguauaaagacagacucggauuagaaaucaggaagauauacggugagaagcugcaguuuaucuucacuaacauugaucccaaaaauccugagucaccauuuauguucagccuucacuugaacgaagcacgggacuaugaggugagugauuccgccccgcaucuggaaggccuagcugaguuucaagaaaauguccgcaagaccaacaauuucucugccuuucucgcgaacgugagaaaagcauucacagccaccguuuacaauuga

SEQ ID NO: 63101 - RNA, 543 nt, Artificial Sequence
  derived and/or modified sequence opt3 from SPCS3__Homo_sapiens__NP_068747
augaacaccgugcugagcagagccaauucccucuucgcuuuuucucuuucagucauggcagcccugacauucggcugcuuuaucacuacggcguucaaggacaggaguguucccgugcgguugcacguaagccgcauuaugcugaaaaacguggaggauuuuaccgggccucgagaacguuccgacuuaggauucauaacauuugauaucacugcugaccuagagaauauuuucgauuggaacgucaagcagcucuuucuguaccuuucugccgaauauucgaccaaaaauaacgcacugaaucaagugguuuugugggacaagaucgugcucagaggugauaacccaaaacugcugcucaaggacaugaagacaaaauacuucuuuuucgaugacggcaauggguuaaagggaaacaggaaugucacccugacucuuucauggaacgugguaccgaaugccggcauuuugccccugguuacagguagcgggcaugugagugucccuuuuccagauaccuaugagaucacgaaauccuacuga

SEQ ID NO: 63102 - RNA, 960 nt, Artificial Sequence
  derived and/or modified sequence opt3 from SPDEF__Homo_sapiens__NP_001239223
augggcagcgccucccccgggcugucuucagugaguccuagccaccuccuucugccaccggacaccgucuccagaacaggauuggagaaggcugcagccggugcgguuggcuuagaaaggcgggauuggucucccucgccuccagcuacucccgagcaggggcugucagccuucuaccuaagcuauuuugacaugcucuacccugaagauaguuccugggcagccaaagcuccaggagcaucuagccgcgaggaacccccugaggagccagaacaaugcccggugaucgacucccaggcccccgcuggcucacuggaucuuguaccuggugggcugacguuggaggaacauagucucgaacaggugcagagcauggucgugggagagguucugaaggacauugaaaccgccuguaaacugcucaacauaacagcggauccaauggacuggucucccuccaaugugcaaaagugguuacuguggacugagcaccaguaucgacuuccuccaaugggcaaagcauuccaggaauuggccggcaaggagcugugcgcuaugucagaggagcaguuucgucaaagaagcccccuagggggagauguccuccaugcccaccuggacaucuggaagagugcaucuaccuccgaggaaagcuggacagauucggagguggacucuuccuguucaggucagccgauucaucuuuggcaguuccugaaagaauugcuccugaagccucacaguuacggcagguuuauccggugguuaaacaaagagaaggggauuuucaaaaucgaagauagcgcucagguagcccgccuguggggaauaagaaagaauaggcccgcgaugaacuaugacaagcucucccggucuauccgccaauacuauaaaaagggcauuauccgaaaaccagacauuagccagagacuuguuuaccaguuugugcacccuaucuga

SEQ ID NO: 63103 - RNA, 1818 nt, Artificial Sequence
  derived and/or modified sequence opt3 from SPDL1__Homo_sapiens__NP_060255
auggaggccgacaucauuaccaaccugagaugcaggcucaaggaagcugaggaagaacggcuuaaagcagcccaguacggccugcaauugguggaaagccagaaugaguuacagaaccagcuggauaagugucgcaaugagaugaugacaaugacugaauccuaugagcaagaaaaauacacgcuacagcgagaggucgagcucaagucucguaugcuggaaucacuuaguugcgagugugaagcgauaaaacagcagcaaaagaugcaccuggagaaguuggaagaacagcucagcagaucccaugggcaggagguuaacgaacugaaaaccaagaucgagaaacugaagguggaacucgacgaggcuagguuaucugaaaaacagcugaagcaccaaguagaucaucagaaggagcuuuugucgugcaaaucagaggaacugcgggugaugagcgagcgcguccaggaaaguauguccucugagaugcuagcccuccaaauugaacugacagagauggagagcaugaagacuacccuuaaagaagaggugaaugaacugcaguauagacaggagcaguuggagcuccugaucacaaacuuaaugaggcaaguugaccggcugaaggaagagaaagaggagcgcgaaaaggaggcaguguccuacuauaaugcccucgagaaagcucgagucgcaaaccaggaucuucaggugcagcuggaccaagccuugcagcaggcucuagaucccaauucaaagggaaacagucuguucgccgaaguagaggacagaagggcggcaauggaacggcagcucauuagcaugaagguuaaauaccaaucucugaagaaacagaauguguuuaaccgugagcagaugcagcgcaugaagcugcaaaucgccacccuguugcagaugaaagguucccagacugaguucgagcaacaggagagacuccuggcuauguuagaacagaagaauggcgagauaaagcaccuucuaggggaaaucaggaaccucgagaaauuuaagaaucuguaugauucaauggaaagcaaaccuagugucgacucuggaacacuugaggauaacaccuacuacacggacuugcugcagaugaagcucgauaaccugaauaaagagauugaauccacuaagggcgagcuuagcauccaacggaugaaggcccuguucgaaucgcagcgagcauuggacauugagcgcaaacucuuugcuaacgagagaugucugcaguuaucugaauccgagaauaugaagcugagggccaaacuagacgaacucaagcugaaauaugagccagaagagaccguggaggugccgguccuuaagaagcggcgcgaaguuuugcccguggauaucacaacugcgaaagacgccugcguaaacaauucagcacuggguggggagguguacagacucccuccacagaaggaagagacccaaaguugucccaacagccuggaagauaauaacuuacagcuggagaaauccgucucuauauauacaccugugguuagccuuucaccacauaagaauuugcccguggacaugcagcucaaaaaggagaaaaagugcgucaagcugauuggagugccugcugaugccgaagcucuaagugagagguccggcaacaccccaaauagcccgcgucuggccgcagaaucuaaacuccagacggagguaaaggaaggcaaagagacuucaaguaagcuggagaaagaaacauguaagaaacuucaccccaucuuguacguuagcuccaagucuaccccugagacucaaugcccacagcaguga

SEQ ID NO: 63104 - RNA, 861 nt, Artificial Sequence
  derived and/or modified sequence opt3 from SPDYA__Homo_sapiens__NP_001008779
augagacacaaccagaugugcugugagaccccaccuacagugacugucuacguuaagagcggcuccaauaggucucaucaacccaaaaagccgaucacgcugaaacggcccauuugcaaggacaacuggcaggccuucgaaaagaauacccacaacaauaacaagucaaagcgcccuaaagggccaugucucgugauacagcgacaggauaugacagcauuuuucaaacuuuuugacgaugaccugauccaagauuucuuguggauggacugcuguugcaaaauugcugauaaguauuuacuggccaugacuuuuguauacuucaaacgugcgaaguuuaccaucagugagcauacaagaauuaauuucuuuaucgcucuauaucucgccaacaccguggaagaggacgaagaggagacuaaguacgaaauauuccccugggcacugggaaagaauuggaggaaacuuuuuccuaacuuccugaaauugcgggaucagcucugggaccgcaucgauuauagagccauugucagcaggcgguguugcgaggaagugauggcuaucgcaccaacacacuacauuuggcagcgcgagcgauccguucaucacucuggugccgugagaaauuauaacagggacgagguccagcugccccggggcccuucggcuaccccaguggauuguucacugugcgggaagaaacgucgcuacguaagacucggauuaagcaguuccucuagccuguccucacacacggccggcguuacugaaaagcauagucaagacagcuacaauucucuuuccauggacaucauaggugauccgucacaggcguauaccgggagcgagggaaugauuuga

SEQ ID NO: 63105 - RNA, 2130 nt, Artificial Sequence
  derived and/or modified sequence opt3 from SPECC1__Homo_sapiens__NP_001028726
augggcaaccacagcgggagacccgaggacccugaaccaggagccuucacuacaacuaagaggacggguaucccggcuccccgggaguuuuccgugaccgucucucgcgaacgaucaguuccucguggcccaaguaaucccagaaaaagcguguccucuccuacaucgucaaacacuccaacccccacaaagcaucugaggaccccuagcacuaaaccaaagcaggagaaugaagggggagagaaagcagcccucgagagucaaguacgggaacuucuggcggaggcuaaggccaaggauuccgaaauuaaccgcuugagaucugagcugaaaaaguacaaagagaagaggacacugaaugcagaaggcaccgacgcccuagguccgaacguggaugggacgagcgucucccccggagacacugagccuaugauacgggcucucgaagagaaaaauaagaacuuccagaaggaacugucagaucuugaggaggaaaaucgcgugcugaaagagaaguugaucuaucucgaacacaguccaaacagcgagggcgcagccucucauaccggcgacuccucaugccccacaagcauuacucaggaaaguucuuuuggguccccuaccggaaaucagaugagcucggauaucgacgaguacaaaaagaacauucacgguaaugcucugcgaacaucuggcuccucaaguagcgauguuaccaaagccucccugucuccagacgcgagcgauuucgagcauaucacggcagaaacucccucaagaccgcucaguuccacaagcaacccuuuuaagucuucaaaauguaguaccgccgggagcucccccaauucugugucggaguuaagccuggcuucccuuacugaaaagauacaaaagauggaggaaaaccaccacucaacagccgaggaguugcaggcaacccugcaggaacuaagugaccagcaacagaugguccaggagcucacggcugaaaacgagaaacugguggaugagaagaccauccuugaaacaucuuuccaucagcacagggagcgggccgaacaacugagccaggagaaugaaaaauugaugaaccuccugcaggagcguguaaagaaugaggaaccaacuacccaagagggaaaaauuaucgaauuagagcagaagugcacaggcauucuggaacagggucgcuuugagagagagaagcuccuuaacauccagcaacagcugacuuguuccuugaggaaaguugaagaggaaaaucagggggcgcuagagaugauaaagcggcugaaagaagagaacgagaagcucaaugaguuccuggaacuugaacgacauaacaauaacaugauggccaaaacccuggaggagugccgcgugacauuggaaggacucaagauggagaauggcucauuaaagagccacuuacagggcgaaaaacaaaaggcaaccgaggcuucugccgucgaacagacugcugaguccugugaggugcaggaaaugcugaaaguggccagagcagagaaggaccuacucgaacugaguugcaacgagcuuaggcaggaauugcugaaagccaauggggagauuaagcacgucagcucucuccuggcuaagguugagaaagacuauuccuaccuuaaggaaaucugugaucaucaagcggagcagcugucacggacgaguuugaaacuccaggaaaaggcaagcgagucggacgccgaaauuaaagauaugaaggagacaaucuuugagcuggaagaccagguggagcaacaccgcgcuguaaaauuacauaacaaucagcugaucuccgaacuagagucuagcgugauuaagcucgaggaacagaagucagaucuggagagacaacuuaaaaccuugacuaagcagaugaaagaagagaccgaagaguggaggcguuuccaggccgaccugcagacagcagucgugguugccaacgauauaaagugcgaggcucaacaggaacuccggaccgugaaacgaaagcuguuagaggaagaggaaaagaacgccagacugcagaaagagcuuggagacguccagggucacggcagggugguaaccagucgcgcagcgccucccuccuuggggucuguuagcuga

SEQ ID NO: 63106 - RNA, 3354 nt, Artificial Sequence
  derived and/or modified sequence opt3 from SPECC1L__Homo_sapiens__NP_001138940
augaagaaagccagcagauccgugggcucuguccccaagguuucagcuaucaguaaaacccagacagcagagaagauuaaaccugaaaacagcuccucugccucgacugggggaaagcuggugaagccagguacggcggcuucacucagcaaaaccaagaguuccgacgaucuucuggccggcauggcagggggaguaacagugacuaauggcgucaaagguaagaaaucuaccugcccgagcgccgcucccuccgcaucagccccugcuaugacaaccguggagaacaagaguaagauaagcacugggacagccucuuccaccaaaaggucaacgagcacuggaaauaaggaaaguucuuccacccgggagcgcuugcgagaacguacaagauuaaaccaaagcaaaaagcugccaucggcgggccagggcgcaaaugacauggcccuagcuaaaaggucucggucccgcacugccaccgagugugauguuagaaugucaaagaguaaaagcgacaaccagaucuccgauagggcagcucucgaggccaaggugaaggaccugcuuacacuggcgaaaaccaaggaugucgaaauuuugcaccuccggaaugagcugcgcgacaugcgagcccagcuggggaucaacgaagaucauucugagggagacgagaaaagcgaaaaggagacgauuauggcacaccaacccacugauguggaaucaacacucuuacagcugcaggagcagaauaccgcuaucagagaagaacuuaaccaauugaaaaaugagaacaggaugcugaaggaccggcuaaaugcccucgguuucagucuggaacagcgucuugauaacuccgagaagcuguuuggcuaccagagcuugucuccugaaauaacuccagggaaucagucagacggaggcgguacacucaccaguagcguagagggguccgcucccggaucuguugaagaccuguuaucgcaagaugagaacacgcugauggaccaucagcacagcaacuccauggauaaucucgacucagagugcagugaaguguaucagccucuuaccucuagcgaugacgcccuggaugcaccauccucaagcgagucugaaggcaucccguccauugagcgcaguagaaaaggcagcucugggaacgccuccgaagucucaguggcuuguuugacagagaggauccaucaaauggaggaaaaucagcacaguacuagcgaggaacuacaggcgacccugcaggagcucgcagaccugcaacagauuacacaggagcuuaacucggaaaaugagcggcugggagaagagaaggugaucuugauggaaucccucugccagcaaucugauaaacuggagcacuucagccgacagauagaguacuuucgcucauuacuggacgaacaucacauuaguuaugucaucgaugaggacguuaaguccgguagauacauggaacuagagcagagguauauggaccucgccgaaaacgcucgguucgagcgcgagcagcugcuuggcgugcaacagcauuugucuaauacucugaaaauggccgaacaggauaacaaggaggcacaggaaaugauuggggcccucaaggagagaagccaccacauggaaaggaucaucgaguccgagcaaaaaggaaaggcugcccuggcagcgacccuugaagaguacaaagcuacaguagccucagaccagauugaaaugaaucgucugaaggcacaguuggagaacgagaaacaaaagguggccgaacucuauagcauacauaauaguggcgauaagucugacauccaggaucuguuagaguccguccggcuggacaaagaaaaggcugagacccuagccagcucgcuccaggaagaucuggcacacacucgaaacgacgcuaauagacuucaggaugccauugcgaaaguggaggacgaguacagggccuuucaagaagaggcuaagaaacagaucgaagauuugaacaugacgcuggagaagcuccgcucagaccuggaugaaaaagagacagagcggucugacaugaaggaaaccauauucgaguuagaagacgagguugaacagcauagagcagugaagcugcacgauaaucuuauuaucagugacuuggagaacacugucaaaaagcuccaggaucaaaaacaugacauggagagggaaaucaagacccugcaccgccgacuacgggaggaauccgccgaguggcgucaguuucaggcugaucugcagacagccgugguaauugcaaacgacaucaaaagcgaggcgcaagaagagauuggugaucucaagagaaggcugcacgaagcccaggagaagaaugaaaaacuuaccaaggaguuggaggaaauaaaaucucgcaagcaggaggaggagcgggggagaguuuacaacuauaugaaugcuguggaaagggaccuggccgcauuacgacaaggcaugggacucagccgccgguccucaacaaguagcgagcccacuccuacggucaaaacccugaucaagucuuucgauuccgcuucacaggugccaaaccccgccgcagccgcuauuccuagaacuccacuuagucccagcccgaugaagacaccucccgcggccgcagucuccccaaugcagaggcauucuaucucgggcccuaucagcaccucaaaaccccugacagcuuuguccgacaagcguccaaauuacggggagauucccgugcaggaacaccuccugcgcaccaguucugccagccggccugccucccuaccaagaguuccggcuauggagucagcaaaaacucugucugugagcaggcgaaguuccgaagagaugaagcgggauauaagcgcccaagaaggagcgucucccgcuucacucauggccauggguacgaccuccccucagcugagucuuagcucgucuccaacagcauccguaacucccaccacacgcagcagaaucagggaggagcggaaagacccuuugucagcccuggcucgagaauauggcgggaguaagagaaacgcauuacucaaguggugucagaaaaagacugagggauaccagaauauugauaucaccaacuuuucuuccagcuggaaugacggccuggccuucugcgcgcuucugcauacguaucuaccagcucacauucccuaccaagaacucaacucacaggacaaacgcaggaauuuuaugcuggccuuccaggcagccgagagugucgguaucaagagcacauuggauauaaacgagauggugcguaccgaacggccggacuggcagaauguuaugcuguaugugacugcuaucuacaaauacuuugagacauga

SEQ ID NO: 63107 - RNA, 5469 nt, Artificial Sequence
  derived and/or modified sequence opt3 from SPEF2__Homo_sapiens__NP_079143
augagcgagauccugugccaauggcucaacaaggaacuuaaaguguccagaacagucucucccaagucauucgccaaggcuuuuaguagcggcuaccuguugggggagguuuuacacaaguucgaacugcaagacgauuuuuccgaguuccuagacucuagagugucgucagcaaaacucaauaacuuuagccggcuggaaccuacacuuaaucuguugggaguacaguucgaucagaacguggcccaugguauuauaacugagaagccaggcgucgcgacgaagcuccuguaucagcuguacaucgcucuccagaagaagaaaaagaguggguuaaccggaguggagaugcagacaaugcagcgccugacuaaucuucgauugcagaacaugaaauccgacaccuuucaagaacgucugagacacaugauuccgagacagacagauuucaaucuaaugcggaucaccuaucgcuuucaggagaaguacaagcauguuaaagaagaccucgcccaucugcacuucgagaaacuugagagauuucagaaacugaaggaagaacaaagguguuucgauauugaaaaacaguauuugaaccggcgccgacagaaugagaucauggcaaagauacaagccgcuaucauucagauccccaaaccugcaucuaacagaacucucaaggcccuggaagcucagaagaugaugaaaaagaaaaaggaggccgaggacguggcggaugaaauuaaaaaguuugaggcauuaaucaagaaagaccugcaggccaaggaaagcgcuuccaaaacaucacucgauaccgccggccaaacgacuaccgaccuucugaauacauacagugaugacgaguauauaaagaaaauucagaagagguuggaagaggacgcauucgcucgggagcagcgugaaaagcgcagaaggaaacuacugauggaucagcucaucgcccacgaggcgcaagaagaggccuaccgggaggaacaacugauuaaccgacuuaugcgccagagccagcaagagagaaggaucgcaguccagcugaugcacgugcggcaugaaaaggagguguuguggcagaaucgcaucuucagagaaaaacagcacgaggagaggcgucucaaggacuuucaagaugcucuggaccgggaagccgcuuuagccaaacaggcaaagauugauuucgaggaacaguuucugaaggagaaacgauuccaugaccaaauagccguugaaagagcucaggcgagguacgagaagcacuauucugugugcgcagagauccuagaucagauugucgaccucuccacuaaaguggccgauuaccgcaugcugaccaacaaucuuaucccauauaaguugaugcacgacuggaaagaacuguuuuucaacgcuaagcccauauacgagcaggccucagugaaaacacucccugcaaacccaagccgggaacaacugaccgagcuugaaaagagagaucuguuggacacgaaugacuaugaggaguacaagaacauggucggugaaugggcccuccccgaggaaaugguugauaaucugccuccaaguaacaauuguauuuuagggcauauccugcacaggcuagcugagaaaucucucccgccccgcgccgaauccacuacaccugagcugcccagcuuugcagugaagggaugccuuuugggcaaaacccugucgggcaagacuacaauccuccgaucucugcagaaagacuucccaauucagaucuuauccauugauacccugguacaggaggcgauacaggcuuuucaugacaacgaaaaggugucagagguccuuccuauccagaagaaugaugaagaggacgccuugccagugcuccaggaggaaauuaaagagagucaggauccccaacacguuuucagcgcagggccgguguccgacgaaguccugccugagacggaaggagagaccaugcuaucugccaacgcugauaagacacccaaagccgaggaaguaaagagcucagacaguuuucugaaacucacuacccgggcacagcugggugcuaaguccgagcagcuuuugaagaaaggcaagagcaucccagauguacuguuaguugacaucauugugaaugccauaaacgaaaucccugucaaucaagauuguauucucgacggguuccccaugacacugaaccaggcgcagcuucuggaggaagccuugacuggaugcaaucguaaccucaccgagguggagaggaaaaaggcucagaaaucuacacuggcaaucgacccagccaccucaaaggaaauuccccuaccuaguccagcuuuugauuucgucauccugcucgacgugagcgauacuuccucuaugucgaggaugaaugacauaaucgccgaggaacugagcuauaagacggcacaugaggauauuucccaacgcguugcggccgaaaaccaggacaaagauggcgaccagaaccuucgggaucagauccaacacagaauuaucgguuucuuggacaauuggccgcuguuagagcagugguuuucagagcccgaaaacauacucauuaagaucaaugcugagauugauaaagaaagucugugugagaaggugaaagagauccuuacaaccgaaauagccaagaaaaagaacaagguagagaaaaagcuggaagagaaagaagcagagaagaaagcugccgcaucucuagccgagcucccucugccaacucccccuccagcucccccgccugaaccagagaaggaaaaggagauccaccagagccaugucgcguccaaaacccccacagccaaggggaaaccucagucagaagcaccccacggaaagcaagagagcuugcaggagggcaaaggcaagaagggggaaaccgcucugaaaaggaagggaucuccaaaagguaaguccaguggcgggaaagugccuguuaaaaagagccccgccgacucuacugauacauccccaguggccauugucccgcagccucccaaaccaggaucagaggaauggguguacguaaaugagcccgugccugaagagaugccauuauuccucguucccuacugggagcugaucgaaaacaguuauauuaauacgaucaagaccguccuucgacaucugcgcgaggaccagcacacuguguuggcuuaccucuaugaaauacggaccagcuuucaagaguuccugaaaagaccugaccacaagcaggauuuuguggcacaguggcaagccgacuucaacucgcuaccggaugaccugugggaugacgaggaaaccaaagcggagcuucaucagagggucaaugaucuccgugaccgccugugggauauuugcgacgcucggaaggaagaggccgaacaggagagauuggauaucaucaacgaguccuggcugcaggacacauuaggcaugacuaugaaucacuuuuucucucucaugcaagcagaacugaacagguuucaggacaccaagcgacuucugcaggauuacuauugggguauggagagcaaaauuccaguugaagacaauaagcgguucacgcgcauccccuuggugcagcucgauucaaaagacaacagugagucccaacugaggauuccucuagugccaaggauaucuaucagccuggaaaccguaacacccaagccuaaaacuaaguccguccuuaaagggaagauggauaauucacucgagaacguggagagcaacuuugaagccgacgagaagcugguuauggauaccuggcagcaggcuaguuuggcagugucucauauggucgccgcggaaauucaccagcgguuaauggaggaagagaaagagaaucaaccggcugaccccaaggaaaaauccccacagaugggcgccaacaagaaagugaagaaggagccucccaaaaagaaacaggaagauaagaaaccaaagggaaagagcccucccauggcagaggccacaccaguuaucgugacuaccgaggaaauugcugagaucaaacgaaagaaugaacugagaguaaaaauaaaggaggaacaucucgccgcacugcaauucgaggagaucgcuacgcaguuucgccuugaacugauuaaaacaaaggccuuggcgcuacuggaggaccucgucaccaaggugguggaugucuacaaacugauggaaaaguggcuuggcgagagguauuuaaacgaaauggccucgacugagaaacugacagacguugcacguuaccacaucgagaccucaacuaagauucagaaugaacucuacuugucucaggaggauuucuucaucaacgggaauauaaaaguguuuccggacccucccccaaguauucggcccccuccaguagaaaaggaggaagacggaacccugacaaucgagcaacucgauucccugagagaccaguuccuugauauggcucccaaagguaucauuggcaacaaggccuuuacggacauacugaucgauuuggugacccuaaaucuggggacuaacaauuucccuagcaacuggaugcaccucacacagccggaguuacaggaacugaccucucuucugacagucaauagcgaguuuguggacuggaggaaguuccucuugguuacuuccaugccauggcccauuccucuggaagaggagcuccuggaaacccuucaaaaauuuaaggcuguggauaaagagcagcuaggaacgaucacauucgaacaguauaugcaggcaggccugugguuuaccggugacgaggauauuaagauccccgaaaacccauuggagccuuuacccuucaaucgccaagagcaucugauagaauuuuucuuccgacucuuugccgacuacgagaaagauccaccucagcuggacuauacucagaugcuucuguacuucgccugucacccggauaccgucgaagggguguauagagcucucucaguugcggugggcacacaugucuuucagcaaguaaaggcaaguauccccagcgccgagaagacuucuuccaccgacgcuggaccagccgaagaguucccugagcccgaagagaacgcagcccgggaagagaggaaauugaaggacgauacagaaaaacgcgagcagaaggacgaggaaauuccagagaacgcuaauaacgagaaaaugucaauggagacgcugcuaaagguguuuaagggcgggagugaggcgcaggauagcaaucguuucgccucccaccugaaaaucgaaaacauuuacgcagagggauuuaucaagaccuuccaagaccucggugcuaaaaaucuugaaccuauagagguugccgugcuguuaaagcaucccuuuauucaggauuugaucucuaacuauucggacuacaaauucccggauaucaagauuauccugcagagaagcgaacacguccagggcucagacggggagcgguccccaaguaggcacacugaggaaaagaaauga

SEQ ID NO: 63108 - RNA, 342 nt, Artificial Sequence
  derived and/or modified sequence opt3 from SPEG__Homo_sapiens__NP_001166947
augaagcccagcccuucccagaacagaaggucuucagacaccggcaguaaagccccaccgacauucaaggugagccugauggaucaauccguccgggaggggcaggacguuaucaugucuauucgcgugcagggagaacccaaaccuguagugucguggcuccgaaaucgucagccagucagacccgaucaaaggcgguuugcugaggaagcagaggguggccuuugccgccugagaauauuggccgcggaaaggggagacgcuggguucuacacuuguaaggccgugaacgaguauggcgcacggcagugcgaggcccgcuuagaaguucgaggugaguga

SEQ ID NO: 63109 - RNA, 1053 nt, Artificial Sequence
  derived and/or modified sequence opt3 from SPESP1__Homo_sapiens__NP_663633
augaagccccuggugcuccuugucgcccuguuguuauggccuagcuccguuccagcuuacccgucuaucaccgugacacccgacgaggaacagaaccugaaucacuauauucaaguacuagagaaccucgugagaucagucccuaguggcgaaccagggagggagaaaaagagcaauucccccaaacauguguacucuauagcaucgaagggaucaaaauucaaggaacugguuacucacggugaugccagcacggagaacgacgugcuuaccaauccuaucagugaggaaacaacuaccuuuccaacaggcggguucacccccgagauuggaaagaaaaagcauacugaauccacaccuuuuuggucuaucaaaccaaacaaugucagcauugugcugcacgcggaggagccguauaucgaaaacgaggaacccgagccugaaccagagcccgcugccaagcagaccgaggcaccucggauguugccaguaguuacggaauccucaaccagucccuacgugacuagcuauaaaucuccggucacaacucucgauaaguccaccggcauagguaucucaacagagagcgaagacgugccucagcugaguggggagaccgccauugaaaagcccgaggaguucggaaaacauccagaaucuuggaauaacgaugacauccugaagaaaauucucgauaucaauucccaggugcaacaggcuuuacugagcgacacgucgaacccugcauaccgcgaggauauagaagccucuaaggaccaccuuaaacgauccuuggcucuggccgcggcagccgagcacaagcuaaaaacuauguauaagucacagcuccugcccgucggccguacaaguaauaagauugaugacaucgaaaccguuauuaacaugcuuugcaauagcagauccaaacuguacgaguacuuggauaucaagugugugccacccgagaugagggaaaaagcugccacuguauuuaacacacucaagaacaugugccggucucgcagagugaccgcacuguuaaaagucuauuga

SEQ ID NO: 63110 - RNA, 6993 nt, Artificial Sequence
  derived and/or modified sequence opt3 from SPG11__Homo_sapiens__NP_001153699
auggccgcugaggaaggcguggcaagcgccgcguccgcugggggaucuugggguaccgccgcaaugggcagaguccugcccaugcuccuuguuccugugccagccgaggcuauggggcagcugggaucaagggcacaauugcggacacagccggaagccuuaggcagucugacugcugccgguagccuacagguacucucccugacgcccgggucucgcggaggcggccgaugcugucuugaggggccuuucuggcacuuucugugggaagacucgcguaacucaagcaccccaacagagaagcccaaauugcucgcgcugggagagaauuacgaacugcucaucuaugaguucaacuuaaaggaugguagaugcgacgcaacuauucuguacaguuguuccagggaagcccuucagaaauugauagaugaccaagauaucucuauuagccugcuaucccuccggauccugucauuucauaauaacaccagucuucuguucauuaauaagugcgugaucuugcacauaaucuuuccugagcgcgacgcugccauuagaguccucaacuguuucacacugccauuacccgcacaggcuguggauaugaucauugacacccagcugugcaggggcauccucuuuguucuuagcucucugggguggauauauauuuucgauguggucgacggaacuuacguggcccauguagauuuggcgcuacacaaagaggacauguguaaugaacagcaacaggagccugccaagaucuccucauuuacaagccugaagguuagucaggaucucgacguggcagucauugugucuuccagcaacucggcuguggcccugaaucuuaaccuguauuuccggcagcauccaggccacuugcucugcgaacgcauccuggaggacuuaccgauccaaggucccaaaggggucgaugaagacgauccuguuaauucugcuuacaacaugaagcuggccaaauuuuccuuccagauugaccgaucauggaaggcacagcuaaguagccucaaugagaccauaaaaaacuccaagcuggaggugucuuguugcgccccaugguuucaagauauccuucacuuggaaagccccgagucaggaaaucauaguacguccguacagagcugggcuuucauuccucaggacaucaugcacggccaguauaacgugcugcaaaaggaucaugcgaaaacuucugacccaggcagaucauggaagauaaugcacauuagugaacaggaggaacccaucgagcucaaaugugucagcgugaccggguucacagcacuguuuacuugggagguugaaaggaugggauacaccaucacacuuugggaucuggagacccaggguaugcagugcuucuccuugggcacgaagugcauuccgguggacucuucgggggaucaacagcucuguuuuguccugacugaaaacggauuaagccugauccuauucggccucacacaggaggaauuucugaaucggcuuaugauucacgguuccgccucaaccguggacacuuugugccaucugaacggguggggccguuguaguauaccuauccacgcucucgaggccggaauugagaaucgccagcuggacacaguaaacuucuuuuuaaaaucuaaggaaaaucuguucaaccccagcuccaaaucaagcguuucugaucaauuugaccaucuuuccagucacuuguaccucagaaauguggaggaacugaucccagcacuagaucugcucugcagcgccaucagggagucuuauuccgagccucagucaaagcauuucagugaacagcugcuuaacuugacccugagcuuuuuaaauaaccagauuaaggagcucuucauacacacggaagagcuggacgaacaccuucaaaaaggcgucaauauccugaccucguacauuaacgaguugcggacauuuaugaucaaguuccccuggaaacucacugaugcuauugacgaguaugaugugcaugaaaaugucccaaaggugaaagaguccaacaucuggaagaagcugucuuucgaagagguuauagccagcgcaauccuaaauaacaaaauucccgaagcgcagaccuuuuuccgaaucgacucacacagugcucagaagcuggaggagcucauugggaucggacugaaccuuguguuugauaauuugaaaaagaacaauauaaaagaagccuccgagcuguuaaagaacauggguuucgacguaaagggccaacuccugaaaauuuguuuuuacacaacuaauaagaacauccgcgauuuccuugucgaaauucugaaagagaagaauuauuuuucugaaaaagagaagagaaccaucgacuucgugcaucagguugagaagcuauaccucgggcacuuucaggaaaacaugcagauacaaagcuucccuagguauuggaucaaagagcaggauuuuuucaagcacaaauccgugcuggacucauuuuugaaguacgacugcaaagaugaauucaauaagcaggaccaucggauuguccugaacugggcauuauggugggaucagcucacacaagagagcauccugcuuccacgcauuaguccggaggaauacaaaucuuauucccccgaggcccuguggagauacuugaccgcuaggcacgacuggcucaauaucauacuguggauuggagaauuccagacucagcauagcuaugccucgcuacagcaaaacaaguggccucugcuuacgguggauguaaucaaucagaacacaucauguaauaacuacaugcguaacgagauccucgacaagcuggcacggaauggcguguuuuuggcuucugaacuggaggauuucgagugcuuuuuacuccgacugaguagaauuggugggguuauccaggacacccuuccaguccaaaacuauaaaacuaaggaaggcugggauuuccacucccaguuuauucuguacuguuuggagcauagccuccagcaccugcuauauguguaccuggacugcuacaaacuuucucccgaaaauuguccuuuccucgagaagaaagaacugcacgaggcccauccaugguuugaguucuuggugcagugcaggcaagucgcgagcaacuuaaccgaucccaagcugauauuucaggccucccucgcuaaugcacagauccugauuccgacaaaccaggccucaguuaguagcaugcuucuggaaggacacaccuugcuagcucuggccacuacaauguauucuccuggcggggugucccaagugguacagaaugaggaaaacgagaauugccucaagaaagucgacccacagcugcuuaagauggcauuaacgcccuacccuaaacugaagaccgcgcucuucccccaguguacuccaccuucaguguugcccagugauaucacaauuuaucaucugauccaaagccucuccccauuugacccgucucgccuguucggauggcagucggccaacacccuugcuauaggugacgccuggagccaccugccucauuucucaucccccgauuugguuaauaaauacgcaaucguggaacggcuaaacuuugcuuauuaccugcacaauggcagaccaaguuucgccuuugggacauuccucguccaggaguuaauuaagucuaagacucccaaacagcugauccaacaggugggaaacgaggcauauguuauuggccuuagcuccuuucacaucccuucaauaggugccgcuugcguguguuuccuggaacucuuggggcuggacucucucaagcugaggguagauaugaaagucgcgaauauuauccuuagcuacaagugccgcaacgaggacgcccaguacaguuuuauccgagaauccguggcagagaaacuaagcaagcuggcugauggcgagaagaccacgaccgaagaguuguuagugcugcucgaagagggaacauggaacucuauucaacagcaggaaauaaaacggcugucauccgagaguagcucgcagugggcccuugucguucaauucugucgucugcauaauaugaagcucucuaucuccuauuugagagagugcgccaaagcuaacgacuggcugcaguuuauuauccacagccagcuacauaauuaccacccagcagaagugaagucacugauucaguauuucagucccguaauccaagaucaccucaggcuugccuuugagaaccugccuucugugccgacuuccaaaauggacagcgaucaggucuguaauaagugcccacaggaauuacagggcucaaaacaagagaugaccgacuuguucgaaauacugcuccaguguagugaggagcccgauagcuggcauuggcugcuuguggaagcgguuaagcagcaagcuccuauccuguccgugcucgccucuugcuugcagggggcaagcgccauuuccugucugugcgucuggaucauuacaucaguggaggacaacguugcuacugaagcaaugggacacauccaggacucuaccgaggaucauacguggaauuuagaagaccuaagugugauauggcgcacacugcucacccggcagaagucgaaaacucuuauuagaggcuuucaacuguucuucaaggauagcccauugcugcucgucauggagauguacgagcugugcauguuuuucaggaacuauaaagaagccgaggcgaagcuucucgaauuucagaaaucccuggagacauugaauaccgcugccacuaagguacaccccgugaucccugcaauguggcuggaggaccagguuuguuucuuacuaaagcugaugcuccagcaaugcaaaacccaguacgaacuugguaagcuguugcagcuguuuguggagcgagaacaucucuucucugaugggccggacgucaaaaagcuguguauccuuugccagauuuuaaaagauacaucaaucgccauaaaccacacgauuaucaccagcuauuccauugagaaucugcaacacgaaugucgcaguauccucgagcgguugcagacugacggacaguuugcucuggccagaaggguggcagagcuagcugaacugcccguagauaaccucgugauaaaggagauuacacaggaaaugcaaacccuuaagcauaucgagcaguggucucugaaacaggcccguaucgacuucuggaagaaaugccacgaaaauuuuaagaaaaacagcauuucauccaaggcggccaguagcuucuuuucuacacaagcacaugucgcuugugagcacccaacuggcugguccucaauggaggaacgccacuugcugcucacccuggccggucauugguuagcucaggaggauguugugccucuugacaagcuggaagagcucgaaaaacagaucuggcuaugccggauuacgcagcacacacugggcagaaaucaagaggagaccgaacccagguucagccgacagauaucgacuucuggggaguugaguuuugauucccuggcaagcgaauucucauucuccaagcucgccgcccuuaacaccucuaaauaccuggaguugaauagccugccaaguaaggagacaugugaaaaccggcucgacuggaaagagcaggaauccuuaaacuuucugaucggacgccuucuggacgauggcugcgugcaugaggcuagcagagucuguagguacuuccacuuuuauaauccugacguggcgcuaguucuccauugccgggcacuggccucuggggaagcuucaauggaggauuugcaccccgagauucacgcccugcuccagagugcagaacuucuggaggaagaggccccagacaucccguuacgaagaguacauucccgccacaagcaaauguucaacccuacugaagagagccagaccuuucugcaguugacaacgcucugccaggauaggacccuggugggaaugaagcuacuugacaaaaucucuucggucccccauggcgagcugucauguacuacagaacuccugauuuuggcucaccacugcuucacccugacuugucauauggaggguauaauccgugugcuccaagcggcccacaugcuuacagauaaucaucuggcaccaagcgaagaguacggguuaguugugcggcuguugaccggaauuggcagauauaacgaaaugacguacaucuuugaccuccugcacaagaaacauuauuucgagguccuaaugaggaagaaacuugaucccuccgguacucugaagaccgcucuccuggacuacauuaaacgcugccgaccuggcgauagugagaagcacaauaugaucgccuuguguuuuucuaugugcagagaaauaggggagaaccacgaagcagccgcucggauccaguuaaagcugauugagagccagccaugggaggacucccucaaagauggacaucaacuuaagcagcugcuacugaaagcccucacauugaugcuggacgcggcagaaucauaugccaaggacaguugugugaggcaggcucagcacugccaacgccuuaccaaacugaucacucuccagauucauuucuuaaauacaggccagaacaccaugcugaucaauuuggggcgucacaagcugauggauuguauacucgcccuucccagauuuuaccaggcuucuauuguagcagaggccuacgacuucgucccugauugggcugaaauccuguaucaacaggugauucuaaagggagacuuuaacuaccuggaggaauucaaacagcagcggcucuugaagagcuccaucuucgaggagauaucaaaaaaguauaaacaacaucagccgacagauaugguuauggaaaaucugaagaagcuucugacuuacugcgaggacguguauuuauacuauaaacucgccuacgaacacaaguuuuacgagaucgucaacgugcuguugaaagauccacagaccggcuguugccugaaggacaugcucgcagguuga

SEQ ID NO: 63111 - RNA, 2001 nt, Artificial Sequence
  derived and/or modified sequence opt3 from SPG20__Homo_sapiens__NP_055902
auggagcaggaaccccaaaacggcgagccugccgaaaucaagauuauaagagaggcuuacaaaaaggcauuccuguuugugaauaaagggcucaacaccgacgaacuuggacagaaggaggaggccaaaaauuauuacaagcaggguaucggccaccuguugagggggauuagcaucuccucuaaggaaucagagcauacaggaccaggcugggaaagugcgcggcagaugcaacagaaaaugaaggagacuuuacagaacguccgcacgcgacuggagauucuagaaaaaggucucgcuaccagccugcagaaugaucuucaagagguuccgaagcuguaucccgaguucccuccaaaagacaugugcgaaaaguugcccgaaccucaguccuuuucuucggccccacagcacgcagaggugaacgggaauacaucaacucccagcgccggagcuguagcagccccugcuagucucucccugccaucucagagcuguccggccgaggcgcccccugcauacaccccacaagccgcugaaggccauuauacaguguccuacggcaccgauucaggggaguucaguagcgucggagaagaguuuuaucguaaccacucucagcccccuccacuggaaacucucgguuuagacgccgaugagcugauccuuauacccaauggcgugcagaucuucuuuguuaacccggcaggggagguguccgcuccuucauaccccggauacuugagaauugucagguuccuggacaauagccuagauacagugcucaaccggccaccuggcuuucugcaaguaugcgacuggcuuuauccccugguuccagaucgcagucccguguugaaguguaccgccggugcguacauguucccugacacgaugcuccaggccgcagggugcuuugucggaguggugcugucuuccgaauuaccagaggaugacagagaacuguucgaggaucuccuuaggcagaugagcgaccugcgguugcaggcuaauuggaaccgcgccgaagaggagaaugaauuucaaaucccgggccgaacuagacccucgucugaccagcuaaaagaggcuuccggcaccgaugucaagcagcuggaccaggggaacaaagauguuaggcauaagggaaaacgggguaagcgugccaaagacacaucaagugaagaggugaaccucagccacauuguaccuugugagccagugcccgaagagaagccuaaggaacugccagagugguccgaaaaagucgcacacaauauccuuucuggcgccagcugggugucaugggggcugguuaagggagcugagauaacuggcaaagcgauucaaaagggugcaaguaaauugcgcgagagaauccagcccgaagagaagccgguggaagucuccccugccgugaccaaggggcucuauauugcuaaacaggccacaggcggagcagccaagguaagccaguuccugguugauggcgugugcaccgucgcuaacuguguggggaaagaguuagccccacaugucaagaaacacggaucuaagcuggugcccgaaucacuaaagaaagacaaggaugguaaaaguccucucgacggcgcaaugguuguggcggcuagcuccguacaaggguucucuacggucuggcagggacuggagugcgccgcaaaguguaucgugaauaacguuucggccgagacugugcagacagucagguacaaauauggcuacaaugcuggugaagccacccaucacgcaguggauagcgcuguaaacguggggguuacugccuauaauaucaacaauauuggcauaaaggcgauggucaagaaaacagccacccagacgggacacacccuuuuggaggacuaccaaaucguggauaacucccagcgggaaaaucaggagggcgcugcaaacgugaauguccgaggggaaaaggacgagcaaacaaaagagguuaaggaagccaaaaagaaagacaaguga

SEQ ID NO: 63112 - RNA, 846 nt, Artificial Sequence
  derived and/or modified sequence opt3 from SPG21__Homo_sapiens__NP_001121362
augggcgagaucaaggugagccccgacuacaacugguucagagggaccgucccucugaaaaagauuauaguugaugacgaugacuccaaaaucuggucucucuaugaugccggaccaaggucaauucggugcccgcuuaucuuucugcccccugugagugguacagcugacguauucuuucgccagauuuuggcauuaacuggcuggggguaccgagugaucgccguccaccuguucggagcgagccuaggcgguuuucucgcucaaaaguucgccgaauauacgcauaaauccccacgugugcacucucugauacuuuguaauucguuuucagauaccagcaucuucaaccagacauggacugcaaauaguuuuuggcugaugcccgccuucauguugaagaagauuguucucgggaacuuuuccucuggaccuguggacccaaugauggcugaugcaaucgacuucauggucgauagacuggagagccugggccaguccgaacucgccucaagguuaacccugaauugccagaacaguuacguggagccccauaaaauucgggacaucccuguaacaauaauggauguuuuugaccaaagcgcucuuucuaccgaagccaaggaggagauguauaaauuguacccaaaugcgcgcagagcacaccugaagacuggcgggaacuucccguaucuauguagguccgccgaagugaaucucuacguccagauucaucugcuucaguuccacggaacaaaauacgcugccaucgaccccucaauggugagcgcagaggaacuggaggugcagaaggguaguuugggcauuucucaagaggaacaguga

SEQ ID NO: 63113 - RNA, 2388 nt, Artificial Sequence
  derived and/or modified sequence opt3 from SPG7__Homo_sapiens__NP_003110
auggccgugcugcuccuucuguugagagcuuuaaggcggggccccgggccuggaccacgcccgcuguggggucccggcccugcauggagcccaggguuccccgcccgaccuggacguggcagaccauacauggcguccaggcccccuggugaccuagcugaggccgggggacgggcacuccagucucugcaacuucgccuguugaccccaacauuugaaggcaucaacggccuccugcugaagcagcaccucguccagaauccgguuagauuauggcagcugcuugggggaacuuucuauuuuaacacgucaagguugaaacaaaagaauaaagagaaggauaaaaguaaggguaaggcccccgaagaggacgaagaggagcggcgccgaagagaaagggaugaccagauguaccgggagcgucugcgcacccuacucgugauugcuguagugaugagccugcuuaacgcacuguccacaucuggcgggucgauaucauggaaugauuucguccaugaaauguuggccaaaggagaggugcagagaguucagguggucccugagagcgacgugguagaaguuuaucuccacccaggcgcuguggucuuugguaggccccggcuggccuuaauguaccgaaugcaaguggcgaacaucgauaaguucgaggaaaaacugcgcgcagccgaggacgaacucaauauugaggcuaaggauagaaucccugugaguuauaaaaggacuggguuuuucggaaacgcccuuuacuccgucggcaugaccgcaguuggccuggcuauuuugugguauguguuucggcuagccgggaugacaggacgcgaggguggcuucucugcguuuaaucagcugaagauggccagauucaccaucguagacgggaagaugggaaaaggcgugagcuuuaaggaugucgcagguaugcaugaagcuaaacucgaggugagggaguucguugacuaccugaaguccccagagcguuuccuucagcugggggccaaagugcccaagggcgcuuugcuccugggaccgccuggcugcgggaaaacuuuacuggccaaggcagucgccacagaagcucaggugcccuuucuagcgauggcaggaccagaguucguagagguuauagguggccucggggccgcucgggugcgaucacuguuuaaggaagccagagcaagggccccuuguaucgucuacauugaugagaucgacgcugugggcaaaaagcgcaguaccacgaugagcggauucucuaacacugaagaggaacaaacccuuaaucaguugcuggucgagauggacgguauggggacaacugaucacgugauuguucucgccuccaccaaccgggcagacauccuggauggcgcgcuuaugagacccggaaggcuggaccgccauguguuuauagauuugccaacacuccaggagcgacgggaaauuuucgagcaacaccugaaaucauuaaagcugacccagagcaguacguuuuauucucagcgucuagcugaacucacucccggcuucuccggggccgacaucgcaaauauuugcaacgaggccgcucugcacgccgcaagagagggacauacaagcguacacacccuuaauuuugaauacgcugucgagaggguguuggccgguacugcgaaaaagucgaagauccugucuaaagaagaacagaagguuguggccuuccaugaauccggccacgcucucgucggguggaugcuggagcacacagaggcagugaugaaaguaucaaucaccccucgcacgaacgccgcuuuaggauuugcccaaaugcugccacgggaucagcaucuuuucaccaaggaacaguuguuugagagaauguguauggcacucggcgguagggcgagugaagcccugagcuucaacgaggugacauccggggcucaggacgaucuacgaaaaguuacucgcauugccuauucuauggucaagcaauucggcauggcaccgggaauaggccccaucagcuuuccugaagcucaggaggggcugaugggaauuggccggagaccauucucacagggucuccagcaaaugauggaccacgaggccaggcugcuuguggcaaaggccuaccgucauaccgaaaaaguguugcaggauaaucuggacaaguuacaggcucucgcgaacgcccugcuugagaaagaagucaucaauuaugaggacauagaagcacugauugggcccccuccacacggacccaagaaaaugaucgcuccgcagcgcuggaucgaugcccaacgggagaagcaggacuugggcgaggaagagacagaagagacucagcaaccuccacucgguggcgaggaacccaccuggccuaaguga

SEQ ID NO: 63114 - RNA, 1197 nt, Artificial Sequence
  derived and/or modified sequence opt3 from SPHK1__Homo_sapiens__NP_068807
auggaccccguggucggcugcgggagaggacuguucgguuuuguuuucagcgccggcgggccuaggggagugcucccacggccgugucgcguacuugugcuguugaacccccgaggcgguaaggggaaagcauuacagcuguuucguucccacguccaaccucuacucgcagaggccgaaaucucuuucacccugaugcuuacagagagaaggaaucaugcgcgggaacuggugcgcucagaggaauugggaagaugggaugcucucguugugaugaguggcgacggccugaugcacgaggucgugaacgggcugauggagaggccagauugggaaacugccauucagaagccccucugcagcuuaccugcaggauccgguaaugcccuggcugcaucucuuaaccauuacgccggcuaugagcagguaacgaaugaagacuugcugaccaacuguacacuacuccugugccggcgccuucugucgccaaugaauuugcucucacugcacacugcuagcggguuacgacuguuuaguguucucucccuugccuggggauucauagcggauguggaccuggagucugagaaauacagaagguugggcgaaaugcgguuuacccuagguacauuccugcgucucgcagcccugcgcaccuauagagggaggcuugcuuaccugcccgucggacgggugggcagcaagacuccugccuccccaguggucguucagcaaggcccgguggaugcacauuugguaccccucgaggaaccugugccaucacacuggacagucgugcccgacgaggauuuuguucugguguuagcucugcuacacagucaucucgggagcgaaauguucgccgcgccuaugggacgaugugccgcuggugucaugcaccuguuuuaugugcgcgcuggcguaucuagagccaugcuuuugaggcuguuccucgcuauggagaaagggcggcauauggaguacgaaugcccauaucugguuuacgugcccgucguggccuuucgccuugagccgaaggacggaaagggcgucuucgcaguggauggugaacugaugguuuccgaggccgugcaggggcagguacacccuaacuacuucuggauggucucaggcuguguggaacccccaccuagcuggaaaccccagcaaaugccacccccugaggagccauuguga

SEQ ID NO: 63115 - RNA, 1788 nt, Artificial Sequence
  derived and/or modified sequence opt3 from SPHK2__Homo_sapiens__NP_001191087
augaacggccaccuggaggccgaggaacagcaagaccaggcucuccauauccagagacuuaggcccaagccugaagcacggccacgcgggggacuggugccguuggccgaggucagcgguugcuguaccuuacgaucccguucucccucagauagugcggcuuacuucugcauuuauacauacccuagaggcaggcgcggggcccggagaagggcaacucggacguuucgcgccgacggagcugcaaccuaugaagagaaucgagccgaggcucagagaugggccacagcgcugacuugucuacucaggggccugccacuucccggugauggggaaauaaccccugaccuguugccacggcccccucgucuccugcugcucguuaacccauucggaggccgcggcuuagcauggcaauggugcaaaaaucacgugcugccgaugaucagcgaggccgggcuuuccuuuaacuugauucagacagaaagacagaaucaugcuagggagcugguacagggacuaucucucucggagugggaugguaucgugaccgucucaggcgacgggcugcuucacgaagugcugaacggauugcucgaucggcccgacugggaggaagccguuaagaugccugugggcauucugccaugugguagcgggaaugcauuagcuggagccgucaaccaacauggcggcuucgagcccgcgcuggggcucgaucuucuguugaauugcagucuacugcucugucgaggagguggccacccucuggaccuucuguccgugacuuuggccucugggagccgcugcuuuuccuuccucucaguagcauggggauuuguuagugauguggacauccagagcgaaagauucagggcucugggcucugcccgguuuacauuagguaccguccuggggcuagcuacgcuccacacuuaccgcggcagacuguccuaucuuccagccaccguggagcccgcaucaccgacacccgcccauagcuugcccagggcuaaaagugagcugacucucaccccagauccugcgcccccaauggcacacucuccccugcaucguuccgugagcgaccuuccucugccauugccgcagcccgcccucgcuucgccuggaucuccagaaccccugccuauauuaucccugaacggcgggggaccagagcuagccggugacuggggcggggcaggagaugccccucucucaccggacccucugcuuaguagcccacccggcuccccuaaggcugccuugcacucucccgucagcgaaggugcaccaguuaucccucccucaagugggcugccacucccgacaccugaugcgcgggugggcgcuuccaccuguggacccccagaccaccuguuacccccucugggcacgccacuucccccugauuggguaacuuuggagggggacuucgugcucaugcuggccauuagcccgucucaucuaggagcagaucuggucgccgcuccacacgcccgauuugacgauggucucgugcaucugugcuggguuagaucaggcaucaguagggcagcucuuuugcgccuguucuuagccauggaacgggggagccacuuuucccucggauguccccagcugggcuacgcggccgcuagagcauucaggcuugagccucugacaccacgcgguguguugaccgucgacggggagcaaguggaauauggcccccuccaggcccagaugcauccuggaauuggcacucugcuaacagggccgcccggaugcccaggccgagagccuuga

SEQ ID NO: 63116 - RNA, 5103 nt, Artificial Sequence
  derived and/or modified sequence opt3 from SPHKAP__Homo_sapiens__NP_001136116
auggacggcaacagccugcucuccgugcccucuaaucuugaaucaaguagaauguacgauguccuggaaccucagcaagggaggggaugcgguagcuccggcucugggccaggaaacucgaucaccgccuguaagaaaguuuugcggucaaauagcuuacuggagaguacagacuauuggcuacagaaccagcgcaugccgugccagauuggcuucguggaagauaaguccgagaauugugcuucuguaugcuuugugaaccucgacgucaauaaagaugaauguagcacugagcaucugcaacagaaacuugugaacguuucccccgaccugccuaaauugauaucaaguaugaaugugcagcagccaaaggagaacgaaaucgucgugcucagcggucuggcaucugggaaucugcaagccgauuucgagguaucccagugccccuggcucccugacauuuguuuaguucagugcgcgcgaggaaaccguccaaauucaacgaacuguaucauuuuugaaaucaauaaguuccugauaggccuugaguuggugcaggagagacaacugcaccuagaaaccaacauccucaaacuggaggaugacacaaacugcagccuuaguucuauugaagaggauuuucugacugcuuccgaacacuuggaggaggaaagcgaggucgacgaaucgaggaaugauuacgagaacaucaaugugucugccaacgugcucgaauccaagcagcugaaaggcgcaacccaggucgaguggaauuguaacaaggagaaaugguuauaugcccuggaagacaaguacauuaauaaguaucccacaccucucaucaaaaccgagcggucaccagaaaaccuuacuaagaauacagcucugcaaaguuuggacccgagcgcaaaacccucccaguggaagcgcgaggccguugggaacggaagacaggcuacccauuacuaucacucugaagccuucaaaggucagauggaaaagagccaagcgcuauacauaccuaaagaugcauacuuuucaaugauggacaaggaugugccaagugccugcgcuguagccgagcagagguccaaucugaaccccggcgaccaugaggauacgcggaaugcacucccuccacgccaggacggggaggugacuaccggaaaguaugcuacaaaccuggccgaaagcguccuucaggaugcguucauucgacugucucaaucacagaguacuuugccccaggagagcgccguguccguuucugugggcucgagccuccugccguccugcuacucaaccaaagacacagucgugaguagaucuuggaaugaguuaccuaagaucguaguugugcagagccccgaugguuccgacgcagcuccacaaccugggauuucaagcuggcccgaaauggaggucucuguggaaaccuccaguauccugagcggagagaacucuuccaggcagccacagucagcccuagaagucgcucucgccugugcagccacggugaucggcacuauuaguagcccccaggcuacagagcggcugaaaauggagcaaguugugucgaacuuuccuccaggcuccucuggggcgcuucagacccaggcaccgcaaggauugaaggaacccagcauaaaugaguauucauucccuagugcccugugcgguaugacucagguagcuuccgccgucgcaguguguggccucggggaacgugaggaaguuacaugcucuguggccccaagcggaucccugcccccugcugccgaggcaucagaggcgaugccaccccuuuguggccuggcuagcauggaauuggguaaagaggccaucgcaaaggggcuccugaaggaagccgcuuuaguccugacccgcccgaacacguacaguucuauuggcgauuuucuagacuccaugaauagaaggaucauggagaccgccagcaaaucgcagacacucugcucagaaaacgugguacggaaugagcuggcacacacucuuucuaacgugauauugcgacacaguauugacgagguucaucacaagaauaugaucaucgauccuaacgacaaucgccauuccagcgaaauucuggauacccucauggagucuacaaaccagcuguuacuggacgucaucuguuucacuuuuaaaaagaugagccacauugugagacuuggagaaugcccagcuguguuguccaaagagaccauaaggcggcgcgagacagaacccucaugucaaccuagugaucccggcgccagccaggcguggaccaaggccacugagucuuccucaaguagcccacucuccaauucucacaacacgucgcuggucaucaauaaccuaguugacgggauguauagcaagcaggauaaaggaggugugagaccuggccuguucaagaaucccacacuccagucacaacuguccaggagucaucgugugccagacucuagcaccgcuacuaccuccucaaaagaaauuuaccuuaaggggaucgcaggagaggauacaaaaucuccgcaccauagcgaaaacgagugccgggccaguuccgagggccagcgaagcccuaccguaucucagucaagauccgguagucaggaagcugaggaaagcauccaccccaacacucaagagaaguauaauugugccacaucgaggauuaacgaaguccaggugaauuugucucuguuaggggacgaucuccugcuuccagcacaguccacgcugcaaaccaagcaucccgacauauacugcaucacugauuucgcggaggaguuggccgacacaguugugagcauggcuaccgaaauugccgcaaucugccucgacaacucaaguggcaaacagccuugguuuugugcuuggaagcgcggaucugaguuccugaugacaccaaauguccccugccggucccuaaaaagaaagaaagaaagccagggcucagggacugccgugaggaagcacaaaccuccgcgccugagugagauuaagcgaaagaccgaugaacacccagagcucaaagagaagcugaugaaccggguuguggacgaaagcaugaaucuugaggauguacccgacuccgucaacuuguuugcaaaugaaguggccgcuaaaaucaugaaccugacggaguucucuaugguggauggaauguggcaggcgcaagguuacccucguaauagauuacucagcggcgacagguggucccgccugaaggccucaucuugugagaguauaccagaagaggauucggaagcacgggcuuaugucaacagccuugggcugauguccacccuaucucagcccguuucaagagccagcuccgugaguaaacagucuagcugcgagucaaucacagacgaauuuuccagguucaugguaaaucagauggagaacgagggacgaggcuuugaacuccuguuggauuacuaugccgguaagaaugcuaguagcauucugaacucugcaaugcaacaggccugucgcaaguccgaccauuuaucagugcggccuagcugcccgucgaaacagucuaguacugaguccaucaccgaagaguucuacagauauaugcucagggauauugaacgugacagccgcgagucagcguccucucggagaagcagucaggauuggacagcugggcugcuuucccccagccugaggucuccagucugucaccgacaaucaaguaugccugacucccggagccccugcucucgcuugacugugaacguuccaaucaaggccaauucgcucgacggcuuugcacagaacuguccucaggauuuccugucagugcagcccgucagcuccgccaguucuagcggacuaugcaaauccgacucaugucuguacagaaggggcgggaccgaucauauaacgaauaugcuuauucacgagacaugggcuaguucuaucgaagcacucaugcggaagaacaaaauuaucguggacgaugccgaggaagcggacaccgagccaguuagcggaggcuccccgucacaagcugaaaagugcgccaaucgacuggcagccagcagaaugugcucugguccuacuuugcuggugcaggaguccuuagauuguccccgcaaggacagugucacagagugcaaacagccacccguaagcucgcucuccaagaccgcuucucugacuaaccacucaccucuugauagcaaaaaggaaaccaguuccugucaagacccagugcccauaaaucauaaaaggcguucucugugcagccgggagguuccuuugauccagauugaaacagaucagagagaggccugugcaggggagccggaaccauuucucucaaaguccagucugcuagaggaagcugagggacacagcaacgacaagaauauccccgacguggucaggggcggugauacggccgugucugcgugccagauucauucagacucccuggauacccgcgacguaccugaagccgaggcaagcacugaggcucgagcccccgaugaagcuccaaacccucccucuaguucggaggaauccacaggcagcuggacccaacuugcaaaugaggaagacaacccagaugacacaucaucuuuccuccagcugagcgagagauccaugaguaaugggaacucaucugccacuagcuccuugggaaucauggauuuagacauauaucaggagaguaugccuagcuccccgaugauuaaugaacugguggaggagaagaagauccucaaaggccagucugagucaaccgaagcccccgcuagcgggccaccuacgggaacagcgucgccccaacggucccugcuugucaucaacuuugaucuggagccagaguguccugacgcagaauugagggccacccuacaguggauugcugccagugagcugggcauccccacuauuuacuucaagaaaucucaggaaaaucgcauagagaaguuccucgauguugugcagcuggugcaccguaaaagcuggaaggucggugacaucuuucaugcagugguucaauacugcaagaugcacgaggaacagaaagacgggagacuuucauuauucgauuggcugcucgaguugggauga

SEQ ID NO: 63117 - RNA, 816 nt, Artificial Sequence
  derived and/or modified sequence opt3 from SPI1__Homo_sapiens__NP_001074016
augcugcaggccugcaagauggagggcuucccccucgugccuccacaaccgagcgaagaccuuguccccuacgauaccgaccuguaucagagacagacacacgaguacuauccuuacuuguccucugauggggaaucacauagugaccacuauugggauuuucauccacaccauguucacagcgaguucgaauccuuugcugagaacaauuucacugaguuacagucugugcaacccccucagcugcagcagcuauacaggcacauggaacucgagcaaaugcauguacuggacacgccaauggugcccccucacccaucgcuuggacaucaggucucauaucugccgcggauguguuugcaguaccccagccucaguccugcacagccauccucugaugaagaggagggugaacgccaaucacccccucuggagguguccgacggcgaagccgaugggcuggagccaggacccggccucuuaccgggugaaaccgggagcaaaaagaaaauccgacuguaccaguuucuuuuggaccugcuacguaguggagauaugaaggacagcauuugguggguugauaaagacaagggcacauuccaguuuucuuccaagcacaaagaggcgcucgcucacagauggggcauacaaaaggggaacaggaaaaagaugacuuaucagaaaauggcccgggcacugcgcaauuacggaaagaccggugaggugaagaaagucaagaaaaagcugacauaucaguucucaggcgaagugcuugggagaggaggcuuggccgagaggcggcauccuccccacuga

SEQ ID NO: 63118 - RNA, 516 nt, Artificial Sequence
  derived and/or modified sequence opt3 from SPIB__Homo_sapiens__NP_001230927
auggccagcuccaugaccuggacagcugcaucuauccccgccacucugauucagagaggccuccuuacgcuggugccuccagcguacgcuccguaucccucaccugucuugagugaggaagaggacuuaccacuggauagccccgcccuagaaguuuccgacucugagucggaugaagcacucguggccgggccugagggaaaggguucagaggcuggcaccaggaagaagcugcggcuuuaccaauuccuguuggggcuccugacacgcggagacaugcgagaaugcguaugguggguggagccaggcgccggugucuuucaguucagcaguaaacacaaggaacugcucgcacguagaugggggcagcagaaaggaaacaggaagcggaugacuuaucaaaaguuagcucgcgcccugagaaauuacgcgaaaaccggcgagauaaggaaggugaaacggaaacuuacauaucaguuugauuccgcauugcugcccgccguucgccgagcuuga

SEQ ID NO: 63119 - RNA, 747 nt, Artificial Sequence
  derived and/or modified sequence opt3 from SPIC__Homo_sapiens__NP_689536
augaccugcguggagcaggacaagcugggccaagccuucgaagaugcuuuugagguccucagacagcacagcacaggggaccuucaguacucccccgauuauaggaacuaccuggcauugaucaaucaucggccucacguuaaaggaaacucuucauguuaugguguguuaccaacugaggaaccgguauacaauuggcgcacggugauuaacagugccgcggacuucuauuuugaaggcaauauacaucagagccugcaaaacaucaccgagaaucagcuaguccagcccacacuccugcagcaaaaagggggaaagggccgaaagaaacuucgucuguucgaguacuugcacgaaucccucuauaacccugagauggcuucuugcauucaguggguggauaagacuaaggguaucuuucaguucguuucgaaaaauaaggaaaaacuggccgagcugugggggaagagaaaaggaaacaggaagaccaugacauaccagaagauggcacgggcccuccgcaauuacggcagaucaggcgagauuaccaaaaucaggcggaaguuaacuuaucaauuuagcgaagcuauacugcagcgccuuaguccauccuacuucuuggggaaagagaucuuuuauucucagugugugcaacccgaccaggaauaccugagccuaaacaauuggaacgcaaauuauaacuacacauaugccaacuaccaugagcucaaucaccacgauugcuga

SEQ ID NO: 63120 - RNA, 2748 nt, Artificial Sequence
  derived and/or modified sequence opt3 from SPIDR__Homo_sapiens__NP_001073863
augcccagaggcagcagggcccggggguccaagcgcaaacgaucuuggaacaccgagugcccuucauucccaggagaacguccgcuccaggugagaagggcuggucugcggacagcaggcgccgcggcuagucuuagcgaggccuggcugcgcuguggggaaggauuucaaaauacuuccggcaaccccucuuugacggcagaggaaaagaccaucacagagaaacacuuagagcugugcccuagaccaaagcaggaaacuaccacaucgaaaucaaccagcggucuaacugacauuacauggaguuccucugggagcgaucucuccgacgaggauaagacccugucacagcuucagagggacgaacugcaauucauagauugggagaucgacagugaucgggccgaggcuagcgacugugaugaauuugaggacgaugaaggagcagucgagauuucugacugcgccuccugugcuucaaaucagagcuugacgagugaugaaaagcucucugagcugcccaaaccuuccagcaucgagauucuggaauacucgucugacuccgagaaggaagacgaucucgagaacguuuuacugaucgacucagaaaguccacauaaauaucacgugcaguucgccagcgaugcgcgccagauaauggagcgacuuaucgaccccagaacuaaguccaccgagacaauuuugcauacuccucaaaaaccaaccgcaaaguuuccgaggacacccgaaaauucugccaagaaaaagcugcuacggggcggccucgcugagcgucugaacgggcuucagaaucgcgaaagaagcgccaucucacuguggaggcaccagugcauuaguuaccagaaaaccuuguccggacgaaagagcgguguacucacggugaaaauccuggaguuacaugaagagugugcaaugcaagucgcuaugugcgagcagcugcucggcucuccugccacuucaaguagccaguccguggcgccacggcccggggccggacuuaagguucuguucacaaaagaaaccgcaggcuauuugcgcgguagaccucaagauacugugaggauauuuccacccuggcagaagcuaauuaucccgucugggucguguccugucauucugaacacauacuucugcgagaaggugguagcuaaagaagacagcgagaagaccugugagguuuauugccccgauaucccacucccucggcgcuccaucucacuggcccagauguuugugauuaaaggacuuacgaauaacagucccgaaauacaggucgugugcucuggcguggcuaccacaggcacugccuggacccacgggcacaaggaggcaaaacaaagaaucccaacaagcacuccccugagggacuccuugcucgaugucguugaaucacagggagccgcuagcuggccuggugcgggcgugcguguagugguccagcggguguacucucugccaucccgagacaguaccagagggcagcaaggagcaagcucuggccauacagauccggccgguaccagggcuuguuuacugguucaggacgccugcgggauguucggcgaggugcaccuagaauuuacuauguccaaggcacgccagcucgagggaaagucauguagucuggucggcaugaaagugcuucagaagguaacgcgggggagaacagccggaauuuucagcuugaucgacacccuguggcccccugcuauaccacucaaaacucccgguagggaucaaccuugcgaggaaauuaagacccaucugccacccccggcccuuuguuauauccugacagcacacccuaauuugggccagaucgacauuaucgaugaggacccaauuuacaaacucuaccagcccccuguuacccgcugccugcgagauauauuacagaugaacgaccuggggacucgguguucguuuuaugcgacagugaucuaccaaaagccccagcuaaagucccuccugcuuuuggaacagcgugagauuuggcugcucgucacggaugugacccugcaaacuaaagaagagagagacccaagguuaccuaagacacugcuugucuauguggcucccuugugcguucucggaucugaggugcuggaagcccuagcaggcgccgcuccacacagccuguucuucaaagaugcccuccgcgaccagggucggaucguaugugcagagagaaccguccugcuuuugcagaagccgcuguuaucagugguuaguggggcuuccucuugcgaacucccuggccccgugaugcuggauagccuugacuccgccacaccagucaauucaaucuguagcgugcagggaacuguagugggcguugaugagaguaccgcguuuucuuggcccgucugcgacaugugcgggaacggaaggcuggaacaacgaccugaggaccgcggugccuucuccuguggcgauugcagccggguggugacgucgccagucuugaaaagacaucuccagguuuuucuggacuguaggucacguccccagugccgcgugaaggugaagcuacugcagcggucuauuaguucccuccugagauucgcugcaggggaggauggaagcuacgaaguaaaaucuguccuuggcaaggagguggguuugcugaauuguuuuguucaaagcgugaccgcccacccuacauccugcauaggguuagaagagaucgagcuccugucagcuggcggagccagugcagaacauuga

SEQ ID NO: 63121 - RNA, 789 nt, Artificial Sequence
  derived and/or modified sequence opt3 from SPIN1__Homo_sapiens__NP_006708
augaagacccccuucggcaaaacaccugggcagagaagcagggccgacgcuggacacgccgguguguccgcaaacaugaugaagaaacggacuucucauaagaaacaccgcucaagugucggcccaagcaagccgguuucccaaccccgacguaauaucguggggugcaggauucagcauggauggaaggagggcaacgguccuguaacgcaguggaaagggaccgugcuggaucaggucccagugaaucccucucucuaccuuauaaaguaugacggauuugauuguguuuacggccuggaauugaacaaagacgagagagugucggcguuagaaguccugccugaucggguggcuacaucacgcaucagcgacgcccaccuagcagauacuaugauuggcaaggccguagagcauauguucgaaaccgaggacgggaguaaagaugaguggagaggaaugguucucgcuagggcaccagugaugaauacaugguuuuauaucaccuacgaaaaggaccccguccuguauauguaccaacuucuggaugacuauaaggagggugauuugcggauuaugccugacuccaacgacucuccaccggccgaacgcgagcccggcgaggugguggauagccucgucgggaaacagguugaauacgcuaaggaggacggauccaaacgaacuggcauggugauccaccagguagaagccaagccuucaguguacuucauaaaauuugaugacgauuuccacaucuaugucuacgaccuggugaagacaaguuga

SEQ ID NO: 63122 - RNA, 777 nt, Artificial Sequence
  derived and/or modified sequence opt3 from SPIN2A__Homo_sapiens__NP_061876
augaagacccccaacgcccaggaggcugaaggccaacagacaagagcagccgcggggagggcuacuggaagcgccaauaugacgaaaaagaaagugucccagaagaaacagcggggucgcccuucuucacaaccacgacguaacaucgucggcugcagaauuagucacggguggaaggagggagacgaaccgauaacccaguggaagggcacaguucuggaucaggugcccaucaauccuagccucuaccuuguaaaauaugacgguauugauuguguguacgggcuggaguugcauagggacgaacgggucuuaucccugaagauccuaucugaucgcguggcaucgucacacauuagcgacgccaaccucgcuaauacuaucauaggaaaagcaguugagcauauguucgagggcgaacacggcaguaaggaugaguggagagggauggugcuggcccaggcuccaaucaugaaagccugguuuuauauuaccuacgaaaaggaccccguccuuuauauguaccaacuguuggaugacuauaaggagggagaucucaggaucaugccugaguccucugaaagcccacccacagagcgggaaccugguggcgugguagacgggcugauuggaaaacauguugaguacaccaaggaagauggcuccaaacgcaucgguauggugauacaccaggucgagacuaagccaucaguguacuucauuaaauuugacgacgauuuccacaucuauguguacgaccuggucaagaaaaguuga

SEQ ID NO: 63123 - RNA, 240 nt, Artificial Sequence
  derived and/or modified sequence opt3 from SPINK1__Homo_sapiens__NP_003113
augaaggugaccggcaucuuccugcucagcgcccuugcucuguuguccuuaucugggaacacaggagcagacucacuggguagagaggccaaaugcuacaaugaacuaaacggcuguacuaagauuuaugaucccgucugcgggacggacggaaauaccuacccuaacgaguguguucucugcuuugaaaauaggaaacggcagacaaguauacugauccaaaagagcggcccauguuga

SEQ ID NO: 63124 - RNA, 405 nt, Artificial Sequence
  derived and/or modified sequence opt3 from SPINK2__Homo_sapiens__NP_001258647
auggcccugagcgugcucagacuugcucuguuguuacuggcagucaccuucgccggcuccgcgaggucugggcccggagagcgggguccuccagaaaagucaggcuuugggagucagacaggaggcgguccgugccccgcuccugggggacuaggcgacggcacucgcgccccaguuaccgggggaagccccgaggaucucccugcaucccugaucccacaauucggucuguuuucuaaauaccgaacgcccaacuguucgcaguaucgucuuccuggcugcccaagacacuucaauccggugugugggucagacaugagcacauacgccaacgaaugcacuuuguguaugaagauuagggagggaggccauaauauaaaaaucauucggaacggucccugcuga

SEQ ID NO: 63125 - RNA, 261 nt, Artificial Sequence
  derived and/or modified sequence opt3 from SPINK4__Homo_sapiens__NP_055286
auggccgugagacagugggucaucgcucuggcacucgccgcgcuucugguuguggacagggagguacccguggcugccggcaaguugccuuucagccggaugccaauuugcgaacacauggucgaguccccgaccuguucucaaaugucaaacuuagugugcgggacagauggacugacuuacacgaaugaaugucagcuaugccucgcacgcauaaaaaccaagcaggacauccagauuaugaaagaugguaaguguuga

SEQ ID NO: 63126 - RNA, 3285 nt, Artificial Sequence
  derived and/or modified sequence opt3 from SPINK5__Homo_sapiens__NP_001121170
augaagaucgccaccgugagcguccugcucccccuugcucugugcuugauucaggacgcagccuccaaaaacgaggaucaagaaaugugucacgaguuccaggcguuuaugaagaauggcaaauuauucugcccucaggacaagaaauuuuuccagucucuggaugggauaauguuuaucaacaagugugcuacaugcaagaugauucuagaaaaagaggccaagucacaaaagagagcaaggcaucucgcccgggcuccaaaggcaacugccccgacggaacugaauugugacgauuucaaaaagggagagcgcgacggugauuuuaucugccccgacuacuaugaggcuguuuguggcaccgaugggaagacauacgacaaccgaugcgcccuuugugcggaaaaugcaaaaacuggaagucagauuggcgugaaaagcgagggugaaugcaaauccucuaacccugagcaggauguauguucggccuuccguccauuugugagagacgggaggcugggaugcacccgggagaaugaucccgucuugggcccugacggcaagacacacgggaacaaaugcgcuaugugugccgaacucuuccugaaggaggcagaaaaugcuaaacgcgagggagaaaccagaaucaggcggaacgccgagaaggacuuuugcaaggaguaugaaaaacaggugcgcaauggucgacuguucuguacuagagagucagauccaguuaggggccccgacgggcggaugcauggaaacaagugcgcgcucugugccgaaauauuuaaacaacguuucagcgaggaaaauaguaagacagaucagaacuuaggcaaagcagaggagaagaccaaggugaaacgcgaaaucgucaagcugugcucccaguaccagaaucaagcuaaaaacgguauucuuuucuguacgagagagaacgacccuaucagggggccagauggaaagaugcacggcaauuugugcucuaugugucaggccuauuuucaggcugaaaacgaggagaaaaagaaggccgaagcacgggcccgaaauaaacgcgagagcggcaaggcuacuuccuacgcggaacugugcucagaguauagaaaacuugugaggaacgggaagcucgcauguacccgggaaaaugacccgauucaaggacccgaugguaaaguacauggcaacacaugcaguaugugcgagguuuucuuucaggccgaggaagaggaaaagaagaaaaaggaggggaaaagccgcaauaagagacagucuaaauccacugcuucauucgaggaacuguguagcgaguacaggaagagucguaaaaacggacggcuuuucugcacccgagaaaaugacccuauccagggcccagaugguaagaugcacgggaacacauguucuaugugcgaggccuucuuucaacaggaagagagagcaagggccaaggcuaaacgcgaagccgcaaaggagauauguuccgaguuccgggaccaggugagaaauggcacccugauuugcacgagggaacacaaccccguccgcggaccugauggcaaaaugcaugggaauaagugugcgaugugcgcuagcguguuuaaauuggaggaagaggaaaagaagaacgacaaagaggagaagggaaaaguggaagccgagaaggucaaacgagaagcaguucaggagcucuguucggaguaccggcacuaugugcguaaugguagacugccaugcacuagggaaaacgaccccaucgagggcuuagaugggaagauucauggaaacacauguucuaugugcgaagccuucuuucaacaggaggcuaaggaaaaagagcgcgccgagccgcgggcaaagguaaaaagagaagcugagaaggaaaccugcgacgaguucaggcgacugcuccagaauggcaaacuauuuuguacucgcgaaaacgauccugugcggggucccgacgggaagacacacggcaauaagugcgccauguguaaagcggucuuccagaaggagaacgaggaaagaaaaaggaaggaggaagaggaucaacguaaugccgcuggacacggcuccucagggggagguggcgggaacacccaggacgaaugcgcagaguaccgcgagcagaugaaaaauggacggcugaguuguacgagagaaagcgauccagugagggacgccgauggcaaguccuauaacaaucagugcaccauguguaaagcuaaguuggagcgagaagccgagcggaagaacgaguacucucgcagcagaucaaaugguacagggagugaauccggcaaagacacuugcgaugaguucaggagccaaaugaagaacggaaaacuaaucuguacccgggaaucugacccuguucgaggccccgaugggaagacacauggaaauaaaugcacuauguguaaggagaagcuggaaagagaggcagcggagaaaaagaaaaaggaagacgaggaccgcucaaacaccggcgaaaggaguaauacaggugagcguagcaacgauaaagaagaccucugccgggaguuuagauccaugcagaggaacgggaagcugaucugcacccgcgagaauaacccagugcgaggacccuauggcaagaugcacauuaauaaaugugccaugugccagucuauauucgauagagaagcuaacgagcggaagaaaaaggacgaagagaaaucgagcuccaagccuucaaauaacgccaaggaucaauguaggcagguccagaaugaagcagaggacgcuaaauuucgccagccaggucguagucuugccucuguggcaagaaugagcacugaugagugcuccgaauuucggaacuacaucaggaauaacgagcugauuuguccgcgcgaaaaugaccccguacauggcgccgaugggaaguuuuauacgaacaaaugcuacaugugucgagcuguuuucuugacagaggcgcucgagagagccaagcugcaagaaaaaccuucacacgugcgggcaagccaggaggaagacucuccagauuccuuuaguagcuuagacucugagaugugcaaggauuacaggguccugccccgcaucggauaucuauguccuaaggaccucaaaccagugugcggcgacgaugggcagaccuacaauaaccccuguaugcugugccaugaaaaucuuauaagacagacuaacacccacauuagguccacaggaaagugcgaggagucaaguaccccgggcacuacagcugccagcaugccuccaucggacgaauga

SEQ ID NO: 63127 - RNA, 243 nt, Artificial Sequence
  derived and/or modified sequence opt3 from SPINK6__Homo_sapiens__NP_001182219
augaagcugagcggcauguuccuccuucuguccuuggccuuauuuugcuuccugaccgggguguuuucucagggaggucaaguggacuguggcgaguuccaggaucccaaaguuuacugcacaagagaaucaaacccucacugugggagugacggacagacuuauggcaauaagugcgcuuuuuguaaagcaaucgucaagagcggugggaaaauuucccuaaagcauccaggaaagugcuga

SEQ ID NO: 63128 - RNA, 258 nt, Artificial Sequence
  derived and/or modified sequence opt3 from SPINK7__Homo_sapiens__NP_115955
augaagaucaccggcgggcugcuccuucugugcacaguggucuacuucuguagcuccucugaggccgcuucauugagucccaaaaagguugacugcagcauuuauaaaaaguacccugugguagcaauaccauguccgaucacuuauuuacccgugugcggauccgauuacauuacguaugguaacgaaugucaccugugcaccgagucucuaaaaucgaauggcagaguccaguuucuccaugacgggucauguuga

SEQ ID NO: 63129 - RNA, 1542 nt, Artificial Sequence
  derived and/or modified sequence opt3 from SPINT1__Homo_sapiens__NP_001027539
auggcccccgcuagaaccauggcaagggcccggcuggcgccugcuggcaucccagccguggcacucuggcuucugugcacauugggguuacagggaacucaagccgguccgcccccugcuccacccggccugccugcaggggccgacugucuaaacagcuucacggcuggagucccaggcuuuguucucgauaccaaugccuccgugucuaacggugcgacauuccuggagucacccacuguacgccgagggugggacugcgugcgugcauguugcaccacacagaauuguaaccuugcccuggucgaauugcagccugauagaggagaggacgcuauugccgcaugcuuucucauaaauugucuguacgaacagaacuucgugugcaaguuugcuccaagggagggcuucaucaauuaucugacccgggaaguuuaccgcaguuauagacaacucaggacucagggcuuugggggaagcgguauuccgaaagccugggcgggcaucgauuuaaaggugcagccccaggagccucugguccuuaaagacguggagaacacagauuggcgguugcugcgcggggacaccgauguacgaguugaaagaaaggacccaaaucaaguggagcuauggggacucaaagaaggcacguaccuguuccagcuuacugucaccuccucugaucaccccgaggacacagccaacgugacugugaccguccugucgacaaagcagaccgaggauuauuguuuggcaucaaauaagguugguaggugccgggggagcuuuccucguugguacuaugacccaacggaacagauuuguaaaaguuucguguacggaggcugccucggcaacaagaauaacuaccugcgcgaggaagagugcaucuuagcuuguagagggguacaaggacccuccauggaaaggcggcauccggugugcucugguacuugucagccuacacaguuucgaugcagcaauggcuguugcauagacuccuuccuggagugugaugacacccccaacugcccagaugccucagacgaggcugccugugaaaaauauacaaguggguuugaugagcuccaacgcauccacuucccuagcgacaagggacauugcgucgaucuucccgacacuggccuguguaaagaaucuauuccaagaugguacuauaaccccuucuccgagcacugcgcaagguuuaccuacggugggugcuauggcaauaagaacaauuucgaagaggagcagcaguguuuggaaucaugccggggaaucagcaagaaagauguguuuggccuacgcagagagauuccuaucccaaguacggggucuguugaaauggccguggcugucuuccuggugauauguauuguaguuguggucgcgauccucggauacugcuuuuucaagaaccagaggaaagacuuucauggucaccaccaucacccgcccccuaccccagcauccagcacagugucgacuaccgaggauacagaacaucuggucuauaaucacacuacccguccccuuuga

SEQ ID NO: 63130 - RNA, 588 nt, Artificial Sequence
  derived and/or modified sequence opt3 from SPINT2__Homo_sapiens__NP_001159575
auggcucagcugugcggccucagaaggagccgggcuuuccuugcacuguugggguccuuacugcuaucuggagugcucgccgcggaccgcgagcgaucaauccacgaaaacgcuaccggugaucuggccacaagucguaaugcagccgacagcuccguccccucugcuccuagaaggcaagauucggaggaccauucaagcgauauguuuaacuacgaagaguauuguacugcaaaugccguuacgggcccaugccgggcuaguuucccgcgcugguacuuugacguggaaagaaacuccuguaauaacuucauuuaugggggaugcaggggcaauaagaacucuuaccggagcgaggaggccuguaugcuucgcugcuuucgacagcaggaaaaucccccucugccauuggguuccaaaguagugguccucgcggggcuguucgugaugguucugauacucuuuuuaggagcaucaaugguguaucugaucagagucgccaggcggaaccaggagcgugcccuucgcaccguguggaguagcggcgaugacaaggaacaauugguuaaaaauacauacguacuguga

SEQ ID NO: 63131 - RNA, 1365 nt, Artificial Sequence
  derived and/or modified sequence opt3 from SPNS1__Homo_sapiens__NP_001135921
auggccggcagcgacaccgcucccuuccugucccaggcagaugacccugaugacgggccagugccgggaacacccggucucccuggcucuacugggaacccaaagucagaggaacccgaggucccugaucaagaaggacuucagagaaucacgggccugaguccagguaggagcgccuugauuguugcgguguuaugcuacauaaaucugcuaaacuauauggaccgguuuaccguagcuguguucaucuccucuuacaugguccucgcccccguguuuggguaucugggagaucgcuacaaucgaaaauaucuuauguguggcggcauugcauucuggucgcugguuacauuggggagcucauuuaucccuggagagcacuucuggcuccugcugcucacucgugguuuagugggcgucggggaagccaguuacuccaccauugcuccaacacugaucgcagaccuuuuuguggccgaucagagaucuaggauguugagcauauucuauuuugcuaucccgguaggauccggccuggguuacauugccgggucaaagguuaaagacauggcgggagauuggcauugggcacuacgggugacccccggccucggcgucguggccgugcugcuucuguucuuggucguucgcgagccuccaagaggggcuguggagaggcacagugaccugcccccucugaacccaacuagcuggugggccgauuuacgggcacuggcucgcaaucucaucuuuggacuuauuacaugccugaccgguguauugggcguggggcuaggagucgaaaucucucgaagacugaggcauuccaacccccgggccgacccgcucgugugugcgacgggccugcuugguucagccccuuuccuguuuuugagccucgcaugcgcucgugggaguauaguugccacuuacauuuucaucuucauuggcgagacccuguuaucuaugaauugggcuaucguggccgacauccugcuauaugucgugauucccacacgcagauccacugcagaagccuuucagauaguacucagccaccuccuuggagaugcuggcucgccauacuugaucgggcugauuucugacaggcuccggcgaaacuggccucccuccuuccugucagaguuucgcgcgcuucaauucagucugauguugugugcauuuguuggagcccucgguggcgcugccuuccuggggaccgcaaucuuuauagaggccgauagaaggcgggcucaguuacaugugcagggacugcuacacgaagccggcagcacagacgaucgcauugucgugccacagagagguagguccacccguguccccguggcaucuguucucaucuga

SEQ ID NO: 63132 - RNA, 1650 nt, Artificial Sequence
  derived and/or modified sequence opt3 from SPNS2__Homo_sapiens__NP_001118230
augaugugccuggagugugccagcgcugcagccggcggggcggaagaggaagaggcugacgccgaaagaaggcggcgccgacguggagcacagagaggugccggcggguccggaugcuguggcgcuaggggugcagggggagccggcgugucugcugccggcgaugagguccaaacccucucagggaguguucggcgcgcgcccacaggaccuccagguacuccgggcacgcccgggugcgcagccaccgcuaagggaccuggcgcccagcagccaaaacccgcaagccuugguagagggaggggagcugccgcggccauccuguccuugggcaacguguuaaauuaccuggaccgguauacaguagcaggcgugcuacucgauauucagcaacacuucggggucaaggaccgcggagcuggucugcuucagucuguguuuauauguucguucaugguugccgcuccuaucuuuggcuaccugggggaucgauucaacagaaaagugauuuugucaugcggaaucuuuuucuggagcgccgucacuuuuaguuccucuuucauuccacagcaguauuuuuggcuccuggugcugagcaggggccucguagguaucggggaggcauccuacucaaccauagcccccacaaucauuggcgacuuauucaccaagaauacucggacacugaugcuuaguguguuuuauuucgcuaucccuuugggaagcggccugggguacauuaccggaucuuccguuaaacaagcggccggugauuggcauugggcacuacgugucucaccagugcucggcaugaucacggggacucugauacuuauucuggugccggcuaccaagcgcggacacgccgaccaguugggcgaucagcucaaggcaagaacaagcuggcugagggacaugaaagccuuaauccggaaccgaaguuaugucuuuucuucccuggcuacuagcgccguuucguucgcaaccggugcgcucgggauguggauuccccuuuaccugcaucgcgcucaggugguacaaaagacagccgaaaccuguaauucuccuccaugcggcgcaaaagauuccuugaucuucggagccaucacguguuuuacuggcuuccuagggguggucacaggagcuggugccaccagauggugcaggcugaagacucagcgggcagacccccucgugugugcuguuggcaugcuggggucagccauuuuuauaugccuuaucuucguggcggccaaaaguagcauugucggagcuuacaucugcauauuugugggcgagacacuguuguucuccaacugggcaauuaccgccgauauccucauguauguaguuaucccuacgcgcagagcuaccgccguggcacugcagucuuuuacaagccacuuacugggugacgcggggucaccauaccuaauuggcuucaucagugaccucauuaggcaauccacuaaggauagcccccugugggaauuucuuucuuugggauaugcccugaugcucuguccguucgucgugguccugggcgggauguuuuuccuugcuaccgcccuguuuuucgugucagaccgugcacgggcugagcagcagguuaaucaguuggccaugccucccgcaagugugaagguauga

SEQ ID NO: 63133 - RNA, 1191 nt, Artificial Sequence
  derived and/or modified sequence opt3 from SPO11__Homo_sapiens__NP_036576
auggccuucgcucccaugggcccugaggccagcuuuuucgacgugcuggauagacacagggaaucccuccuugcagcgcugcggcgcgggggacgagagccaccgaccgguggcucucguuuggcuucaaguagcgaagucuuagccuccaucgagaacauuauacaggacaucauuacaucucuggcaagaaaugaagcccccgcuuuuacuaucgauaacaggucgucaugggagaauauuaaguucgaggacagcguugggcuacaaauggugagucauugcacgacccggaaaaucaaguccgauucuccuaaaagcgcacagaaguuuucccucauacugaaaauccuuucaaugauuuacaagcugguacagaguaacacauaugccacuaagcgcgacaucuacuauaccgauagccaguuguucggaaaucaaacaguggucgacaacauuaucaaugauauaucuuguaugcucaaaguguccagaaggucacugcacauucugagcaccaguaagggccucaucgcugguaacuuacgguacauugaagaggacgggacuaaaguuaauugcacauguggagccaccgcgguggcagucccaucuaacauccagggcauccgcaaucuggugacggaugccaaguuuguacuuauuguugaaaaagacgcuacuuuccagcgauugcuggaugacaacuuuugcaauaagcuaucccccuguauaaugaucaccggcaagggggugccugaccucaacacaagacugcuugucaaaaagcugugggauacuuuccaugugccaguguuuaccuuggucgacgccgauccccacggaauugagaucaugugcauauauaaauacgguagcaugucgaugucuuucgaggcacaucaccucacaguuccugcuauuagguggcugggcuuacugccauccgaccucaagcggcuuaaugugccgaaagauucacugauccccuugaccaagcgugaccagaugaaacuagauaguauccugcgcagaccuuauguaacgugucaaccauuuuggaggaaggaaauggagauuauggccgacagcaagaugaaagcggaaauccaggcccucacuuuccuguccucugauuaccuuagccggguguaccugcccaacaaguugaaauucgggggauggauuuga

SEQ ID NO: 63134 - RNA, 1320 nt, Artificial Sequence
  derived and/or modified sequence opt3 from SPOCK1__Homo_sapiens__NP_004589
augcccgccaucgcugugcuggcagccgcggcugccgcauggugcuuccuccaggucgagagcagacaccuugacgcccuggcuggcggggcaggaccuaaccaugguaacuuuuuggauaaugaccaaugguuauccaccguuucucaguacgauagggacaaguauuggaaucgguuccgcgaugacgauuacuuucgaaacuggaauccaaacaaaccguucgaccaggcccuggaucccucaaaggacccuugucuaaaagugaagugcaguccacacaaaguaugugugacacaggauuaucaaacugcucucugcgucagccguaagcaucugcuucccagacagaagaaaggcaauguggcccagaagcacuggguugggccuuccaaccuggugaaauguaagccaugccccgucgcgcagucugcaaugguguguggaucggacggccauucauacacgagcaaaugcaaguuggaauuucacgccuguaguaccgguaagucccucgcuacacugugcgaugggccuuguccaugccugccggagcccgaaccuccaaaacacaaggccgagaggucugcaugcacugacaaagaacuccggaauuuagcuagccgccugaaggacugguucggagcccuucaugaggaugcgaacagaguaauuaaacccaccuccucaaauacagcccaaggcagguuugacaccaguauauugccuaucuguaaggauagccugggcuggauguucaacaaacuagacaugaauuaugaucuccugcuugacccaucugagauuaacgcaaucuaccuggauaaguaugaacccugcauuaagccguuguuuaauuccugugacucauucaaagaugggaagcucagcaacaacgaguggugcuacuguuuucagaaaccuggaggucugcccugccagaaugaaaugaaccggauccagaaguuaaguaaaggcaagucucugcucggggcuuucauaccacgcuguaaugaggagggauacuauaaggccacucaaugccacggcuccacaggucaguguuggugcguugacaaauacgggaacgaacuugcuggaagccgaaagcagggcgccgugucgugugaggaggaacaagaaaccucuggcgauuuuggguccggagguucagucgugcuguuggacgaccuagaguaugagagagaacugggcccuaaagauaaggaggggaaacucagggugcauacgcgggcagucacugaagacgaugaggacgaagaugacgauaaggaggacgagguuggauacaucugguga

SEQ ID NO: 63135 - RNA, 234 nt, Artificial Sequence
  derived and/or modified sequence opt3 from SPOCK2__Homo_sapiens__NP_001127906
augagagcccccggcugcgggaggcuggugcucccucuucuguuguuagcugcagccgcgcuggcugagggagacgccaagggucuaaaagaaggcgagaccccagggaacuucauggaagaugagcaguggcucagcuccaucucucaauacucaggaaagauuaaacacuggaaucgguuucgcgacgucccgaguagcgaucccccuuccacaacucaggcaacgccauga

SEQ ID NO: 63136 - RNA, 1302 nt, Artificial Sequence
  derived and/or modified sequence opt3 from SPOCK3__Homo_sapiens__NP_001035249
augcugaaggugagcgccguccucugcguuugugcugcagccuggugcucccagucucuugcggcugccgcagccguggcugcagccggcgggagaucagacggagguaacuuccuggaugacaaacaaugguugaccacaaucagucaguacgauaaggagguaggccaguggaauaaauuuagggacgaugacuauuuccggacuuggagccccgggaagccuuuugaucaggcuuuagacccagccaaagauccgugucugaagaugaagugcucccgccacaaaguguguauugcgcaagacucucagacggcagucugcauaucgcaucgacgucuaacccacagaaugaaggaagccggaguggaucauaggcaguggcggggccccauccucucaacauguaaacagugcccuguuguguacccaagccccgucugugguagugacgggcacacuuauuccuuccaaugcaagcuggaguaccaggcuugugugcuuggaaaacagauuucuguaaagugcgaaggccauugcccuuguccaagcgauaagcccaccuccacaucacgcaacguuaaaagagccugcagugaccuggaguuuagggaaguggcaaaucgguugcgcgacugguucaaggcucuccacgagagcggcucucagaacaaaaagaccaaaacucugcugcgaccugagagauccagguuugauacaucaauccucccaauuuguaaggacagcuuaggguggauguucaaucggcuggauaccaacuaugaccuuuugcuggaucaaagugaacuacguucuaucuaccucgacaaaaaugagcagugcacgaaggccuuuuucaacuccugugauacuuauaaggacagccugauaucgaauaacgaauggugcuacuguuuucagcgccaacaggauccgcccugccagaccgagcuuucuaauauccagaaaagacaaggagucaagaaacuguugggucaguacauuccucucugugacgaggauggcuauuacaagccaacacagugccacggguccgugggacaguguuggugcguggacagguauggcaacgaagucauggguucacggaucaaugggguugcggacugcgccauugauuucgagaucaguggagacuuugcaagcggcgauuuccaugaauggacugacgaugaggacgaugaagacgauauaaugaacgacgaggaugagauugaagacgaugacgaggacgaaggcgaugacgaugacgggggagaugaccacgauguguacaucuga

SEQ ID NO: 63137 - RNA, 2424 nt, Artificial Sequence
  derived and/or modified sequence opt3 from SPON1__Homo_sapiens__NP_006099
augagacugagccccgccccucucaaacuuuccaggaccccagcucuguuggcauuagcccugccgcuagcggcugcccucgcauucucugacgagacacuggauaaggugcccaagucagaaggcuacugcagucggauccuucgcgcccaggggacucgacgugagggauauacggaauuuagccugagagucgagggugacccugauuucuacaaaccaggcaccuccuauaggguuacauugucugcugcacccccuucguacuuucggggguucacucucauugcccugcgcgaaaacagagagggagacaaggaggaagaucacgcuggcaccuuucaaauaaucgacgaggaagagacacaguucaugucaaauuguccaguggccguaaccgagagcacucccaggcggcgcacacgaauccagguguuuuggauugcgccuccagcagguaccgggugcgucauucugaaagccaguaucgugcagaagagaauaaucuauuuccaagaugaaggaucccucacgaagaaauuaugugagcaggacucuacuuuugauggcguuaccgacaagccgauucuggauugcugugcuugcggcacagccaaauacaggcuuacuuucuaugggaacuggagcgaaaagacccaucccaaagacuacccucggcgugcaaaucacugguccgcuaucauuggagguucacauaguaagaacuacguguugugggaguauggcggguacgccagcgaaggagucaagcaggucgcggagcugggcucuccaguaaaaauggaggaagagauccgccagcaauccgaugaaguucuaacagugauaaaggccaaagcacaguggcccgcuuggcagccucucaaugucagagccgcuccaucagccgaguuuagcguggacaggacccggcaccugaugaguuuccuuacgaugaugggucccucuccggacuggaacguggggcuguccgcagaagauuuguguacuaaggagugcggauggguccagaaaguugugcaagaccucauuccuugggaugccggcacagacagcggcguaaccuaugagucgcccaauaagccaacuaucccucaggagaaaauucgaccccugacaucuuuagaucauccacagucccccuuuuacgacccugaagggggaucaaucacccaaguggcucgcgucgugaucgaaagaauugcgaggaagggugagcaguguaacauaguuccagauaauguggacgauaucgucgcagaccuggccccggaagagaaggaugaggacgacacgcccgaaaccugcauuuauaguaacuggagcccuugguccgcuuguucuagcucaacaugcgauaaaggcaagcggaugcgccagagaaugcucaaagcccagcuugaccugagugugccaugccccgauacucaagacuuccagccuuguauggggccaggaugcuccgaugaggacggcagcaccuguacaaugucugaauggaucacuuggucacccugcaguauaagcugugguauggggaugaggucccgugagcgguacguaaagcaguucccggaggauggcucuguuugcaccuugccuacagaagagaccgaaaaauguacugugaaugaggaaugcucgccaagcuccugucuaaugacggaguggggagagugggacgaaugcucagcaacauguggcauggggaugaagaagcgacacagaaugauuaaaaugaaccccgccgauggaaguaugugcaaggcugagaccucucaggccgaaaaaugcaugaugccugagugucacacuauccccugccugcucagcccaugguccgaauggucagacuguagcgugaccugcgguaagggcaugaggacacgccaacggaugcugaaaucucuugcagagcugggggauuguaaugaggacuuggaacagguggagaagugcaugcucccugaaugucccaucgauugcgagcugaccgaauggucccaguggagugaguguaacaagagcugcggaaaaggccaugucauuagaacuaggaugauccagauggagccacaauuugguggggcgccguguccugaaacagugcagcgcaagaaaugccggauucgaaagugcuuacguaaucccucuauacagaaacugagauggagggaggcucgcgaaucccggagaucagagcagcuaaaggaggaaagugagggcgaacaauucccaggauguaggaugcgacccuggacggccuggagcgagugcaccaagcucuguggcgggggaauccaggaacgcuauaugacuguuaaaaagcgguuuaaaucgucccaguucacaucuugcaaggacaaaaaggagauuagagcauguaacgugcacccuugcuga

SEQ ID NO: 63138 - RNA, 996 nt, Artificial Sequence
  derived and/or modified sequence opt3 from SPON2__Homo_sapiens__NP_001185950
auggagaaccccagcccugccgcugcacugggcaaggcccucugcgcgcuucuguuggcuaccuuaggggccgcaggacagccacuggguggcgaauccaucuguucugccagagcuccggcaaaauacucaauuacauucacugggaaguggagucaaacggccuuucccaaacaguauccucuauucaggccacccgcucaguggagcucccuccugggagccgcgcacucuucggacuacucaauguggcggaagaaucaguaugugagcaacggccuucgcgauuuugcagagcgaggugaagccugggcucugaugaaagagauagaagccgcaggggaggcuuugcaaaguguccaugccguuuucuccgcgccugccgugccaucuggaaccggccagacaagcgcagagcucgaaguacagcguagacacucccuggugucauuugucgugaggaucguucccaguccugacugguucgugggcgucgauagccuggaccucugcgauggggaccgguggcgcgagcaggcugccuuagaucuguacccauaugacgcuggaacugauucugguuuuaccuucuccucaccgaauuuugccacaauuccccaagacaccgugacugaaaucacaagcaguucuccuucccauccagcaaacagcuucuacuaucccagacuuaaggccuugccuccaauugcuaggguaacccugguucggcuacgccagucgccccgagcguuuaucccgccugcacccgugcucccaucuagagauaaugagauagucgacuccgccucagugccugagacgccccuggauugugaagugagucuuuggagcuccuggggccugugcgggggacacuguggcagguuggguacuaagucucggacccguuacguccgcguucagccagcuaacaaugggagccccugcccugagcucgaagaggaagccgagugugugccagacaacugcguauga

SEQ ID NO: 63139 - RNA, 1125 nt, Artificial Sequence
  derived and/or modified sequence opt3 from SPOP__Homo_sapiens__NP_003554
augagcagagugcccuccccuccaccgcccgccgagaugucuucaggcccugucgcugaaaguuggugcuacacccagaucaagguugugaaauucagcuauauguggacaauuaacaauuuuuccuucuguagggaggaaaugggggagguaauaaagucuucgacuuuuucaagcggagcaaacgacaaacugaaguggugccuccgggugaauccaaaaggucuugaugaagagaguaaggacuaccuguccuuguauuuacugcuagucucuugucccaagagcgaggugcgcgccaaauucaaguuuuccauccucaacgcgaaaggcgaagagacgaaggcuauggaaucacaacgagccuaccguuucguucaggggaaagauuggggauuuaagaaguucauuagaagggacuuucugcuugaugaggcaaauggccuguugccugacgauaaacucacccuguucugcgaggugagugucgugcaggacagcguaaacaucucuggucagaauacaaugaacaugguuaaggugccagaaugucggcuggccgaugagcucgggggauuaugggaaaauucccgcuuuacugacugcugucugugcgucgcuggccaagaguuccaggcacacaaagccauucuugcugccagaucacccguguuuagcgcgauguucgaacaugagauggaggaaaguaagaaaaacaggguggagaucaaugaugucgaaccugagguuuucaaggaaaugauguguuuuauauauaccggcaaagcaccaaacuuggacaagauggccgaugaccugcuagcugccgcagacaaguacgcucucgagcggcugaaagugaugugcgaggaugcccuuuguucuaaucuguccguagaaaacgcggccgagaucuugauucucgcagaccugcacagcgcugaucaguuaaagacacaggccguggacuucaucaauuaucaugcuucggauguccuggaaaccucuggguggaaauccauggugguuucacacccgcaucucguggccgaggcauaccgcagucuugccagcgcucaaugccccuuucugggaccuccacgaaagagauugaaacaguccuga

SEQ ID NO: 63140 - RNA, 903 nt, Artificial Sequence
  derived and/or modified sequence opt3 from SPP1__Homo_sapiens__NP_000573
augagaaucgccgugauuugcuucugucugcucggcauaaccugcgcuauccccgucaagcaggcagacagcggguccucugaggaaaaacaacuuuacaacaaguauccugaugccguugcgacauggcugaauccagacccgucacagaaacagaacuuguuagcuccccagacucugccuaguaagagcaaugagucccacgaucauauggacgauauggacgaugaagacgaugacgaucacguggacucucaagauucgauugacucaaacgacagcgaugacguagaugacacggaugacagucaucaguccgaugagucucaccauagcgacgaauccgaugagcuagugaccgacuuuccaacagaucuccccgccacugaggucuucaccccugugguuccaacaguggacaccuacgacggaaggggugauucagucguguauggccugcggaguaaaagcaagaaguuucgccgacccgacauccaguacccugaugcaacugacgaagauauuacaucucacauggaguccgaagaacuuaauggggccuauaaagcuaucccaguagcacaggaccugaacgccccgucagauugggacagccguggaaaggauaguuacgagaccucucaauuggacgaucaguccgcugaaacgcacagccauaaacagucgagacucuauaagaggaaagccaaugacgagucuaacgaacacuccgauguuauagacucacaggagcugaguaaggugagccgggaguuccauucccacgaguuucacucucaugaggacaugcuggucguggaucccaagagcaaagaagaggacaagcaccucaaauuccgcaucucacaugaauuagauagugcguccagcgaggugaauuga

SEQ ID NO: 63141 - RNA, 636 nt, Artificial Sequence
  derived and/or modified sequence opt3 from SPP2__Homo_sapiens__NP_008875
augaucagcagaauggagaagaugaccaugaugaugaaaauucugauaauguucgcccucggcaugaacuacugguccugcucuggguuucccguguaugacuacgauccuucaagucuuagggacgcucugagcgcauccgucguuaaggugaauagccagucguugucaccauauuuauuccgggccuuucgcagcagucugaaacgaguagaagugcuagaugagaacaaucucgucaugaaccuggaguucuccauccgugaaacaacuuguagaaaggacucuggagaagauccggcgacgugcgcuuuucaaagggacuacuaugugagcaccgccguuugucgguccacagugaaagucucagcacaacaggugcaggguguacacgcccgcugcaguuggucuucuuccacuucagagagcuacaguucugaggaaaugauuuucggcgauaugcuugggucccauaaguggagaaauaacuaucuguuuggauugaucagcgacgagucgauuucugaacaguucuacgauaggucccucggcaucaugcggcgcguucugcccccugguaaucgaagauacccaaaccacaggcaucgggcucguauaaauaccgacuuugaguga

SEQ ID NO: 63142 - RNA, 1563 nt, Artificial Sequence
  derived and/or modified sequence opt3 from SPPL2A__Homo_sapiens__NP_116191
augggcccccagagaaggcugagcccugccggggcugcacuccuuuggggauuccuguugcaauuaaccgccgcgcaggaggcuauccugcacgccuccgguaacggcacaacuaaggacuacugcaugcuauauaauccauacuggacggcacucccgucuacccuggaaaacgccacaucaauuagucuuaugaaucugacuagcacccccuuguguaaccucuccgauauaccuccaguggggaucaaaucuaaggcugucguugugcccuggggaucgugccauuuucuggagaaagcacggauugcccagaagggcggugcugaagccaugcugguagugaauaacucaguccucuucccuccaagcgggaaucgcagugaguuucccgacgugaaaaucuuaauugcguucaucuccuauaaggauuuucgagacaugaaccagacacugggagauaauauaaccguuaagauguacucuccuagcuggccaaacuucgacuauacuaugguggucaucuuugugauugcaguauucacaguugcccuuggcggcuacugguccggguugguggaacuggagaaucuaaaagcugucaccacggaggaucgugaaaugagaaagaaaaaggaggaauaucucacuuuuucaccgcugaccguggugaucuucgucguuauuuguugcgugaugaugguacuucuguacuuuuucuacaaaugguugguguaugucaugaucgccauauuuuguauugcaagugcuaugagccucuacaacugccuggccgcguuaauccacaagauucccuauggacaauguacaaucgccugcagggguaagaauauggaggugcggcugaucuuccucucuggccuuuguauugcaguugcuguggucugggccguguuccgcaacgaggacagaugggcuuggauacugcaggauaucuuggggauugccuuuugccuaaaucugaucaaaacucucaagcugccuaacuucaaauccuguguaauacuucugggauugcuccuguuauacgacguguuuuucguuuuuauuaccccauucaucacaaagaacggcgaaucaaucauggucgagcuggcagccggucccuuugggaauaacgaaaaacuaccuguggucauuagggugccaaagcucaucuauuucagcguuaugagugugugccugaugcccguaucuauucuuggauuuggcgauauaaucgucccgggcuugcugauugcuuacugccggcgcuucgacgugcagaccggguccagcuauaucuacuacguuucgucuacgguggcguaugcaaucggaaugauucucacuuuugucgugcugguacuuaugaaaaagggucagccugcccuguuguaccucgugcccuguacacugauaaccgcuuccguugucgccuggcgaagaaaggagaugaaaaaguucuggaaaggcaauucauaucaaaugauggaucauuuagacugcgcaacuaacgaagagaauccagugaucaguggggagcagauugugcagcaguga

SEQ ID NO: 63143 - RNA, 1536 nt, Artificial Sequence
  derived and/or modified sequence opt3 from SPPL2B__Homo_sapiens__NP_001070706
auggccgcugcaguggccgcggcucuggccagacuccuugcagccuuccuguuguuagcugcacaggucgccugcgaguacggcaugguucacgugguaagccaagcugggggacccgaagguaaggacuauuguauccuguacaacccucagugggcccaucuaccacacgaucucuccaaagcgucuuuucugcagcuuaggaauuggaccgcaucacuguugugcagugccgcugaccucccggcccggggcuucagcaaccagauuccccugguggcacgcgggaauuguacauuuuaugagaagguccgacuggcucaaggauccggcgcccguggucucuuaauagugucuagagaaaggcugguuccuccagggggaaacaaaacucaguacgaugagaucggcauucccguggcgcuuuugucguauaaggacaugcuggauaucuucacgcgguuuggccgcaccgucagagccgcacuauacgcuccuaaagaaccagugcucgacuauaauaugguaauuaucuucauaauggccguugggacaguggcuaucggagguuacugggccggcucaagggaugucaagaagcgguacaugaaacauaagcgcgacgaugggcccgagaaacaggaggacgaagcaguggaugugacuccugucaugaccugcguuuuugugguaauguguugcagcaugcuggugcuucuguauuacuucuaugacuugcucgucuacgugguuauuggaaucuuuugucuggccagugcuacaggcuuauauuccugccuggcgccaugugugcgaagacucccguucgguaagugcaggauucccaacaauucucuuccuuacuuucacaaacggccacaggcacguaugcuguugcuagcccuguucugugucgcugugagcguaguuuggggaguguuucgcaacgaggaucaaugggccuggguccuccaggacgcacuggggaucgccuucugccuuuauaugcugaagaccauaagauugcccacuuucaaggcuugcacacuccuguuacuggugcuauuucucuacgacauuuucuuugucuucaucaccccuuuucugacgaaauccggcucaaguauuaugguggaaguugccacuggcccaagcgauucugcaaccagggagaagcugcccaugguguugaaaguaccgcggcuuaauuccucaccucucgcgcugugugaccgacccuucagccuucugggguuuggagauaucuuggucccaggucuccugguggcuuacugccaucgcuucgacauccagguucagaguucuagaguguauuuugucgccuguacaauugcauacggcgugggguuacugguaacuuucguggcccuagcucucaugcaaaggggacagccugcccugcuuuauuugguucccugcacccuggucacauccugugcaguggcucucuggcggcgcgagcugggcguguuuuggaccgguagcggguucgccgucaacacgucguuacuguga

SEQ ID NO: 63144 - RNA, 2055 nt, Artificial Sequence
  derived and/or modified sequence opt3 from SPPL2C__Homo_sapiens__NP_787078
auggccugccugggcuuccuccuucccgugggguuucuguuguuaaucagcaccgucgcuggagguaaguacggcguugcacacgugguauccgagaacuggucuaaagacuauuguauucuguucucaagugauuacauaacacuaccuagagaccuccaucacgccccacugcuuccgcuguaugaugggacuaaggcgcccuggugcccuggagaagacagcccacaucaggcucaauugaggucccccucucagcggccucuccgccagacgaccgccauggugaugcgaggcaauuguucguuucacacaaaagguuggcuggcacaggggcaaggagcccauggccugcucaucgucucacgugugagcgaucagcagugcagugacacuaccuuagcuccacaggaucccagacaaccucuggcagaccuuacaauuccaguugccauguugcacuacgcugauaugcuggacauccuaucccacaccaggggcgaggccgugguccggguggcgauguaugcaccgcccgaaccuauuaucgauuacaacaugcucguaauauucauccuggccguugggacuguggcugccggagguuauugggcaggccuuacagaggcuaaucgccugcagagaaggcgggcccgccgagggggaggcucuggugggcaucaccaguugcaggaagcggccgcagcugagggagcccaaaaggaggacaacgaagauauuccagucgacuuuacccccgcuaugacgggcgugguggucacucucagcuguucccugauguuacugcucuacuucuuuuacgaccauuucguuuaugugaccaucggcauuuuugggcuuggagccgguaucggccuguacucaugcuugaguccucuaguauguagacugagccucaggcaguaucagcggccaccccacucucugugggcaucccuuccgcugccuuugcuccuguuagccucacugugcgcuacagugauaauuuucugggucgcguaccguaaugaggaucgcugggcauggcuacuccaagacacucuggggaucagcuauugucuuuuuguguugcacagaguuaggcugcccacccucaaaaacugcaguucuuuccugcuugcccuguuggcuuuugauguguucuucgucuuugugacaccauucuuuaccaagacgggagaauccauuauggcccagguagcacucggcccugccgagagcucgucucaugagcggcugcccaugguuuuaaaggugccacgacugcgcgucuccgcucuaacucucuguucacagcccuucaguauccuggguuuuggggacaucguggucccuggcuuccuuguggccuacugcugcagauuugauguucagguguguagcaggcaaauuuauuucguagcaugcacagucgcguacgcugugggauugcugguuaccuuuauggccauggugcucaugcagaugggccagccagcacuguuauaccuggucuccucuacucuuuugacaagccucgccguggcugccugucggcaggaacugucacuauucuggaccgggcaaggacgcgcaaaaaugugcggucugggcugugcuccgagugccggguccagacagaagcaggagggagcggccgacgcucacacggcaagcacccucgaaaggggcacaucucguggugccggggaucuggacucaaaucccggcgaggauacuaccgaaauaguaacaaucagugagaacgaggcuacuaauccugaagaccggagcgauuccucugagggauggucggacgcccaucuugacccaaacgaauugcccuuuauuccuccaggcgcaagcgaggaacugaugcccuuaaugccgauggcgaugcucaucccucugaugccacuuaugcccccucccuccgagcuggggcacgugcaugcccaggcucaagcccacgagaccggauugccaugggcaggucuccacaaacgaaagggccugaaaguuagaaagucaaugaguacacaggcuccucuauga

SEQ ID NO: 63145 - RNA, 1155 nt, Artificial Sequence
  derived and/or modified sequence opt3 from SPPL3__Homo_sapiens__NP_620584
auggccgagcagaccuacagcugggcuuauucccugguggacucuucacaagucaguacauuccucaucagcauucuucugauaguuuacggcuccuuuagaucuuugaacauggauuucgaaaaucaggacaaggagaaagauucgaacucaagcaguggguccuuuaauggaaacucuacuaauaacagcauccagacgauugacuccacccaggcauuauuccugcccaucggugccucagugagucuacucguaauguuuuucuuuuucgauagcgugcaagucguguuuacaauuugcacugcgguucuggcuaccaucgccuucgcauuucuucuguugccuaugugucaguaucucacaaggccaugcucuccgcagaauaagauauccuucggcuguugcgggcgguuuaccgccgcugaacugcugucauucagccucagugugauguuaguccugaucugggugcuuacuggacacugguugcugauggacgcacuagccaugggccucuguguagcuaugauugccuucguucgccugcccucucuuaaaguguccugccuguugcucagcggucuguuaaucuacgaugucuuuuggguguucuuuucggcguauauuuucaacucuaaugugauggucaagguugcaacacagccugccgacaacccacuggaugugcucucccgaaaacuucaucuggggcccaauguaggacgugacgugccuagauugucacuaccaggcaagcuggucuuucccaguagcaccggcucccacuucucuaugcucgggaucggagauauagugaugccuggucugcuucuguguuuuguuuugagguacgacaacuauaagaaacaagcuagcggcgauucaugcggggccccaggaccggcaaauauuaguggccggaugcagaagguguccuacuuccauuguacgcucaucgguuacuuugucgggcuguuaacugcuaccguggccagccgcauucacagagcggcccagcccgcacugcuauaucucguaccuuucacacugcuuccauugcugacuauggcuuaccucaaaggagaccugaggcggauguggucugagcccuuucauucaaagaguagcuccucucgcuuccuugaaguuuga

SEQ ID NO: 63146 - RNA, 1335 nt, Artificial Sequence
  derived and/or modified sequence opt3 from SPRED1__Homo_sapiens__NP_689807
augagcgaggaaaccgccacauccgacaacgauaauucuuacgcuagagugagggcagucguuaugacucgggacgauucaaguggcggguggcugccccucggagguagcggccuuuccucugugacgguauucaaggugccucaccaggaggaaaacgggugcgccgacuuuuucauccgcggagagcgacugcgugauaaaauggucguguuggaauguauguuaaagaaagaccugauuuauaauaagguuaccccaacauuucaucacuggaaaauagaugacaagaaguucggccuaacuuuucaaucgccggcggaugcuagagccuucgacagggguauccggcgcgcaauugaggauaucucacaggggugccccgagagcaaaaacgaagccgagggagcugacgaucuccaggcaaaugaagaggacaguuccucuagccuggugaaggaccaucuuuuucagcaagagaccgucgugacauccgaaccuuacagaucaaguaacauuaggccaagccccuucgaggaucugaaugcccggcgcguauauaugcagucucaggcuaaccagaucaccuuuggccaaccuggcuuggacauacagucccgaucaauggaauacguucagagacagaucagcaaagagugugggagucucaagucucaaaauagggugccacugaaauccauucggcacgucagcuuccaggaugaagacgagaucgugcguauuaacccccgcgauauccugauaagaagguaugccgacuaccggcauccugauauguggaagaaugaccucgagcgagaugacgcggauucgucuauucaguuuuccaagccagacaguaaaaagucagacuauuuauacagcugcggagaugaaacuaaacuguccucuccgaaggacagcguggucuucaaaacacaacccucaagucuuaagaucaaaaaguccaagcgcagaaaagaggauggugaaaggagccgguguguuuacugccaggagcgcuuuaaccacgaagagaaugugagaggcaagugucaggacgcaccugauccaauuaaaaggugcaucuaucagguaucuuguauguugugcgccgagucaaugcuguaccacuguaugagugacagcgaaggggauuucuccgaccccugcucuugcgauaccucggacgauaaguucugucuacguuggcucgcucugguggcccuuagcuuuaucgucccuugcauguguugcuaugugccacugcggaugugucaucgaugcggagaggcauguggcugcuguggugggaaacacaaggcugccggauga

SEQ ID NO: 63147 - RNA, 1248 nt, Artificial Sequence
  derived and/or modified sequence opt3 from SPRED2__Homo_sapiens__NP_001121682
auggccagccccggcuccgacucuuacaucgugagagucaaggcuguugugaugaccagggaugacucaagugggggaugguucccucaggaggguggcgggauuagccggguaggagugugcaaagucaugcacccagaaggcaacggucgcuccggguuucugauacauggagagcgacaaaaggauaaacucgugguucuugaauguuaugugcguaaggaccuggucuacacaaaagcaaauccgacuuuccaccauuggaagguggauaacagaaaguuuggcuugacguuccagucucccgccgacgcgagggcuuuugaucggggcguacgcaaagccaucgaggacuuaauugaagggucgaccacaucaagcaguacuauccacaaugaggcagagcugggagaugacgauguuuucaccacagccaccgacuccucuagcaacuccucacagaagagagaacagccuacuaggacaauuaguagcccaaccucuugcgagcaucggcgcaucuauacgcuaggucaccuccacgauuccuaccccacugaccauuaucaccuggaccaaccuaugccacgacccuacagacaggugucauuuccugaugacgaugaagagauagucaggaucaauccacgggagaaaauuuggaugaccggcuaugaagacuaccgucaugcuccggugcgcgggaaguaccccgauccuagcgaggacgcagauaguucuuaugugagauucgccaaaggagaagucccaaagcacgacuacaacuaucccuacguugauuccagcgacuuuggccuuggugaggauccuaaggggaggggaggcucggugaucaaaacacagccaucucggggcaagucccgacgcagaaaagaagacggggagaggucacgguguguauauugccgcgacauguucaaucacgaggaaaacagaaggggacauugucaggaugcucccgacagugugcguacuugcauucggcgagucagcuguauguggugcgccgauuccaugcuguaccacuguaugucugacccggagggugauuauaccgacccuugcagcugugauacaucagacgaaaaguuuugcuugagauggauggcgcucaucgcacugaguuuccuggcccccugcauguguugcuaccucccauuaagggcuuguuaccauugcggcgugaugugucgcugcugugggggaaaacacaaggccgcagcuuga

SEQ ID NO: 63148 - RNA, 1233 nt, Artificial Sequence
  derived and/or modified sequence opt3 from SPRED3__Homo_sapiens__XP_011525279
auggugagagucagggccguugugauggcucgggacgauagcuccggcggguggcugcccguaggagguggcgggcucucucaggugucagucugccgcgugcgaggagcacguccugagggcggugccagacaagggcacuacguuauccauggagaaaggcuucgggaccagaagaccacacuggaguguacuuugaaaccaggcuuaguguauaacaaggucaauccgauuuuccaccauuggagucugggcgauugcaaauuugggcuaacguuccagagccccgcggaagcugacgaguuucagaagucccuccuggccgcacuugccgcucugggacgcgguucuuugaccccuucgucaagcaguuccucuagcuccccaucacaagauacagcagaaacucccuguccucucaccagucacguggacagcgauucuuccucaagccauaguagacaggagacaccacccucugccgcugccgcgccuauaaucaccauggaguccgcaagcggcuucgggccaacuacaccgccccagaggcggcgcucgucugcccaguccuacccuccacugcugcccuuuaccggcauuccugaaccaucagagccccucgcuggcgccgguggguuaggauggggcggccgaggguaugaagacuacagaaggaguggaccgccugcaccccuggcucuuagcacgugcguaguucgguucgccaaaacuggugcguugcguggcgccgcacuggggcccccugcugcccuacccgcuccacucaccgaggccgcacccccugccccaccggcucgcccaccuccaggacccggcccuuccucugcgccagcaaaggccagccccgaggcugaagaggccgcaagaugugugcacugcagggcccuguuucggcgacgcgcugaugguagagggggaaggugugccgaagcaccggacccuggacggcuucugguccgcagauugucaugccucuggugugcggagagucuguuauaucacugccuguccgaugcugaaggcgacuucagcgauccaugugccugcgagcccgggcauccuaggcccgcagcccguugggcugcccucgcagcucuuucucuggccgugccaugcuuguguugcuacgcgccucuacgggccugucacuggguggcugcacgaugcggaugugccgguugcggcgggagacaugaggaagcugccagguga

SEQ ID NO: 63149 - RNA, 786 nt, Artificial Sequence
  derived and/or modified sequence opt3 from SPR__Homo_sapiens__NP_003115
auggagggcgggcugggacgagccgugugccuccuuaccggugcuagcaggggcuucgggcggacacuggcacccuuguuagccucccugcuaucuccuggaucaguccucguucugagugcgcgcaacgacgaagcucuuagacagcuggaggccgaauugggcgcagagcguagcggucucagagugguaagggugccagccgaucugggggcugaagcaggacugcaacagcucuuaggcgcccugcgggagcuuccgcgccccaagggcuugcagagacugcuacucaucaauaacgcugggucccugggagacgucucuaaagguuuuguggaucuuucggacucaacucagguuaauaacuacugggcccugaauuugacgagcaugcucugucugaccaguuccguguuaaaggcguucccugauucuccaggccugaacaggacagucgugaauauuagcucccucugcgcacuucaacccuuuaaagggugggcccuguauugugcuggaaaggccgcacgggacauguuguuccagguacuagcucuggaggaaccuaacguucgcgugcucaauuacgccccaggcccccuggauacugacaugcagcagcuugcgcgagagaccucagucgauccugacaugagaaaaggucugcaagaauugaaggccaaggggaaacucguggauugcaaggugagugcacagaaacuguuaagccugcuagagaaggacgaguuuaaaucuggagcucacgucgauuucuaugacaaguga

SEQ ID NO: 63150 - RNA, 456 nt, Artificial Sequence
  derived and/or modified sequence opt3 from SPRN__Homo_sapiens__NP_001012526
augaacugggcccccgcuaccugcugggcacugcuccuugccgcggcuuuccugugugacagcggcgccgcaaagggagggagagguggcgccaggggguccgcucggggaggcgugcgcgguggggcacgaggagccucucgugucagaguuaggccugcucagcgguacggcgccccaggcucaaguuugcgcguggcggcagccggggcugccgcaggagcugccgcgggugccgcagcuggcuuagccgcugggagcggauggagaagggccgcaggcccgggugagcgggggcuggaagaugaggaagacggaguacccggcggcaaugggacaggaccugguaucuauuccuaccgcgccuggacuucuggcgcugggccaacgcgaggacccagacuaugccucgugcugggcggugcgcuuggggcacugggcuugcucaggccuuga

SEQ ID NO: 63151 - RNA, 270 nt, Artificial Sequence
  derived and/or modified sequence opt3 from SPRR1A__Homo_sapiens__NP_001186757
augaacagccagcaacagaagcagcccugcaccccuccaccgcagccccaacagcaacaggugaaacagccuugucagccacccccucaggagccaugcauccccaagacaaaagaaccuugucacccaaaggucccggagcccugccauccuaaaguuccagaacccugucagccuaaggugccagagcccugccaaccgaagguaccugaacccuguccauccacugugacgccugcccccgcucagcagaaaaccaagcaaaaauga

SEQ ID NO: 63152 - RNA, 270 nt, Artificial Sequence
  derived and/or modified sequence opt3 from SPRR1B__Homo_sapiens__NP_003116
augagcucccagcaacagaagcagcccugcaccccuccaccgcagcugcaacagcaacaggugaaacagcccugucagccuccaccccaggagccuugcaucccaaagacaaaagaacccugucacccuaaggucccagagccgugccaucccaaaguuccugaaccaugucagcccaaggugccugagccaugccaccccaagguaccggaaccuugucccucuauugugacuccagccccugcucaacagaaaacgaagcagaaauga

SEQ ID NO: 63153 - RNA, 219 nt, Artificial Sequence
  derived and/or modified sequence opt3 from SPRR2A__Homo_sapiens__NP_005979
augagcuaccagcaacagcagugcaagcagcccugucaaccuccaccggugugccccaccccuaaauguccagagcccugcccuccacccaaguguccugaaccaugcccgcccccuaaauguccacagcccugcccuccacagcagugucaacagaaguaucccccggucacaccuucucccccaugccaguccaaauacccucccaagucaaaguga

SEQ ID NO: 63154 - RNA, 219 nt, Artificial Sequence
  derived and/or modified sequence opt3 from SPRR2B__Homo_sapiens__NP_001017418
augagcuaccagcaacagcagugcaagcagcccugucaaccuccaccggugugccccaccccuaaauguccagagcccugcccuccacccaaguguccugaaccaugcccgcccccuaaauguccacagcccugcccuccacagcagugucaacagaaguaucccccggucacaccuucucccccaugccagccuaaauacccacccaaguccaaguga

SEQ ID NO: 63155 - RNA, 510 nt, Artificial Sequence
  derived and/or modified sequence opt3 from SPRR3__Homo_sapiens__NP_001091058
augagcuccuaccagcaaaagcagaccuucacacccccuccacagcugcagcaacaacaggugaaacagccgucucagcccccuccacaggagaucuuuguccccacuacgaaggaaccuugccacucaaaaguuccacagcccggcaacaccaagauuccugagccaggguguacaaaagugccggaacccggaugcacuaagguaccugagccagguuguaccaaggugcccgaaccuggcugcacaaaagucccagagcccggguguaccaaggugccggagccuggaugcacuaaaguucccgaaccaggcuauacaaaggugccugagcccgguaguauaaaagucccagaccagggguucaucaaguuucccgaaccuggagccauuaaggugccagagcaaggcuacaccaaaguaccgguucccggcuauacgaagcucccugagccaugucccagcacugugaccccugggccagcucagcagaaaacaaagcaaaaauga

SEQ ID NO: 63156 - RNA, 753 nt, Artificial Sequence
  derived and/or modified sequence opt3 from SPRTN__Homo_sapiens__NP_001010984
auggacgaugaccugaugcucgcccuuagacugcaggaggaauggaacuugcaagaggcugaaagggaucacgcacaggagucauuaucccugguggacgccucuugggagcuagucgaucccaccccugaccuccaggcgcuguucguucaguuuaaugaucaauucuuuuggggccagcuugaagcuguggagguaaaguggucagugcggaugacacugugcgccgggaucuguaguuacgaaggaaaagguggcaugugcagcauucgcuuguccgagccacuccugaagcugcgaccgcguaaagaccucgucgaaacuuuacugcaugagaugauacacgcauaucuuuucgugacgaacaaugauaaggacagagaggggcauggacccgaauuuuguaaacacaugcauaggaucaacucuuugaccggcgccaauauuacaguuuaccacacuuuccacgaugagguggacgaauaucggcgccauugguggagaugcaacgguccuugucagcacaggccacccuacuauggguacgucaagcgggcuaccaaucgcgagccuucggcacaugauuauuggugggccgaacaccagaagacaugcggaggcaccuacaucaaaauuaaggagccagagaacuacagcaaaaagggcaaagggaaggcuaagcugggaaaagaacccgugcuagccgcggagaauaaggguacuuuuguauauauccuccugauauucauguga

SEQ ID NO: 63157 - RNA, 960 nt, Artificial Sequence
  derived and/or modified sequence opt3 from SPRY1__Homo_sapiens__NP_001244968
auggacccccagaaccaacacggcagcggguccucucugguggucauccagcagccuucacucgauaguagacagaggcuugacuacgagcgggaaauucaaccaaccgccauacugagcuuggaucagaucaaggcuauucgcggauccaaugaguauacagaagguccgucuguugugaagcgacccgcaccucguacugccccaagacaggagaagcaugaaaggacgcacgagaucauucccaucaacguaaauaacaauuacgagcaucggcacaccucgcauuuaggccacgcggugcugccuucaaacgcucgcgggccaauacuaagcagaaguacauccacuggaucugccgcaagcuccggcucaaauaguagcgccucuuccgaacagggucuccuggggaggucacccccuacccggccagucccgggacaccgcagcgagcgagcuaucagaacacaacccaaacagcuuauuguggacgaucugaagggcaguuugaaagaagaccucacccagcauaaguucaucugcgagcaguguggcaagugcaaauguggggagugcacugcaccuaggacacugccaucuugucuggccugcaaccggcaaugucucugcuccgcugaaagcaugguugaguauggaaccuguaugugcuuagugaaggguaucuuuuaccacuguucgaaugaugacgaaggcgauucuuauuccgacaaccccugcucaugcagucagagccauuguugcucccguuaccuguguaugggggccaugucucuuuucuugccuugccugcuauguuauccacccgcgaaaggaugccucaagcugugucgcagaugcuacgauuggauucacaggccgggcugucggugcaaaaauagcaacacggucuacuguaaacuugagucaugcccuagucgaggucaggggaagcccuccuga

SEQ ID NO: 63158 - RNA, 948 nt, Artificial Sequence
  derived and/or modified sequence opt3 from SPRY2__Homo_sapiens__NP_005833
auggaggccagagcucagagcggcaacgggucccaaccccugcuccagaccccuagggacggaggucggcagcgcggcgaaccagauccgcgagacgcacuuacacagcaaguccacguccugucuuuggaucagauccgugccauuagaaauacuaacgaguacacggaagggcccaccguugugccuaggccaggauuaaagcccgcgccucggccaucaacacagcauaaacacgagcgccugcauggccuacccgaacacagacagccuccaaggcuccaacauagucagguacacagcuccgcucgggccccgcugucucgcucgauaucaacugugagcagugguucccgaucuagcaccagaacauccaccucaaguucaucuuccgagcagaggcuucuggggagcagcuucaguucuggacccgucgcagacggcaucauucgggugcagccuaaguccgaguugaaaccaggcgaacucaagccccugagcaaagaggaucuggggcuccacgccuaucguugcgaagacuguggaaagugcaaguguaaagagugcacuuacccucgcccauuacccucggauuggaucugugacaagcaaugccuguguucugcucagaauguuauugauuaugguacaugcguguguugcgucaaaggcuuguuuuaccauuguuccaacgacgaugaggacaauugcgcagauaacccgugcucauguagucagagccacugcuguaccagaugguccgccaugggggugaugucucuuuuccugccuugccuaugguguuaucuccccgcuaagggaugccugaaacuuugucaaggcugcuacgacaggguaaaucggccagguugucgaugcaagaacagcaauacgguuuguugcaaggugccuacugugcccccacgcaacuuugaaaaacccaccuga

SEQ ID NO: 63159 - RNA, 867 nt, Artificial Sequence
  derived and/or modified sequence opt3 from SPRY3__Homo_sapiens__NP_005831
auggacgccgcugugaccgaugacuuccagcaaauccugcccauugagcagcucagaagcacacacgcauccaacgauuacgucgaaaggccuccagccccgugcaagcaggcgcuuucuucacccagucugauaguucagacucauaaaagcgacugguccuuggcuacgaugccuaccucuuuaccacggucgcugucacaaugucaccagcuacagccccucccucagcaucugagccaaaguuccaucgccucuagcaugucccacucaacaacugcaagugaucagcgccuucuggccagcauuaccccaucucccuccggccagucaaucauucgaacacagccuggggcuggagugcauccaaaggcagacggugccuugaaaggcgaggcugaacaaagcgccgggcacccgagugagcaccucuuuaucugcgaagaguguggacguugcaaguguguacccugcaccgcggcaagaccucugccaucuuguuggcugugcaaucagaggugucucugcuccgccgagagcuuacuggauuauggcacuugucuuugcugcgugaaagguuuguucuaccauuguucgacagacgaugaagacaacugcgcugaugagcccuguucuugcgggccuuccucauguuuuguccggugggccgcaaugagucugauaagccuauuccucccaugccuguguugcuaucuucccacccgcggaugucugcacuugugccagcaaggcuacgacucccucagaaggccgggcugucggugcaagcgccauacgaauacugugugccgaaagaucucuagcgggucagcuccuuuucccaaagcccaggaaaagaguguuuga

SEQ ID NO: 63160 - RNA, 900 nt, Artificial Sequence
  derived and/or modified sequence opt3 from SPRY4__Homo_sapiens__NP_001280218
auggagcccccuaucccacagagcgccccgcugacccccaacuccgugaugguccaaccucuccuugacucuagaaugucacacaguaggcugcagcauccauugacaauuuuacccauagaucagguuaagacuagccacguggaaaaugacuacaucgauaacccuucccuggcucuaacgaccggcccaaaacggacacgcgggggagcacccgagcucgccccuacuccagcgcgaugcgaccaggauguaacccaucacuggauuucuuucucgggucguccgucaagcgugaguuccucuagcuccacaucaagugaccaaagacugcuugaucauauggcucccccuccagucgccgaccaggcaagccccagggccgugcggauccagccuaagguugugcacugucagccacuggauuugaaaggccccgcugucccgccugaacucgacaagcacuuucugcugugcgaggcaugugggaaaugcaaguguaaggaaugcgccucuccccgcacccucccauccuguugggugugcaaucaagaguguuuaugcucagcucagacucugguaaacuauggaacauguaugugccuuguucagggcauuuucuaccauugcaccaaugaggaugacgaagguagcugugccgaucacccuugcaguuguucuagauccaacugcugugcgagguggagcuuuaugggggcauugucggugguccugcccugccuacucuguuaucugccagccacgggaugcgugaaacuugcucagcggggcuacgaccgccugcgaagacccggcuguaggugcaagcauacuaauucugugaucuguaaagccgcauccggggacgcuaagaccucacggccugauaaaccauucuga

SEQ ID NO: 63161 - RNA, 474 nt, Artificial Sequence
  derived and/or modified sequence opt3 from SPRYD7__Homo_sapiens__NP_001120954
auggccaccagcgugcugugcugucucagaugcuguagggacggcgggacaggacacaucccccuuaaggagaugccugcuguccagcuggauacucaacauauggguauuuggggcauagggguugcaacgcagaaagugaacuugaaucagaucccauuaggacgggacaugcacucccugguaaugcgcaacgauggcgcccuauaccauaauaacgaagagaagaaucgacucccggcgaacucucugccccaggaaggugacguggucgggauuaccuaugaucacguggagcuuaauguuuaccugaacggcaaaaauaugcauugcccugcuucaggaauccguggcacaguguauccagucguguacguagacgauagugccauuuuggacugucaauucagcgaauuuuaucacacucccccuccaggguucgagaagauccucuuugagcagcagauauucuga

SEQ ID NO: 63162 - RNA, 1068 nt, Artificial Sequence
  derived and/or modified sequence opt3 from SPSB3__Homo_sapiens__NP_543137
auggccagaaggccccggaacagccgcgcuuggcacuucgugcuguccgcagcccgacgugacgcggaugcuagagccgucgcacucgccggcucuaccaauuggggguacgacucagauggacagcauagugacagcgauuccgacccugaguauucuacacuuccaccgucgauccccucagcuguuccugugacuggugagagcuuuugcgauugugcaggccaaagugaagccuccuucugcucuagccugcacuccgcucauagggggcgggacugucgcugcggagaagaggaugaauacuuugacuggguaugggaugacuugaacaagucaagugccacguuacugagcugugauaauagaaaagugucuuuccacauggaguauuccugcggcaccgcggcaauuagggguacaaaggagcuaggggaaggacagcauuuuugggagauaaaaaugacuucaccagucuacggcaccgacaugauggugggcaucgggacaagcgacguugaucucgacaaguaucggcacaccuucuguagucugcuuggacgcgaugaagacucuuggggucuguccuacacuggcuugcuccaccauaaaggggauaagacuagcuuuucgucucgauucggacagggcuccauuaucggugugcaccuggacaccuggcaugggacgcugacauuuuucaagaacagaaaaugcauuggagucgccgcuaccaagcuccagaauaaaagguuuuaucccaugguguguucaacagccgcacggaguagcaugaagguaacucguuccugcgcuucugccaccagcuuacaauaccuguguugccaccgccuuagacaguugaggccugauucaggcgacacacuggagggccuaccacugcccccugggcucaaacagguucuucacaacaagcugggauggguguugaguauguccugcagccggcgaaaggcgccagucucugauccgcaggccgcaaccucagcucaucccaguagccgcgagccuagaccaugucaaaggaaacggugccgcagaacguga

SEQ ID NO: 63163 - RNA, 822 nt, Artificial Sequence
  derived and/or modified sequence opt3 from SPSB4__Homo_sapiens__NP_543138
augggccagaagcugagcgggucccucaaaucuguggaggucagagaacccgcccuuaggccugcuaagcgggagcugcgcggagcagaaccaggucgaccggcccguuuggaccaauuacuggauaugcccgcggcuggccuagccguucagcucagacacgcauggaacccugaggacaggucacugaauguguucguaaaagaugacgaucggcuuaccuuucaucgccacccaguggcccagaguacagacgggaucagaggaaaggucggccaugcuaggggucugcacgcauggcagauuaacuggcccgcccggcaacgcgggacucaugcugugguuggaguggccacggcgcgagcaccuuugcacagcgucggcuacaccgcccucgugggcuccgaugcugaaucuugggggugggaccugggaagaucgaggcuguaucacgaugguaaaaaucagccaggcguagccuaccccgcauuccucgggccugacgaggcuuuugccuuaccagauucacugcuuguuguguuggacauggaugagggaacacugagcuucauagucgacggccaguaucuagguguggcguuucgggggcucaagggaaagaaacuguacccgguggucagugccguuuggggccauugcgaagugacuaugcguuauaucaacggccuugaccccgagccucugccauugauggaucucugucgcagauccauuaggucugcacuggggcggcagcgauuacaagacaucagcucccugccccucccucagucacuuaagaauuaccugcaguaucaguga

SEQ ID NO: 63164 - RNA, 7260 nt, Artificial Sequence
  derived and/or modified sequence opt3 from SPTA1__Homo_sapiens__XP_011508218
auggaacaguuccccaaggaaaccguggucgaaagcuccggaccuaaaguucuggaaacagccgaagaaauccaagagcggaggcaggaggugcucacucgguaccagucuuuuaaggaacgcguagcugagcgagggcagaaacuugaagacucauaucaucugcaaguguucaagcgugaugcagacgauuugggaaaauggauuauggagaaggucaacauauuaacggacaagaguuacgaggauccaaccaauauccaggguaaauaucagaagcaccagagccuggaagccgaggugcagacaaaauccagacugaugucugaacucgagaagacuagggaagaacgguuuaccaugggccacucggcgcaugaggaaacaaaagcucacauugaggaacugcgccaucuuugggaccuguugcucgagcugacccuggaaaagggggaucagcucuuaagagcccugaaguuccagcaguacguucaagagugcgcagacauccuugaguggauuggagauaaagaagccaucgcuacuucaguggaguugggcgaagacugggagaggacagaaguccugcacaagaaauuugaggauuuccagguggagcuuguagcaaaggaaggucggguuguggaggucaaccaguaugccaaugaaugugcugaggagaaccacccggaccucccccugauacaaagcaaacagaaugaagugaacgccgcgugggagcgccuucgagggcuggcauugcagagacagaaggcccucaguaaugcugccaaccugcaaagguuuaaacgggaugugaccgaagcaauccaguggauuaaggagaaggaaccugucuuaacguccgaggacuacggaaaagaccugguugcuucugagggccucuuccauagccacaagggccuugaacguaaucuggccgugauguccgauaaaguaaaggaguugugcgcgaaagccgaaaaguugacucugucacauccaagugacgcaccccagauccaggagaugaaggaagaucucgugagcucuugggagcacauucgcgcucuggccaccuccagauaugagaaacuucaagcuacauacugguaccacagguuuucaagcgacuucgaugaacugaguggguggaugaacgagaagacugccgcaaucaaugccgacgaauugccuaccgaugucgcuggaggugaggugcuccuggaccggcaucagcagcacaaacaugaaauagauucuuaugacgaucgauuucaguccgcggacgagacaggccaagacuuaguuaacgcaaaucacgaggccagcgaugaagugcgcgagaagauggaaauucuggacaacaauuggaccgcucuacucgagcugugggaugagagacauaggcaguacgaacagugucuugacuuccacuuguuuuaucgggauucggagcaggucgacucuuggaugucccgccaagaagccuuccuggagaacgaagaucucgggaacucacugggaagugcagaggcccuucugcagaaacacgaggacuucgaagaggcuuuuacggcccaggaagagaagaucauuacuguggauaagacagcaaccaaauugaucggcgacgaucauuacgacagcgaaaauaucaaggcgauuagagauggucuccuggcuaggcgugacgccuuacgggagaaagcagccacucgaagaaggcugcuaaaggagucccuccugcuucaaaaauuguaugaagacucugaugaccugaagaacuggauaaauaagaaaaagaaacucgcugaugacgaggauuacaaggacauccagaaccugaaaagccgcguacagaagcagcaaguuuucgaaaaagaguuagccgugaauaagacacagcuggaaaacauucagaagaccgggcaggagaugaucgagggaggccacuaugcaucagauaaugucacgacccggcuuagugaaguggcuuccuugugggaggaacuccuggaggccacaaaacaaaagggcacucagcuacaugaggcgaaccagcagcugcaauuugaaaauaacgccgaggaccuccagagauggcuggaagaugucgaguggcaagugaccagcgaagacuacgggaaaggacuugcugagguucaaaauagguugcgcaagcacggucuguuagagucugcaguggccgcucgacaggaucagguagacauacucacagaucuggccgcauacuucgaagagauuggccacccagacucaaaagacauccgggcgcgucaggaaagucuugucugcagauuugaggcccugaaggaacccuuggcuacuaggaagaaaaagcuccuggaucuacugcaucuccaacugaucugucgcgacaccgaggaugaggaagccuggauucaggagacagaaccuagcgcaaccuccacuuaucuugggaaagacuugaucgcuucuaagaaacuguuaaaccggcacagagugauucucgagaauauagccucgcaugaaccaaggauccaggagauuacggagcgaggaaacaagaugguugaagagggccacuucgcagccgaagauguggcuagccgcgucaagucccugaaucagaacauggagucacuucgggcgagagccgcaaggcgucaaaacgaccuggaggcuaaugugcaguuucagcaguaccuagccgaucuccaugaagccgagacauggauccgcgaaaaagagccgaucguagacaacaccaauuauggugcugaugaagaggcagccggggcgcuguugaagaaacacgaggcuuuccuguuagaccucaacaguuuuggcgauucuaugaaggcccugcggaaucaagcaaacgccugccagcagcagcaagcugcacccguggaaggaguugccggcgagcagagagucauggcgcuuuacgacuuccaggcuaggagcccucgagaagugacuaugaaaaagggggacgugcugaccuugcucuccucaauuaauaaggauugguggaaagucgaggccgcagaccaccaaggaauaguuccagccguguaugugcggcgccuggcucaugaugaauuucccaugcuaccucagagaaggcgggaggagccagguaacaucacacagcgacaggaacaaauugagaaucaguacagaagccugcuugaccgcgccgaagagaggcgucggagacuccugcagagguauaacgaguucuugcuggcauacgaggcuggcgauauguuagaguggauccaggaaaagaaagccgagaauaccgggguagaacucgacgaugucugggagcugcaaaagaaauuugacgaguuccagaaggaucuuaacacuaaugaaccccgccugcgagacauuaacaaaguggcggaugaccuacucuucgagggacugcuaacaccggaaggcgcccagaucagacaggagcuaaauucucggugggguucccuucaaaggcucgcagaugaacagcgccagcuguuggggagugcucacgccguugagguguuucaucgugaggcugacgacacgaaggaacaaauagagaagaaaugucaggcauuaagcgccgccgauccuggcucugaccuguucuccguccaggcucuccagagacggcacgaaggauuugagagggaucuggugccccuuggcgacaagguuaccauccugggggaaacugcggagcgcuugucagagagucauccagaugcaacagaagaccuacaacgacagaaaauggagcugaacgaagccugggaggaucuccagggaagaaccaaggaccggaaagaaagccugaacgaggcucagaaguucuaccuauuuuuaucgaaggccagggaucugcaaaauuggauuuccucuaucgguggcauggugagcucacaggagcucgcagaagacuugacagggauugagauccugcucgaacgccaccaggagcacagagccgauauggaggcugaagcgccuacuuuccaggcccuggaggacuuuagugcagaacuuauagauuccggacaucacgcuucucccgagauugagaagaagcugcaagccguaaaauuggagagggacgaccuagagaaggcaugggaaaaacggaagaagauccuggaucagugccucgaguuacagauguuccagggcaacugugaccaagucgaaagcuggaugguggcccgugaaaauucccugcgcucagaugacaaaagcagucuugauucucuggaagcucucaugaagaaacgagacgauuuggacaaggccauuaccgcgcaggaggguaaaaucacggaucuggagcauuuugcagaaucccucauagccgacgagcacuaugcuaaggaagagaucgccaccagacugcagagggugcuugaucgguggaaggcucuaaaagcacaacugauugacgaacgcacaaaguugggggacuacgccaacuuaaaacaguucuauagagaucuggaggagcucgaagaguggaucagcgaaaugcugccaacugcuugcgacgagucguacaaggaugccaccaauauucagaggaaauaucuuaagcaccagacauuugcacaugaggucgacggccggucagaacaaguucacggagugaucaaccugggcaauucucucauagaguguagugcgugcgaugggaacgaagaggccaugaaggaacaguuggagcagcugaaagagcauugggaccaccuacuggaacgaacuaaugauaagggcaaaaagcucaacgaggcuuccagacagcaacgcuucaauaccagcauuagggacuuugaguucuggcuuucugaggccgaaacgcuguuagcaaugaaagaucaggcucgggacuuggccagcgcaggcaaccugcucaagaaacaucagcugcuugagcgugagaugcuggccagagaagaugcucucaaggacuugaauacacuggcggaggauuuacuauccucagguaccuucaacguagaccagaucgugaagaaaaaggacaaugucaacaaaagguuucugaacgugcaagaacucgccgcagcucaccacgagaaacuuaaagaagccuacgcccuguuccaguuuuuccaggauuuggacgaugaggagaguuggaucgaagagaagcugauucgcguuagcucucaagacuaugggcgggaucuccagggagugcagaaucugcuuaagaaacauaagcgacucgaaggcgagcuggucgcacacgagcccgcuauccagaacguguuggacauggccgaaaaacugaaggauaaagcggcuguuggucaagaggaaauucaguuaagacuagcccaguuuguggagcauugggaaaagcugaaggagcucgcaaaagccaggggccuuaagcuggaggaauccuuggaguaccugcaguucaugcaaaaugcugaagaggaagaggcauggauaaacgagaaaaaugcccucgcgguccgcggggacugcggagauacucuggcugccacacagucacuuuuaaugaagcacgaagcacuggagaacgacuuugccguacacgaaacccgggugcagaauguuugugcucagggcgaggauauccucaacaaaguguugcaagaagagagucagaauaaggagauuagcuccaagaucgaagcccugaacgagaaaacuccuucucuagcaaaggcuauugccgcguggaaacugcagcucgaagacgacuacgccuuccaagaguuuaauuggaaggcagaugucguggaggcuuggaucgccgacaaagaaaccucgcuuaagacaaacgggaauggagcagaucugggcgacuucuugacgcugcucgcuaaacaggauacccuggacgccagcuuacagucauuucagcaagagagacuuccagaaauaacugaucugaaggacaagcucaucuccgcccagcauaaccagaguaaagcgauugaggaacguuaugcugcacuacugaagaggugggagcaguugcuggaggccucugcuguacaccggcaaaaacuccuugaaaagcagcugccguugcagaaagccgaggaucuguucguggaguucgcacauaaggccagcgcucucaauaacuggugcgagaagauggaagagaauuuauccgagcccguccacuguguuucacugaacgaaauccgccagcuucaaaaagaccaugaggauuuucuggcgucucuagcccgagcacaggcugacuucaagugccuccuggaauuggaucagcagauuaaagcccugggugugccuagcaguccauacacauggcucaccguggagguccuugaaagaacauggaagcaccuguccgacaucauagaggagagggaacaagaguuacagaaagaagaggcaagacaggugaagaacuuugagaugugucaagaguucgagcagaaugccagcacuuuucugcaguggauuuuggaaacccgcgcuuauuuccucgacgggucucugcuaaaggagacgggaacacuugaaucacagcuggaggccaacaaaagaaagcaaaaagagauccaggcgaugaagaggcagcucaccaaaaucguugaucugggcgacaauuuggaagaugcacugauucucgacauaaaguacuccacuaucggucuugcccagcaaugggaucagcuguaucaguuaggccugcgaaugcagcacaacuuggagcaacagauucaggcuaaggacaucaaagggguaagugaagagacccucaaggaauuuagcacaauuuacaaacauuucgaugagaaucugacuggacggcuaacccacaaggaguuucguucgugccuuagaggccugaacuauuaccuccccaugguggaagaggacgaacaugagccuaaauucgaaaaguuucuggaugccgucgacccagggcgcaaaggauacgugucuuuggaggauuauacagcauucuuaaucgacaaggaguccgaaaauauaaagagcucagaugagaucgaaaacgcuuuucaagcccuggcugagggcaaaaguuacauuacgaaggaggacaugaaacaggcccucacccccgaacagguuucuuucugugcaacucacaugcagcaauauauggacccgaggggucggucccaccuuagcggguacgauuaugugggauucacaaauucauacuuuggcaacuga

SEQ ID NO: 63165 - RNA, 7434 nt, Artificial Sequence
  derived and/or modified sequence opt3 from SPTAN1__Homo_sapiens__NP_001123910
auggaccccagcggcgugaagguccuggaaaccgccgaagauauccaggaacgaaggcagcagguucucgaccgguaccaccgcuucaaagaacuuuccacacugcgacgucagaaguuggaggauucuuaucgauuucaguucuuucaaagggacgcugaagaguuagagaaauggauucaggaaaagcugcagauagcuucagaugagaacuacaaagacccuacuaauuuacaggggaagcuccaaaagcaucaggccuucgaagcggaggugcaggcuaacaguggagccaucguaaaacuggaugagacggguaaucuuaugauuagcgaaggccacuuugcauccgagaccauccggacacgccugauggaauugcauagacagugggagcuccugcuggaaaagaugagggagaaagggauuaagcucuuacaagcccagaaacuggugcaguaucuucgggagugcgaagacgucauggauuggaucaacgacaaggaggcuauagugacuucugaagaguugggacaagaucuggaacacguugaggugcuacagaagaaauucgaggaauuucagaccgacauggcagcccaugaggaacgcgucaaugaggugaaccaguucgcugccaagcucauccaagaacagcacccagaggaggaacugauuaaaacaaagcaggaugagguaaaugcggcauggcagcgacuuaaaggccuggccuugcaaagacaggguaagcucuuuggggcugccgaaguucagagguucaaccgggacguggacgagaccaucucguggauuaaagagaaggaacagcugauggcaucagaugacuuuggacgugauuuagcuagcguccaagcccugcuccgcaagcacgagggccuugaaagagaccuggcggccuuggaggauaaagugaaggcacuaugugcugaagccgacaggcugcagcagagucauccgcucuccgcuacucagauccaagugaaacgggaggagcugauaacaaauugggaacagauucgaacccuugccgcagagcgccacgccagacugaacgauucuuacagguugcagcgguuccucgcugacuuucgcgaucugacgagcugggucacugaaaugaaggcguuaaucaaugcagacgagcuggccuccgauguugcuggcgccgaagcacuacucgacagacaucaagagcacaaaggggagauugacgcccacgaagauucauucaagagugcugacgagagcggacaggcccugcuugcagcgggucauuaugcuucugaugaagugagggagaaguugaccguacuguccgaggaacgugccgcacuccuggagcuuugggaacugcggcgacagcaguacgagcaaugcauggacuugcaacucuucuauagagauacagaacagguggacaacuggaugucaaaacaggaggccuuucuguuaaaugaggaucugggcgacagccuagauagugucgaagcucuccugaagaaacacgaggacuucgaaaagucucuuuccgcccaagaggagaagauaacugcauuggaugaguuugcuaccaagcugauccagaacaaucauuacgccauggaggacguggcgacaaggcgcgaugcccuccugagccggagaaacgcuuuacacgaaagggcaaugcgccgacgggcccagcuggcugacucguuccaucuucagcaauuuuuccgugacucugaugaguugaaguccuggguuaacgagaaaaugaagaccgccacggacgaggcauacaaagaucccucaaaucuccaggggaaggugcagaaacaccaagcguuugaagccgagcugagugcuaaccagagcagaauugacgcccuagagaaggcaggacagaagcugauagaugucaaucacuaugcuaaagacgaaguggccgcaaggaugaacgagguaaucucccucuggaagaaacugcuugaagccacugaguugaagggcauuaaacugcgcgaagcuaaucagcaacagcaguucaaccggaauguugaggauaucgaguuauggcucuacgaaguggagggucaucuggcgucugacgauuaugggaaggaccuuacaaacguccagaaucugcagaagaaacacgccuugcucgaagcagauguggcugcccaucaggacagaauagauggaauuaccauccaggccaggcaguuucaagacgcuggccacuucgacgcagagaacaucaagaaaaagcaggaggcccuggucgcgcgauacgaagcucuaaaagagccuaugguggcccgcaagcagaaacuggcagauagccuccggcugcagcaacuuuuuagagacguugaagaugaggaaacuuggauuagggagaaggagccaaucgccgcuucaacaaaucguggcaaggacuugauuggggugcagaaccugcucaaaaagcaccaggcacuacaggccgaaauagcgggacaugagccccgcaucaaagcuguaacccagaaagguaaugccauggucgaagagggccacuucgcagccgaagaugugaaagcuaagcugcaugagcuuaaccagaagugggaggcccugaaagcaaaggcuagucagcggagacaagaccuagaagauucccuccaggcccagcaguauuuugcggacgccaaugaggcagaaagcuggaugagggagaaagaaccuauuguugggucuacggauuacggaaaggacgaggauucagcugaggcccuguugaaaaagcacgaagcucugaugagugacuuaagcgcauauggcuccucuauccaagcccuccgagagcaggcccagucgugucggcagcaaguggcuccaaccgacgaugaaacagguaaggagcugguccuugcgcuguacgacuaccaggagaaaagcccccgcgaagugacuaugaagaaaggggauaucuugacccuccugaacuccacaaacaaggacugguggaaaguagaggugaaugauagacagggcuucguuccugcagccuaugucaagaaacuagacccagcucaaucagccaguagggaaaaccugcuugaggaacagggaucuauugcacuccggcaggagcagauagauaaucaaacucgaaucaccaaggaggccggcagcgugucccugagaaugaagcaaguggaagaguuguaccauucacuguuagaacucggggagaaacgcaagggaaugcuggagaaaagcugcaagaaauucaugcuuuuuagggaggcuaacgagcugcagcaguggauuaaugaaaaggaggcggccuugacaucugaagaggucggugcagaccucgaacaaguugaggugcugcagaagaaauucgaugacuuucagaaggaucuaaaagcuaacgagucccgucugaaggacaucaauaaaguggccgaagaucuugagagugaaggccucauggcagaggagguacaggccguccaacagcaggaaguguaugggaugaugccgcgggacgagaccgacagcaagacugcuucucccuggaaguccgccagacugaugguucacacgguggcgacauucaacucaauuaaagaauugaaugagagguggcgcaguuuacagcaacuggcagaagaacgaagccagcuccugggaucggcccacgagguccagagauuucaucgggaugcugacgaaaccaaggaguggaucgaagagaaaaaccaagcccuuaauacugauaacuacggccacgaccuggcuuccgugcaggcauugcagaggaagcaugaagguuucgagcgcgaucuagccgcucugggggacaaaguuaauucucucggcgagaccgccgaacgucugauacagagccacccugagucagcagaagaucuucaagagaaguguacagaauuaaaccaggcguggaguucccugggaaagagagccgaccagcggaaagcuaagcucggcgauucucaugacuugcagagguuucugagcgauuuccgcgaccucauguccuggaucaaugggauucgaggacuggugucaagcgaugagcuugccaaagacguaaccggugcagaggcucuguuggaaagacaccaagagcaccggacugaaaucgacgccagggcaggcacauuucaggccuucgagcaguuugggcagcaacuacuggcucauggacacuaugcgaguccagagauuaagcagaaacucgauaucuuagaccaggaacgcgccgaucuggagaaggcauggguccaaagaaggaugaugcuugaccagugccuggaacuccaguuguuccaucgggauugugagcaggcugaaaacuggauggccgcccgugaggcauuucugaacacggaggacaagggcgauucucucgacuccguggaagcucugaucaaaaagcacgaggauuucgacaaagccauuaaugugcaagaagagaagaucgcggcacuucaggccuucgcagaucagcuaauugccgcuggucacuacgcaaaaggggacaucagcucgcgccgaaacgaaguccuggacagauggaggcgguugaaggcccagaugauagagaaacgcucaaaguuaggcgagucucaaacccugcagcaguuuaguagagauguugacgaaaucgaggcguggauuuccgaaaagcuccagacugcuagcgaugagucuuauaaagaccccacaaauauccaacugagcaaacuucuguccaaacaucagaagcaccaggccuucgaagcagagcuccaugccaacgcugauaggauucggggagugaucgacaugggcaauucauugauagagcgaggggccugcgcaggaagugaagaugcuguaaaagccagacuggcggcccuagcagaccaauggcaguuucuggugcaaaagagcgcugagaagucucagaaacucaaggaagccaacaaacaacagaauuucaacaccggcauuaaggauuuugacuucuggcuuuccgaggucgaggcacuguuagcuucagaagauuacgguaaagacuuggccagugugaauaaccugcucaagaagcaccagcugcuugaggccgauaucagcgcgcaugaagaccgccugaaagaccucaauucccaggcugauucuuugaugacaucgagcgcauuugacacuucacaaguuaaggauaaaagggacaccaucaacgggcgguuccagaagauuaaauccauggccgcuagucguagagccaagcugaaugagucucacagguuacaccaguuuuuccgcgauauggacgaugaagagagcuggaucaaggagaaaaagcuacuggugggauccgaagacuacggccgggaucucacggguguccagaaccuuaggaaaaagcauaaaagacuggaggcagaauuggccgcucacgagccugcgauucaaggcgugcuggacaccgggaagaaacucucagaugacaauacaauaggaaaggaagagauccagcagagacuggcccaguuuguugagcauuggaaggaacuuaaacaacucgcagcugcccgcggccagcggcuggaggaaucuuuggaguaucagcaauucguggcaaacgucgaagaggaggaagccuggauuaacgagaagaugacucugguagcuagcgaagacuacggggauaccuuagccgcgauccagggacuacugaaaaagcacgaggcauucgagacagacuuuacugugcacaaagauagaguuaaugacguguguaccaacggccaggaucucauuaagaagaauaaccaucacgaagagaauaucaguuccaaaaugaagggucuuaacgggaaagucagcgaccuggaaaaggccgcugcccagcguaaagcaaaguuggaugaaaauucugcuuuccugcaauuuaacuggaaggccgacgugguagaaucauggauaggagagaaagaaaauucccucaagacggaugacuauggcagggaucugaguagcgugcagacacuuuuaaccaaacaggaaacuuucgacgcuggucugcaggccuuucaacaggagggcaucgcaaacauuacagcgcucaaggaucaguugcuggccgcuaaacauguccagucgaaggccaucgaagcacggcacgcuucucuaaugaagcgcuggucccaacugcucgccaauagcgcagccaggaaaaagaaacuucuggaggcgcagucacauuucagaaagguugaagacuuguuucugaccuucgcuaaaaaggccagugcauuuaacucuugguucgagaaugccgaggaagaccucacugauccagugagaugcaacucccuggaggaaauuaaggcuuuacgggaggcccacgacgcauuucgcagcucacuuaguagcgcucaggccgauuucaaucaacuggcggaacucgacagacagaucaaguccuuuaggguggcuucuaaccccuacaccugguucacaauggaggcccuagaggaaacguggcgaaaucugcagaagauaauuaaagagcgggaauuggagcugcagaaggagcaacguagacaggaagagaacgauaaacuccgccaggaguucgcacagcacgccaacgcuuuucaucaauggauccaggagaccaggacuuaucuucuggacgggagcuguauggucgaagaguccggaacauuggagucacagcuggaagcaaccaagcggaaacaccaggagaucagagccaugcgcucucaacucaagaagauugaagauuuaggcgcggccauggaggaagcucugauacuugacaauaaauacacagagcauaguacuguggggcuggcacagcagugggaucagcuagaccaacucggaaugaggaugcagcacaaccuggagcagcaaauccaggcccgaaauaccacgggcguuacagaagaggcuuugaaggaguucucgaugauguuuaaacacuucgauaaggacaaaagcggucggcugaaccaucaggaguuuaaguccugccucagaucucuuggguaugaucugccgaugguagaagagggagagccugaccccgaguucgaggccauuuuagacaccguggauccaaauagggacggccacgucucacugcaggaauacauggcauuuaugaucagccgcgagacugagaacgugaaguccagugaagagauugaaucugcuuuccgugccuugagcucagaggguaaaccuuacguuaccaaggaagaacucuaucaaaaucugacacgggagcaggcggauuacugcgugucccauaugaaacccuaugucgacggcaaggggagagaacuaccaacugccuuugauuacguggaguucaccaggagucuuuuuguaaacuga

SEQ ID NO: 63166 - RNA, 6414 nt, Artificial Sequence
  derived and/or modified sequence opt3 from SPTB__Homo_sapiens__NP_000338
augaccagcgccaccgaguucgaaaacgugggcaaucaacccccuuacuccagaaucaacgcuagaugggacgcaccagaugacgagcuggauaaugacaacucuucagcccggcucuuugaacgcagucgaauuaaggcgcuugcugaugagcgugaagucguucagaagaagacuuucacgaaaugggugaauagccaccuggccagaguauccugcaggauaaccgacuuguauaaggauuuacgggacgggcgcaugcugaucaaacuacucgaggugcugucuggagagaugcuuccgaagcccacaaaggguaaaaugaggauucauugucuggaaaacgucgauaaggcauugcaguuucucaaagagcagagggugcaccuggaaaauaugggcucgcaugacaucguugaugggaaccaccggcuggugcucggauuaauuuggacuaucauacugcgcuuccagauccaagacauugucgugcagacccaggagggccgagagacaagaucagccaaggaugcucuuuugcuguggugccagaugaaaaccgcagguuacccucauguaaauguuacuaacuuuacaagcaguuggaaggacgggcuagccuucaaugcucucauccacaagcacaggccagaccugauugauuuugacaaacuuaaggauuccaacgcccggcauaaucuggaacacgcguucaacguggcagagcgucaauugggaaucauaccccuccuggacccugaagaugucuuuaccgagaauccagacgaaaaaucuauuaucacguaugugguggccuucuaccauuauuuuagcaagaugaaagucuuagcuguugagggcaagcgcgugggcaaaguaauugaucacgccaucgagacugaaaagaugaucgagaaguacuccgggcuggcaucagaccuccuuaccuggauugaacagacaauaacugugcugaacaguagaaaauucgcuaacagcuugaccggaguccagcagcaacuacaggccuuuucuacauauaggaccguggagaagcccccuaaauuccaggaaaaggguaaucuggagguucuccuguucacgauccaaucccggaugcgagcgaacaaucagaaaguguacacuccacacgauggcaaacuugucucagacauuaaccgcgccugggagagccuggaagaggcagaauacagaagggaguuggcucuccggaaugaacugauccgccaggagaaguuagagcagcuggccagaagguuugaucguaaagcugccaugcgggaaacauggcuaagugagaaccaacgacucguggcacaggacaauuucggguaugaccuggccgcuguagaagcggcaaagaaaaagcaugaggccauagagaccgauacugcugccuacgaagagagaguuagggcacuugaagacuuggcccaggagcuggaaaaagagaacuaucacgaucagaagcgcauuacagcucggaaggacaauauccucagacuguggucuuaccuucaagagcuguugcaguccaggcgccagcgacucgaaaccacgcuggccuuacagaaacuguuucaagauaugcuacauagcaucgacuggauggaugagauuaaggcacaccuccugucggcggaguucggaaaacaucuuuuggagguggaagaccugcuccagaagcacaaacugauggaggcugauaucgccauucagggcgacaaggucaaggcaauaaccgccgcuacauuaaaauuuacugaggguaagggguaucagccgugugauccccaagugauccaggaccggauuucucaccuggaacagugcuucgaggaacuuuccaacauggccgcaggacguaaagcucaauuggagcagucaaagagacucuggaaauuuuucugggaaauggaugaggccgagaguuggaucaaggaaaaagagcagaucuacagcucccuggacuauggcaaggaccuaaccucuguccugauucuccagaggaagcauaaagcguuugaagaugagcugcgcggccuugacgcccacuuggagcaaauauuccaggaagcucaugggaugguggcacggaagcaguuuggacacccucagaucgaggccagaauuaaagaaguuagcgcucaaugggaucagcugaaggacuuagccgcauucuguaaaaagaaucuccaggaugcggagaacuuuuuccaguuccaaggugacgccgaugaccugaaggcuuggcuucaggaugcccacaggcuguugucaggcgaagacguggggcaggaugagggagcaacacgagcucucggcaaaaagcauaaagacuuucuggaggaacuagaggaaagucgcgguguaauggagcaccuggaacaacaggcccagggguucccagaggaguuucgggauucccccgacgucacucauagacuccaggcacugagggaacuuuaccaacaggugguugcccaggcugacuugcgucagcaacgccugcaggaggcguuagaucucuacaccguguucggcgaaacagacgccugcgagcuguggaugggagaaaaggagaaauggcuugcagagauggaaaugccugauacccuggaggaccuagaagucgugcagcaccgguuugauauccucgaccaggagaugaagacucugaugacgcaaauugauggcguaaauuuggcugccaacagccugguggagucugggcauccaagaucaagggaaguuaagcaguaucaggaccacuuaaauacacgauggcaggccuuccaaacccucgucagugagcggcgcgaagcuguggauagcgcacugagagugcacaacuacugugucgacugcgaggaaacuuccaaauggaucaccgauaagacaaaaguuguggagucuaccaaggaccuuggaagggaccuggccgguauaaucgcgauucagcggaaauugucgggccucgagcgagauguggcugccauccaggcaagaguagacgcccuggaacgcgagagccaacagcuaauggauucccaucccgaacagaaggaggacauugggcagaggcaaaagcaccuggaagaacuuuggcagggacuccagcagucacugcaaggccaggaggauuugcugggugaagucagucaguuacaggcuuuucuccaagaccuggaugacuuccaggcauggcuuucuaucacucagaaagccguggcgagcgaggauaugccggaaucccugccugaggcugaacaauugcuccagcagcaugccgggauaaaggacgagauugauggccaccaggacucauaucaacguguuaaagagagcggagaaaaggugauccagggccagacagaucccgaguaccugcuacuggggcagcggcuugaaggacucgacacggguuggaacgcacugggcagaaugugggagucuaggucccauaccuuggcccaauguuuaggguuucaggaguuccagaaagacgcuaagcaggccgaagcaauucugaguaaucaagaguauacucucgcucaccuggaaccaccugauagccuugaggccgcggaagccggaauccgcaaauuugaggacuuccugggcucuauggagaacaaucgagauaaggucuugucccccguggacucagguaacaagcuaguugcagaagggaaucuguacagugauaaaauaaaggagaaagugcagcucaucgaagacagacaccggaagaacaaugagaaagcucaggaagccagcguacugcuuagggauaacuuagagcugcagaauuuucuccaaaacugccaggaguugacacuguggauuaaugacaagcuccugaccucgcaggaugucuccuaugacgaagcucgcaaccuucauaauaaguggcugaaacaccaagcauucguggccgaguuggccucucaugaaggcuggcuagagaacaucgaugcugaaggaaagcagcugauggacgagaaaccacaguucacagcgcucgugagccagaaguuagaggcacugcaccgucuuugggaugaacugcaagccacuaccaaagagaagacgcagcaccucucagcugccagaaguuccgacuugcggcugcagacccaugcagaccucaauaaguggauuucugccauggaagaucagcugaggagcgacgaucccggcaaagaccuuacauccgucaaccgcaugcuagcuaagcugaaacgaguugaggaucaagugaacguaagaaaggaggaauugggggaguuauuugcccaggugccuucaaugggagaagagggcggugacgcggaucugagcaucgaaaaacgguuccucgaccugcuugagccacuggggaggcgcaagaagcagcucgagaguucuagagcaaaauugcagauauccagggaucuggaagacgagacucuaugggucgaggaacggcugccgcucgcucaaagcgccgauuacggaaccaaucuucagacagugcagcuguuuaugaagaaaaaccaaacuuuacagaaugaaauuuugggccacacaccccguguugaggacgugcugcagcgcggucagcaacucgucgaggcagccgaaaucgacugucaggaucuggaggaacgacuuggccaucugcagucgucaugggacagacucagggaggcugccgcggggcgguugcagcgccugagagaugcaaacgaagcccaacaguacuauuuagacgcugaugaggccgaggcuuggaucggagaacaggagcuauacgugauuucugacgaaaucccuaaggaugaggagggcgcaauuguuaugcugaaaaggcaccuccggcagcaacgagccguggaagacuaugggagaaauauaaagcagcuugcuagucgcgcccagggacuguuguccgcaggccauccagagggugaacaaaucauuaggcugcaggggcaggucgauaagcacuacgcgggacucaaagacguagccgaggaacggaagcguaaacuggagaacauguaucaccuuuuccagcucaagagagagacggaugaccuggaacaauggaucagcgagaaagaauugguggcuucuagccccgagaugggccaggauuuugaccauguuacacuguuaagggacaaguuccgcgauuuugcccgggaaaccggugcaauuggccaggagcgaguggacaaugucaacgcuuucaucgagagacuaauagaugccgggcacuccgaagcagccacuaucgcugaguggaaagacggacugaaugaaaugugggcggaucuccuugagcugauugacacaaggaugcaguugcuggccgcaucauacgaucuccaucgcuauuuuuacaccggcgcugaaauccuggggcuuauugacgagaagcaccgggaguuaccugaagaugugggacuggacgccaguacugccgagagcuuccacagaguacauaccgcauuugaacgugagcuccacuugcugggcgugcaaguccagcaguuccaggauguugcuacaaggcuacaaacggccuacgcgggugagaaggcugaagccauccagaacaaagagcaggaagugucugcagccuggcaggcucugcucgacgcaugcgccgggcggcgcacccaacuuguggacacugcggauaaguuccgauuuuucuccauggcuagagaccuguugucauggauggagaguauaauuaggcagaucgaaacacaggagcggccacgcgaugucagcuccguggagcugcucaugaaauaucaucaaggaaucaaugccgaaauugagaccagaucuaagaacuuuucggcaugccuggaauuaggcgagagccuucugcagaggcagcaccaggccucagaagagauacgagagaaacuccaacagguuaugucccggcguaaggaaaugaaugagaagugggaagcuagaugggagcgccuaaggaugcuguuggaaguaugucaguucagucgggacgccucuguggcagaggcuuggcugaucgcccaggagcccuaccucgcgagcggugauuuuggccauacagucgacuccguggaaaaacuuauuaagagacacgaggccuucgaaaaaucaacugcaucuugggcugagcgcuuugccgcacuggagaagccgaccacguuggaacugaaagagaggcaaaucgcugaacgaccugccgaggaaacagggccacaggaggaggaaggagagaccgccggcgaagcgcccguuagccaccaugcugcaacugagcggaccaguccugugucccucuggagcagauuaucuucauccugggaaagucugcagcccgagccaagccacccuuauuga

SEQ ID NO: 63167 - RNA, 6468 nt, Artificial Sequence
  derived and/or modified sequence opt3 from SPTBN1__Homo_sapiens__NP_842565
auggagcugcagagaaccucauccaucucuggcccccucagcccugccuacacagggcaagugcccuauaacuacaaucagcuugaaggaagauucaagcagcugcaggacgagcgggaagcuguccagaaaaagacuuuuacgaaauggguuaacagucacuuggcacgcgugagcugccgaauuaccgauuuauauacagaccugcgugaugguagaaugcuaauaaagcuccuggagguacuuuccggcgaaaggcugccgaaacccacuaaggggcggaugcgcauccauuguuuggagaauguggacaaggcccuccaauuccugaaagagcagagaguccaccuggaaaacaugggaucucaugauauuguggacggcaaucacaggcucaccuuaggucugaucuggacaauuauccuucgguuucagauacaagauaucucgguugagaccgaagacaacaaggagaaaaagucagcgaaagaugcuuugcugcuauggugccagaugaagacugccggguacccuaaugugaacauucauaauuucacaaccagcuggcgcgacggaauggcauuuaacgcccucauccacaagcaccgaccagaucugauugacuucgauaaacuuaagaaaaguaaugcucauuauaaccugcagaaugcauuuaacuuggccgagcagcaccucggccugacgaaguuacuggaccccgaagacaucuccgucgaucauccugacgagaaaucuauaauuacuuacgugguaaccuauuaccacuacuucagcaagaugaaagcucucgccguugaaggcaagagaaucgggaaggugcuugauaaugcgauugagacagagaagaugaucgagaaguaugagucccuggcaucagacuugcuagaauggaucgagcaaacuauuauaauccugaacaacaggaaauuugccaauagucucgucggagugcagcagcaacugcaggcuuucaacaccuaccggacaguggaaaagccacccaaauuuaccgagaaggguaaucuugaaguccuguuguucacgauucagagcaagaugcgugccaacaaucagaaaguuuauaugccucgcgagggcaagcucaucucugauauaaacaaagcaugggagagacuggaaaaggcugagcacgaaagggaguuagcccugcggaaugaacuaauucgacaagagaaacucgagcagcuggcgcgcagauuugacaggaaggccgcaaugcgggaaacuuggcuuuccgagaaccagcgcuuggugucacaggauaauuucggguucgaccugccagcuguagaagccgcuacaaagaaacaugaggccaucgagaccgauaucgcagccuacgaagagagagugcaagcugucguggcgguugcaagggaacucgaggccgaaaacuaucacgacauuaagcguaucacugcucggaaagauaaugugauucgacugugggaguaccuucuggaguugcucagagccaggcgccagcggcuggaaaugaacuuaggacugcagaagauauuucaggagaugcuauauaucauggacuggauggacgaaaugaaaguccucgugcugagccaagauuacggcaagcaucuuuuggguguagaggaccugcuccagaagcacacacugguugaagcagauauugggauccaggccgagagagugaggggagucaaugcuagugcccagaaauucgcaaccgacggcgagggcuacaagccgugugauccccaagugauccgcgaccgagucgcgcauauggaauuuugcuaucaggaguuaugucagcuggcugccgaacggcgugcaagacuugaggaaucuaggcgcuuguggaaauucuuuugggagauggccgaggaagagggguggauucgggaaaaggagaaaauacucuccagcgaugacuacggaaaggaucugacgucggugaugagacuacugucuaaacacagggcuuucgaggacgaaauguccggucgaucaggccacuuugagcaagccaucaaggaaggggaggauaugauugcagaagaacauuucggaagugagaagauccgcgaacggauuaucuauauaagagagcagugggcuaaccucgaacagcugagcgccaucaggaaaaagcgucuugaggaagcguccuugcugcaccaguuucaagccgacgcugaugacauugacgcauggauguuagauauccucaaaauuguuucuagcucagacgugggccaugaugaguacaguacccagucccugguaaagaaacacaaggacgucgccgaggaaaucgcuaauuaucgcccuacacuugauacucugcacgagcaggccagcgcauugccacaggaacaugcggagucucccgacgugcgggguagacucucagggauagaagagagguacaaggagguugccgaacugacccgacuacggaaacaagcucugcaggauacacucgcccuguauaagauguucagugaggcagacgcuugcgaacuuuggauugaugagaaagagcagugguugaacaacaugcagaucccugaaaagcuggaggacuuagaagugauucaacaccgcuuugagagccucgaaccagagaugaauaaccaggccuccagagucgcagugguaaaucagaucgccaggcaacugaugcauucuggccaccccucggagaaagaaauaaaggcucagcaggauaaacuuaacacucgguggagccaguuccgagagcugguggacaggaaaaaggaugcgcuacucuccgcccugucaauccaaaauuaccauuuggaauguaacgagaccaaaaguuggauucgcgaaaagacaaaaguuaucgagucuacccaggaccugggaaaugacuuagcaggcgucauggcucuccagaggaagcugacugggauggagcgugaucuuguggccauugaagccaagcugagcgacuugcagaaagaggcugaaaagcucgaguccgaacacccggaucaagcacaggccauccugucacggcuagcggagauaagcgacgugugggaggaaaugaaaacgacacugaagaacagagaggcuucucuuggagaagccuccaaacuccagcaguuucugagggauuuggacgauuuccaaaguuggcugagccgcacccagacugcaauugccucugaggacaugccuaauaccuuaacagaggcugaaaagcuccugacccagcacgagaacaucaaaaaugaaaucgauaacuacgaggaagacuaucagaagaugcgagauaugggugagauggucacucaaggccagacagacgcacaguacauguuccuuagacaacggcugcaggccuuggacacgggguggaaugagcuccauaagaugugggaaaacaggcagaaucugcuaucccagucacacgcguaucaacaguuucugcgcgauaccaaacaggcugaggccuuccuuaacaaccaggaauacguucucgcacauacugagaugcccacaacccuggaaggagccgaggcugccauuaagaaacaagaggacuuuaugacaacuauggaugcaaaugaagagaagaucaacgcugugguggaaaccggccguagauugguaagugacgguaauauuaacagcgaucggauacaggagaaagucgacucgaucgaugacaggcaccgcaagaaucgagaaacggccuccgaguuacugaugagacucaaggauaaccgggaccugcagaaauuccuucaggauugccaagagcugucuuuguggauuaaugaaaagaugcuaaccgcgcaggacaugagcuaugaugaggccaggaaccugcauucaaaauggcucaagcaccaggcauuuauggcugaacuggccaguaauaaagaguggcuugacaagaucgagaaggaagggaugcaauuaauuuccgagaaaccagaaacagaggcugugguuaaggaaaaacugacuggccuccacaagaugugggagguguuggagucuaccacacagacuaaagcacagcgccuguucgacgccaacaaggccgaacucuuuacccagagcugugcugaucuggacaaguggcuucauggacuggagucccaaauccagucagaugacuacggcaaagauuugacgagcgucaauauacuacugaagaaacagcagaugcucgaaaaccaaauggaggugagaaagaaagaaaucgaggaguuacagagucaggcgcaggcacugucucaagaagggaaguccacagacgagguugauagcaagaggcuuaccgugcagacuaaauucauggaacugcucgagccuuugaaugaacggaagcacaaccugcucgccucgaaagagauucaucaguuuaaucgugacguagaggaugaaauccugugggucggagagcgcaugccccuugcuacaucaaccgaccacggucacaaccuacagacugugcaacuguugauuaagaaaaaccagaccuuacagaaggaaauccaaggccaucagccacgaauagaugacauuuucgagagaucucagaauaucgugacagauaguuccagccugucugccgaggcaaucaggcagcggcucgccgaccugaaacaacuuugggggcugcucauugaagagacggaaaagcgccacagaagguuggaggaagcucaucgggcgcagcaguauuacuuugacgccgcagaggcugaggccuggaugagcgaacaggagcuguacaugauguccgaagagaaggcaaaagaugaacaaucagccgucaguaugcuaaagaaacaccagauacuggagcaggcuguugaggacuaugccgaaaccgugcaucagcucagcaagacuucucgagcgcuuguagcagauucccaccccgagucagaaagaaucaguaugcgccaaagcaaaguggacaagcuguacgccggauuaaaggauuuggcugaggaaaggcggggcaaacuggacgagcgucacagacucuuccagcugaacagggaggucgaugaccuugaacaguggauugccgagcgcgaagugguugcugguucccaugagcuggggcaagauuaugagcacgugacaaugcuccaggaacgguuucgagaguucgcaagagacaccggcaauaucggacaggaaagggucgauacagugaaccauuuggccgacgagcugauuaauucuggccacucggacgcugccacuaucgcagaauggaaggauggguuaaacgaggcgugggccgaccuacuggagcucauagauacccgcacgcagauccuugcugccagcuacgaacugcacaaauucuaucaugacgcaaaggagauuuuuggacggauccaagauaaacacaagaaguugccugaggaacugggcagagaccagaauacaguugaaacccuccagcguaugcauacuaccuucgagcacgauauucaggcucuggguacacaagugaggcagcuucaggaggacgccgcacggcuccaggccgcuuacgcgggggauaaagccgacgauauccaaaagcgcgaaaacgagguccuggaagcauggaaaucauugcuggacgcuugcgagucccgaagaguaagguuaguggauacuggagacaaguuucgguucuuuaguaugguucgcgaccuaaugcuguggauggaagaugugauaagacagauugaggcccaggagaaaccaagggacgucucuagcguggaacuccuuaugaauaaccaucaaggcaucaaggccgagaucgaugcacgaaaugacuccuucaccacauguauugaacuggguaagucauugcuggcucggaaacacuaugccucugaggagaucaaggaaaaacuccugcagcuuacggagaagcguaaagaaaugauagauaagugggaggacagaugggaaugguuacgccugauucucgagguacaccaguuuagcagggaugcgaguguggcugaggccugguugcugggccaggaaccguaccuauccagccgggagaucgggcaaucugucgacgaaguugagaaacugauuaagagacaugaagcauucgagaagucagccgcuaccugggaugagcgcuuuuccgcacucgaaaggcuuacuacacuggaguugcuggaagugcgacggcagcaggaggaagaggagagaaaaaggcgcccaccuaguccagaacccagcaccaaggugucggaggaagccgagucucagcaacagugggacacuuccaaaggagagcaggucagccagaacggccucccugcggaacaagggucaccacgugugaguuaccggucucagacauaucagaauuacaagaacuucaauuccagaaggaccgcuagcgaucagcccuggucaggacuguga

SEQ ID NO: 63168 - RNA, 7173 nt, Artificial Sequence
  derived and/or modified sequence opt3 from SPTBN2__Homo_sapiens__NP_008877
augagcuccacccugucucccacagacuucgauucacucgagauccaaggacaauacagugacauuaacaauagaugggaucuuccugacagcgauugggacaacgauuccucuucggccaggcuguuugaacggucacgcauaaaggcuuuggcugacgagcgagaagccgugcagaagaagacuuucacgaagugggucaauagccacuuagcgcguguuaccugcagagugggggaucuguauagugaccuaagggauggacggaaccuccugcgccuucuggagguguuguccggugaaauccucccaaagccgacaaaaggcagaaugaggauucauugucuggagaauguggacaaggcucugcaguuucucaaggagcagaaaguccacuuagaaaacauggggucucaugauaucguggacggaaaucaccggcugacucuuggcuugguuuggaccauuauccugcgcuuccaaauacaggacaucagcguggagacagaagauaacaaggagaaaaaguccgccaaagacgcacuacuccuguggugccagaugaagaccgccgguuaccccaaugucaacgugcauaauuuuacuacaucauggcgagaugggcuugcuuucaacgcaauuguacacaagcacagaccugaccuguuggauuuugagagucucaaaaaguguaaugcccauuauaaccugcagaaugcuuucaacuuagccgaaaaagagcugggacucaccaaacuucuggacccagaagauguuaacguggaccaacccgaugagaaaagcaucauuacguacgucgcgacuuauuaccacuauuuuucuaagaugaaagcauuggccguggaaggcaagaggaucggcaaggugcuagaccaugcuauggaggccgagcggcuggucgaaaaauacgagucccucgcaucagaacugcuucaguggauagagcagaccauuguuacacugaaugaucgucaguuggcuaacagccucaguggggugcaaaaucagcugcagucuuucaacuccuaccgcacuguagaaaagccuccaaaauuuaccgagaagggaaauuuagaggugcugcuauucacaauccaaagcaaacucagagccaacaaucagaaggucuauacccccagggaaggucggcugauuucggacaucaacaaggcgugggagcgacuugaaaaagccgagcacgaacgcgaguuggcacugagaacggagcucaucaggcaggaaaagcuggagcagcuugcugcccgguuugaccgcaaagcugccaugagagaaacuuggcugucugagaaucaaagguuggugucccaggauaacuucggccucgagcuggcagccguugaagcugcggugcguaagcacgaggcaauugaaacagacauagucgccuacucagggcgggugcaggcuguagaugccguugcagccgaguuagcugccgaacgauaucaugacaucaaaagaauugcagcgaggcagcacaauguggcucgccugugggauuuccuacggcaaauggucgccgcaagaagggagcgccuccugcuuaacuuggagcugcagaagguguuucaggaccuccuguacuuaauggauuggauggaagagaugaagggacgacugcagagucaagaccuuggccggcauuuggccggugucgaagaucuccugcagcuacacgagcugguggaagcugacaucgccguucaggcagagcgugugagagcuguaagcgccuccgcgcucagguucugcaauccugggaaagaguaucgcccaugugauccgcagcuggucucugaacggguggccaaacuugagcaaagcuacgaggcuuugugcgagcuggcagccgcuagaagggcccgauuagaagagucacgccggcucuggagauuucugugggagguuggagaagcagaggcgugggugagggaacagcagcaucuucuggccagugcugacaccggccgugauuugacuggcgcccuccgccugcuaaacaaacacacagcacugagaggggaaauguccggacggcucgguccccugaaacuuaccuuggagcaaggccagcagcuggucgcugaagggcacccuggagccagccaggcaucugccagggcugcggaguuacaagcccagugggaacgacucgaggcacuggcugaggaacgggcccagcgccuugcccaggcugcaucacuguaucaauuccaggccgacgcgaaugacauggaggcuuggcuaguggaugcccucagacugguaaguagcccagaauugggccaugacgaguuuuccacgcaggcacuggccaggcagcaccgggcuuuagaagaggaaauacgaucucauagacccacccucgaugcacugcgcgagcaagccgcggcacuuccuccaacacugucgaggacucccgaggugcagggucguguuccgaccuuggaacggcacuacgaggaacuccaggccagagcaggggagagggcccgcgcucuggaagccgcacuagcucuguacacaaugcuuagcgaggccggcgcguguggacucugggucgaggaaaaagagcaauggcugaacggcuuggcccugccugaacgauuagaggaccucgagguggugcagcagagauucgaaacucuggagcccgaaaugaacacccuugcagcucagauuacagccgucaaugauaucgcugagcaacuguugaaggcaaacccaccugggaaggaccggaucguuaauacccaggaacagcucaaccacagguggcagcaauuucgccgucuggccgauggcaagaaggccgcucuaacuuccgcgcugucaauucagaauuaucaucuugagugcacggagacacaggcauggaugagagagaagaccaaggugaucgagaguacucagggucucggcaacgaccuggccgggguguuggcuuuacaacggaaacuggccggaaccgaaagggaucucgaggcaauugccgcucgcguaggcgaacugacacgagaggcgaaugcccuugcagcuggucaccccgcccaggcagucgccauaaacgcuagacugcgggaggugcagaccgggugggaagacuugagggccacuaugcgcagaagggaggaaucucuaggcgaggcgcggcgucugcaggauuuccuccgcagccuggacgauuuucaagcauggcuuggacgaacacagacggccguugcuuccgaagagggcccagccaccuuacccgaggcugaagcacugcucgcccagcaugcugccuugagaggggagguggaaagggcacaaucagaguacagccggcugcgcgcgcucggagaggaagucacuagagaccaggccgacccucagugucuguuccuuaggcagcggcuggaggcuuuggguacaggcugggaagaacuagggcgaaugugggaaucuagacaaggacgccuggcccaggcacacggcuuucaggguuuccucagggaugcucggcaggccgaggggguguuauccagucaagaguauguucugagccauaccgaaaugccaggcacacuucaggcagccgacgcugcgaucaagaaacuggaggauuuuaugucuacuauggacgccaauggagaacguauucacggccucuuggaggcagggagacagcugguguccgaaggaaacauccacgcugauaagaucagggagaaggccgacucaauugagcgccggcauaaaaagaaucaggaugccgcacaacaguuccucggccgacugagagacaacagggaacagcaacacuuccuucaggauugccaugagcuaaaacuguggauagacgaaaagauguugaccgcucaggauguaaguuacgacgaggcccgcaauuuacacacgaaauggcagaagcaucaagcguuuauggcugaacuggccgcaaacaaggacuggcucgauaaagucgacaaggagggucgggagcugacccuugaaaaaccggagcugaaggcccucgugagcgaaaaauugagagaucugcaccguaggugggacgagcuagagacaacuacccaggcuaaggcacggucgcuguucgaugccaaucgcgcggaacucuuugcucaguccuguugcgcccuugagucuuggcuggagagcuuacaggcacaauugcacucagacgauuaugggaaggaccugacaagugugaacauccuccugaaaaagcagcagaugcuugagugggaaauggccguccgagagaaagagguugaagcuauucaggcccaagcaaaggcucuggcccaggaggaucagggagcgggcgaaguggagagaacuuccagggccguagaagagaaauuccgggcacucugccagcccaugcgcgagagauguaggcgauugcaggcuucucgggaacagcaucaguuucaccgugacguggaggaugaaauccugugggucaccgagagauuaccuauggccagcuccauggaacaugguaaggaccuaccaucagugcaacugcucaugaagaaaaaccagacgcuucagaaggagauucagggccacgagccccgcaucgcagaucugagggaacggcaaagagcuuugggggccgccgcggcuggaccugagcuggcagaacuccaggagauguggaaacgccugggccacgagcuugaacucagggggaagcgacuggaggacgccuugcgggcucagcaguucuacagagacgccgcagaagccgaggcuuggaugggagaacaagagcugcauaugaugggccaggagaaagcgaaggaugaauuaagcgcccaggcagagguuaaaaagcaccaggugcuagaacaagcucuggccgacuaugcacagacaauacaucagcucgccgcuaguucucaagauaugaucgaccacgagcauccagaauccaccaggauuagcauccgccaggcccaggucgauaaacuuuacgcgggucugaaagaguuggcaggggagcgucgggaaagacugcaggagcaccucaggcugugccaacuucgccgagaauuagacgaucuggagcaguggauucaggaacgggaggugguugccgcuucgcacgagcucggacaggacuacgaacaugugacuauguugagagauaaguuuagggaguucucacgcgacacaucuaccaucggccaagaaagagucgauagugccaaugcacuggcuaacggucuaauagccggcgggcacgcugcccgggcaacuguagcggaguggaaagacucccugaaugaggccugggcugaucuccuugaacuguuggacaccaggggacaggugcuggccgcagcuuaugagcuccagcguuuucugcauggcgcccgacaggcauuagcccgcguucaacacaagcagcagcaacuucccgacgggacaggaagagaucugaacgcggcugaagcccuccagcggaggcacugugcauacgagcaugacauucaggcccuaagcccucaggugcaacagguccaggaugacggccaccgccugcagaaggcuuaugccggugauaaagcagaagagaucgggagacauaugcaagcuguggccgaggcgugggcucaguugcagggaucuagcgccgcacggaggcagcugcuccuugacacgaccgauaaguuccgauuuuucaaagccguacgugaacugauguuguggauggacgaggugaaucugcaaauggaugcucaggaaagaccgcgcgacgucuccucagcagaucucguuauuaagaaccagcagggcaucaaagccgagauagaagcgcgggccgacagguuuaguagcugcaucgacauggguaaggaguuacuggcuagaucucacuacgcagccgaggaaauuuccgagaaacuuucacaacugcaggcucgccggcaggaaacugccgagaaguggcaagaaaagauggauuggcuacagcucgugcuggagguguuggucuucggcagggacgcagggauggcugaggccuggcuguguagucaggaaccacucgugcgaagcgcggagcuuggaugcacaguugaugaaguagagucccugaucaaaagacaugaggccuuccagaagucugcaguggcuugggaagaacgguuuugugccuuagaaaaacugaccgcauuggaggaaagggagaaggagcgcaaacguaagagagaagaggaggaacgaaggaagcaacccccugcccccgaaccaacagcuucggucccucccggcgaccucguagggggacagacugccagcgauaccacgugggacggcacacagccacggccgccucccucaacccaggcgccauccguuaauggugugugcacugauggggagcccagucaaccucugcuaggacagcagcgccuugagcacucuagcuucccagaaggccccggcccuggguccggagacgaggcuaacgguccgagaggcgaaaggcagacccggacacgcgggccagcacccucagccaugccucaaucuagaagcacugagagugcucacgccgcaacccugccaccccgaggaccugaaccguccgcccaggagcagauggagggcaugcucuguaggaaacaagaaauggaggcuuuugguaagaaagcggccaaucggagcuggcagaacgucuauugcgugcugcgucgcgggucuuugggauucuacaaggaugcaaaagccgcuucagcaggcguacccuaucauggcgaagucccagugucccuggccagagcucaggggaguguugccuuugacuacaggaagcggaagcacguguucaaacucggacuucaggaugguaaggaguaccuguuucaagcgaaagacgaggcagaaaugagcucgugguuaagagucgugaaugccgcuauugccacagcaucuuccgcuagcggcgagccugaggaacccguugugccaucaacgacccgcgggaugacucgagccaugacaaugccucccgucaguccagugggagcggaaggcccgguagugcugaggucuaaggauggucgggagagagagcgugaaaaacgcuucuccuuuuucaagaaaaacaaguga

SEQ ID NO: 63169 - RNA, 7695 nt, Artificial Sequence
  derived and/or modified sequence opt3 from SPTBN4__Homo_sapiens__NP_066022
auggcccaggugcccggcgaggucgacaacauggaagggcugccugcuccaaauaacaauccggcagccagaugggagagccccgauaggggaugggaacgggagcaaccugcggcuuccaccgccgcagccucucucuucgaaugcucacgcaucaaggcucuugcagacgagcgagaggccguucagaagaagacauuuacuaagugggugaacagucaccuggcucguguagguugucauauuggcgauuuguacguggacuuaagagauggguucguccugacgaggcuacucgaagugcugagcggagagcagcuuccacggcccacccgcggcagaaugaggauacacucccuggaaaauguugacaaggccuugcaguuucucaaagagcaacgggugcaucuggagaacgucgguucucacgauaucguggacgggaaucaucgccugacacucggauuaguauggacuauuauccugcgauuccagauucagguuaucaagauagaaaccgaggauaacagagaaacaaggucggcgaaggacgcacuuuugcuguggugccagaugaaaaccgccggcuauccugaggugaauauccaaaacuuuacuacaucauggcgggauggccuagcuuucaaugcccucauucaccgucaccgcccagaccuggucgauuuuagcaaacuuaccaaaaguaacgcaaauuacaaccugcagagagcuuucaggacggccgaacagcauuuggggcucgcgcggcuguuagaccccgaggacgugaauauggaggccccugaugaaaaguccaucauuacuuauguggucucuuuuuaccacuauuucagcaaaaugaaggcacuggcuguugagggaaagcgaaucgguaaagugcucgaccagguacuugaagugggcaagauaauugagcgcuacgaggaacuggccgcugaguugcuagccuggauccauagaaccgucgggcugauuuccaaccaaaaauuugcaaacucacucaguggagugcagcagcaacugcaggccuucacagcuuauuguacucuugaaaagccaguuaaauuucaggagaagggcaaucuggaagugcuacucuucagcauccagucuaaacugagggcgugcaaccggcgcuuauucgucccgagagaggguugugggaucugggauauugacaaggcauggggagaacuggagaaggccgagcacgaaagggaggcugcccuacgugcagaacucauacggcaagagaaacuggagcuuuuggcccagcgauuugaucacaagguggcuaugagagaauccuggcugaaugagaaccagaggcucguaucacaggacaauuucggcuacgaacugcccgccguugaggcagcgaugaaaaagcaugaagcuaucgaggccgauauugcagccuacgaggaacgcgugcaaggcgucgcugagcuugcccaggcacuggcugccgaaggguauuacgacauccggagaguggcggcccagagggauagcgucuugcgccagugggcucuccugaccggauuagugggugcacgacggacacgucuggagcaaaaccuagcccuccagaaaguuuuucaggaaaugguguauaugguagacuggauggaggagaugcaggcucaacugcuuaguagagaaugcggccagcacuuggucgaggccgaugaccugcuccagaagcaugggcuguuagaaggagacauagcagcgcaaucugagaggguggaagcccugaaugcugccgcacuucgcuucucccaguugcagggcuaccagccuugugauccacaaguuauuugcaaccgggugaaucacguccaugguugucucgcugagcugcaggagcaggccgcaagaaggcgagccgaacuagaggcuagccgcucgcugugggcgcuccugcaggaacuugaggaggccgaaucuugggcacgggacaaggagagauugcuggaagcugccgggggcggaggcgccgcuggggcagccggagcggcugguaccgccggcggggcacacgauuuauccucaacggccaggcuccuggcucaacacaaaauccuucagggagagcugggcggucgucgcgcauugcuccagcaggcccugcggugcggggaagaauugguggcggcuggcggagccguaggccccggggcagacacugugcaucugguuggacucgccgagagagcugccagugcaaggcgacgguggcaacgccuggaagaggcugccgcgagaagggaacggcgacuucaggaggccagagcauugcaccaguuuggugcugaucuggacggcuuacucgauuggcugcgcgacgccuauaggcuugcugcagccggggauuucggacaugacgaagccagcucccgucggcuggcuagacaacacagggcgcuaacaggcgaggucgaggcacaccgcgguccugugucugggcuccgaagacagcuggccaccuugggcggagcuagcggcgccgggccacugguggucgcauuacagguucgggugguggaagccgagcagcucuuugcugaaguaacugaggucgcggcccugaggcgccaauggcuucgugaugcacuggcuguguacagaauguucggagaaguucaugccugugaguuguggaucggcgagaaggaacaguggcuccugucaaugcgggugcccgacagucuagaugacgucgaggugguucagcacagguuugaaucccuggaccaggagaugaacagccuuaugggucgcgugcucgauguaaaucauacaguccaagagcugguggaagggggacacccgucuucagacgaggugcgaaguugccaggaucauuugaacagcagauggaaucggauugucgaacugguugagcagaggaaagaagagauguccgcaguguuacucguagagaaccacgugcuggaagucgccgaggugcgcgcucagguuagagaaaagaggcgggccguggagucugcgccucgugcaggcggugcccuucaauggcgccugucgggcuuggaagcugcccuccaggcucuggagccccgacaggcagcccuacuggaggaagcugcccuucucgcagagagauucccagcgcaggccgcuaggcugcaccaaggggccgaagaguugggagcagaauggggcgcuuuagccagcgcagcccaggcuugcggggaggcggucgccgcagcuggacggcugcagcgcuuucuccaugaccuggaugccuuccuugacuggcuggugagagcccaagaggcagcuggcgguuccgaagggccuuugcccaauucacuagaggaagccgaugcgcugcucgcuaggcacgccgcacugaaagaggagguugaccagcgggaagaggauuaugcccgaaucguggcugcaagugaagcccuuuuagcggcugacggagccgagcugggcccaggucucgcauuggaugaauggcugccccaucucgagcugggcuggcacaaacuucugggguugugggaggccagacgcgaagcucuaguccaggcccauauuuaccagcuguuucucagggacuuacggcaagcacugguagugcuucguaaccaggagauggcucugucuggagccgaacucccuggcaccguugagagcguggaagaggcguugaagcagcacagagauuuccugacgaccauggagcucucccagcagaagaugcaggucgccgugcaggcagcugaagggcugcuuaggcagggaaacauauacggcgagcaagcccaggaagcaguaacacgccuacuggagaagaaucaggaaaaccaauugcgggcucagcaguggaugcagaaauuacacgaccaacuggagcuccagcauuuccugcgagacugucacgagcuugaugguuggauccaugaaaagaugcugauggccagagacgggacuagggaggauaaucacaaacuccacaagcgcugguugcggcaucaggccuuuauggcggaacuggcucagaacaaggaguggcuagagaaaauugaaagagagggacaacagcugaugcaggaaaagccagagcucgcagccucagugcguaagaaacuuggcgaaaucaggcagugcugggcugagcuggagagcaccacacaagccaaagcacggcaguuauucgaagccucuaaagcugaccaguugguccaguccuuugcggagcuggauaaaaagcuccugcacauggaaagucaacuucaggacguugauccggguggcgaccuggccacugugaauagccagcucaagaaauugcaaucuauggagucccagguggaagagugguaucgcgaggucggggaacugcaggcacagaccgcugccuuaccccuagagccugcaucaaaggaacuggugggagagcgacaaaacgccguuggcgaaagacucguaaggcuucuggagccauugcaggagcggcgcagacugcuccuggcuaguaaagaacuucaucagguggcccacgaucucgacgaugagcuggcguggguccaggaaagguugccccuggcaaugcaaacagagcgagggaauggauuacaggccgugcagcagcauaucaagaaaaaccaaggccuacggcgugagauucaggcucacgguccuagacuggaagagguucucgaacgcgccggggcacuugcuagccugaggucgccagaggccgaagcugugcggagaggauuggagcagcugcaauccgccugggcaggccuccgcgaggcggccgaaaggcgacagcagguccuggacgcugccuuccagguggagcaauacuauuuugacguagcagaagucgaggcuuggcuuggcgaacaggaguuacugaugaugucugaggauaaggggaaggacgaacagagcacccuccaguugcugaaaaagcaccuacaacuggagcagggaguggaaaauuacgaggaaucaauagcccagcucagucggcaguguagagcacuucuggagaugggucaucccgauuccgagcaaaucucuaggcgccagagccagguugaccguuuguauguggcccugaaagaacucggcgaggaacggagagucgcgcuggagcaacaguacugguuauaucagcuuuccaggcaagugucagagcuggaacacuggauugcugagaaggaaguuguggccgggagcccggagcucggacaagauuucgaacaugucagugugcuacaggagaaauuuucugaguucgcauccgaaacuggcauggccggucgcgagcgacuggcugccguaaaccagaugguggacgaauugaucgagugcgggcacacggcagcugccacaauggcggaauggaaggauggacugaaugaggcuugggccgagcuccuugaacugaugggcacccgggcacaguugcuggccgcuagcagagagcuccacaaguuuuucucggacgcaagggaauuacaaggccagauugaggaaaaacgcagacggcugccuaggcuuacuaccccacccgagccucgucccucagccucuaguaugcagcgaacacugcgcgcguuugagcaugaucuacagcuccugguuucccaagucagacaguugcaggaaggggccgcucagcugcggaccguguacgcaggagagcacgccgaagcuaucgccagcagggagcaagaggugcuccaggguuggaaggaacuucugucugcaugugaggacgcucgcuuacaugucagcuccacugccgaugcgcugagauuccacucacagguacgggacuugcucaguuggauggauggcauagccagccaaaucggggcagcugacaaaccaagggacgugucuuccguugaagugcugaugaacuaccaucagggacuaaagacagagcuugaagcccgagucccugagcugacgaccugccaggagcucggccguucacuguugcugaauaaaagugcaauggccgaugaaauucaggcucaacucgacaaacuugguacuagaaaggaggaagugagcgagaaaugggaucgccacugggaauggcugcagcagauguuagagguucaccaguuugcccaagaggcgguggucgcugacgcauggcugacagcccaggaacccuugcuccagucccgggagcuggggucuucgguggaugaaguagagcagcuaaucaggagacaugaggcuuuccgcaaggccgcagccgcuugggaggagcgguucagcucacuuaggcgacugaccacaauugagaagaucaaggcggagcaauccaaacagccaccgacuccucuccugggaagaaaguuuuucggcgaccccaccgaauuggccgcaaaagccgcuccauuacugcggcccggcggguaugagaggggacucgagccucuugcacgccgugccagugauacgcugucugcugaagugagaacccgaguugguuacgucaggcaggagcuaaagccagaacggcugcaaccccgcauagacagacucccugagauuccgggcaggguggaaccagccgcguugcccgcagccccugaggaugcugccgagacaccagcaacucccgcugccgcggaacaggugcggccucgcccggagagacaggaaagcgccgaccgagcugaggaacugcccaggcggcgucgcccagagagacaggaguccgucgaucaaucagaagaggcagccaggcggagacgcccugaacgacaggagucugcugaacacgaggcagcccauagccuuacccuggggagguaugagcagauggaacggagacgugagcgcagggaacggagacucgagcgacaggagaguuccgaacaagagaugcccaucaggggagacuuaguuaagggcaaagcuacacuggccgauauuguggaacaguugcaggagaaggaagcagguccagggcugccugccggacccagccucccacagccgcgcgagcuuccucccggccggcugccaaacggccuagagcugcccgaaagaacuccuaggccagaccgcccccgugcgcgggacagaccuaaaccgcgaaggcgcccacggcccagagaagggggagaagguggcgggucuaggcgcucaagauccgcuccugcccaaggaggcagugcacccgccccaccucccccaccuacccacacgguacagcacgaggguuuucucuugcggaagcgagaacuggaugcuaauaggaaaagcucgaaccguucuugggugucccuuuacuguguccugagcaagggggaguuaggauucuauaaggacucaaaaggcccggccaguggcucuacacaugggggagagccccuccuguccuugcacaaggcaaccagcgaaguggcuucagauuacaaaaagaaaaagcauguuuuuaagcugcagacucaggacgguagugaguuccuccuucaagccaaagaugaagaggaaaugaacggcuggcuggaggcgguggcaagcuccgucgccgagcacgcugaaaucgccagaugggggcagacacuaccaaccacuucuagcaccgacgagggaaauccuaagcgggaaggcggugaucgcagggcuuccgggcgaagaaaauga

SEQ ID NO: 63170 - RNA, 11025 nt, Artificial Sequence
  derived and/or modified sequence opt3 from SPTBN5__Homo_sapiens__NP_057726
auggccggacaaccccacagcccuagagagcugcucggggcugccggacauaggucccggcgcccaucuaccgaacuucgagugccgcccucaccuagucugacaauggacagccaauacgagacuggucacauccguaaguugcaagccagacauaugcagaugcaggagaagacguucaccaaguggauuaacaaugucuuucaaugcggccaggcggggauaaaaaucaggaacuuauauacagagcuggcugauggcauucaccuacuccggcugcuugaacugaucuccggcgaggccuugccacccccuucucgcgguagacucaggguucauuuccuggaaaauucgucacgggcacuggccuuucuccgcgcuaaggugccaguccccuuaauugggccugaaaacaucguggacggagaucagacucugauacuuggcuugaucugggucauuauccugcgauuccagauuagccacaucagucuagacaaagaggaauuuggcgcauccgccgcucuccugucuaccaaggaggcccuucugguguggugucaaagaaagacagcgagcuacaccaauguuaacauaacugauuucuccaggucauggagugacggguugggauuuaaugcacucauucacgcccaucggccagaucuguuagacuaugguagccugcguccggaucgcccccuccacaaccuugcuuucgccuuucugguggcagagcaggaauugggcaucgcucagcuacuggacccugaggaugucgccgcggcccagccagacgaaagaucuauuaugacauacgugucccucuauuaccauuauugcucaaggcugcaccaagggcagaccguacagcggcgacuuacgaaaauccuguugcaacuccaggagacugaacuguuacagacccaguacgagcaacugguugcagaucuacuccgcuggaucgcugagaagcagaugcagcuggaagccagagacuuccccgacagccuuccugcuaugaggcaguugcuggccgcauuuacaauuuuccggacucaagagaaaccaccccgccuccagcagagaggagccgcugaagcgcugcuuuuuaggcugcagaccgcauugcaagcccagaaucgucggccguuccucccucacgagggccuggguuuagcugaacugagucaguguugggccgggcuagagugggcagaggccgcucgaucucaggcccuccaacagagacugcuucaguugcaaaggcuggaaacacucgcacgccgguuccagcauaaggcggcucugagagaguccuuuuuaaaagaugccgaacaggugcuggaccaggcaagggcacccccagcuagccuugccaccgucgaggcagcugugcaacgcuugggaaugcucgaagccggcauacugccucaggagggccgauuccaggcgcuagccgagaucgcugauauucugcggcaggaacaauaccacucgugggcagacguggcccguagacaggaggaagucacgguuagguggcagcgccuccugcagcaucuucaagggcagcggaagcaaguggcugauaugcaagccguauugucucuguuacaggagguggaggcagcgucccaccagcucgaagaacugcaggaacccgccagaucaacugcuugcggacaacagcuugccgaggucguggaacuguugcagaggcaugaccuccuggaggcacagguuagugcucacggugcccacgugagccaucuagcacaacagacagccgagcuggauuccucucucggcaccagcgucgaagugcugcaggcuaaggcgcgaacucuugcccaguugcaacagucacugguagcauuaguucgcgcucggagagcccuccuggagcagacacuucagagggccgaauuucugcguaacugugaggaagaggaggcuuggcuaaaagaaugcgggcaacgcgugggaaaugcagcccucggccgggaccugagucagaucgcgggugcuuugcagaagcacaaagcccuggaggcagaaguccauagacaccaagccgugugugucgauuuagugaggcgagggcgggaccucuccgcucgcagaccacccacccagccugauccaggcgagagggcagaagccguucagggaggcuggcagcugcuucaaacgcgggugguagggcgaggagcgagacugcagaccgcuuugcucguccugcaguauuucgccgacgcagccgaggcugccagcuggcuacgcgagaggcguucuucacuggaacgggcaaguugcggucaggaccaagcugccgcggagacacuucucagaaggcacgugcgccuggaacgaguuuugagagccuuugcagcugagcugcggagguuagaggaacagggccgcgccgcuagcgcacgugccucccucuucacugugaacucugcccugucgccgcccggggagagccuuagaaauccuggaccaugguccgaggcuucaugucaucccggcccuggugaugcguggaagauggcacugccagccgagcccgacccggauuuugacccuaacaccauauugcagacacaggaucaccucagucaagacuacgaaucucugcgggcucuagcccagcugaggcgcgcacgacuugaggaggccauggcucucuucggguuuugcagcuccuguggcgaacugcaguugugguuagagaaacaaacuguccugcuccagagagugcagccacaggcggauacccuggaaguaaugcaacuuaaguaugagaauuuccugacagccuuggcagugggaaaaggccuaugggcugaaguuucaagcucugccgagcagcugcggcagagguaccccgggaacuccacccagauucaacgccagcaggaggaacucagucagagauggggacaacuggaggcacuuaagagggaaaaggccguccaguuagcucauagcguggaggugugcucuuuucugcaggaaugcgguccuacucagguccaacuccgggacguuuugcugcagcucgaggcccugcagcccggcuccucagaggauacgugucacgcgcuucaacuggcacagaaaaagacauuggugcuagaacgucgcgugcauuuccugcagaguguagucgugaaaguugaggaaccaggguaugccgagagccagccucuccaaggacagguggagaccuuacagggccugcuuaagcagguccaagaacagguggcucagcgagccagaaggcaggcugagacucaagcacggcagucguuucugcaggaaucccaacagcucuugcugugggccgagucuguucaggcucagcuccgcagcaaagaagugucaguagacgucgccagugcacaaagacugcuuagggagcaccaggaucuacuggaggaaauccacuuguggcaggagcgguuacagcaacuggacgcgcagucccagcccauggccgcucucgauugcccagacucucaggaagugccgaacacccugcgagugcuuggucaacaggggcaggagcugaagguccucugggaacaaagacagcagugguugcaggagggccuggagcuacaaaaguucggacgcgaaguugacggcuucacagccaccugugcaaaucaucaggcuuggcugcaccucgauaaccuuggggaggacgugagggaagcccugagcuuauugcagcagcaucgggaguuuggacgucugcucuccacucugggcccuagagcagaagcccuuagggcucacggugagaaacugguacaaucacagcaucccgcggcccacacagugcgcgagcagcuccagagcauccaagcacaguggacgcgguugcaggggcgaagugaacagagaaggcgccaacuguuagcuucucuacagcugcaggaguggaagcaagaugucgccgaacucaugcaguggauggaggagaaaggacuuauggccgcacacgaaccauccggcgcucggagaaauauucugcagaccuugaagcgucaugaggccgcggaaagcgagcugcucgcuacuaggcggcacguggaagcccugcagcaaguuggucgcgagcuucucucgcgaagacccugcggccaggaggacauccagacaaggcugcagggguugcggucaaaaugggaagcacugaaccgcaagaugaccgagagaggagaugaauuacaacaggccggccagcaggagcaacuacugaggcagcuccaggacgcuaaggaacaacuugagcagcuggagggggcauugcagucuagugaaacaggacaggaucugcgauccagccaacggcuccagaaacgucaucagcagcuggagucugaaagcagaacucuugccgcgaagauggcugccuuagcauccauggcccacggcauggcugccaguccugccauucuggaggaaacccaaaaacaccuccgcagguuggagcugcuacagggucaucuggcuauacgggggcuccagcuucaggccucaguggagcugcaccaauucugucauuugagcaauauggaacugucuugggucgcggagcacaugccacauggaucccccacgucauacaccgaaugccucaacggcgcccagagucugcacagaaagcacaaagaguuacagguggagguuaaggcacaucagggucaagugcagcgcguccuuagcuccggcaggucucuggcugccucggggcacccucaggcacaacauaucguagaacagugucaggagcucgaaggacacugggcugagcuagaacgagccugcgaggcccgggcgcagugucugcaacaggcugugacauuucagcaguauuucuuggacguuagcgagcuggaaggcuggguggaggaaaagagaccgcucgucucauccagggauuacgggcgcgacgaggcagccacucuucgucugauuaauaaacaccaggcuuugcaggaagaacuggccaucuacuggaguucuauggaggaacucgaucagaccgcacagacauuaacuggaccagaggugcccgaacaacagcggguagugcaggagagacugagggaacaacuucgcgcccugcaggagcuagcugcgacccgagaccgggagcucgaaggcacgcugagauugcaugaguuucugagggaagccgaggaucuccaggguuggcuugcaagccagaagcaagcugccaaagggggagagucccugggcgaagacccugagcacgcauuacaucugugcacaaaguucgccaaauuucagcaccaggucgaaauggguucacagcgcguugcugccuguagauugcucgcggagucucugcuagaacggggccauagcgcagggccaauggugaggcaacgucagcaggaccuucagaccgccuggagugagcugugggagcucacucaagcucgaggacacgcccugcgcgauacagaaaccacuuugagagugcaccgggaccugcucgagguccuuacccaggugcaggaaaaggcaacaucccugcccaacaauguugcuagggauuuaugcggccuggaggcccaauugcgcagccaucaggggcucgaaagagagcugguaggaacggagcggcagcuacaggaacuucuggagaccgcuggcagggugcaaaaacucugcccugguccgcaggcccacgcaguccagcagcgacaacaggcggugacucaggccugggcuguucugcagcguagaauggaacaacgccgggcccaguuggagagggcaagauuacuggcucgcuuccggacagccgugagggacuaugcaucuugggccgcgcgagucagacaggaucuccagguggaagagucaucccaagagcccaguagcgggccacuuaagcugucggcucaucaguggcuacgggccgaacuggaggcaagggaaaagcucuggcagcaagccacccaguugggacagcaggcucugcuugccgcaggcacaccuacuaaagagguacaagaggaacugcgcgcucuccaggaccagcgugaucaggucuaccaaaccugggccagaaagcaggagcgauuacaggcggaacagcaagagcagcuguuuuugagggaauguggccggcuggaggagauccucgcugcccaggaagugucucuuaaaacguccgcacuggggagcucaguugaggaaguggagcaacuaauucgcaagcacgaagucuuccugaaagugcucacagcccaggacaagaaggaggcugcauugagagagaggcugaaaacccuucggcgccccagaguucgagauaggcugccaauauuacuccagcggcguaugcgcgugaaggaacuggccgagaguagaggacacgcguugcaugccucucugcucauggcuuccuuuacucaggcagccacccaagcugaagacuggauccaggccugggcacagcagcuuaaagagccuguacccccaggugaucugagggacaagcuaaaaccgcugcucaagcaccaggcuuucgaagccgaggugcaggcgcaugaggaaguaaugacaagcguggccaagaaaggcgaggcauugcuggcucagucacacccucgggccggggaaguuagucagagauuacaaggacuucgcaagcauugggaggaccugcgacaggcaauggcccucaggggccaggagcuggaagaucggagaaacuuuuuggaguuccugcagcgugucgaccucgcugaagccuggauucaagagaaagaagugaagaugaaugugggugaucuugggcaggaccuggagcacugccuacagcugcgcaggcgguuaagagaguuccgaggaaacagcgcgggcgauacugucggcgacgcuuguaucagguccauuucugaucucagccugcaauugaaaaaucgcgaccccgaagagguaaagaucauaugccagcggagaucccagcuuaacaauaggugggcaucauuucacgggaaccugcuccgcuaucagcaacagcuggaaggagccuuggagauccaugugcugucucgugaacuagauaacguuaccaagcggauucaggagaaagaggcucucauccaggcccuugacugugguaaggaucuggaaagugugcaaagauuacugcgaaaacacgaggaacucgagagggaaguccauccaauucaggcacagguggagucgcuggagcgcgaaguuggccgguugugccagagaagccccgaggccgcucacgggcuuaggcaucgccaacaggaaguggcggaguccugguggcagcugagaucucgggcccaaaagcgaagggaggcacucgacgcccugcaccaggcucagaaacuacaggcaauguugcaagaacugcucgucucagcccagcgucuuagagcucagauggauacaagcccugccccacggucccccguggaggcgcgcaggaugcuggaagaacaccaggaauguaaggcagaguuagacaguuggacggacucuaucagccuggcccgaucaaccggacaacagcuccugacugcuggccauccuuucuccagugauauaagacagguauuggccggucuugagcaggaacugagcucucucgagggggcauggcaagaacaccagcugcagcuacagcaggcuuuagagcugcaguuguuucucuccucaguggagaagauggagcgguggcugugcagcaaggaggacucgcuugccucugaaggacugugggauccgcucgcgccaauggagccccuguuguggaagcauaaaaugcuugaaugggaccuggagguucaggccggcaagauuagugcucuagaagcaacagcccgcggccuccaccaagggggacacccugaggcucaguccgcacuggguaggugucaggccauguuacugagaaaagaggcuuuguuccggcaggccggcacccgucgccauaggcucgaagaacugcgacaacuucaggcauuucugcaggauagccaggaagucgccgcguggcucagagagaagaauuugguggcucuggaggaagggcuucuggacacugccauguuacccgcacaacuacagaaacagcagaacuuccaagccgagcucgaugcuucaaugcaccagcagcaagaacugcagcgggagggacagaggcuguugcagggcggucauccagccuccgaagcaauccaagagcgccucgaggaacugggggcucuuuggggagagcugcaggacaauucucagaagaagguggccaaauuacagaaggcgugcgaagcacucagacugcggaggagcauggaggaauuggagaacuggcuugagccuauugaagucgagcugcgcgcccccacaguuggccaagcucuaccaggcgugggggaacuccugggaacccagcgagagcuggaagccgcuguagauaaaaaggcaagacaggccgaggcguugcucggucaggcccaggcuuuugugcgugagggccacugucuggcacaggacgucgaggagcaagcccggaggcuucugcaacgcuucaaaaguuuaagagaaccucuccaggagcggaggacggcucuggaggcccgaucccuauugcugaaguuuuucagagaugcagacgaagagauggccugggugcaggaaaaacuuccgcucgcugcggcccaggauuacgggcaaagccugucugcaguucgccaucugcaggagcagcaccagaauuuggaaucagagaugaguucccacgaggcucuuacucgggugguccucggaaccggcuauaaacugguacaagccggucauuuugcagcccacgaaguggcugcgaggguucagcaguuagagaaggccauggcacaucugcgugcugaagccgccagacgcaggcuacuccugcagcaagcucaggaggcacagcaguucuugacagaacugcuugaggccgggagcuggcucgcugagcggggacacgugcuggacucugaagacaugggccacucggcggaggccacccaagcauuacugcgaagauuggaagccacuaaacgcgaucucgaggcuuucucacccaggaucgaacggcugcagcagacagcagcccuucuggagagcagaaagaacccagaguccccuaaaguccuagcucaacuccaggccgugcgugaagcacaugcggagcuguugcgcagggccgaagcucggggccacgggcugcaggagcagcuucaacuccaucagcuggagcgagaaaccuuacuguuggacgccuggcucacaacuaaggcagcuaccgccgagagucaggauuacggacaggaccuggaaggugucaaggugcuugaggaaaaauuugaugcguucagaaaggagguucaaucucugggccaggccaaaguguaugcucuaaggaagcucgcagggacgcuggagcgcggagcaccccggagauacccacacauacaggcucagcgaagcaggaucgaagcagccugggagcgguuggaccaagccauuaaagcucgcacagaaaaucuggcagccgcgcaugagguacacuccuuucagcaggcugccgcagaacuucaaggcagaaugcaggagaagaccgccuuaaugaagggugaggaugggggccacucacugaguucugugcguacucuccagcagcaacauaggcggcuggaaagagagcuagaagcuauggagaaagaagucgcccgcuugcagaccgaggcaugcaggcugggacagcuccacccugcugcccccggcgggcuugcgaagguucaggaggcaugggccacacugcaagcuaaagcccaggaacgaggacaguggcucgcucaggcagcccaaggucaugcguuccugggccggugccaggaguuauuggccugggcucaggaaagacaggagcuggcaagcuccgaggaacuugccgaggacguggcuggggccgaacaacugcucggacagcacgaggaacugggccaggagauccgcgaguguaggcuacaagcacaggaucuucgucaggaaggucagcaacuggucgacaacucacauuuuaugagcgccgaggugacugaaugccuccaggaguuggaagggagacugcaggaguuagaggaggcuugggcgcugcgguggcagcgcugugccgagucuuggggccuccaaaaacuuaggcagcgacuggaacaggcagaggcuugguuggccugcugggaaggacugcuccuaaaaccggauuacggccacuccguaagugacguggagcugcuucugcacagacaucaggaccucgagaaguugcuggcagcccaagaagagaaauucgcucagaugcagaagaccgaaauggagcaagaguuacugcuccagccacaggaacuuaagccugggcgggcgggaagcucgcugacguccuuucaguggcgccccucuggucaccaaggcuugggggcccagcuggcagagacaagggauccacaggacgcuaaaggaacccccacuauggaaggcucacucgaguucaagcagcaucuacugccuggugggagacaaccgagcaguuccucuugggauagcugucggggcaauuuacagggaucaucccugagucucuuucuugacgaacguauggccgccgagaaaguugcuagcauugcauugcuggaucugacaggcgcccgaugcgagaggcuccgcgggagacacggacggaagcacaccuucucucuuaggcugacuucaggcgcggaaaucuuguuugcugcccccuccgaggaacaggcagagagcugguggcgcgcccuggguucuacagcugcacagagucucucgccaaaacuaaaggccaagccuguguccagccugaacgaauguaccacgaaagacgcuagacccgggugcuuacuucggucagauccuuga

SEQ ID NO: 63171 - RNA, 1422 nt, Artificial Sequence
  derived and/or modified sequence opt3 from SPTLC1__Homo_sapiens__NP_006406
auggccaccgcuacagagcagugggugcuggucgaaaugguucaagcacucuacgaggcccccgcguaucaccuuauccuggaaggcauuuugauauuauggaucauuagacugcuauucagcaagacuuacaaacuccaggagagguccgaccugacggugaaggaaaaagaggagcuuaucgaagaguggcagccugaaccacugguaccgcccgugccuaaggaucauccagcuuugaacuauaauauugucucugggcccccuucacacaaaaccgugguuaacggaaaggagugcaucaauuuugccaguuucaacuuucucggucugcuggacaauccacgggugaaggcagccgcucucgcaagccugaaaaaguacggcgucgggacauguggaccccgcggcuucuaugguacuuuugaugugcaucuggaccuugaggaucgauuggccaaauucaugaagaccgaagaggcuauaaucuacuccuauggguuugccacaauugcgucugcaaucccugccuacucgaaacguggagacauuguauucguugauagagcugccugcuuugcaauccagaagggccugcaggcuucaaggagcgacauaaagcuauucaaacacaacgauauggccgaccucgaacggcugcuuaaggagcaagaaauugaggaucagaaaaauccacgcaaggcgagagugaccaggcgguuuaucgucguggagggccuguacaugaacacugggacaauuuguccguugcccgaacucgugaaacugaaguauaaauacaaggcccgcaucuucuuagaggaaagucuguccuuuggaguccucggugagcauggccgagggguuaccgaacacuauggaaucaauauugacgauauagaccuuaucucugcaaacauggagaaugcucuggccagcauuggcgguuucugcugugggagauccuucgugaucgaccaccagagguugucaggacaaggcuacugcuuuagugcuagccuaccuccacugcucgccgcagccgcuauagaggcgcugaacauuauggaagagaaucccggcaucuucgcaguacuuaaggaaaaaugugggcagauccauaaggcccugcagggaauuucugguuugaaaguggucggcgagucccucagcccugcuuuucacuuacaguuagaagagucaacggggagucgggagcaagaugugcgucugcuacaggaaaucguugaccagugcaugaaccgcucuauugcccucacucaagcaagauaucuggagaaggaagagaaaugucuuccacccccguccauaaggguggucgugaccguagagcagacagaagaggaauuggagcgggccgcuagcacuaucaaggaaguugcccaggcagugcugcucuga

SEQ ID NO: 63172 - RNA, 1689 nt, Artificial Sequence
  derived and/or modified sequence opt3 from SPTLC2__Homo_sapiens__NP_004854
augagacccgagccuggcgggugcuguugcaggcggaccgugcgcgccaacggaugugucgcuaauggugaaguucgaaacggcuacgugcguagcuccgcagccgcggcugccgcagccgcugcagggcagauccaccauguaacacaaaauggaggccuguauaagagaccauucaacgaggccuuugaagagacuccgaugcucguggcuguccuuacguacguggguuaugggguucugaccuuguucggauacuuaagggacuuucugcgguauuggcgcauugaaaaaugccaccaugccacagagagagaggaacagaaggauuucgugucucuauaccaggacuuugagaauuucuauacuaggaaccucuacaugcggauacgcgauaauuggaaccgacccaucuguucagucccuggcgcgagaguggacauuauggaaaggcagagucacgauuacaauuggagcuuuaaauauaccggcaacaucauuaaggggguaaucaauaugggauccuacaacuaucuggguuucgcacggaauacaggcucuugccaagaggccgcugccaaaguucuugaggaauacggggcaggaguguguucgacccgucaggagauaggcaaccuggacaagcaugaagaguuggaggaacucgucgcucgcuuucuggguguggaggccgcgauggccuaugggaugggauucgcaacuaauucaaugaacaucccagcucuggugggcaagggcugccucauuuuaagcgaugaacugaaccacgccagucuugucuugggggcuagacuguccggagccacaaucaggauuuuuaaacacaauaacaugcagucucuagagaagcuccugaaagacgcaaucguuuacggucagccccggacccgacgcccuuggaagaaaauacuuauucugguggaaggcaucuauagcauggagggguccauuguaagauugccagaagugaucgcccucaagaagaaauacaaggcuuaccuguauuuagaugaggcgcauucaaucggagcacugggccccacggguaggggcgucguggaguacuucgggcucgacccugaagauguugacgugaugaugggaacuuuuaccaaaaguuucggcgccagcgggggauauauugguggcaagaaagagcuuauagauuaccugcggacacacucucauuccgcugucuaugccacuucauugagcccaccggugguagaacaaaucauuaccaguaugaaguguaucauggggcaggacggaacaucucuaggcaaagagugcguucagcagcuggcagaaaauacccgcuacuucagaaggcgucucaaggagauggguuuuauaauuuaugggaacgaggacucccccguggucccucugaugcuuuacaugccagccaagaucggcgcuuucggacgggaaaugcugaaacgaaauaucggcguggucgugguuggguuucccgccacgccuauuaucgagagcagagcaagguucuguuugucggcggcucacacuaaggaaauucucgauacagcccugaaagagauagacgaggugggagauuuacugcaacuaaaguacucucgccaccggcucguaccacugcuugacagacccuuugaugaaaccacuuaugaggaaacagaggacuga

SEQ ID NO: 63173 - RNA, 1659 nt, Artificial Sequence
  derived and/or modified sequence opt3 from SPTLC3__Homo_sapiens__NP_060797
auggccaaccccggcgggggagcugugugcaaugguaagcugcacaaccauaaaaagcagagcaauggcucccaaucuagaaacuguaccaaaaaugggaucgucaaggaggcacagcagaacggaaaaccucacuucuacgacaagcucauuguugaaucauuugaggaagccccacuucaugugaugguauucacauauaugggcuacgguauagggacucuguuuggauauuugagggauuucuuacggaauuggggcaucgagaagugcaacgcggcuguggaacgcaaagagcagaaggacuuugucccgcuguaccaagauuucgagaauuuuuauacgcgaaaccuauacaugcguauuagagacaauuggaacaggcccaucuguagugccccuggcccacucuucgaucugauggaacgggugagcgacgauuauaauuggaccuuucgcuucacagggagaguuauuaaagacgugaucaacaugggauccuacaauuuucuuggucuggcagccaaguacgaugagucuaugaggacuauaaaagacgucuuggaaguguauggcaccgggguagcuucgacacggcacgagaugggaacccucgauaagcauaaggagcuggaagaccugguugcaaaauuccucaacguggaggccgcuauggucuuuggcauggguuucgccacuaacucaaugaauauccccgcguuaguggggaagggaugccugauucuuagcgaugaauugaaccacacaagucuggugcuaggcgcacgccucuccggcgccaccauccgaauuuucaaacacaauaacacgcagucucuggagaaacuucugagagacgcugucaucuacgggcagccuaggacucggcgugccuggaaaaagauauugauucucguugaaggaguguauagcauggaggguuccaucguacaucugccacagauuaucgcacugaaaaagaaguacaaggcuuauuuauacaucgacgaggcccacucaauuggcgcgguggggcccaccggacgcggcgucacagaauuuuucggucucgauccucaugagguggacguucuuauggggacuuuuaccaagaguuucggcgccagcggaggcuauauagcagggagaaaagaucugguggacuacuugaggguccacucucacuccgcuguguacgccucaagcaugaguccaccgaucgcugaacaaauuauccggucucuaaagcugauaaugggacucgaugguacaacccagggccugcagcgaguacagcaacuugccaaaaauacgcgcuauuuuagacagaggcugcaggagaugggguucauuaucuacggaaacgaaaaugcauccguugugcccuugcuccuguauaugccuggcaaggucgccgcuuuugcgcggcauauguuagagaagaaaaucgguguggucgugguuggguucccagcaacuccccuggccgaggcucgcgccagauuuugugugagcgcagcccacacaagggaaaugcuagacaccguacucgaggcucuggaugaaaugggcgaccuuuugcaacugaaguacucgcgucauaaaaagucugcccggccugagcucuaugaugaaacuuccuucgagcuggaggacuga

SEQ ID NO: 63174 - RNA, 231 nt, Artificial Sequence
  derived and/or modified sequence opt3 from SPTSSB__Homo_sapiens__NP_001035189
auggaccugagaagggugaaggaguacuucagcuggcucuauuaccaguaucaaaucauuuccugcugugccguccuugaacccugggagcggucuauguuuaacaccauacuguugacaaucauugcuaugguuguguacacugcauauguauucaucccuauucacauccgcuuagccugggaauuuuucucaaaaauaugcggcuaccauaguacgaucagcaauuga

SEQ ID NO: 63175 - RNA, 2058 nt, Artificial Sequence
  derived and/or modified sequence opt3 from SPTY2D1__Homo_sapiens__NP_919261
auggacuucagagagauccugaugauugccagcaagggccagggggugaacaauguccccaaaagguacucccucgcuguuggaccuccaaagaaagauccgaaggugaaagguguacaaucugcagccgugcaggcguuucuuaagcggaaggaagaggaacugcgccgaaaagcauuggaggaaaagcguagaaaagaggaguuagucaagaaaaggauagaacugaagcacgacaagaaagcccgggcaauggccaagcgcaccaaagauaacuuccauggcuauaaugggauccccauugaggaaaagaguaaaaagagacaggcuacagagucacacacuagccagggaacggacagggaguacgaaauggaggaagagaacgaauuucuagaguauaaucaugcagaguccgaacaagaguacgaagaggaacaggagccuccaaaaguggagucuaagcccaagguuccucucaaaucggccccacccccuaugaacuucaccgaucugcuucggcuggcugaaaagaaacaguuugagccaguggaaaucaaggucgugaaaaagucagaggaacgcccgaugacagccgaggaguugcgagaaagagaguuccucgaaaggaagcaccggcguaaaaagcuggagacugacggcaaacugcccccuaccguaagcaagaaagcgccaagucagaaggaguccguugguacaaagcucucuaaagggagcggagaucgccaucccuccucaaagggcaugccuuuaccacacgcagagaaaaagaguagacccagcauggccaaugaaaaacaccuggcucuuucuuccucaaagagcaugccgggcgaaaggauuaaggccgggaguggaaacucuucccaaccuagcuugcgggagggucaugacaaacccguguuuaauggcgcagggaagccacacucgucuaccuccucaccuaguguccccaaaacuagcgcuucccgaacacagaagucugccguggaacauaaagcgaagaaaagccugucacacccaagucacucccgccccggaccuauggugaccccacauaacaaggccaagagcccgggcgucagacagcccgguucuucaaguagcuccgcaccugggcagccaucuacgggaguugcuaggcccacugugucgagcggcccuguaccacggcgccaaaauggcuccucaaguucugggcccgagagaagcaucuccggaagcaaaaagccgaccaacgauucaaauccuucuaggcguacaguguccgguacuugcggcccagggcagcccgccaguagcucuggaggcccuggucggcccauauccgggucagucaguagcgcucgaccacuaggcucguccagaggaccuggcaggcccgugucuagcccacacgagcuccgccggccgguuucagggcugggaccucccgguagaaguguguccggcccagggaggucuaucagcggauccauucccgccggccgcaccgucucaaacagcgugccuggucgaccaguaaguucucuugggcccggccagacaguuuccagcucgggaccuaccaucaaaccgaaguguacgguggucucagaaacuauuucuaguaaaaauaucauaucccggagcucuaacggccaaaugaacgggaugaagccaccccugagcggauaucgugcagcccaggguccucagagauugccauuccccacaggcuacaagaggcagcgcgaguaugaagaggaagacgaugacgaugacgaguacgacuccgagauggaagauuuuauugaggacgaaggggagccucaagaagagaucucaaaacauauucgggagaucuucggauacgauagaaagaaauauaaggacgaaagugauuacgcucucagguauauggagagcucuuggaaagaacagcagaaggaggaggcgaagucccugcgauuaggcaugcaggaagaccuggaggaaaugcgccgggaggaagaggagaugcaaagaaggcgugcuaaaaagcucaaacgccgguga

SEQ ID NO: 63176 - RNA, 1293 nt, Artificial Sequence
  derived and/or modified sequence opt3 from SPZ1__Homo_sapiens__NP_115956
auggccagcuccgcuaagucugcagagaugcccaccaucucaaaaacagugaacccuacuccagacccgcaccaggaauaccuggaucccagaauuacgauagcccucuucgagaucggcagucauagcccuuccucuugggggucgcuuccauuucugaaaaauucaagccaccaagucaccgaacagcagacagcgcagaaauucaacaauuuguuaaaggagauuaaagacauccugaagaacauggcuggauuugaagagaagauuacugaggccaaagaacuauucgaggaaaccaauaucacagaggauguuagugcacauaaggagaacauaaggggucucgacaaaaucaaugaaaugcuguccaccaaccuucccgugucucuggccccugagaaggaagauaaugagaaaaagcaagaaaugauuuuggagacuaacaucacagaggacguaagcgcucacaaggaaaauauucggggccucgauaaaaucaacgagaugcuguccaccaaucugccagugucacucgcacccgaaaaggaggacaacgaaaagaagcagcagaugauaauggagaaucagaacagugagaacacggcccaagucuuugcucgcgauuuagugaaucgacuggaagagaaaaagguucuuaacgaaacucagcagagccaggagaaagccaagaaucguuugaacgugcaagaagagaccaugaagauuagaaauaacauggagcagcugcuacaggaagcggagcauuggucuaaacaacacacagaacucuccaagcugaucaaaucauaucagaaaagccagaaagacauuagugagacucuugggaauaacggagucggcuuccagacccaaccuaauaacgaggugucugcaaagcacgaacuggaggaacagguaaagaaauugucccaugauacauacagccuccagcugauggccgcuuuacuggagaaugaaugccagauccuccaacagaggguugagauccuuaaggagcugcaccaucagaaacaggguaccuugcaagaaaagccaauucagauaaacuauaaacaggacaagaagaaucagaaaccgucggaggccaagaaaguggaaauguacaagcaaaacaaacaggcaaugaaggggacguuuuggaagaaagaucggucuugucgcucccuagacgucugccugaauaagaaggcuuguaacacucaguucaacauccacguggccagaaaggcgcucaggggaaaaaugcggucagccaguagccugcgcuga

SEQ ID NO: 63177 - RNA, 1725 nt, Artificial Sequence
  derived and/or modified sequence opt3 from SQLE__Homo_sapiens__NP_003120
auguggaccuuccugggcaucgccacauuuacuuacuucuauaagaaauuuggggacuucauuacgcucgcuaacagagaggugcuucugugcgucuugguuuuucuaagccugggucuagugcucuccuacaggugucggcaccgcaaugguggccugcuugggcgacagcaaucuggaucacaguucgcacuguuuagugauauauugagcggccuccccuucaucggauuuuucugggccaaguccccuccagaaucugagaacaaagaacagcuggaggcgcguagaaggcggaaggggaccaauauuucggaaacaucacugaucggaacugcugccugcaccagcacaaguucccagaacgacccggagguaauuaucgugggcgcaggcguccucgggucugccuuagcugcagugcugagccgcgauggaagaaaaguuaccgugauagagagggaccuuaaggaacccgaucggaucgucggugaguuuuugcaaccuggcggguaucaugugcugaaggaccuaggacucggcgauacuguagaaggucuggacgcccagguugugaauggguacaugauucacgaucaggaguccaaaucagagguccagaucccauauccccuuagugaaaacaaucaagugcagagcggacgcgcuuuccaucacggccgauuuauuaugucucugagaaaggccgcgauggcagagccuaacgccaaauucaucgaaggcguggucuugcagcuccuggaggaagacgauguugugauggggguacaguacaaggacaaagagacaggagauauaaaggaguuacaugcuccacugaccguggucgccgacggucucuucuccaaguuuaggaaaucacuugugagcaauaagguuagugugucuucccacuucgucggcuuucugaugaaaaacgcaccccaauucaaggcuaaucacgccgaauugauucuagcgaacccuagcccagugcugaucuaucagauuucgucuuccgagacgcggguacucguugacauccguggggaaaugccgcgcaaucugagagaguacaugguggagaaaaucuacccccagauuccugaucaucuuaaggaaccauuucuggaggccacugacaacucacacuugaggaguaugcccgcuagcuuccucccuccauccucugucaaaaagcggggagugcuguuacugggcgaugcauauaauaugcgacauccccuaaccggugggggcaugacagucgccuuuaaggacauaaaacucuggcgcaagcugcuuaaaggaaucccggauuuguacgacgaugcugccauuuucgaagcaaagaaaucauuuuauugggccagaaagacuagccacaguuucgugguuaacauccuggcucaagcgcucuacgagcuguuuuccgcaaccgacgauagccuucaccagcugaggaaggccuguuucuuguauuuuaaacucggcggggaaugcguggcuggaccuguaggucuguuaucuguccugucacccaacccauuagugcucauaggccauuucuucgccguugcaauuuacgccguguauuuuuguuucaagagugagccuuggaucacaaaaccccgggcucugcuuagcuccggggccgucuuguacaaggcaugcucugugaucuuuccacugauuuacucggaaaugaaauauaugguacacuga

SEQ ID NO: 63178 - RNA, 1353 nt, Artificial Sequence
  derived and/or modified sequence opt3 from SQRDL__Homo_sapiens__NP_067022
auggugccccuggucgccguugugagcggcccuagagcucaacucuucgcaugccuucugagguuggggacccagcagguaggaccauuacagcugcacacaggugccucccaugcggcucggaaccacuacgaggugcuaguccucggcgggggaucuggcgguaucacuauggccgcacgcaugaagcgaaaagugggggccgaaaauguugcuauuguggagccgucagaacgucauuuuuaucagcccauauggacgcuggucggagcaggcgccaagcaacuuaguagcuccggcagaccuaccgcuucugugaucccaucggggguagaguggauuaaagccaggguuacagaacugaaccccgacaagaauuguauccacacugaugacgaugagaaaauuucauaccgguauuugaucauagcgcucggaauccagcuggacuacgagaagauuaagggucugccugaaggcuucgcacauccaaaaaucgggagcaacuauagugugaagaccgucgagaaaacauggaaggcccuccaggauuuuaaagaaggaaaugcuauuuucaccuuucccaacacuccugugaagugcgccggcgcaccacagaagaucauguacuuauccgaggcuuauuuccgcaaaacagguaagagaucuaaagccaauauaauuuuuaacaccagccugggggcgaucuucggagugaagaaauacgccgacgcacuucaagagauuauccaggaaaggaauuugacggucaacuacaagaaaaaucugaucgagguucgggcugauaagcaggaagccguguuugagaaccuagacaagccgggcgaaacucagguaauuuccuaugagaugcuccacgugacacccccuaugucaccacccgauguccugaaaacaaguccuguggcugacgccgcaggcuggguugauguggacaaggagacucuucaacaccgccgauacccaaaugucuucgggauaggagauuguaccaaccugcccacaagcaaaaccgccgcugcgguggcagcccagucugguaucuuggacagaacgauuuccguaaucaugaagaaucagacuccgaccaaaaaguaugacggcuacaccucaugcccucucguuacuggguauaacagggugauacuggcugaauuugauuacaaggccgagcccuuagaaacauucccauuugaccaaagcaaagagcggcugaguauguaucucaugaaggcagaucuuaugccuuuccuguacuggaacaugauguugcguggauacuggggcggucccgccuuccuacgcaaacuguuucaucucgggaugucuuga

SEQ ID NO: 63179 - RNA, 1071 nt, Artificial Sequence
  derived and/or modified sequence opt3 from SQSTM1__Homo_sapiens__NP_001135771
auggccaugagcuacgugaaggacgauaucuucagaauuuauauaaaagagaagaaagaaugcaggcgggaccaccgacccccuugugcucaggaggcaccacgcaacaugguccauccgaauguuaucugcgauggcuguaacgggcccgugguaggaacccguuacaagugcuccguguguccugacuaugaucugugcucugucugugaagguaaaggccuccacagagggcauacaaaacuugccuuuccaucacccuucggacaccugagugagggcuuuagccauuccaggugguugcggaaggugaagcacggucacuucggguggccuggaugggaaaugggcccacccggcaauuggucuccucgcccaccgagagcgggggaggcuaggcccggaccuacugccgagucggcaucagguccaagcgaagaccccaguguuaacuuuuuaaagaaugugggcgaguccgucgccgcugcacugucuccucuagggauugaaguggauaucgacguagagcauggaggcaaacggagccgccucacgccaguuucccccgagucaaguagcaccgaagagaagucuuccucacaaccgagcaguugcuguucugauccuuccaaacccggugggaacguggaaggagccacacagagccuggcugagcagaugcgaaagauugcccuugaaucggagggcagaccagaggaacagauggagucugacaauugcuccggcggggaugacgauuggacucaccugucaaguaaggaagucgacccuagcaccggagaguugcaaucccuccagaugcccgaaucugaggguccaagcucacuggaccccagucaggagggcccuacagggcugaaagaagcggcacucuacccacauuuaccgcccgaggccgauccuaggcugaucgaaucccuuagccagauguugucuaugggauucucagacgagggcgguuggcugacccggcuacuccaaacuaagaacuaugauauaggggcugcccuggacacaauccaguacaguaaacacccacccccucuuuga

SEQ ID NO: 63180 - RNA, 711 nt, Artificial Sequence
  derived and/or modified sequence opt3 from SRA1__Homo_sapiens__NP_001030312
augaccagaugccccgccggccaggcugagguggaaauggcagagcuguacgucaagccugggaacaaagaaaggggauggaaugacccaccgcaauucagcuauggucuccagacacaggccggcgggccccggcgcucccuucugacuaagcgaguugcggcuccucaggauggaucuccacgugugcccgccucagagacgaguccuggcccacccccuauggguccaccgcccccuagcuccaaagcaccaagaucucccccuguagggucgggaccagccucaggcguggaacccaccagcuuuccggucgagagugaggcugugauggaagacguuuugaggccuuuagagcaagcacuggaagauugucggggccacacacgcaagcaagugugcgacgauaucuccagaaggcuagcccuccugcaggagcagugggcugggggaaaacuuucuauucccgucaagaagcggauggcccuguuggugcaggagcucagcucccaucgcugggacgcggcagaugacauacaccgaucacugaugguagaucauguuacugaagugagucaguggauggucggugugaaaagacugaucgccgagaagaggagccucuucucugaagaggcugccaacgaagagaaauccgcagcuaccgccgagaagaaucacacaauuccaggcuuucagcaggcgucauga

SEQ ID NO: 63181 - RNA, 2988 nt, Artificial Sequence
  derived and/or modified sequence opt3 from SRBD1__Homo_sapiens__NP_060549
augagcucccugcccagaagggccaaggugcagguccaagacguugugcucaaagaugaguucucuucauuuagugaacuuagcuccgcuucugaggaagacgauaaggaggacucggcaugggaaccucagaaaaagguaccacggucacgcaaacagccgcccccuaaggagagcaagccaaaacgaaugccccgugugaagaaaaacgccccucagaucagugauggcuccgaggucgugguugugaaggaagaacugaacucuagcgucgcgauugcugacaccgccuuggaagauaggaaaaauaaguuagacacagugcaaacucugaagacggcaaaaaccaagcagaaaugcgccgcucagccacacacaguaagacggacuaagaaacuaaagguugaggaggaaaccuccaaagcaucaaaucucgagggggaaaguaacagcucugagacacccuccaccucaacuguguggggagguacauguaagaaggaagagaaugaugacgauuucaccuuuggccagagcgcccugaaaaagauaaaaacggagacuuacccucaagggcagccagucaaguucccggcuaacgccaauaguaccaaagaagagguggaaaugaacugggacauggugcagguccuuucugagcgcacaaauaucgaacccuggguuugcgcgaacauuaucagacuguuuaaugaugacaacacuauuccuuucaucauaagguaucggaaggaguugaucaauaaccucgacgcagauucccugcgcgaggugcagcaaacccuggaggagcuccgagccguagcuaagaaagugcauagcacaauucagaagaucaaaaaggaaggaaaaaugucggaguguuuacugaaggccaugcuuaauugcaagaccuuugaagaguuggagcacgucucugcaccauacaaaacgggcuccaaggguacuaaagcucagagagccaggcaacuggggcuagaaggagcggcccgggcacuccuggagaagcccggcgaacuuucacuguugaguuauauucguccugacgugaaaggccucagcacacugcaggauaucgagauagggguucagcauauuuuagcugacaugaucgccaaggauaaggacacccuggauuucauucgcaaccucugucagaaaagacacgugugcauccaauccucucuugcuaaggucagcaguaaaaaggugaacgagaaagacguagauaaguuucuguuguaccagcauuucucauguaauaucaggaacauucaccaccaucagauacuagccaucaaucggggagaaaaccugaaaguucucacugugaaggucaauauuuccgacggugugaaggaugaguuuugccgaugguguauccagaaccgcuggagaccaaggagcuucgcacggcccgaacugaugaaaauacuuuauaauucucugaacgacucauuuaagcgcuugauuuacccgcuccugugcagagaguucagggccaaauuaacaagugacgcugaaaaggagagcgucaugauguucggccguaaucugcggcaacuacuccugaccuccccugugcccgggcgaacgcuuaugggaguugauccaggcuauaaacacgguuguaaguuggcgaucaucucuccuaccucgcagauucugcauacagacgugguauaccuccacugcgggcagggauuuagagaggcagaaaagaucaaaacucugcuucugaacuucaauugcagcaccgucgugauuggcaacggcacagccuguagggagacugaggcuuacuuugccgauuugauaaugaagaauuauuucgcaccccucgacguuguguacugcaucgucuccgaagccggggcuucaauuuauagugugucuccagaagccaacaaagagaugcccggacuggauccuaauuuacgcagcgcaguauccaucgcgcggagagugcaggacccacuggcugagcuaguuaagaucgaaccgaaacacauuggugucggcauguaccaacaugaugugucacagacccuccugaaggccacacuugacagcguggucgaggaauguguuucuuuuguggggguggauauaaacaucugcuccgagguauugcugaggcacauugcaggacucaacgccaaucgcgcuaagaacaucauugaauggcgagagaaaaauggccccuucaucaaccgggagcagcugaagaaagucaaggguuuagggccuaaaaguuuucagcaaugugccggcuucauacguaucaaucaggacuauauuagaaccuuuugcagccagcaaacugaaacgucuggacagauccagggcguggcaguuacauccucagcugauguggaggucaccaacgaaaagcaggggaagaaaaagaguaaaacugccgugaauguucugcuuaagccaaaccccuuggaccaaaccuguauucauccugagagcuacgauaucgcgaugagguuccucucguccauaggagguacacuguaugaggugggcaaaccagaaaugcagcagaagauuaauucuuuucuagagaaagaagggauggagaagaucgccgaacgccugcagaccacuguacacacacuccaagucauuaucgacggacugagccagcccgagucauucgacuuucggacggauuucgacaagccggauuucaaaagaaguauagugugccuugaggacuugcagaucggcaccgugcugacugguaaggucgaaaacgcuacauuauuugggauuuucguugauaucggcgugggaaaauccggccucauuccuaucaggaauguaaccgaggcaaagcugucuaaaacaaagaagcgacgcagccuugggcugggaccaggugaacggguggagguccagguguugaacauagacauucccagauccaggaucacucucgaucugauccguguucuauga

SEQ ID NO: 63182 - RNA, 9693 nt, Artificial Sequence
  derived and/or modified sequence opt3 from SRCAP__Homo_sapiens__NP_006653
augcagagcucccccucuccugcccacccacaacugccggugcuccagacccagauggucucagacggcaugaccgggaguaaccccguuagcccugcuuccucuucgucaccagccagcaguggagccgguggcaucagcccccaacauauugcgcaagauucuagccuugacgggccuccaggacccccugauggcgcuacugugccacuggaggguuucuccuugucacaggccgcagacuuagccaauaaggggccgaaaugggaaaagagucacgcugagauagcagaacaggccaaacaugaggcugaaaucgagacgagaauugccgagcugaggaaggaaggauuuuggagccuaaaacggcuccccaagguaccugagccaccccgcccuaagggccacugggauuaccugugcgaagagaugcaguggcuuucugcggacuucgcacaagagcgacguuggaaaagaggcguggccaggaaggucgugcggaugguuauccgccaucacgaagaacagagacagaaagaagagagggcucggcgcgaagaacaggccaagcugcgaagaauugcauccaccauggcuaaagaugugaggcaauuuuggucaaacgucgagaaggugguacaguucaagcagcaaagccgguuggaagagaaacguaagaaagcccucgaccugcaccuggauuuuaucguugggcagacagaaaaguauagugaccucuuaucucagucccugaaucagccacuuacuagcucgaaagcgggaucuucccccuguuuggguucaaguagcgccgcauccucuccgccucccccagcuagccgccuggaugacgaggauggcgacuuccaaccucaggaagacgaggaggaagaugacgaggaaaccauagagguggaggaacagcaggaggggaacgaugccgaagcucaaagaagggagaucgaacuacuccggcgagagggagagcugccccuugaggaacuguugcgcucacucccaccccagcuguuagaaggcccuaguuccccaagccagacaccgucuucacaugacagugauaccagagacggucccgaggaaggggccgaggaggaaccuccacagguccuggagauuaagcccccuccaagcgcagugacucaaaggaauaaacagcccuggcacccggaugaagacgaugaggaauuuacagccaacgaggaggaagcugaggacgaagaggauaccaucgcggcagaggaacagcucgagggagaaguggaccaugccauggagcuuuccgaacuggcucgggagggcgaguugucuauggaagaacuccugcagcaauacgccggcgcauaugccccugggucgggaagcuccgaagacgaggaugaagacgaggucgaugcuaauucaagugacugcgagccagaaggucccguugaggccgaggaaccuccccaggaagauucuagcucccagucagacagcguggaggaucgcucugaggacgaagaggaugaacacuccgaggaagaggagacgaguggcagcucugcauccgaagagucagaaagugaggagagcgaagacgcgcaaucgcagucccaggcugaugaggaagaggaagacgaugacuucgggguagaguaccuccuggccagagacgaggaacagucugaggcagaugccggaagcggcccaccuacucccgguccaaccacacuugggccgaagaaggaaauuacugacaucgcugccgcagcugagucacugcaaccuaaaggcuauaccuuggccacaacccaggugaagacgcccauaccacuccuguuaaggggacagcugcgugaauaccagcacauuggccuagauuggcucgucacuauguaugagaaaaagcugaacgggauccuugcggacgagaugggauuggguaaaacaauucaaaccaucagucugcucgcccaucuggcuugugaaaagggcaauugggggccccaccuuaucauugugccuacuuccguuaugcugaacugggagauggaauugaagcgguggugcccaucuuuuaaaauacucacauacuacggagcacagaaggagcgaaaacugaagagacagggcuggaccaaacccaaugccuuccauguguguaucacgagcuauaaguuaguccugcaggaucaccaggcuuuuaggcgcaagaacuggcgguaccuaauucucgacgaagcccagaauaucaaaaacuucaagucccagagauggcaaucacugcuuaauuuuaacagccagaggcgcuugcugcucaccgguacaccucugcagaacaguuuaauggagcuguggucucuuaugcauuucuugaugccgcacguguuccagucccaccgagaguuuaaagaaugguucagcaauccacucacugggaugauagagggcucgcaagaauauaacgagggacugguaaagcggcuacauaaaguucugcgucccuuucuccugagaagggugaaggucgauguggagaagcagaugccuaaaaaguacgaacacgucauucgcugccggcuuucaaaaagacagagguguuuguaugacgauuucauggcacagaccacaacuaaggagacccuggcgacaggccauuuuaugucugugaucaauaucuuaaugcaacuccgaaaaguuugcaaccacccaaaucuguucgacccccgcccugugaccaguccguuuauuacucccgggaucuguuucuccacggccagccuuguacugcgggcuacagauguccacccauugcagagaauugacaugggaagguuugaucucauaggucuggaaggccgugugucucgcuacgaggccgacaccuuccuaccucggcauagacugagcaggcgaguucuccuggaaguggcaacugcucccgacccaccuccccggccaaagccggucaaaaugaaggugaaccgcaugcuucagccuguacccaagcaggaggggagaaccgugguugucgugaauaacccaagggcccccuugggaccugugccaguccggcccccuccgggcccagagcuguccgcacaacccacaccuggucccguuccacagguguuaccugccucacucauggugagugcuagccccgcggggccaccucugaucccggccucucgacccccaggcccuguacuucugcccccacuacagccuaauuccggaucacucccccagguccugccgaguccauugggcgugcugagcgggaccuccagaccucccacuccaacauuaucucucaaacccacgccuccggcacccguucgccugucgccagcuccucccccuggaagcucaucccuucugaagccauugaccgugcccccuggcuauacuuuuccacccgccgccgcuacaaccacaaguacuaccacggcaaccgccacaacuaccgcggucccggcuccuacaccagcaccccaaaggcucauucugucuccugauaugcaggcacgucuaccaagcggugaagugguuuccaucgggcagcuggccucacuugcucaacggcccguggcaaacgccggaggcucuaaaccgcucacuuuccagauccaggguaauaagcugaccuugacgggcgcgcagguaagacaacuggcugucgggcagccuaggcccuuacagcgcaacguggugcaccucgucagcgccggaggccagcaucaccugauuagucaaccagcacauguugcccuuauacaggcuguggccccuacacccgggccaacccccguauccgugcugccuagcucuacuccaucaacaaccccggcacccacuggauugucccucccucuggcugccaaucaggucccacccaccauggugaacaauacaggcguugugaaaaucgucgugcgacaggcgccuagagacggucuaacgccaguucccccucuggccccggcaccacggcccccuaguagcgggcuucccgcugugcucaacccaaggccuacccugacucccggacgcuugccaacaccgaccuuaggcacagcccgugcuccuaugcccacuccaacccuggucagaccccuccugaaacuuguacacucgccuucuccagagguguccgcaagcgcccccggugccgcuccucugacgauuucaaguccguugcacguuccaucuucccuacccggcccugcgagcucaccaaugcccaucccuaacaguagcccccuggcauccccagugucuagcacagucuccgugccgcucucaucuagucugccuauuucgguacccaccacucuuccagccccugcuagcgcccccuuaaccaucccaauauccgcaccucugacagugucugccucagggcccgcucucuugacuagcgucaccccgccacuggcgccuguugugcccgccgcaccaggacccccuucccucgcuccgaguggcgccucuccaagcgcaucagcccugacacuugggcuggcuacggcccccuccuugaguagcucucaaaccccuggacauccccuacugcucgcgccaacuuccucacacgugccuggcuuaaauagcacagucgcacccgccugcucgccagugcugguuccugcuucugcccuugcuaguccguuucccuccgcaccaaacccugcccccgcucaggccagccugcucgcaccagcgucauccgccucucaggcuuuggccaccccucuggcacccauggcugccccgcaaacugcaauccucgccccaagcccugcucccccacuggcgccccuuccuguacuagcccccaguccaggugcagcuccugugcuggccuccagccagacaccgguccccgugauggccccaucuucaaccccugggacgaguuuggcauccgcuagccccguuccagccccuacucccguguuagcgccgucuucgacccagacaaugcugccugcuccaguccccucaccucucccaagccccgccuccacccagacucuggcacuugccccugcucuggcaccaacacucggaggcaguucucccagccaaaccuugucccuggguacaggcaauccgcaggggccuuuccccacucagacccuaucacugacgccagccaguucucucgugcccacuccugcgcagacccuuagccuggcuccaggacccccuuuaggcccaacucaaaccuugucccuggccccggcacccccucucgccccagcuucacccguagggccugccccagcacauacacugacucuugcucccgccuccucuuccgcgagucugcucgccccggcaagcguccagaccuugacgcugucgccugcuccagugcccacauuaggaccugccgcagcucagacccuagcccuggcccccgcguccacucagucuccagcuucacaagcaagcagucucguuguguccgccucuggcgcugccccgcuuccugucacaauggugagccggcugcccguuucaaaggaugaaccagacaccuugacucugagguccggucccccuaguccacccagcacagcaaccucuuucgggggaccucgcccacgaagacagccgcccccuccaccccggucaccuuuuuaccucgauucccuggaggagaagaggaagcgccagagaagcgagaggcuugagcggauuuuccagcucucugaagcccacggcgcucuggcgccaguguacggcacggaggucuuggacuuuuguacucugccccaaccuguggccaguccgaucgggccccguucgccaggaccuucccaucccaccuucuggacauauaccgaagcagcucaccgcgccguauuauuuccacagcagcgacuagaucaacugagcgagauuaucgaaagauucauauuugugaugccucccguugaggcaccaccgccuucacuccacgccugccaucccccacccuggcuugcuccuaggcaggccgcguuccaggagcagcuggcaucugaauuguggccacgggcccgcccccugcacagaauugucugcaacaugaggacacaauuuccugaccuccggcugauccaguacgauugugguaaacuucagacuuuagcugugcugcuccgacaguugaaggccgagggccauagagugcugauuuucacccaaaugacgcgcaugcuagacguccuggaacaguuucucacauaucacgggcaccuuuaccugagguuggauggaagcacucggguagagcagcgucaggcacugauggagagauucaaugcugacaaaaggaucuuuugcuucauacucuccacccgcaguggcgguguggggguuaaccugacaggagccgacaccguggucuucuaugauucagacuggaauccgacuauggaugcucaagcccaggaccggugucaucgaaucggccagaccagagaugugcacauuuacagguuaaucucugaacgcacaguugaggaaaacauucuuaagaaggcaaaucaaaaacggaugcugggcgacauggcgaucgaagggggaaacuuuacgacugccuauuucaagcagcagaccauaagagagcucuuugauaugccccuagaggagccaagcuccaguagcgugccuuccgcucccgaagaggaagaggaaacagucgccucuaaacagacccauauucuggagcaagcauugugccgugcugaggacgaagaggauaucagggccgcaacucaggccaaggcggaacagguggcugagcuggccgaguucaaugagaacgacgguuuuccagcaggcgagggggaagaggccggacggccuggcgcugaagaugaggagaugucacgcgccgaacaggagaucgcagcucucguagaacaacuuacacccauugagcgauacgccaugaaauuccuggaagcgagcuuggaggaggugucgagagaggaacugaagcaggcugaggaacagguugaagccgcaaggaaggaccucgaucaggccaaagaggaggucuuucgguuaccacaagaagaggaagaggguccgggggcuggagacgaauccaguuguggcaccggcgggggaacgcaccgcagaucuaagaaagcaaaggccccugagaggcccgguacucgagugagcgagcggcugcguggcgcgagagccgaaacacagggggcuaaucauaccccagugaucucagcacaccagacccgcuccacuacaaccccucccaggugcucuccagcccgggagagagucccucgccccgcuccgaggccacgacccacuccugccagugcaccagcugccauucccgcgcuuguuccugugccgguaagcgcccccgugccaauauccgcaccuaaccccaucacaauucugccaguccacauccuaccuucacccccaccucccagccaaauuccgccuuguucuaguccagcuugcacgcccccuccagccuguacacccccgccugcacauacacccccacccgcccagacuugccucgugaccccuuccagcccacuguugcugggacccccuucaguuccaaucucugcuuccgugacaaaucucccgcuuggccugcggcccgaagccgaguuaugugcgcaggcucuggcaucgccugagagcuuggaacucgccagugucgcuucuuccgagaccagcucacugagucuaguaccacccaaagaccuucugccuguggccguugaaauacucccaguguccgagaagaaccugagcuugacucccucugcaccgucacugacgcucgaagccgguagcaucccuaacgggcaggagcaagaggcuccagauuccgcggaaggaaccacacuuacuguccugcccgagggcgaagaguuaccucugugcgugucugaaaguaauggcuuggagcuacccccaucggccgcaagcgacgagccucugcaggaaccccuagaggccgauagaaccuccgaggagcuuacagaagcuaaaaccccaacuucaucuccggagaagccccaggagcuggucacagcagaaguggccgcuccuagcacgaguuccucagccaccucuagcccagaggggcccuccccugcgaggccaccccgccgucggacaagugcagacguugaaauuagaggacaggguacaggcaggccugggcaaccgccaggacccaaggugcuccgcaaacugccuggccgauugguaaccguggucgaggagaaggaauuaguucggagaaggcgccagcagagaggugccgcuagcacccuggugccaggggucucugagacaucagccucccccggaagcccuagugugcggucuauguccggccccgaaucgagcccaccgaucggcgggccuugcgaggcagcucccucauccucucucccaacuccuccccagcaaccauucauugccaggcgucacaucgaacuuggaguaacggguggcgggaguccggagaacggagauggcgcgcugcuagccauaaccccucccgcugugaaacgacgcagaggucggccacccaagaaaaauaggagcccugcagacgccgggcgcggcguugaugaggcuccaucauccacacugaagggaaagacuaacggcgcagaccccgugccugggccggaaacccucauugucgccgauccaguguuggagccccagcugaucccuggaccccagccacuugguccucagcccguccauagaccaaauccucugcucagcccgguggaaaaacggaggcgaggccgucccccaaaggcuagagacuuaccuauccccgggacaauuucuagugccggagauggcaacuccgagagccgcacccaaccaccuccccacccgucaccacugacucccuugccuccacugcucguuugucccacggcaacaguagccaauaccgugacuaccgucacaauaucuacuucgccucccaaacggaagagggguagaccaccuaaaaacccgcccagcccacgcccuucccagcuucccgugcuggaccgggauaguaccucuguucuagaaucaugcgggcugggcaggcgaagacagccacaaggacagggcgagagcgagggguccaguucugacgaagacggaagccggccucucacaagguuggcgcgccugcgucuugaggcugaagguaugagaggccgaaaguccgggggaucaaugguggucgccgugauccaggaugaccuggauuuagcagacagcggccccggugggcucgagcugacgccgccaguagugucuuugaccccuaagcugagguccacucggcuccgccccggcagucuuguuccaccucuggaaacagagaaacuacccagaaagagggccggagcuccggucggcgggucaccuggacuggccaaacggggccgccuccagcccccaagccccuuggguccugaggggucgguggaagaguccgaagcagaggcuucuggagaggaagaggaaggcgaugguaccccaagacgaaggcccggcccucggcgucugguggggacuacaaaucaaggagaccagcgcauuuuaagaaguagcgccccacccucacuugcgggcccggcagucucccacagggggcggaaggccaaaaccuga

SEQ ID NO: 63183 - RNA, 1611 nt, Artificial Sequence
  derived and/or modified sequence opt3 from SRC__Homo_sapiens__NP_005408
augggcagcaacaaguccaaacccaaggacgccucucagagaaggcggucacuggagccugcugaaaaugugcacggggcaggagguggcgccuucccagcgagucaaaccccgagcaaacccgcuuccgccgaugggcaucgcggaccuucugcagccuuugcuccagcagccgcugagcccaaacucuucggcgguuuuaacucgucagacacagucacuagcccucagcgagccgggccacuugcgggaggcguuacgaccuucguggcacuguacgauuaugaaagucguacagagacugacuuguccuuuaagaagggcgaaagauuacagaucguaaauaacaccgagggggauugguggcuggcccacucucuaagcacaggacagaccgguuacauucccuccaauuauguggcuccuucagacaguauacaagccgaggaaugguacuucggcaagaucacuaggcgggagagcgaacgccuccugcuuaacgcagagaauccaagagggacauuucuggucagggagucugaaaccacgaaaggagcuuauugcuuguccgugucagauuucgacaacgccaagggccucaauguuaaacauuacaagauucggaaacuggauagcgguggguuuuauaucaccagucgcacucaguucaacucucugcagcagcucguggcguacuacuccaagcacgccgacggauuaugucaucgacugacaacugucugcccgaccagcaagccccaaacacagggccuugcaaaagaugcuugggagauuccuagagaaucguugaggcuggaggugaagcuaggccagggguguuuuggagaaguauggauggguaccuggaauggcacgacucggguugccaucaaaacacucaagccagggaccaugucucccgaggcuuuccugcaggaggcccaagugaugaaaaagcugcgucacgaaaaacuuguccaguuguaugcagugguguccgaggaaccuauauacaucgucacugaguauaugucaaagggaagucuccuggacuuuuuaaagggcgaaacagguaaauaccugcgccucccacagcuuguugauauggccgcucaaauugcgagcgggauggcauauguggagagaaugaacuacguacacagggaccugcgggccgcuaauaucuuggugggcgagaaccuagucugcaagguggccgacuucggacuggcacgacucauugaagauaaugaguauaccgcccgccagggcgcuaaauuccccaucaaguggacggccccggaagcagcgcuguacgggagauuuaccauaaaauccgacguuuggucuuucgguauucuucugacagaguugacuaccaagggaagggugccuuaccccggcauggucaaccgggaagugcucgaucagguagagcgcggguauagaaugccauguccucccgagugcccagaaagccugcaugacuuaaugugucagugcuggaggaaggagcccgaggaacguccuacauuugaguaccugcaggcuuuccuagaagauuauuuuacuucaaccgagccacaauaccagccgggagaaaaccucuga

SEQ ID NO: 63184 - RNA, 3552 nt, Artificial Sequence
  derived and/or modified sequence opt3 from SRCIN1__Homo_sapiens__NP_079524
augggcaacgcccccagccaggacccugagagauccucuccaccgaugcugucagcugaugacgcagaauaccccagggaguaucggacccucgggggagguggcgggggaggcaguggugggcgccgauucagcaaugugggacuuguccacacauccgaacguagacauacuguuaucgccgcgcaaucucuggaggcuuugucgggcuuacagaaggccgaugcagacaggaaacgggaugccuuuauggaccaccugaagucaaaauacccucagcaugcucuagcacuccgcggccagcaagauagaaugagggaacagccaaacuauuggagcuucaagacgcggaguucccgccacacccagggggcccagcccggacuggcugaccaagccgcgaaacuuucuuacgcaagcgccgagucccuggagacaaugucagaagcugaguugccucucgguuuuagucgaaugaauagauucaggcagagccugccacugucucgguccgccucacagacuaagcuccguagccccggcguguuauuucugcaguucggggaagagacccgcagaguacauauuacacacgaggugaguucucuugauaccuugcacgcacugauagcucauauguuuccucaaaagcuaacuaugggaaugcucaaauccccaaacacagccauccugauuaaggacgaagcgaggaaugucuucuaugagcuugaagaugugcgggacauccaggaucgaagcauuaucaaaauauaccgcaaggagccgcuguaugccgcauuucccggcucgcacuugaccaacggugaccucagaagggaaaugguuuacgcuucucgggaguccucaccuacgcgcagacugaauaacuuaaguccagcaccccaucuggcuagcggguccccuccacccggacucccgucuggccuuccuagcggccugcagucagggagucccuccaggagccguuugucuuacgccggaggucggccaccuucauaugcaggcagucccgugcaccacgccgcugagcgacuagggggagcgccagcagcccaaggcgucagccccuccccuucugcuauccuggaaagaagggacgugaaaccagaugaggaccucgccucgaaggccggugggaugguacugguuaagggcgaaggacuuuacgccgauccguauggccuguugcaugaggggcgccucagccuggcugccgcagcgggagaccccuucgcuuacccuggugccggcggguuauauaaacggggauccgugagaucacugaguacuuacucugcagccgcucuacagagcgaucucgaagacucccuguauaaggccgcaggcggugggggcccacuuuacggagauggcuacggguuuagguugcccccuucaagcccacagaaacuggcugacgucgccgcgcccccgggagguccuccacccccucacucucccuauuccggcccaccuagucgcgggagccccgugcgacagucuuuccggaaggauuccggaucaaguagcguguuugccgagucgccaggcgguaaaacccguuccgcugggucugcaagcacagccggcgcuccgccuucagaacucuuccccggaccaggcgaaagaagucuggucggguucggacccccuguuccagccaaggacacugagaccagggaacgcauggaggcaauggaaaaacaaauugcgucccuuacaggccuggugcagucugccuugcuccgggguagcgagcccgagaccccuuccgaaaagaucgaggggucaaauggagcugccacgccgagcgcaccaugcggcagugguggcagaucuuccggggcuacucccguaagcggaccuccacccccuucggccucaucuacaccggcaggccagcccaccgccgugaguaggcugcagaugcaauuacaucugcgagggcuacagaacuccgcuagcgaucuccgcggacagcugcagcaacuucggaaguugcagcugcagaaucaggaaucugucagagcgcuccugaaaaggacugaggccgaguuaagcaugcguguguccgaagcagcucgccggcaagaggacccacugcagagacagaggacacuuguugaagaggaacgauugcgguaccucaacgacgaggagcugauuacccaacagcuaaaugaucuggaaaagucaguggagaaaauccagcgcgacgucagucacaaccauagacucgugccuggccccgaacuggaggaaaaggcccuuguauugaaacagcugggugagacguuaaccgagcucaaggcccacuuuccagggcugcaaagcaagaugaggguugugcuucgggucgaaguggaggcugucaaauuccugaaggaggagccucagcgauuggauggacuccugaaaagaugucgcggcgugacagacacucuagcacagauaaggcgucagguugaugaagguguguggcccccaccgaauaaccugcucucucaauccccuaagaaaguaaccgccgagacagacuuuaacaagucagucgauuucgagaugcccccacccaguccuccacugaaucuucacgaauugagcggccccgcggagggggcuucccugacuccuaagggaggcaacccgaccaaaggguuagacacaccaggaaagcggucuguggauaaagccguuucgguggaagcagccgagagagacugggaggaaaagagggcugcacucacccaguauagcgccaaagauauuaaucgccugcuugaggaaacucaggcggagcugcuaaaggcuauccccgaccucgauugcgccucaaaggcacauccuggccccgccccaacgccugaccacaaacccccaaaggcuccucauggucagaaagccgcaccgcgaacagaacccuccgggagacggggaagugacgagcugaccgucccaagguaccgcacugagaagccuucuaaaagcccacccccucccccgccacguagauccuuuccuucaucucacggcuugaccacaacccggacuggugaagugguagugacaagcaagaaagauagugcuuucauuaagaaggccgaguccgaggaacuggaaguucaaaaaccccaggucaaguuaaggcgcgcggugagcgagguggcccgaccagcaucuacgcccccuaucauggcuucagccaucaaagacgaggaugacgaagauagaauuauagcugagcucgaauccggcgggggaagugucccgcccaugaagguugugaccccaggcgcaagccggcugaaagccgcccaggggcaagcuggaucgccugacaagucuaagcacggcaaacagagggcggaguauaugcgcauccaggcacagcaacaggccacuaagcccuccaaagaaaugagcgguucaaacgagacaaguucuccuguguccgagaagccaagcgcuucaagaaccaguauucccguacuuacauccuuuggggccaggaauagcucuaucagcuucuga

SEQ ID NO: 63185 - RNA, 639 nt, Artificial Sequence
  derived and/or modified sequence opt3 from SRD5A1__Homo_sapiens__XP_011512405
auggagcacgccgcucagcccuggagauggcaaaggcggcgcggcuggcgacguagcgcaugcuggccuagauccccaaccuguucugccccgugggcggcuaggucaagucgggccaucgugcgcagaacacagugcacugcagccacgaggugucccgcuaccgggagcgaaugccggcgcggaccuccagguuggugucgauccugccccagauggccuuguaggucuacaucgacuccagcaucacccccucgggucagcgccgcucguccaaccgccaguuccuggccgugcucuagcuccacaaccggcauuggguucggacuguggcucacuggcaugcuuauaaacauccauucagaccacauucugcgcaauuugagaaagcccggugauacaggguacaaaaucccuaggggaggcuuauuugaguauguuaccgcggcaaacuacuucggcgaaauuauggagugguguggguaugcccuggcuaguuggagcgugcagggagccgcauuugcuuucuuuacguucugcuuucuaucuggucgggccaaggaacaucacgagugguaccuccgaaaauucgaggaauauccaaaguuucgcaaaaucauaauccccuuccuguuuuga

SEQ ID NO: 63186 - RNA, 747 nt, Artificial Sequence
  derived and/or modified sequence opt3 from SRD5A2__Homo_sapiens__XP_011531370
augcaagugcagugccagcagagccccguccuggccggcuccgcuacccucguugcacuuggggcccuggcguuguacguggcuaagccuucuggauaugguaaacacacagagucauuaaagccagccgcaacuagacugccggccagggcugcaugguuccuacaggaacuccccaguuuugccguaccugcuggcauccuggcccggcaaccacuuagccuguucgggcccccuggaacgguguugcucggccuguuuugucugcauuacuuccaccgcaccuuugucuauucccucuuaaaccgaggucguccauaccccgcgauucugauacuuagagggacagcauucugcacuggaaauggcguguugcagggcuauuaccugaucuauugugccgaguacccugacgggugguacaccgauauuagguuuucucuagcuugccucccaguugugcugcuuuucaucacaucguggcugcaggacgucgauuguucaagccggcauuauauuuggcagagucgccaagaagagagaaggucccggggaaccgguuuggccugcacuuuuuaccagaaaucuaagcgcuucccgcgaaaaagccccaaccaggacuuuacacuccaccugaucggcgggaccuccucaugugauccuuuaagucagugcaaucuguguagcggaggcuggcaaaagaagagagguuggaaccagcuccuuagguaugaaacgucuauauga

SEQ ID NO: 63187 - RNA, 957 nt, Artificial Sequence
  derived and/or modified sequence opt3 from SRD5A3__Homo_sapiens__NP_078868
auggcccccugggcugaggcagaacacagcgcccugaacccucucagagcgguguggcuuacccugacagcugccuucuuguuaacucugcuacuccagcugcuuccaccgggccuguugcccgggugcgcaaucuuucaagaccucauuagguacggaaagacgaaauguggugagccuucccggccagccgcuugccgcgcauucgauguccccaagcgauauuuuucucauuucuacauaaucucaguucuguggaauggcuuucugcucugguguuuaacccagagucuguuccuuggggccccuuuuccaagcugguugcacggacugcuacguauucucggcgcugcccaguuccaggguggggaacuggcgcuuuccgcauuucugguguugguauuccucuggcugcauucuuuaagaaggcuguuugagugccucuaugugucggucuucucaaacgugaugauccacguugugcaauacuguuuuggacuugucuauuacgugcugguaggcuugacaguucuaagccaggugcccauggacggccggaaugccuauauuacugggaaaaaccugcucaugcaggcucgcugguuccauauccugggaaugaugauguucauauggaguuccgcccaccaguacaagugccacgucauccuugguaaucugaggaaaaacaaggcaggcguggugauucauuguaaucacagaaucccuuuuggggauugguucgaauacgucucuagcccaaacuauuuggcugagcucaugauuuacguuuccauggccgugaccuuuggauuccauaaucugacauggugguuaguagugaccaacgucuuuuucaaucaagcgcugucagccuuucuaagucaccaguucuauaagagcaaauuugugucuuacccgaagcaccggaaagcauuccuccccuuucuguucuga

SEQ ID NO: 63188 - RNA, 3534 nt, Artificial Sequence
  derived and/or modified sequence opt3 from SREBF1__Homo_sapiens__NP_001005291
auggacgagcccccuuucagcgaagccgcucuggagcaggcacucggcgaaccaugcgaucuugacgccgcgcuguugaccgauaucgagggggaagugggagcugguagaggcagggccaacggguuagacgcaccgcgggccggagcugaucgcggcgcaauggacuguacauuugaggauaugcugcaacuaauuaauaaccaggacuccgauuuccccggucucuuugacccuccauacgccgggucuggagcuggcggcacugaucccgccucaccugacacgaguagcccagggucccugucucccccuccagcgacccuuucgucaagccuggaggcauucuugaguggaccgcaggccgcucccuccccucucucuccaccccagccugccccaacaccccugaagauguauccgagcaugccugcauuuucccccgguccaggcauaaaagaagagucagucccucugaguauccuccaaacucccaccccacagcccuuaccuggggcucugcuuccacagagcuucccggcccccgcgccuccacaguuuucuuccacacccguuuugggauacccuucaccacccggcgguuucagcaccgggaguccgccuggaaauacucaacagccacugcccggccuaccucucgccucucccccaggcgugccucccguaucccugcacacacaggugcagagcgucgugccacaacagcuucugaccguuacggcagcuccgacugccgcuccugugaccacaacugucaccucgcagauucaacaggugcccguauugcuccagccacauuuuaucaaggccgauucucuguuacugacagcaaugaaaaccgacggggccacgguuaaggcugcgggacucuccccacuugugucagguacuacaguccagaccggcccucugccaacuuuggugagugggggaacaauucuagcaaccgugccccuggucguugacgccgaaaaacucccuaucaaccgacuggcugccggcagcaaggcaccggccuccgcucaaucucguggugagaagagaacggcccacaaugcaauagagaaaagguaucggagcucaaucaacgauaagauuaucgaacuuaaagaccuggugguagggaccgaggcgaaguugaauaaaagugcugugcuccgcaaggccauugauuacaucagauuccugcagcauuccaaccagaaguuaaaacaggaaaaucugagccuaaggacagcaguccacaagucuaaaucacucaaggaccuggugagugccugcggcagcggaggcaacacugauguucuuauggagggggugaaaaccgaagucgaggacacauugacuccacccccuuccgaugcuggaucuccauuucaaucgagcccccugucccucgguucacggggcagugggucuggaggcagcgguuccgacucagagccugauagcccgguguucgaagacucuaaggccaaacccgagcagcgcccaucccugcauagucgagggaugcuugauagaagcaggcuggcauuguguacccucguauuucugugcuuaucuuguaauccucuggcuucccuacucggcgcccggggacugcccucaccaagugacacaaccagcguuuaucacucgccuggccguaacgugcuugggacugaaucccgcgacggacccgguugggcgcagugguugcugccaccggucguguggcuccugaauggcuuacugguccuugugucuuugguucuccuguucguguacggggagccuguaacgagaccccacagcggaccagccgucuauuucuggaggcaucggaagcaggcugaucuagaccuggcacgaggcgauuuugcccaagcugcccagcagcucuggcuggcacuucgcgcguuggguagaccccugccuacaucacacuuagaccucgccugcagucugcuuuggaaccugauaaggcauuugcuccagcggcuguggguggggcgcuggcuagcuggcagagccggaggccugcaacaggauugugcacucaggguugacgcuuccgccucugcacgugaugccgcucugguguaccacaaguugcaccaguugcauaccauggggaaacacacuggaggccaucugaccgcgacaaauuuagcccucagcgcacugaaccuugcugaaugcgccggugacgccgucuccguggcuacccuggcagagauuuacguagccgcggcucuacgggugaagacuucacucccacgagcccugcacuucuugacaagauuuuuccugagcagugcaaggcaagccuguuuagcucagucuggguccguucccccugcaaugcaguggcucugccauccggucggacaccgcuuuuucguggauggcgacuggagcgugcugucgacgccaugggagucacuuuauucucuggccgguaaccccgucgauccuuuggcgcagguuacccaacucuuucgggaacaucugcuagagagagcucugaauugugugacucagcccaacccaaguccuggcuccgccgacggggauaaagaguucagcgacgcacuuggauaccuccagcugcuuaauucuugcagcgacgccgcuggcgcccccgcauauuccuuuucaaucaguagcucuauggcuacaaccacagggguggauccaguagccaaguggugggcgucccugacugccgucgugauucacugguuaaggcgcgacgaagaagcagcugagcgacucugcccucugguugagcaccuuccgcgggugcugcaggaaucagagcgucccuugccaagagccgcucuccauaguuucaaagcagccagggcccugcuaggaugugcuaaggcggaaagcggcccugcaucccugaccaucugcgagaaggccucugguuaccuucaagauucgcucgcuacgacccccgccagcucauccaucgacaaagcaguccagcuguuuuugugugauuuacugcucgugguucgcacaagucuguggcggcagcagcaacccccugcccccgcuccggcggcccaggggacuucuagcagaccacaggcauccgcucuugagcugaggggauuccaacgagacuugucaucucuacgccggcuggcccagagcuuuagaccugcaaugaggcguguguuccuccacgaagccaccgcucgccugauggccggcgcgagucccacacggacucaccagcuuuuagauagaucccugaggcgacgggcagguccaggcgggaagggaggcgccguagcugagcucgaaccccgcccuaccagaagggagcaugccgaggcuuugcugcucgcaagcugcuaucugccgcccggguuccuuucugccccaggacagcgggucggcaugcuggcugaagccgcacgaacguuggagaaacuaggugacagacgccugcuccacgauugucaacagauguuaaugaggcugggagggggcacaaccgugacuucauccuga

SEQ ID NO: 63189 - RNA, 3426 nt, Artificial Sequence
  derived and/or modified sequence opt3 from SREBF2__Homo_sapiens__NP_004590
auggacgauagcggcgagcugggaggacucgaaaccauggagacacuuacugaacugggugacgaguugacguuaggcgauaucgacgaaaugcugcaguucguguccaaccaagucggggaguuucccgaucuauucucugagcagcucugcucaaguuuuccuggaagcggcgguuccgggucuucgucaggaagcaguggcuccucuagcuccucaaguaauggcagagggucuagcuccggagccguugacccaucagugcagaggagcuucacccagguaacacugccgaguuuuucucccuccgcugcaagcccucaagccccaacucuucaggugaaggucucgcccaccucugugccuacaaccccacgggcgacucccauucugcagccucgcccacagccgcaaccccagccucagacacaguugcaacagcagaccguuaugauaacgccaacuuucuccaccacaccccaaacucgaaucauucagcagccucucaucuaccagaacgcugccaccucauuucaagugcugcagccacagguccagagucuggugacaagcucccaaguacagcccguuaccauucagcagcaagugcagacgguccaggcacagcgugugcucacucaaacagccaaugguaccuuacagacucuggcuccggcaacagugcagaccgucgccgcuccucaaguucaacaggugcccguacuugugcagccacagaucauaaaaacggauucuuugguccugaccacacuaaagacugacggcagcccugugauggccgcgguucagaaccccgcacucaccgcccugacaacuccaauccagaccgcugcccuucaggugcccacacuggucgggucaaguggaaccauuuugacuacgaugccugugaugaugggccaagaaaaaguaccaaucaagcagguuccggguggggugaaacagcucgagcccccuaaggaaggagagagaaggacaacccacaauauuaucgagaagcgguaucgcuccagcauaaacgauaaaauuaucgaacugaaggacuuagucaugggcacugaugcaaaaaugcauaagucuggcgugcugagaaaagcuauugacuacaucaaguaucuccagcaagucaaucacaaacuuaggcaggagaacauggugcugaaguuggccaaucagaagaacaaacuacugaaggggaucgaucucggaucacugguugacaaugaaguggaccuuaaaauugaggauuucaaccaaaauguacuguugaugaguccacccgcgagcgacuccgguucucaggccggcuuuucgccuuacagcauagauuccgaaccagggucaccccuccuggacgaugcaaaggucaaagacgagccggauaguccuccaguggcuuuaggaaugguugaccggucucgcauccugcuaugugugcucaccuuccugugccuuagcuuuaaccccuugacaucccugcuccaguggggcggugcccaugauucagaccagcacccucauagcgggucuggccgauccguccugaguuucgagagcggaucuggcgggugguuugauuggaugaugcccacccuucuguuguggcucgugaauggaguaauugugcuguccguuuucgucaaguuacuggugcacggugaaccagugaucagaccucacucaaggaguagcgucacuuucuggcggcaucguaagcaagcugaccuagaccucgcccgcggcgauuuugcagccgcugcggggaaccugcagacaugucuugcaguuuuggggagagcccugcccacgucgaggcucgaccuggcuugcuccuuaucuuggaacgugauacgguauagccugcagaaacuucgauuggugcgcuggcuccugaagaaaguauuccaguguagaagggccaccccagcaacugaggccggcuuugaagaugaggcuaagacaucagcccgggacgcagcgcuagcuuaccaccgccugcaucaacuccacauuaccgguaaacugccggccgggagugcaugcuccgauguccacauggcccuuugugcugugaauuuggccgaaugcgcagaggagaagaucccucccucuacacugguugaaauccauuuaacugcugccaugggccucaagaccagauguggaggcaaacugggguuccuugcgagcuauuuucuguccagggcccagucauugugcggaccagagcacagcgcugugcccgacagucuccguuggcugugucauccucuaggucagaaguucuuuauggaacggucuugguccgucaaaagcgcagccaaggagucgcuguacugcgcucagcgaaacccagccgaucccauugcacaagugcaccaggcguucugcaaaaaucuccuggaaagagccaucgagucacuuguuaagccucaggcuaagaaaaaggccggcgaccaggaggaagagucuugugaauuuaguuccgcauuggaguaccugaaauuacuccauagcuucguggauucuguaggggucaugagcccgccacuguccaggucaagugugcuuaagagcgcucugggacccgacauuauaugccgcugguggacgucugccaucaccguggcaauuuccuggcuacaaggcgaugacgccgcuguccggucacacuuuacaaaaguugagagaaucccuaaggcgcucgaagugacugagaguccacugguaaaggccaucuuccacgcauguagggcuaugcaugccagcuugcccgguaaagccgaugggcagcaguccucuuuuugccacugugaacgcgcuucgggccaucuguggagcucauuaaacguguccggagcaaccagugacccugcccucaaucacgucgugcaacugcuuacaugcgaccuguugcucucucugcgaacugcgcuauggcagaagcaggcuagcgccucccaggcaguuggcgagaccuaucacgccucaggggcugaacuggcaggauuccaacgggaucuuggcucucuccguagacuggcccauagcuucaggccggcguaccgcaaaguguuuuugcacgaggcuacgguccggcugauggccggugcaagucccacaagaacccaucaguuacucgagcacucccugaggcgacgcacuacacagagcaccaagcauggggaaguggacgccuggccaggacagcgggagagagcuacugccauucuucuggcauguaggcacuugccucucucuuuccugucaucccccggccaacgugcuguucuacuggccgaagcggcccgcacccuugagaaagugggugaucggagaaguugcaacgacugucagcagaugauagucaagcucggcgggggaacagcaaucgcugccagcuga

SEQ ID NO: 63190 - RNA, 1875 nt, Artificial Sequence
  derived and/or modified sequence opt3 from SREK1__Homo_sapiens__NP_001070667
augaacagcggcgggggauucggucugggccucggguuuggacuuacccccacauccgugauccaggucacuaaucugucuucagccguuacgagugagcaaaugagaaccuuguucagcuuuuuaggcgaaauugaggaacugaggcuauacccuccagacaacgcuccgcucgcauucuccucuaaggugugcuauguaaaauuucgggaucccucgucagugggugucgcccagcaccugacaaauacuguguucauagaccgcgcgcuuaucguugugccuugugcugaggggaagauuccagaagagagcaaagcccugaguuugcucgcacccgccccuaccaugacaucccugaugccaggagcuggccugcuccccaucccuaccccaaacccguuaacuacacugggcgucucucuuagcuccuugggggcaauucccgccgcugcccuggauccuaauaucgcgacccuaggagagauaccacagcccccucucauggguaacguggacccaucaaagaucgaugaaauucgacguacgguauacguuggcaaucugaacagucagacuaccacagcagaccaacuucuggaguuuuucaaacaggugggggaagucaaguuugugagaauggccggagaugagacucagcccaccagguucgcuuuuguggaguucgccgaccagaauagcgucccgcgggcauuggcuuuuaacggcguuauguucggugaucgcccucucaagaucaaucauucuaacaaugccauugugaaacccccagaaaugacaccucaagcggccgcaaaggagcuggaagagguaaugaaaagagugagggaagcucaguccuucaucucagccgcuauagagcccgagagcgggaagaguaacgaacggaaaggaggccgcucucgaucccacaccagaagcaagucgaggucuuccucaaagagucauagccggcguaaacgcucccagucuaagcacagaagcaggucacauaaucggagucgaucccgccagaaagacagaaggcggagcaagucuccacacaaaaagcgcucaaaaaguagagagaggcguaagagccggucccgaucucacucgagagauaagaggaaagacacgcgcgaaaagauuaaagagaaggaacgggucaaagagaaggauagagagaaggaaagggagcgcgaaaaagagcgagaaaaggagaaagagcggggcaagaacaaagaccgugacaaggaaagagagaaggauagggaaaaagacaaggagaaagaucgcgagcgggaaagagagaaggaacaugagaaagacagggauaaggaaaaggagaaagagcaagacaaggaaaaagagcgagaaaaggaucgcagcaaagagaucgacgaaaagcggaaaaaggauaagaaauccagaacucccccuaggucauauaacgccagucgucgcucucggagcuccucaagagagaggcgacggcgcagaagcaggucuuccagucggagcccacgaacaucuaagaccauuaaaagaaaguccucacgcaguccgagccccaggucgcguaauaaaaaggacaagaaacgggagaaggaaagagaucacaucuccgagaggcgcgaacgagagagaucuacuagcaugcggaaaucaaguaacgacagggacgggaaggaaaaauuagagaaaaauuccacaucucugaaggagaaggaacauaacaaggagccugauagcuccgugucaaaagaaguugacgauaaggacgcaccacgcaccgaggagaauaaaauccagcacaacggaaauugccagcucaacgaagagaaucuuagcacgaagaccgaagccguguga

SEQ ID NO: 63191 - RNA, 468 nt, Artificial Sequence
  derived and/or modified sequence opt3 from SREK1IP1__Homo_sapiens__NP_776190
auggccgugcccggcugcaacaaggacagcgucagagcuggguguaaaaagugcggauacccuggucaccugaccuucgaguguaggaauuuucuccggguugauccaaaacgcgacaucgugcuugauguauccucuacaucaagugaagacagcgaugaggaaaacgaggaacugaauaaguugcaggcauuacaagagaaacgaauuaacgaggaagaggaaaagaagaaagagaaguccaaagagaagauaaaacugaagaagaaacguaagagaucuuauucgucaagcaguacugaagaggacacguccaaacagaagaaacagaaguaccagaaaaaggaaaagaaaaaggagaaaaagucuaaaagcaagaagggcaaacaucacaagaaagaaaagaaaaagaggaagaaagagaagcauuccucaaccccgaauaguagcgaguucucucggaaauga

SEQ ID NO: 63192 - RNA, 1290 nt, Artificial Sequence
  derived and/or modified sequence opt3 from SRFBP1__Homo_sapiens__NP_689759
auggcccagcccggcacccugaaccucaauaacgagguggucaagaugagaaaagaaguuaagaggauccgggugcuuguaauucgcaaacuggugcgaagcgucgggcguuugaaguccaaaaagggaacagaggacgcuuuacugaagaaucaaagaagggcacagcggcuacucgaagagauacacgccaugaaagaacugaagccugauaucgugacuaaaucugcgcuuggugacgauauuaacuucgagaagaucuuuaaaaagccagacucaacggcuaccgagcgcgccauugcaagacuggccguucauccguugcucaagaaaaagaucgaugugcugaaagcugcaguccaggccuucaaggaagcuaggcagaauguggccgagguagaaaguagcaaaaacgcguccgaggacaaucacucugagaacacacuguacucgaaugauaacggcucaaaucuccaacgggaagcaacuguuauaagcgagcagaaggugaaagaaaccaagaucuuagccaagaaacccauucauaacaguaaggagaaaaucgcuaagauggaacacgggccuaaagccgucacaauugcaaauuccccaucuaagcccagcgagaaggacuccguggugucacuggagagucagaaaaccccugcugauccaaaacuuaagacuuugagccagacaaagaaaaacaagggaucugacuccucacugagcggcaauagugaugguggggaagaguuuugcgaagaggaaaaggaguauuucgacgauucuaccgaggaacgcuuuuacaaacaauccagcaugucggaggacucugacuccggagaugacuucuuuaucggcaagguccgaagaacgaggaaaaaggaaucaaguugucauagcuccguuaaagagcagaagccccuagaaaagguguuccucaaagaggauacuggcgagacccacggggacacacggaacgauaagauaaaaccuucuacugaaacccguaagcuggagagcguauuuuuccacucacuuaguggauccaaaagcucucgcagaaacuuuaaggaacaggccccaaaaacaaggucacuggacuucccgcagaaugagccccaaauuaagaaccaguuuaauaagaaauugaguggucggcucgagaacaccaagcagcaacugcaguuaccucugcauccaagcugggaagcgucccgacgcagaaaagagcagcagucuaauaucgccguguuccaaggcaagaaaauuacguucgaugacuga

SEQ ID NO: 63193 - RNA, 915 nt, Artificial Sequence
  derived and/or modified sequence opt3 from SRF__Homo_sapiens__NP_001278930
augaucaccagcgagacaggcaaggcccugauucagacuugccucaacucccccgacucuccuccaagaucagauccgacgaccgaccaaaggaugagugcuacaggguucgaagagacugaucuuaccuaccaggugagcgaauccgacucuucgggagagacaaaagauacccugaagcccgcauuuacugucacaaauuugccugguaccacgucaacuauacagaccgccccaagcacaaguacuaccaugcagguuuccucuggccccagcuucccuaucacaaacuauuuagcgccaguguccgcuucaguaagucccagcgccgugucuuccgcaaaugggaccguccugaaaucaacgggaagcggcccugugaguucuggugggcuaaugcaacucccaacuuccuuuacacugaugccgggaggcgccguugcucaacaggugcccguccaggcaauucaggugcaccaggccccucagcaggcuagcccaucgcgggacucuuccaccgaucuuacucaaacaucaaguagcggcaccguaacgcugcccgccaccaucaugacauccucuguuccuacuaccgucgggggacauaugauguacccaagcccccacgcggugauguaugcaccgacaucagguuugggcgacgggagucucacugugcugaacgccuucucccaggcuccuagcaccaugcaagugucucauucacagguccaggaacccggaggcguuccacagguguuucugacagccaguagcgguaccguacagauuccuguguccgcaguccaacuccaccagauggcugugaucgggcagcaggccggaucuucgagcaauuuaacugagcugcaaguugugaaccuugauacggcgcauuccacaaagucagaguga

SEQ ID NO: 63194 - RNA, 3258 nt, Artificial Sequence
  derived and/or modified sequence opt3 from SRGAP1__Homo_sapiens__NP_065813
augagcacccccuccagauucaagaaagacaaggagaucauugccgaauacgagucucaggugaaagaaauaagggcccaacuggucgagcagcagaagugccucgaacagcaaacagagaugcggguucagcuucugcaggauuugcaggacuuuuuccgcaaaaaggcagagaucgaaacugaguauucacgaaacuuagaaaagcuggccgagcguuuuauggcgaaaacgagaaguaccaaggaucaccaacaguacaaaaaggaccagaaucuacucagcccugugaacuguugguaucugcuucugaaucagguaaggcgggaguccaaagaucaugcuacauugucugacauuuaccucaacaaugugaucaugcgcuucaugcaaauuucggaagauucaacuagaauguuuaaaaagagcaaggagaucgccuuccagcugcacgaagaccugaugaagguccucaacgaguuauauaccgugaugaaaacauaccauauguaucacgcagaaaguauauccgccgagucuaagcugaaagaggcugaaaagcaggaggaaaaacaaaucggcaggagcggggauccaguuuuucauauucggcuugaggaacgccaccagcgaagauccucagugaagaagaucgagaaaaugaaggagaaaaggcaggcaaaguacagugaaaauaaauugaaaagcauuaaggcccggaacgaguaccugcuaacccucgaagcuacuaaugccucugucuucaaguauuacauccacgaccuguccgaucuuauagacugcugugaucugggauaucaugcgucauugaaccgugcacuccgcacauaccugagcgccgaguauaauuuagaaaccaguagacacgagggucuggacauuaucgagaacgcuguggacaaucucgaaccgaggucugauaagcagcgguuuauggagauguaccccgccgcauucugcccuccaaugaaauuugaguuccaaucccauaugggcgacgaaguaugucagguuagcgcucagcagcccgugcaagccgagcuuaugcugcgauaucagcaguugcagucgcgccuagcgacgcugaagauugaaaacgaggaagucaaaaagacuaccgaggccacacuccaaacuauccaggauauggugaccaucgaagacuacgaugugucugagugcuuucagcacuccagaucaacagagagugucaagagcaccguuuccgaaacguaccugucuaaaccuagcauugcaaagaggcgggcuaaucagcaagagacugaacaguucuauuucaugaaacuucgcgaguaccuggaagggucaaacuugauaacaaagcuccaggccaaacacgaccuguuacaaagaacccugggagagggccauagggcugaguauaugacuacacguccacccaacgugccuccaaagccgcagaagcaccggaaaagucgacccagaucccaguacaauaccaagcuauuuaacggugaucucgaaacguucguaaaagacagcggacaggugaucccucugauugucgagucuuguaucagguuuauaaaucuuuauggguugcaacaucagggcauuuuccgcgugucaggcagucagguugaagugaacgauaucaagaauagcuuugagagaggggaaaacccacuggccgacgaucaguccaaucacgacaucaacucugucgcaggagugcucaaacuguacuuccggggucuugagaauccccuguuuccuaaggagagguucaacgacuugauuucgugcauccgcauugauaaucucuaugaacgagcccugcauauacggaaauuacugcuaacccucccacguagcguacugaucguuaugagauaccuuuuugcuuucuugaaccaccugucccaauacucagacgagaauaugauggaucccuauaaccucgcgauuuguuuuggcccgacacugaugccugugcccgaaauccaggaccaggucaguugccaggcacacgugaaugagaucauuaagacuauaaucauucaucacgagaccaucuucccagaugccaaggaauuagacgggccugucuacgagaaauguauggcuggagaugacuauugcgauucucccuacagcgaacauggcacacuggaggaaguggaccaagaugccgguacugagccacacaccuccgaggacgaaugcgagcccauugaagcaaucgccaaguuugauuauguugggaggucagcucgcgagcuuagcuucaaaaagggagccucuuugcuccuguaccaccgggcauccgaagacuggugggagggcagacauaacggcauagacgggcuagugccucaccaguauaucguaguccaggauauggacgauacauucagugacacccugagccaaaaagcggauucugaggcuuccucaggaccagugacugaagacaagaguagcucgaaggauaugaacuccccgacggacaggcaucccgaugguuaccucgcccgacagcgcaaacggggcgagccuccacccccuguuagaaggccagggcguacaucugacggacacuguccccugcauccgccucacgcacuuagcaauucaaguguggauuugggcuccccaucucuggccagccacccccgcgguuuacuccagaaccgggggcugaauaacgacuccccugaaagaaggcgacggcccggccauggaucacuuaccaauauuagccgccacgauagucugaagaaaaucgacucuccaccuauuagaagguccacuagcucgggccaguacaccggguuuaacgaccauaagcccuuggauccagagacaaucgcucaagacauagaagagaccaugaauacugcccucaacgagcugcgggaacuagagcgacagucaacagcaaaacacgcuccggaugucgugcuggacacgcucgaacagguaaagaauaguccuacccccgccacuucuacagagucccugagcccacuucauaacguggcguugagaucuagcgagccccagauucgcagguccaccucaaguagcucugauacaauguccacuuucaagccuaugguugccccacguaugggaguccaacugaaacccccugcuuuacggccgaagccagcagugcuccccaaaaccaauccuacgaucgguccagcucccccuccgcagggccccaccgacaagucaugcacaauguga

SEQ ID NO: 63195 - RNA, 2370 nt, Artificial Sequence
  derived and/or modified sequence opt3 from SRGAP2__Homo_sapiens__NP_001287881
augaccagccccgccaaguucaaaaaggacaaagagaucauugcugaauacgauacacaggugaaggagauaagagcacaacugacugaacagaugaaaugccucgaccagcagugugagcuuaggguccaacuguugcaggauuuacaggacuuuuuccggaagaaggccgaaaucgagauggauuauucccgcaaccuggagaaacuagcggaacgauuucucgcuaagacgcguucuaccaaagaccagcaauucaagaaagaucagaauguucugucaccugugaacugcuggaaucuucuguugaaccagguaaagagagagaguagggaccacacaacucucagcgauauuuaccugaauaacaucauuccacgguuugugcaggucuccgaagacucuggccgccuguucaagaaaucgaaggagguggggcaacagcuccaggaugacuuaaugaaaguucugaaugagcuuuauucagugaugaagaccuaccauauguauaacgccgauagcaucagugcacaauccaaauugaaggaagccgagaaacaggaagagaagcagauaggaaagucugucaaacaggaagacagacaaacaccgaggagccccgacuccaccgcuaaugugcggaucgaggagaagcacguacgccgaucaaguguuaaaaagauugagaaaaugaaggaaaagagacaggcaaaauacacugaaaacaagcugaaagccaucaaggcuaggaaugaguaucuacucgcccuggaagcgacaaacgcaagcguguuuaaauacuacauucaugaucuuucugaccugaucgauuguugcgacuuggguuaucacgccucccucaaucgggcucugcguaccuucuuaucagccgagcugaaccucgagcagagcaagcaugaaggccuugaugcaauagagaaugcugucgaaaaccuggacgccacgagugauaagcagcgcuugauggagauguacaacaauguguuuuguccuccaaugaaauucgaauuucaaccccacaugggggacauggcgucucagcuaugcgcccagcagccugugcaauccgagcugguccagagaugucagcagcuccaaagcaggcugucgacucuuaagauugagaacgaagagguuaaaaagaccauggaagcaacacugcagacuauccaggauauugugaccguagaggacuucgaugugucugacugcuuucaauauuccaauucaauggagagugucaaaagcacaguguccgaaaccuucaugucuaagccaagcaucgcuaagcggcgagccaaccagcaggagacggaacaguucuacuuuacuaaaaugaaggaguauuuggaaggacgcaaucucaucacaaaacugcaagcuaagcacgacuuacugcagaaaacccuaggcgagucacagagaacugauuguagucucgccaggcgguccagcacaguucgcaagcaggacucuucacaagcaauuccccugguggucgagaguugcauaagauucaucagcaggcauggucuucagcacgaagggauuuuucguguguccggaucucagguagagguuaacgauaucaaaaaugccuucgaacggggcgaggacccuuuggcuggcgaucagaacgaccaugauauggacucgauagcgggggugcugaagcucuacuuucgaggacuggaacacccacuuuucccgaaggauauuuuucacgaccugauggcaugugucaccauggauaauuugcaagagagagcccuccauaucaggaaagugcuguuaguccugcccaagacgacccuaaucauuaugcgcuaucucuucgcuuuucugaaccaccuuagccaguucuccgaggaaaauaugauggacccuuacaacuuggccaucugcuuugguccaucacugaugagugugcccgagggccaugaucagguuucuugccaagcacacgugaaugaacucauuaaaacaauaaucauucagcaugagaacaucuucccuagcccacgggaacuggaggggcccguauacuccagaggaggcucaauggaggacuauugugacagcccgcacggugaaacuaccucugucgaggauuccacacaggacgugacugccgaacaccauaccagugaugacgagugcgagccuaucgaagcuauugccaaguuugauuacguugggaggacagcacgcgagcugagcuucaaaaagggagcgucuuuacuuuuguaucagcgagcuuccgacgauuggugggaaggccggcacaauggcauagacgggcucaucccccaucaauacauugugguccaggauacccugaucucauga

SEQ ID NO: 63196 - RNA, 3228 nt, Artificial Sequence
  derived and/or modified sequence opt3 from SRGAP3__Homo_sapiens__NP_001028289
augagcucccagaccaaguucaaaaaggacaaagagaucauugccgaauacgaggcucaaauaaaggaaaucagaacacagcugguggagcaguuuaaaugccucgaacagcaaucugagucaaggcuucagcuguugcaggauuuacaggaguucuuucggcgcaaggcagaaauugagcuggaauauagucgaagccuagagaagcucgccgagcguuucuccucuaaaaucagaucgucaagggaacaccaauuuaagaaagaccaguaccugcuuagccccgucaacuguugguaucugguuuugcaucagacucggcgcgagaguagagaucacgcgacgcucaaugacauuuucaugaacaaugugaucguaaggcugucccagauaucugaagaugugauccggcuguuuaagaaaagcaaggagauuggccuccaaaugcaugaagaguuacugaaggucaccaacgagcuuuacacagugaugaaaacuuaucacauguaccaugcugaauccaucucagccgagaguaaguugaaagaagcagagaagcaggaagagaaacaguucaauaagagcggggaccugucuaugaaccuacuccgccacgaggaucgaccucaaagaagguccucaguuaaaaagauugaaaagaugaaagagaagcggcaggccaaauauagcgaaaauaagcugaaaugcaccaaggcucguaacgacuaccuucugaauuuggcagccacaaacgcugccaucaguaaguacuauauacacgaugugucugaccucauugauuguugcgaccugggauuucaugcguccuuagcacgcaccuucagaacuuaccugagcgccgaguauaaucucgaaacaucgaggcacgagggucuugaugucaucgagaacgcuguggacaaucuggacucucgguccgauaaacauaccguaauggacauguguaaccagguguuuugcccaccguugaaguucgaauuucagccccacaugggcgaugagguuugucaagucucagcccagcagccugugcagacggaacuacugaugcgauaccaccaacuccagagucgccuggcaacucuuaaaauugagaaugaggaagugagaaagacccuggacgcuacaaugcagacuuugcaggauaugcucaccgucgaggacuucgauguuagcgacgccuuccaacauuccaggucuacagaaagcgugaaaucagcggccagugagaccuauauguccaagaucaacaucgcaaagcggcgcgcuaaccagcaggaaacggagauguuuuacuucacuaaauuuaaggaguauguaaaugggagcaaccugauuacaaaauuacaggccaagcacgaucugcuaaaacaaacccucggagaaggcgagagagcugaaugcgguacuacaagggggcgucggaaugcccgaaccagaaaccaggacucuggacaggcaauaccacugguggucgagucauguaucagguacauuaaucuuuacggcuugcaacagcagggcaucuuccgcgugcccgggagucagguugaagugaacgauauaaagaauagcuuugagcggggagaggacccucuggucgacgaucaaaacgaaagagacauuaauuccguggccgguguacucaagcuguauuucaggggccuugagaacccacuguuucccaaagaacgcuuccaggauuugaucucuacgaucaagcucgagaauccugcugaacgaguucaucagauucagcaaauccuggugaccuuaccacgggucgugauugucgugaugcguuaccuguuugcguuccuaaaccaccucucgcaguauagcgacgagaauaugauggauccguacaaccuggcaauaugcuuugggcccacacuuaugcauaucccugacggacaggauccaguuuccugucaggcccacauuaaugaggugaucaaaacuaucauuauacaccaugaagcuaucuuccccucaccuagagaguuggaaggcccaguauaugagaagugcauggccgguggggaggaauacugcgacaguccccacucugagccgggagcaauugaugaagucgaccaugauaacggcaccgagccucacacaagcgacgaagagguggagcaaaucgaagccauugcuaaauuugauuauaugggcaggucccccagggagcugucauucaagaaaggggccagccuccuguuauaccaccgggcaucugaagacuggugggagggaagacauaacgguguugacggccugaucccacaccaguacauagugguccaggauauggacgaugcguucuccgacagucuuagccaaaaggcugauucugaagccuccucagggccuuugcucgacgauaaggcaaguagcaaaaaugaccugcagucgcccacugagcauaucuccgauuauggauuuggcggugugauggggaggguacgacuacgcucugacggcgccgcuauuccacggagaaggagcggaggcgauacccacucacccccucgugggcugggaccaaguaucgacacaccgccccgcgccgcagcuuguccuuccucuccacauaagauuccccucacccgggguagaaucgagagcccugaaaaacgccgaauggccacuuucggcuccgcggggucaauaaacuacccagauaagaaagcccugagcgagggacacaguaugcggucuacgugcggcuccacacgccacagcucgcuuggugaccauaagucauuggaagcugaggcacuggccgaagacauugagaagaccaugucuacugcuuuacacgagcucagagaacuggagaggcagaauaccgugaaacaggcccccgauguuguccuugacacacuggaaccguugaagaacccuccagggcccgugaguuccgagccugcaagcccccuccauaccaucgugauucgggauccagacgcggccaugcgaagaucuagcuccucaaguacugagaugaugacaacguuuaaaccugcucugagcgcccgccuagcaggcgcucaacugaggcccccaccgaugcguccuguccggcccguugugcagcacagaucuuccucaaguagcuccucuggagugggcucgccagccguaacccccacugaaaagauguucccuaauagcucagcagauaaauccgggacaauguga

SEQ ID NO: 63197 - RNA, 477 nt, Artificial Sequence
  derived and/or modified sequence opt3 from SRGN__Homo_sapiens__NP_002718
augaugcagaagcugcucaaaugcagcagacuugugcuggccuuggcuuuaauccugguccuagaguccucuguucaaggcuaccccaccaggcgggcacgcuaucagugggugcgauguaacccugacucaaauagugccaacugccucgaagagaaggggccaauguucgaacugcuuccgggagagagcaauaaaauuccccgucugagaacagauuuguuuccuaagacuaggauacaggaccucaaccggaucuucccacuguccgaagauuacucugguucgggcuuugggucaggaagcggcagugguuccgggucuggaagcggcuuccugacggagauggagcaggacuaucaacucguagaugaauccgacgcguuucacgauaauuuacgcucacuggacagaaaccuucccagugauagccaggacuugggccagcaugggcuggaggaagauuucaugcuauga

SEQ ID NO: 63198 - RNA, 543 nt, Artificial Sequence
  derived and/or modified sequence opt3 from SRI__Homo_sapiens__NP_001243821
augcaguacggcggggcccccggagguccugcuuucccaggccaaacccaggacccgcuguauggguacuuugcagccguggcgggacaggauggccagaucgacgcugaugagcuccaaagaugccuuacacagagcgguauugccgggggauauaagcccuucaaccuggaaacuuguagguugauggucuccauguuagaccgggauaugucuggcacgaugggcuuuaaugaguucaaagaacugugggcaguucuaaacggguggcgccagcacuuuauaucauucgacaccgaucgaaguggaacaguggacccucaggagcuccaaaaggcccugacuaccauggguuuucgucuuagcccacaggcuguaaauuccaucgcaaaaagauacucuacaaacggcaagauuaccuucgaugacuauaucgccugcugugugaaacugagggcuuugacugauucguuucggcgcagagacacagcccagcagggggucgugaauuuccccuacgaugacguuucacucaggaacuga

SEQ ID NO: 63199 - RNA, 1422 nt, Artificial Sequence
  derived and/or modified sequence opt3 from SRL__Homo_sapiens__NP_001092284
augagagcccuggugcuccuuggcugccuguuggcuagcuuacuguucuccgggcaggcagaggaaaccgaggacgccaacgaagaggcgccccuaagggaucggucucacaucgaaaagacacucaugcugaaugaggacaaaccuucagaugacuacagugcuguccuucaacgccugcgaaagauuuaucauagcuccauaaaaccauuggagcagucuuacaaguauaacgaacuccgucagcacgagaucacugauggagaaauuacgucgaaaccgaugguucuguuucugggucccuggucagugggcaagagcaccaugaucaauuaccucuuagggcuggagaacacaagauaucagcuuuacacuggagccgagccuaccacaagugaguucaccguauugaugcauggcccaaagcugaaaacuauugaagguaucgugauggcagccgacuccgcuaggucuuuuagcccccuagaaaaguucgggcaaaauuuucucgagaaacugauaggaaucgaagucccucacaaacuucuggagcgggugacauucguugauaccccaggcauuaucgagaaccgcaagcagcaggaaagaggcuaucccuuuaaugacgugugucagugguucauugauagggcagacuugaucuuugucguguucgauccuacgaagcucgacguagggcuggaguuagaaaugcuguuucggcaacucaagggacgcgagucccagauacgaauuauccuuaacaaagccgauaaucuggcuacucagauguugaugagaguuuacggugcccuauucuggucacuggcgccacucauuaacgugaccgaaccgcccagggucuacgugaguagcuuuuggccucaggaguauaagccagacacacaucaagagcuguuccuucaggaagagaucucucuguuggaagaccucaaucaggugaucgagaaccggcuggaaaauaaaauugcauucauacgucaacacgccauccgcgucaggauucacgcuuuacugguugauagauaccuacagacuuauaaggacaaaaugaccuuuuucuccgauggcgagcucguguuuaaggacaucguagaggaucccgacaaauucuacauauuuaagacaauucuggccaagaccaacgugucaaaauucgaucuuccuaaucgggaagcauauaaggacuuuuucgggaucaacccaaucagcaguuuuaaauugcugucucagcagugcuccuacaugggaggcuguuuccucgagaagauugaacgagcuaucacgcaagagcugcccggucuucuggggagcuugggacucggcaaaaacccgggcgcccugaauugcgauaagacuggguguucggagacaccuaagaaccgcuauagaaaacauuga

SEQ ID NO: 63200 - RNA, 1467 nt, Artificial Sequence
  derived and/or modified sequence opt3 from SRMS__Homo_sapiens__NP_543013
auggagcccuuccugagaaggcggcucgccuuucuuagcuucuuuugggacaagaucuggccugcuggcggggaaccagaucacggaaccccggguucccuggaccccaacacagauccugugccaacuuugcccgcagagccuugcucuccauucccccaguuauuucuggcccuauacgacuucacggcgcgcuguggcggggaacucucaguccgacguggagauagacugugcgcucuugaggaaggcgguggguauauuuuugccaggcggcugaguggacaaccuagcgcaggcuugguuccaauaacccauguggccaaggcuuccccggagacacucucugaccagcccugguacuucucgggcguaucacgcacucaggcacagcaacugcugcucagcccuccaaaugagcccggggccuuuuuaaucagaccuagugaauccucucugggagguuauagccuuuccgugagggcucaggccaaagucugucacuaccgggugucaauggcggcagauggcaguuuguaucugcagaaagggcgccuauucccaggacucgaggaacugcuuaccuacuauaaggccaacuggaaacugauucagaaucccuugcuccaaccgugcaugccucagaaggcuccccgacaggacguuugggagagaccacauagcgaguuugcccugggcaggaaguuaggugaaggguacuucggagaggugugggaaggccuguggcucggcucucuuccugucgcaaucaaagugauuaaguccgcuaacaugaaacugacagauuuggccaaggagauccagacccuaaaagggcugcggcacgaacgucucauacgccugcaugcgguauguucaggaggugagcccguuuacaucgugacugagcuuaugagaaagggcaaucugcaagccuuuuuggggacaccagaaggaagggcacuccggcugcccccuuuacugggcuucgcuugccaggucgccgaggguaugagcuaucuagaggaacagcgaguggugcaccgcgaccucgcugccagaaacguccugguugaugacgggcuugcauguaagguggccgauuucggcuuggcuaggcugcucaaagacgacauuuacaguccaucuuccagcucgaagaucccgguaaaauggaccgcgcccgaagcagccaauuaucggguguuuucucaaaaguccgaugucuggucauucggagugcugcuucacgagguuuuuacguacggccagugcccuuaugaggggaugacuaaccaugaaacccugcagcagauuaugcgcggauacagauugccaaggcccgcugccuguccugcagagguguauguccucaugcuggaaugcuggcguaguagcccagaggaacggcccuccuucgccacauuacgagagaaacugcacgcuauccauagaugucacccguga

SEQ ID NO: 63201 - RNA, 411 nt, Artificial Sequence
  derived and/or modified sequence opt3 from SRP14__Homo_sapiens__NP_003125
auggugcugcucgagagcgaacaguuccuuaccgagcugacaagauuguuucaaaagugcaggacuuccggcucugucuacaucacgcugaaaaaguaugacgggcggaccaaacccauuccuaagaaaggaacaguugaagguuucgagccagccgauaacaaguguuuacuacgcgcuacugacggcaagaaaaagauaucaaccgugguaaguagcaaagaagugaauaaguuucagauggcauacuccaaccuccugcgagccaauauggaugggcuuaaaaagcgugacaagaaaaacaagaccaaaaagacaaaagcggcugccgcagccgcugcagccgcuccggccgcggcagccacugcucccacaaccgccgcaacgacugcugccaccgcggcccaguga

SEQ ID NO: 63202 - RNA, 333 nt, Artificial Sequence
  derived and/or modified sequence opt3 from SRP19__Homo_sapiens__NP_001191122
auggccugcgcugcagccagaagccccgcggaccaggauagguucaucuguauuuacccugcuuaucugaacaauaagaaaaccauagccgagggccggcgcaucccaauuuccaaggcaguggaaaacccgacagccacugagauccaagacgucugcucugcuguugggcucaauguguuucuugagaaaaacaagauguacucacgagaauggaaucgugauguacaguauagaggaagggugcggguccagcugaaacaggaagacgguaguuuguguuuagugcaauuccccagccacuacacgcugucccuaaccucuggcucguga

SEQ ID NO: 63203 - RNA, 1770 nt, Artificial Sequence
  derived and/or modified sequence opt3 from SRP68__Homo_sapiens__NP_001247431
auggccgcugagaaacaggugcccggcgggggagguggcgggggaagcggcggugggggaggcuccggcgggggagguucuggcgggggaagaggcgccgguggggaagagaacaaggaaaaugagaggccuucagcaggaaguaaggcgaacaaagaguucggcgacagccugucccucgagauccuucaaauuauaaaggagucucagcagcagcacggccugcggcauggggauuuucaacgcuaccgauauuuguuacugguccuaauggacgcugaacgugccuggucguacgcaaugcagcucaaacaggaggccaauaccgaaccaagaaagagguuccaucugcuuucacggcugcgcaaggcuguuaaacacgcagaggaguuggaaagacucugcgagagcaacaggguggaugccaagacaaaacuggaagcucaggccuauacugcguaccugaguggaaugcuccgguuugagcaccaagaauggaaggcagccaucgaggcuuucaauaaauguaagacgauuuaugagaaguuagccuccgcauuuaccgaagaacaggcuguacuguacaaccagcgcguggaagagaucucuccgaauauucgauauugcgccuacaacaucggugaccagagcgcgauaaaugaacuuaugcaaaugagauugagguccggcgggacagagggacugcuagccgagaaacucgaagcacugaucacucagacccgggcuaagcaggccgcuacaaugucagaggucgaauggcguggccgcaccgugcccguuaaaauugauaaggugagaaucuuccuucuggguuuggccgacaacgaggcagccauuguccaagcugaaagugaggagacuaaagaaaggcucuuugagagcaugcugucugaaugucgggaugcgauccaggugguacgagaggaguuaaagccugaccagaaacagcgcgauuacauacuggaaggggagccaggcaagguuuccaaucuccaauaucuucauucauaccugacauauauuaaguugagcaccgcaaucaaaagaaacgaaaauauggccaagggacuacagagggcucugcuccagcagcaacccgaggacgauaguaaacggucuccucgcccacaggaccugauuagacuuuacgauaucauccugcagaacuugguggaacuccugcaguuacccggccuggaggaggacaaggccuuccaaaaagaaauugggcuaaagacgcucgucuuuaaggcauauaggugcuucuuuauagcccaguccuacgugcuggugaaaaaguggagcgaggcucuugucuuguaugaccguguucugaaauacgccaaugaagugaacucggaugcaggagcguucaagaacucucucaaagaccugccugauguacaggagcuuaucacucaggugcgguccgaaaaguguucacugcaagcugccgcaauuuuggacgccaaugaugcucaccagaccgagacaaguagcucccaggucaaggacaacaaaccacucguggagcgauuugaaacuuucugccuggauccgucuuuaguuaccaagcaagccaaucuggugcacuuucccccugguuuccagccaauccccuguaaaccucuauucuuugaccucgcacugaaccaugucgcuuucccaccccuugaggauaaguuggaacagaaaacaaagagcggccugaccggguacauaaagggaauuuuuggcuucagaucauga

SEQ ID NO: 63204 - RNA, 1833 nt, Artificial Sequence
  derived and/or modified sequence opt3 from SRP72__Homo_sapiens__NP_001254651
auggccagcggcggguccggaggugugucuguccccgcucuguggucagagguuaacagauacggccagaauggggacuucaccagggcacucaagacagugaacaaaauccuucaaauuaauaaggaugacguaacugcccugcacugcaaaguggucuguuugauacagaacggaaguuuuaaggaagcguuaaaugugaucaacacgcacaccaaaguucuggcuaauaacagccuauccuucgagaaggccuauugcgaauaccggcucaaucgcauugagaacgcacugaagacaaucgaaucugccaaucagcagacugauaaacuuaaggagcuguauggccaaguguuguaccgacucgagcguuaugacgaaugucuggcugucuacagagaucuggugaggaacucgcaggacgauuaugacgaggaacggaaaaccaaucucucagcaguaguugccgcucagagcaacugggagaagguggucccugagaauuuaggucugcaggaagggacacacgagcuuugcuacaacaccgccugugcguugauuggacaaggccagcugaaccaggcaaugaaaauccuacagaaggccgaagaucucugccgcagaagucuguccgaggacacugaucaaaauguguuugacucuaagaaaaaggugaaacuuacaaacgcugaaggcgucgaguucaagcugagcaaaaagcaguugcaggccauagaguuuaauaaagcacuccuggcuauguacaccaaccaagccgaacaguguaggaagaucuccgcgucauuacagagucagagcccagagcaucugcucccgguucuuauucaagccgcacagcugugccgggaaaagcagcacacgaaagcuaucgaguugcuacaggaguucucugaucaacaucccgagaaugccgcugagauuaagcugacuauggcccagcucaaaaucucccaggggaacauaucaaaggcaugucugauucuucgcagcaucgaagaacugaaacacaagccuggaauggugagugccuugguaaccauguauucucacgaagaggacauugacuccgcuaucgaaguguuuacacaggcgauccaaugguaccagaaucaucagccaaagagccccgcacaccucucgcugauucgagaggccgcuaacuucaaauuaaaguaugguagaaagaaggaggccauaucugaucugcagcaacuauggaaacagaauccuaaggacauccauacucucgcacagcugauuuccgccuacucacuugucgauccagaaaaggcuaaagccuugaguaagcaucugcccagcuccgacucuaugagccucaaaguggauguugaggcacuggaaaacucagcgggcgcuaccuauaucaggaagaaagggggaaaggugacaggcgacagucaaccuaaggagcagggucagggggaucuuaaaaagaaaaagaaaaagaaaaagggaaagcugcccaaaaauuacgacccgaaggucacccccgauccugagcggugguugccaaugcgugaacgcuccuauuacagaggcaggaaaaagggcaaaaagaaggaccagauagggaaaggaacgcaaggugccacugcaggcgccagcucugagcucgaugcuucaaagacagugaguagcccaccuaccuccccacggcccgggucugccgcaacuguaucggcuagcacauccaacauuaucccgccucgacaccagaaacccgccggagcgccagccaccaagaaaaagcagcagcaaaagaaaaagaaaggcgguaaagggggcugguga

SEQ ID NO: 63205 - RNA, 249 nt, Artificial Sequence
  derived and/or modified sequence opt3 from SRP9__Homo_sapiens__NP_001123912
augccccaguaccaaaccugggaggaguucagcagagccgcugaaaagcuguaucucgcagacccuaugaaagccagggugguccuuaaguaccggcacuccgauggcaaccugugcguuaaagugacagacgauuugguacgccaguguuuagcgcugcuacuccgacugcagugcucugggaugaucauugcucauuguauacuugaccuguugggaucaagugguccacucgccagcgcauccuga

SEQ ID NO: 63206 - RNA, 1968 nt, Artificial Sequence
  derived and/or modified sequence opt3 from SRPK1__Homo_sapiens__NP_003128
auggagagaaaggugcuggcccuccaggcuaggaaaaagcggaccaaagcaaagaaagacaaggcccaacgcaagagcgaaacacagcaccgaggcuccgcgccccauucugagucagaucuuccugaacaggaggaagagauccuggggagugacgaugacgagcaggaagauccaaacgacuacugcaaaggagguuaucacuuggucaagauuggcgauuuauucaaugggcguuaccauguuauaagaaaacugggauggggccacuuuagcacuguguggcuauccugggacauccaagguaagaaauucguagcuaugaagguggucaagucugccgagcauuauacggaaaccgcacucgaugagauuaggcugcuuaaaucggugcggaacucagacccgaaugaucccaaccgcgagaugguugugcagcuguuggacgauuuuaagaucagcggggucaauggaacacacauuuguaugguguucgaaguacucggccaccaucugcugaaauggaucauaaagaguaacuaccagggccucccuuuaccaugcguuaaaaagaucauucagcaagugcugcaggggcuugacuauuugcacacuaaauguagaaucauucauaccgacaucaagcccgagaauauacugcuauccgucaacgaacaguacauuaggcggcucgccgcugaggcaacagaauggcagcgcucuggagccccuccacccagcgguuccgcugugucaaccgccccucaaccaaagccggcggauaaaaugaguaagaauaaaaagaaaaagcugaagaaaaagcagaaacgacaggcagagcuucuggagaagagaaugcaagaaaucgaggaaauggagaaagaaagcggccccgggcagaagaggccuaacaagcaggaggagucugaauccccaguggagcggcccuugaaagaaaauccuccaaacaagaugacucaggagaaacucgaagagucaagcacaauuggacaagaccagacccugauggagcgugauacggaaggcggugccgcugagaucaauugcaacggggucaucgaaguuauuaauuauacucagaacaguaacaaugagaccuuacgccacaaggaggaccugcacaacgccaaugauugugacgugcagaaccucaaucaagaaucuuccuuucuuagcucgcagaacggagauucuuccacaucacaggagacugacaguugcacccccauaacaagcgaaguauccgauaccauggugugucagucuagcucaacggucggccaaaguuucuccgagcagcauaucagccagcugcaggaaucuauuagagcagagaucccgugcgaggacgaacaagagcaggaacacaauggcccuuuggauaacaaagggaagucaacugcuggaaauuuucuagugaacccccuggagccaaagaaugccgaaaaacucaagguuaaaauagcggaccuggguaacgccuguugggugcauaagcacuucacagaggacauucagaccaggcaauaccggagucuugagguccugaucggcagcggguacaauacuccugcagauaucugguccacagcuugcauggccuuugaauuggcuaccggagacuaucucuucgagccccauucuggcgaagaguacacgcgagaugaagaccacauugcccugaucauugaguuacuggguaaagugccacgcaagcuaauaguagcagggaaauauucgaaggaguuuuucaccaagaaaggcgaucucaagcacaucacaaaacugaagcccuggggacuuuuugaaguuuugguggagaaauacgaauggagccaggaggaggccgcuggcuucacugacuuccugcucccuaugcuggaacuuauuccagagaagagagcgaccgcagccgaaugucugaggcauccgugguugaacuccuga

SEQ ID NO: 63207 - RNA, 2067 nt, Artificial Sequence
  derived and/or modified sequence opt3 from SRPK2__Homo_sapiens__NP_872633
augagcgugaacuccgagaagucuucaaguagcgaaagacccgagccucagcaaaaagccccacuggucccgcccccuccacccccuccacccccuccaccgcccccucucccagaccccaccccuccagaacccgaggaagagauccuuggcuccgaugacgaggaacaggaggauccggcugacuacugcaaagggggauaucacccuguuaagauuggugaucuguucaauggcagguaccaugugauacggaaguugggguggggacacuuuucuacaguaugguuauguugggacaugcagggcaaacgcuucguggcaaugaaggucgugaagucggcccagcauuauacugaaacggcgcuggaugagaucaaacuacucaagugcguucgagagucagaccccagcgauccaaacaaagacauggugguccaacugauugaugacuuuaagaucagugguaugaaugggauucacguguguaugguauucgaaguucuuggacaucaccuguugaaauggaucauaaaguccaacuaccagggccucccugugcguugcgucaagucuaucauuagacaggugcugcagggccuggauuaucuccacagcaaauguaagaucauucauaccgacaucaaacccgagaauauauuaaugugcguggacgaugcuuacgucaggcggauggccgcagaagccacagaguggcaaaaggcuggggcaccacccccuuccggaucagccguuaguacugcuccacagcagaaaccgauugguaagaucagcaaaaacaagaagaaaaagcugaaaaagaaacagaagcgccaagccgaacuuuuggagaagagacugcaggagauugaagaacuagaaagggaggcggaacggaaaaucaucgaggagaauauuaccucugcagcccccuccaacgaccaggauggcgaauauuguccugaggugaagcucaaaacaaccgggcuggaagaggcugccgaagcagagacugcuaaggacaauggagaggccgaagaucaagaggaaaaagaggacgcggagaaggaaaacauagagaaggaugaagacgauguagaccaggagcuugccaauaucgauccaacauggauugaaucacccaaaaccaacggccacaucgagaaugguccuuuuagccuggagcagcaguuggacgacgaagaugacgaugaggaagacugcccaaaccccgaggaauacaaucucgaugagccgaacgcagagagugacuacacguauucuuccagcuacgaacaauucaacggggagcugccuaauggacgccauaagauaccagaaucgcaguuucccgaguucucuacuuccuuauuuucaggcagucuggaaccuguggcuuguggcagcguccucuccgaggggucuccccuuaccgagcaggaagagagcucaccaagucacgaucgauccagaacagugagcgccucuucaacuggagaccugccuaaagcuaagaccagggccgcagauuugcuaguuaacccccuggacccacggaaugccgauaaaauucgugugaagaucgcugaccucgguaacgcgugcuggguccacaagcauuucacagaagauauccagacccgccaauauagaaguauugaggugcugaucggcgcaggguacagcacgccggccgacauuugguccacugcuuguauggccuuugagcuugcaacaggagacuaucuguucgaaccucacucuggcgaggauuacucgagggacgaagaucauauagcccacaucauugaguugcucgguagcaucccccggcauuuugcucuguccgggaaauauucacgagaguucuucaaucgcagaggcgaguuaaggcacaucaccaagcugaaaccauggagucuauuugacguacucguugagaaguacggauggccccacgaagaugccgcacaguucacugacuuucugauuccuaugcuugagauggugccagaaaaacgggcgucugcuggcgagugcuugcgccaucccuggcugaacagcuga

SEQ ID NO: 63208 - RNA, 816 nt, Artificial Sequence
  derived and/or modified sequence opt3 from SRPRB__Homo_sapiens__NP_067026
auggccagcgcugacuccagaaggguggcagauggcgggggagccgguggcaccuuccagcccuaccuggacacacuccggcaagagcuucagcagacugauccuacgcuguugucugucguuguggcgguauuagcugugcugcuaacccucgucuuuuggaagcugauccgcucacgacguaguagccagagagccgugcuucugguuggguugugcgacuccggaaaaacacuccuguucgugaggcugcucacuggcuuauaucgggauacccaaacaucuauuaccgacucgugugcagucuaccgcgugaacaauaacagagguaauucacugacucuuauagauuugccagggcacgaaagccugaggcuacaguuucucgagcgguucaagaguuccgcccgcgcuaucguauuuguuguggacucugcagccuuccagcgagaagucaaagauguggcugaguuucuguaucaggugcuuauugacagcaugggacugaagaacacaccguccuucuugaucgccugcaauaaacaagauauugcgauggcaaagucagccaagcucauccagcagcagcuggaaaaagaguuaaacacccugagagucacgaggagugcugcccccagcacucucgacucuuccucaaccgcuccugcacaacuuggcaagaaaggcaaggaguuugaguucagccagcugccauugaaaguugaauuucuagaauguagugccaaagggggacggggugaugugggcucugcggacauacaggaccuggagaaguggcucgccaagaucgcauga

SEQ ID NO: 63209 - RNA, 1833 nt, Artificial Sequence
  derived and/or modified sequence opt3 from SRPR__Homo_sapiens__NP_001171313
augcuggacuucuuuaccaucuucagcaagggcgggcucgugcuuuggugcuuucagggagucuccgauucuuguacaggucccguuaacgcccugauuagaucaguguuguuacaaguaggcuuccagaaaauacugacucuaacguacguggacaagcucaucgaugacguccacaggcuguuucgggauaaauaucgcaccgagauucagcagcaaagugcucuuagccuguugaaugggacauucgacuuucagaacgauuuccuccgacugcugcgugaagcagaggaauccucuaagaucagagccccuacuaccaugaaaaaguuugaggacucggaaaaggcgaaaaagccagugaggucaaugauugagacacggggagagaaaccgaaggaaaaagcuaagaauagcaagaaaaagggcgccaaaaaggaggguagugaugggccccucgcaaccuccaaaccuguuccagccgaaaagucuggauuacccgugggcccugagaacggcgucgagcugagcaaagaggaacuuauccgcagaaagagggaagaguucauacagaagcaugggcggggaauggaaaaauccaauaagucaacuaaaagugacgcuccaaaggagaaagguaagaaggcaccccgcgugugggaguugggcgggugcgccaacaaagaaguacuggauuacagcacaccuaccacgaauggaacuccagaggcugcccuaucugaagacaucaaccucauucgaggcaccgguuccgggggacagcugcaagaucuugacuguucaagcagugacgaugagggcgcggcacaaaauucuacaaagccguccgccacuaaaggcacccugggagggauguuugguauguugaagggccucguugggagcaaaucgcugucuagagaagacauggaguccguguuagauaagaugagggaccaccugaucgcuaagaacgucgccgcagauauugcugugcagcucugcgagucaguggccaauaaacuugaaggaaaggucaugggcacauucaguaccguuacgagcacugugaaacaggcgcugcaggaguccuugguacagauccuacagccccaacggcguguggacaugcugcgcgauauaauggacgcccagagaaggcagcggccuuaugucgugacauuuugugguguuaacggggugggcaagucuaccaaucucgcaaaaauuagcuucuggcugcuugaaaacggauucucaguccugaucgcugccugcgauacuuuucgagcuggcgccguggagcaguugcgcacacauaccagaaggcucagugcacugcacccacccgaaaagcaugggggacggacgaugguacaauuauucgagaaggguuacggcaaagacgccgcugggauugcgauggaggcaaucgccuuugcucgcaaucagggauucgauguugugcuggucgacaccgccggcagaaugcaggacaacgcaccucuaaugacagcccucgcuaagcugaucacugugaacaccccagaucuugucuuguuugugggugaagcccugguugggaaugaggcaguggaccagcucguaaaauucaacagggcgcuggcugaucacuccauggcccaaacaccccgucuuauugacggcauaguccugacuaaguuugauaccaucgacgauaaagugggagcagccauuagcaugacauauaucaccucuaagccgauaguuuucgugggcacugggcagacguacugugacuugcggucacucaaugcuaaagccgucguggcagcucugaugaaggccuga

SEQ ID NO: 63210 - RNA, 1398 nt, Artificial Sequence
  derived and/or modified sequence opt3 from SRPX2__Homo_sapiens__XP_005262178
auggccagccagcugacccaaagaggcgcucucuuccuucuguuuuucuugacacccgcagugacuccuacgugguacgccggguccggauauuacccagacgagucuuauaacgaagucuacgcggaggaaguuccgcaggcucccgccuuagauuauagggugccucgguggugcuacacccugaauauccaggacggugaggcaacauguuauucaccaaagggcgggaacuaccacaguagccuaggaacucgcugcgaacucuccugugaucgaggcuuucgucugauugguagaaggucuguacagugccuucccucgcggcgcuggucagggaccgccuacuguagacaaaugaggugccaugcucugccuuucauaacaagcggaaccuauacuuguacaaauggcguguugcucgacagucggugcgauuacuccuguucuagcggcuaucaccuggagggggaccgcucccgaaucugcauggaggauggaagauggucagguggcgaaccagucuguguggacauugaucccccuaaaaucaggugcccacauagucgggagaagauggcagaaccggagaaacugaccgcccguguuuacugggaucccccucucgugaaggacagcgcugacgggacgauuacucgcgucaccuuaagaggaccagagcccggcucucacuuuccugaaggugagcaugugaucagguauacagccuacgaucgggcguauaaccgagcauccugcaaauucauaguaaagguucaggugcgcagauguccaacucugaagcccccgcagcacggguaccuuaccugcacaucagccggagacaauuacggcgcuaccugugaauaucacugcgacggcggguacgauaggcagggaacgccuagccgggucugucaaaguucucgccagugguccgguucgcccccaaucugcgccccuaugaaaauuaacgugaaugugaacagcgcagcuggcuugcuggaccaguuuuaugagaagcagagacuacucaucauuucugcccccgauccauccaauagguacuauaaaaugcaaaucucaaugcugcagcagaguacuugugggcuugaccugcgucaugucacaauaauugaauugguuggacaacccccucaggaggugggccggauccgagagcagcagcucagcgcgaacauuaucgaggaacugagacaauuccagagguuaacccgcuccuacuuuaauaugguacugaucgauaagcaggguauugaccgggauagauauauggaaccagugacuccggaggaaauauucacauuuaucgacgauuaccuccuuucuaaccaggagcugacccaaaggcgcgagcagcgagacauuugcgaauga

SEQ ID NO: 63211 - RNA, 1335 nt, Artificial Sequence
  derived and/or modified sequence opt3 from SRPX__Homo_sapiens__NP_001164221
augggcagccccgcccacagaccugcucugcuccuucuguugccaccguuacugcuacuccugcuucugagggugcccccuucccggucuuucccagacacccccuggugcucaccuaucaaggucaaauacggggauguuuauugucgcgcaccacagggagguuacuauaagacagccuugggcacucgaugcgacauucguugucaaaaaggguacgagcuccauggaaguagccugcugauaugccaguccaacaagagauggucugauaaagugaucuguaagcagaagaggugccccacgcucgcgaugccugcuaauggcgguuuuaaauguguagacggggccuauuucaacucgcggugcgaauacuauuguucaccaggauacaccuuaaagggcgagcgcacagugacuugcauggauaauaaagcauggagcggcagaccggccaguugugucgacauggaacccccuaggauuaagugcccauccgugaaagagcggaucgcugaacccaacaagcugaccguucgcgugucuugggagacaccugaggggcgagauaccgcagacgguauucuuacugaugucaucuugaagggacugccacccggcagcaauuuuccggaaggggaccacaaaauacaguacacaguguaugauagagccgagaacaagggaaccugcaaauucaggguaaagguucgggugaaacguuguggcaagcuaaaugcuccugaaaacgguuacaugaaaugcuccucagacggggauaauuauggagccacgugugaguuuaguugcaucggcggcuacgagcuccaagggagccccgcgcgcgucugucagucuaaccuggcaugguccggaacugaaccaaccugcgccgcuaugaaugugaacgugggugucagaacagccgcagcucuacuggaccaguucuaugagaagaggcgguugcucauuguuucaacuccuaccgcccgaaaucuguuauaccgccugcagcucggcaugcuucaacaggcgcagugugggcuggacuugagacauaucacagugguagaacuugugggagucuuucccacccugauuggcaggaucggugccaagauaaugccacccgcacucgcucugcagcuucggcuguugcuccgcauuccucuguauagcuucaguaugguguuaguugauaaacacgggauggacaaggagagauacgugucucuggucaugccaguggcccuauuuaaccucaucgauacguucccgcugaggaaagaagagaugguacuucaagcugagaugucccagacuugcaauacauga

SEQ ID NO: 63212 - RNA, 1023 nt, Artificial Sequence
  derived and/or modified sequence opt3 from SRR__Homo_sapiens__XP_011522276
augugcgcccaguacuguaucagcuucgcugacguggagaaggcacacauuaacauaagagauuccauccaucugacccccguccucacaucuucaauucuuaaucaacugacuggcaggaacuuguuuuucaaaugcgaauuauuucagaagacggggaguuucaaaauccggggagcccugaaugcgguucgcagccuagugccugacgcucucgagcgaaagccaaaagccguagugacccacuccucugguaaccauggccaggcacugacauaugccgcuaaacuugaagggauuccggcauacaucgucgugccccagacugccccugauuguaagaagcuggcuauacaagccuauggagcgucgaucguuuacugcgagccaucagacgaaagccgugagaauguggcaaagagagucaccgaggaaacagagggcauuauggugcaccccaaccaggaaccugccguaaucgcuggucaggggaccauugccuuggagguucucaaucaggugccacuggucgaugcacugguggugcccgucggaggcggcgggaugcucgcuggaaucgccauaacuguuaaagcguuaaagccuagugugaaaguauaugccgcagagccauccaacgcugacgauuguuaccaaucuaagcugaaggguaaacuuaugccgaauuuguaucccccugaaacaauugccgacggcgucaagagcuccaucgggcugaacaccuggccaauuaucagggaucuaguggacgauaucuuuacggugacugaggacgaaauuaaaugcgcuacccagcucguuugggagcggaugaagcugcuuauagaacccacagccggagugggcgucgcagccgugcugucacagcauuuccagacuguaaguccugagguuaaaaauaucuguauuguguugagcggugggaacgucgaucucaccucuuccaucacaugggugaagcaagcugagcgcccagcgucauaccagagcgucaguguguga

SEQ ID NO: 63213 - RNA, 2751 nt, Artificial Sequence
  derived and/or modified sequence opt3 from SRRM1__Homo_sapiens__NP_001290377
auggacgccggcuucuuuagagggaccagcgcugagcaggauaacagguucuccaauaagcagaaaaagcugcucaaacaacuuaaguuugcagaaugccuggagaaaaagguggacaugucuaaggucaacuuggaaguuaucaaacccuggauuacaaagcgggugacugagauauuaggauucgaagaugacguagugaucgaguuuauuuucaaucagcuggaggucaaaaacccugauucaaagaugaugcagaucaaucuaacggguuuucucaacggcaaaaaugcccgcgaguucaugggggaacuguggccacuucuguugagugcgcaagaaaacauugcuggaaucccgagcgccuuucucgagcugaagaaggaggaaauaaaacagcgacagaucgagcaggaaaagcuggcauccaugaaaaagcaagacgaggauaaagacaagcgugauaaagaagagaaggagucuucgagagaaaagagggagcggucacgcagccccagaaggcggaaaagucgcuccccuucuccacgaagaaggagcucccccgugcggcgugaacgcaagagaucacacaguaggagcccucggcaucgaaccaaaucucgcuccccaucacccgccccugagaagaaagaaaagacaccagagcucccggagcccagcguuaaggugaaagaaccuaguguccaggaggcuacuucuaccuccgacauuuuaaaggugccaaaacccgaaccuaucccagagcccaaggaaccgagcccugagaaaaauucgaagaaggagaaagaaaaggagaaaacaagacccaggucucggucccgcucaaagaguagaagcaggacccguucccggucuccaagccacacucgaccuagaaggcgccaucggucaagaaguagguccuacagcccccgccgacggccaucuccccguagaaggccuucaccacgccggagaacaccgcccaggcgaaugccuccacccccucgccaccggagaaguaggagcccaguacgucgccggagaagguccucugcaucgcugagcggcuccucaaguucuagcuccucaagccgaucucggagucccccgaaaaagccuccaaagcgcaccuccagcccucccagaaaaacgaggcggcuuucucccuccgccucaccaccucgaagacgccauaggcccaguccaccggcuacuccucccccaaagacccgucacagccccacaccucagcagucgaaccggacuagaaaauccaggguuucugugagcccaggucgcaccucagucacaaagcacaaagggaccgaaaagcgagagagucccuccccugccccgaaaccaagaaagguggaguugucugaaagcgaggaagauaagggaggcaaaauggcggcagccgacuccgugcaacagcggaggcaguaucgccgucaaaaucagcagucaagcagugauucuggcuccagcucgucaucugaggacgaaagacccaagcggagucaugucaaaaacggggagguuggaaggcgccgaagacacuccccuagccggucugcuagcccaucccccaggaagcgccagaaagagacgucaccuagaaugcaaauggguaagagguggcagaguccggugacuaagagcggccggcgucgccgaucucccuccccaccucccacaagaaggcggcgcucaccaaguccugcacccccaccgagaaggcggcgaaccccuacucccccacccagacgcaggacaccuagcccacccccucggcguagauccccgucuccaaggcgcuacucgcccccuauucagcggcgauauagccccucaccaccucccaaaagaaggaccgccuccccaccuccgcccccaaagcgccgggcuaguccuucucccccaccuaaaagacguguaagccauucacccccgccaaagcagagguccucuccugugacgaaacggcgcagccccagucuguccagcaagcaccgaaaggggucuucaccauccagaaguaccagggaagcccggagcccccaaccuaauaaacgccacucgccgucucccagaccaagggcgccucagacauccagcucacccccuccaguccgacggggagccaguucuagcccccagcguagacaguccccuucaccaaguacucgccccaucaggcgggugagcagaaccccggagccuaagaaaauaaagaaagcagcuuccccaucuccccaaagcguucgcaggguguccucaucucgaagugucucgggcagcccugaaccagccgcuaagaagcccccggccccucccuccccagugcagucucagucaccuagcacaaacuggucccccgcaguaccaguuaaaaaggccaaaagucccacuccuucuccaagcccgcccagaaauucagaccaggagggugggggaaagaaaaagaaaaagaagaaagauaagaaacauaagaaagacaagaagcacaaaaagcauaaaaagcacaaaaaggaaaaggcuguggcggcagccgcugccgcagccgucaccccugcugccauugcagcggcuacaaccacucuagcccaagaggagccaguggcagcccccgaaccuaaaaaggagacggaauccgaggcugaagauaaccucgacgaucuggagaaacaucuucgggagaaggcccugaggaguaugcgcaaagcacaggucagcccacagucuuga

SEQ ID NO: 63214 - RNA, 8259 nt, Artificial Sequence
  derived and/or modified sequence opt3 from SRRM2__Homo_sapiens__NP_057417
auguacaacggcaucgggcugcccaccccuagaggaagcgguacaaauggcuaugugcagaggaaccucucccuuguccgggggcgccgaggagagcguccagacuacaagggcgaagaggaacugagaagguuggaggccgcuuuaguuaaacggccgaaucccgauauucuggaccacgaacgcaagagaaggguggagcuacggugccucgagcuggaagagaugauggaagagcaagguuaugaggaacagcagauacaggagaaaguagcaacuuuccgccuuaugcuguuggaaaaggaugugaacccugggggaaaagaggaaacgccaggccaacgacccgccgucaccgagacacaucagcucgcggagcugaaugaaaagaagaacgagagacugagggcugccuuuggcaucucugacucauacguggaugggaguagcuucgacccucagcggcgugcacgcgaagccaaacagccagcucccgagccuccaaagccguauucccucguuagagaaucuucgucaagcaggagucccacuccuaaacaaaagaaaaagaagaaaaagaaagaucggggacgacgcuccgagucuagcuccccaagaagggagcggaagaaaucaaguaagaaaaagaagcaccgcagcgaaucugaguccaaaaagagaaaacauaggucacccaccccuaagagcaaacguaagaguaaggacaaaaagcggaaacgaucuagauccacaaccccagcacccaagagcaggcgcgcccaccggucgacuucugcugauuccgccucaaguagcgacacauccagaucuaggagccgcucagcggcagccaaaacccauacgacugcuuuagccggucgaaguccguccccugcaagcggccggcguggggaaggagaugcucccuuuucugagccaggcaccacaucaacucagagaccuaguagccccgaaaccgccacaaagcagccauccucucccuacgaggacaaggauaaagacaagaaagagaagucggcgaccaggccuagcccauccccggaacgcucaaguacgggucccgagccuccagcccccacuccucugcuugcagaacggcacgggggaucuccacagcccuuggcuacaaccccgcugagccaagagccugugaauccacccuccgaggccucaccuacuagagacaggagccccccaaaaucuccugaaaagcuaccccaguccaguagcucugaguccucaccaccgaguccucagcccacaaaggucagccgacacgcuucguccucuccagaaagccccaaaccugccccagcacccggcucacaucgcgagauuaguuccucuccuaccagcaagaaccggucccacggcagagccaaaagggauaagucacauagccacacgccgagucgucgcauggggcggucuagauccccagcuaccgcgaaaaggggacgaagccggucgcgcacacccacuaagagaggucacucaaggucucggaguccucaauggcgaagaucccgcagcgcacagagguggggccguucucggagcccacagagaagggggcgcucccgaucaccccagagaccuggauggagucggagcaggaauacccaacgccguggcagaucucgguccgccaggcgcggucgaucacauaguagaagcccggcuacacgggggaggucccgcucuagaacucccgccaggcggggccguucgcgcagccgaaccccagcaagaaggcggucacgcuccagaacaccuaccaggcggcgaaguagaucucgcacucccgccaggcggggacguagcagauccaggacgccagcucgccggcgaucaagaacaaggucuccugugcgccggagaagccguaguaggucccccgcccggcgcagcggccgaucuagaucaaggaccccagcacggcgcgggagauccaggagucgaacuccggcgcggcguggaagaagccgcucgaggaccccugcucggagaucuggucgcuccaggagccgaacacccgcccggagaggcaggucacgcagucguaccccacggagagggaggucucgcucccgaagccucguacggagaggaaggucacacagucgcacuccccagagacggggcaggagcgguuccucuagcgaacguaaaaacaagucccgaacaucacagcgcagaucucggaguaauucgagcccugagaugaagaaauccaggaucucuucacgcagaagccggucccugaguucuccaaggagcaaggcaaaaucacgacuuucccugcguagaaguuugagcgggucuucccccuguccuaagcagaaaucacaaacgccgccacgccggagcaggucgggcucuagucagcccaaggccaaguccagaaccccuccccgccggagcaggucauccucuagcccaccucccaaacagaagaguaaaacuccaucccgacagagccauucuucaaguuccccucacccgaagguuaaaagcggaacacccccaagacaaggcucuauuaccucgccucaggcuaacgagcagucagugacaccccagcggaggagcugcuucgaauccaguccagacccugagcucaagucucgcacucccagccgucauuccuguucagggaguucuccgccaagagucaagagcuccaccccuccccgacaaucaccaagcaggucuuccaguccccagccuaaagugaaggccaucauaagcccgcggcagcgcucgcacuccggaucuucaagccccaguccauccagagugacgucuaggaccacaccucggcgcagcagaucagucucccccugcaguaauguugaaagccgacuguuaccuagguauucucacucagguuccagcucuccagauacuaaagugaagcccgagaccccuccacggcaaagucauucgggcuccaucagccccuacccgaaaguaaaggcacagacaccuccagggcccucacugucuggaagcaaguccccuuguccacaggaaaaaaguaaggacucacucgugcagucuugccccggcagccuuucccugugugcuggugucaaaaguagcacuccgccuggggaguccuacuuuggcgugucuucauugcaacuaaagggacagagccagaccucgcccgaucaccguuccgacacgaguucuccagagguucgccagagccauucagaauccccuucucugcaaaguaaaagccagacaucccccaagggcgggagaucaaggagcucuaguccagugaccgagcucgccucccggagccccauuagacaggaucgcggagaauucucagcgucuccuaugcugaaauccggcaugucgccagagcagagccgauuucaaagugacucuuccagcuauccgacugucgauucaaacagucuucugggucaguccagguuggaaacagccgagagcaaggagaagauggcucuccccccucaggaagacgcaaccgccucuccaccccggcaaaaagauaaguucucaccuuuuccagugcaggacagacccgagagcucccugguauucaaagacacuuuacguaccccuccgcgcgaaaggucuggggcuggaaguucgccagagacaaaggagcagaauagcgcccugcccacguccucacaggaugaagagcuaauggaaguuguggagaaaucugaagagccugcaggccaaauccucagccaccugaguuccgagcuuaaggaaaugucaaccucuaacuuugagagcucccccgaagucgaggaacggccagcggugaguuugacucuggaccagagccagucucaggccucacucgaggcugucgaggugccuuccauggccagcaguugggguggcccccacuucucuccagaacauaaggagcuguccaacucgccgcuuagagaaaauagcuuugggucaccucuggaguuccgaaacuccggacccuugggcacagaaaugaauaccggguucucuagugagguuaaagaggaucucaacggaccauuucugaaucaauuagaaacagaccccagccuggauaugaaggagcagucaacuagguccagcggccacucuaguuccgaacuaagcccugacgcaguggagaaagcugguaugucaucuaaccagucgauuagcuccccaguacucgaugccgucccccgcaccccuagucgggagagaucuucaagcgcauccaguccggaaaugaaggacgggcugccaaggacgcccucucgccguagccgguccggaucaagcccuggccuuagagaugguucuggcacaccaucccgacauaguuugucagggagcucgcccggaaugaaagacaucccuaggacccccucccgcggccggucugagugcgauaguagcccagaaccgaaggcccugccucagacucccagaccaaggucacgcuccccuucuagccccgagcucaauaacaagugucugaccccacaaagagaacggaguggguccgagagcucuguggaccagaaaacaguugcucgaacuccuuuaggacagaggucacguuccggcagcagucaggagcuggaugugaagcccucugcgucaccgcaagaaagauccgagagcgacucgucuccagacaguaaagccaagacccggacaccucuucgccagaggucccgaagcgguucaucucccgaagucgauagcaaauccagauugaguccacggcgcucaaggagcggguccucucccgaggugaaggacaagccuagagcagcuccgcgggcccagaguggaagcgauuccucaccagaacccaaagccccugcuccccgugcacucccacgcaggucucgaucgggcagcuccaguaaggguagaggcccuucucccgaggggagcucauccacggagagcucuccagaacacccuccgaaaagucggaccgccaggcgcggauccagaucaagccccgagccaaagacuaaaucucggacaccucccaggcgccgaucguccagaaguagcccagaacugacccguaaggcgcggcuaucaaggcgcucuagauccgcuagcaguucaccugagacucgguccaggacacccccgcgacauagacgcagcccaucuguaaguagcccugaacccgccgagaagucccggucuucaaggcguagacgcagcgcauccucgccaaggaccaaaacgacuucucggcgaggcagaagucccagcccuaagccccgcgggcugcaaaggucacgguccagaucucgucgcgagaaaaccaggacaacccggcgaagagacaggagcggauccagucagucaacuagccgccggagacagcgaucuaggucccggagucgcgugacaagacguaggcggggcgguagcggguaccacucaagaucuccagcccgccaggaauccucgaggaccagcagucgacggagacgcggaaggucccguacaccuccgacuucuagaaagcggucacgcagcaggaccucccccgcuccauggaaacgaucuagaagccgggcaaguccugccacgcaccgcaggucaagaucccggacaccccucauaagccgucgaaggucucgcaguagaaccuccccaguuagccggaggcgcucaagaucgcggacuucugucacccgaaggagaagccgcucccgugcgaguccugugucacggaggagaucucgcagccggacacccccggugacucgaaggagaucccgcagucggaccccuacgacaaggcguagaagccgaucucgcaccccacccgucacucggaggagaucccggucacgcacaccuccaguuaccaggagacgaagccguucgcggacuucccccauuacaaggcgcagaucuaggagucggaccucaccugugacgagacgccgaagcaggucccggacuucuccagugaccagacgccguagcaggagucggacaucacccguaaccagacgacgcuccaggagccggacaccgccugcuaucagacgcaggucucguuccagaacuccccugcuuccacggaagcgaagucgcagcaggucacccuuggccauuagacggaggucucgcuccagaaccccucggacggcacgaggcaaacguagccugacaaggucgccacccgccauccgcagacggagugcuucuggcucauccagcgauaggucuagaagcgccacuccuccagcaacccgaaaucauuccgggagucgcacaccgcccgucgcuuuaaacucaagccggauguccugcuucucuaggccuaguaugucaccaaccccccucgacagaugucgcagcccuggaaugcuggagccacuugguuccucucggacucccaugucggugcugcaacaggccggcgggagcaugauggauggaccgggcccucguaucccagaccaccagaggaccuccguucccgaaaaucaugcgcagaguagaauugccuuggcacucacagcuauaucacuggguacggcccgaccucccccaucuaugagcgcugcagggcuagccgcccggaugucccaagugccggcuccugucccccugaugagucuccgcacugcgccagcagccaaccuggcuucuaggauccccgccgcaagcgccgcugcgaugaaucuugccucagcaagaaccccugcuauuccaacagccgugaacuuggcagauucccggacccccgccgcugccgcggcaaugaaucuggccagcccucgcacugcuguugccccaucugcugugaacuuagcagacccgaggacacccaccgccccugcuguaaaccucgccggagcacgaacgccagcggcccuggcugcccuuucacugacuggcaguggcacacccccuaccgcagcuaauuauccauccagcucgagaaccccccaggccccugcaucugccaaccuagucgggccgcguuccgcucacgcgacugcccccgugaauaucgcaggaagccggacagcugccgcccucgcaccagcuucacugaccagugcccgcauggcgccugcuuugucuggugccaaccugacaucccccagggugccauuaagcgcauacgagagagucucaggccggacuaguccuccccuccuggaucgagccaggucccgcacgccaccgagcgcuccuucucagucgagaaugaccagcgagcgggcacccuccccaucaucucguauggggcaggcccccagucaaagccuucugccuccagcgcaggaccagcccagguccccuguuccgucugcuuuuucagaucaaagcagaugcuugauagcccagacaacucccguggcaggaagucagucccucucuagcggcgccguagcuaccacaaccuccucagccggugaccauaaugggaugcugagugugccagcaccuggagucccccacagcgacgugggcgaaccaccugcuucuacuggcgcccagcaacccuccgcgcuagccgcacugcagccagcuaaggagcgccggucgagcucaaguuccucuagcucauccucuagcaguuccagcucuucaaguuccagcucuucgucaagcuccagugggucuagcuccucagauagugaaggaagcucucuuccgguucagccugagguggcccucaagcgaguccccuccccaacgccugcacccaaagaagcugugagggaggguagaccaccugagcccaccccggccaagcgcaaacggaggagcucaucuuccaguagcucguccucuucaagcaguuccucuagcucaaguuccagcucuuccucaagcaguucuucguccagcucaucuaguagcuccucaagcuccucuaguagcuccucuucaccaucgcccgccaagccuggcccacaggcgcugcccaaaccugcuagcccgaagaagcccccaccuggggaaagacgcagucguuccccccgaaaaccaauugacucuuugcgggauagcaggucacuguccuauaguccuguugagagacgcaggcccucuccacaaccuagcccccgggaccagcaguccucaagcucugaaagaggaagucgacgcggccagaggggugauucccggagcccgucgcacaagagacgucgcgagacaccuucuccaaggcccaugagacaucggucaucccgaagcccuuga

SEQ ID NO: 63215 - RNA, 1836 nt, Artificial Sequence
  derived and/or modified sequence opt3 from SRRM4__Homo_sapiens__NP_919262
auggccagcgugcagcaaggcgagaagcagcuguucgaaaaauuuuggagagggaccuucaaggcugucgcaacacccaggccugaguccaucauuguugccucuauaacugcgcggaaaccacucccgcgcacggaaccccagaacaauccugugguaccagcucaggacggacccucagagaaacuuggucaacaccuggccaccgaaccuuugggcacaaacaguugggagcgagauaaaacuugccgugaguuaggggcaaccagaggacauagcgccucccacgacaaggaucugacaccacccccuucuucgaggggcaagaaaaagaaaaagaaaucaacccggaagaagcgcagaaggagcaguuccuacucuccaagcccggugaaaaagaaaaagaaaaaguccucaaagaagcauaagcggcgccgaaguuuuagcaaaaagagaaggcacucuuccucaagccccaaaaguaagcggcgugacgaaaaacgccauaagaagcagucuagauccaggccucggaaaagccaccgacaccgccaucacagauguccaucgaggucucaguccucagagagucggcccagcuccugcgaaucucgccauagagguaggagcccugaggaggggcagaagucacgucggcgacacaguagaagguguuccaaaacucuaugcaaggauagcccagaagcucaaucuucacggcccccgagucagccucuccagaugcugggauaucuuagcgcacgcggcgucaucacaggcuccgggucugccgcugaccuguucaccaaaacggccucgcccuugacuaccagcagaggaaggucccaggaguacgauucagguaaugacacaaguucuccaccuagcacucaaaccuccucagcgcgcagccgaggccaggaaaaggggucucccuccggaggccucaguaagagccgggagcugaacucugguaauacauccgauucagggaacaguuuuaccacgagcucgccacagaauaaaggagcaaugcuggaaaaccucucccccacuucucguggcagagagagcaggggcuuccaaucaccuuguuuagagugcgccgaagugaagaaaaguucccugguuccaucuacagcucgcagcuccccgaugaagggguguucacggagcaguucuuaugccuccaccagaagcucgucacacucuaguaggucccccaauccucgagcaagcccacgcuacacucagucucggagcacauccucagagaaaagaaguuauagcaggucucccuccuacucaaguaagagcggaaagcguuccccuccaucucgcucgagccggucaagaaggucccccaguuauucucgauacagcccgucccgggaacgcgacccuaaauacucagagaaggauucucagcagagagaaagggagcgggcucgaagacgcaggcguagcuauaguccaaugcggaaaagaaggcgcgacucccccagccaucuugaggcccgaagaauuaccucugcgcggaagaggccuauccccuacuaucgcccaucaccuuccaguagcgguucguugucuuccacgagcucaugguacaguucuuccagcucacguagugccagcagauccuauucucggagcaggucccgcucacgaucuagacggaggagucgcaccagaacaucgagcuccucuucaagcaggucccccaguccaggcucucggagccguucacgcucccgaaguagaagcaggucucggucccgcucacaaagcagaucguacucuagugcagauuccuauagcucaacuaggcgguga

SEQ ID NO: 63216 - RNA, 2652 nt, Artificial Sequence
  derived and/or modified sequence opt3 from SRRT__Homo_sapiens__XP_005250462
auggcccccagcgacagagcuaugggcgauuccgacgaugaguacgacaggcggcgccgagauaaguuccguagagaaaggucugacuaugaucggucacgcgagagagacgaaaggcggcgcggggaugacuggaacgaucgagagugggacagaggaagggaacggcguagucgcggugaguacagagauuaugacaggaaucggcgagagcgcuuuagcccuccaagacacgaacuguccccgccccagaaaaggaugcggcgcgacugggaugagcauucuucggacccuuaccacucaggcuaugaaaugccauacgcagggggaggcggugggcccaccuauggaccuccacaacccuggggccauccugaugugcacaucaugcagcaucacguccucccaauucaggccagacuuggcagcauagcggagaucgaccuggggguuccgcccccugugaugaagacauucaaagaguuuuuguuaagucuggaugacuccguagaugaaacugaggcugugaagagguacaacgacuacaaacuagauuuccgucggcagcaaaugcaggacuuuuuccucgcccacaaggaugaagagugguuucgaucuaaguaucauccagacgaagucggaaaaagaaggcaggaggcacgcggugcccugcagaaucggcuuagaguguuccugagcuugauggagacgggcugguuugacaaccuccugcuggauauugacaaggcugaugcaaucguuaaaaugcucgacgccgcugugauuaagauggaagggggaaccgagaaugauuuaaggauccuggaacaagaggaagaggaggaacaggccggcaaacccggugagccuuccaagaaggaagaggggcgcgcgggagcaggccuuggcgacggggaacgaaaaacaaacgauaaggacgagaaaaaggaggauggaaaacaggccgaaaaugacucaaguaacgaugacaagacuaaaaagagcgagggugauggcgacaaggaagagaaaaaggaggacucugaaaaagaggcuaagaaauccucaaagaagcggaaucguaaacacagcggggaugacaguuucgaugaaggaucugucuccgagagcgaaucggagucugaguccggccaggccgaagaggaaaaggaggaagcagaggaggcuuugaaagaaaaggagaaaccaaaggaagaggaaugggagaagcccaaagacgccgcgggucuggagugcaagccgagaccucuacauaaaaccuguucacucuuuaugaggaacauagcccccaauaucagucgcgcagaaauuaucagccugugcaagcgguacccaggguucaugagaguggcucuuuccgagccucaacccgaaaggcgauuuuuccgccggggcuggguaacauucgauagaucuguuaacauuaaagagaucuguuggaaucugcagaacauaagguugcgugagugcgaacucagcccaggagugaaucgcgaccugacccggagagucaggaacauuaacggcaucacucagcacaagcaaauugugcgaaaugauaucaaguuagccgcuaaacugauccacacacucgacgaucggacccagcuuugggccucagagcccgggacgccuccacugccgaccaguuugcccucccagaacccuauucuaaagaauauaaccgacuaucugaucgaagaggugagcgcagaagaggaggaacuccugggaucuucagguggcgccccacccgaggaaccuccaaaagaggggaaccccgcugaaauuaaugucgagcgcgaugagaaacuuaucaaaguucuggacaaguugcuccuguacuuaagaauagugcauagucuggauuauuacaacacaugugaauauccgaaugaggacgaaaugccuaacaggugcggaauuauccacguacggggcccaaugcccccuaaucgaaucagccauggugaggugcuagaauggcagaaaacuuuugaggagaagcucacuccccugcuuuccgucagagaaucuuugucggaggaagaggcgcaaaagauggggcgcaaagacccagagcaggaaguggagaaguucguuacaagcaacacccaggaacugggcaaagauaaguggcucuguccucuguccggcaaaaaguuuaagggccccgaguucgugaggaaacacauuuuuaauaagcaugcagaaaagaucgaggaggucaagaaagaaguggccuucuuuaacaauuuccuuacggacgcuaagcguccagcccugccggagauuaagccugcacagcccccagggcccgcccaaauauugccuccaggacucacucccggucugccuuacccgcaccagacaccacagggcuuaaugcccuacgggcagccucggccacccauccugggauauggcgcuggugccguaagaccugcaguuccgaccgggggacccccauacccucacgcgcccuauggagcuggcagggggaacuacgaugccuuucgcggacaaggcgguuauccagggaaaccucgaaauagaauggugcggggagaccccagggcaauugucgaauaccgcgaucuagacgccccagaugacguggauuucuuuuga

SEQ ID NO: 63217 - RNA, 519 nt, Artificial Sequence
  derived and/or modified sequence opt3 from SRSF10__Homo_sapiens__NP_001287865
augagcagauaccugaggcccccuaacaccucccucuucgugcggaaugucgccgacgauacacgcucugaggaccuucgacgugaauuuggcagauaugggccaaucguugauguguacguaccgcuggacuucuauacuaggcggccccgcggauuugcuuacgugcaguucgaggaugucagagacgcagaagaugccuugcacaacuuagacaggaaguggauuugcggucggcaaauagagauccaguuugcgcagggcgaucgcaaaacgccuaaucagaugaaggcuaaagaagggcgaaacguguauucaaguagcagauacgacgauuaugacagguaccggcguucccgcucuagaucguacgagaggcggcgaucacgcagcagaaguuucgauuauaauuacaggcgguccuauucuccacgcaacagacccaccggaaggccucgucggagccgaucccauucagacaaugacagucaaguuagcaagaaaaagaacgagagauga

SEQ ID NO: 63218 - RNA, 1455 nt, Artificial Sequence
  derived and/or modified sequence opt3 from SRSF11__Homo_sapiens__XP_011540729
augagcaacaccacagugguccccuccacugccggcccugggccaucuggagguccgggcgggggaggcggugggggaggcggcgggggagguacggagguuauccaggugaccaauguaucacccagugcuagcuccgaacaaaugagaacacuguucggcuuucucgggaagauugacgagcuuaggcuguucccuccagaugacucucccuugccugugucgucacgggucugcuuugugaaauuccacgauccagacagcgcaguuguggcccagcauuuaacuaacaccgucuuuguggaucgcgcgcugauaguaguucccuacgcugaaggagugaucccugacgaggccaaggcacuaagucuccuggccccagcuaaugcagucgccggccuucugccgggugggggauugcuccccacaccuaacccacugacccagauuggcgcugugccccuggccgcgcucggcgcaccuacuuuagauccagcccuggcugcccuuggguugcccggagcaaaucugaacucccagucucuagcugccgaccaacuccugaaacuuaugagcacaguggauccgaagcugaaucacgucgcggccgguuugguuuccccuucacucaaaagugacaccagcucuaaggaaaucgaggaggcaaugaagcgagugcgugaagcucagucccugauuucagccgcuaucgagcccgauaaaaaggaagagaaaagaaggcauagccggagucgcucuagauccaggcggcgccgaacgccaagcucgucuagacacaggcggucccguucacgcaguagaaggcggagccauuccaagucucgaagccgcagaaggucaaaaaguccucggcgcagaaggucccacagccgugagcggggccgaagaucuaggucaaccaguaagacucgcgacaagaaaaaggaagauaaagagaagaaacggagcaagacacccccaaaauccuauucuacugccagaaggucgcgcagcgcaucccgagaacggcguagaaggcgcucacggagugggaccagaucucccaagaagccuaggagcccaaaacgaaaguuaucccgcucaccgagcccccggagacacaaaaaggagaaaaagaaggacaaagacaaggaaaggucucgugaugagcgcgagcgguccacaaguaaaaagaaaaagagcaaggacaaagaaaaggauagagagaggaaaucugaauccgacaaggauguaaaacaggugacccgagacuacgaugaggaggaacagggauaugacucagagaaggaaaagaaagaggaaaagaaaccuauagagacgggcaguccaaagacuaaagaauguagcgucgagaaggguacaggggauucgcugcgggaguccaaagugaacggcgacgaucaucacgaagaggacauggacaugucugauuga

SEQ ID NO: 63219 - RNA, 786 nt, Artificial Sequence
  derived and/or modified sequence opt3 from SRSF12__Homo_sapiens__NP_542781
augagcagauacaccaggcccccuaacacaucccuguucauccggaauguggccgacgcuacucgcccagaggaucuccgacgugaauuuggcagauaugggccgauugucgacguuuacauaccccuugauuucuauacgaggcggccucgcggauuugcauacgugcaguucgaggacguaagagaugccgaagacgcgcuguauaacuugaauaggaagugggugugcggucggcaaaucgagauucaguuugcucagggcgaucgcaaaaccccagggcagaugaagucuaaagaacgacaccccuguucaccuagugaccauagaaggagccgguccccaucucaacgucgcacaagaucgaggucaagcaguuggggacggaaccgacgcagauccgauucuuuaaaggagagcaggcaccggcgcuucuccuacucacagaguaaaagcagaucuaagucccugcccaggcguucaacuagcgcccggcagagucgaaccccuagaaggaauuuuggcucucgcggucgguccagaagcaagucgcuacagaaaaggucuaaguccaucgggaaaucacaaaguagcuccccacagaagcagacaucuagcggaaccaaaucacgcagucauggccgacacuccgacagcauugcacggucuccgugcaagucacccaagggcuauacuaacagugagacaaaaguccagaccgccaagcauagccacuuccguucccacucuagaucgaggagcuaccgccauaaaaauuccugguga

SEQ ID NO: 63220 - RNA, 606 nt, Artificial Sequence
  derived and/or modified sequence opt3 from SRSF1__Homo_sapiens__NP_001071634
augagcggcgggggagugaucagaggucccgccggcaacaaugacugcaggauuuacgucgggaaccugccuccagauauacggaccaaggacaucgaggauguuuucuauaaauacggagcuauucgcgacaucgaucucaagaaucgacguggcgguccgcccuuugcauucguggaauuugaggacccuagagaugccgaagacgcgguauaugggagggauggauacgacuaugauggcuaccggcuucgcguggaguucccaagauccggcagggggacaggacgggguggcgggggaggcggugggggaggcgcuccccgcggccgauaugggccuccaucuagaaggucagaaaaccgggucgugguuaguggacugcccccuagcgguuccuggcaggacuugaaagaucacaugcgugaggccggcgacguguguuacgcagacgucuaccgcgaugggacuggagugguagaguuuguuagaaaggaagacaugacguaugccgugaggaaauuagauaauaccaaguuccggucucaugaggucggcuacacacgaauccuguuuuucgaccaaaacuggauucaguggucguga

SEQ ID NO: 63221 - RNA, 666 nt, Artificial Sequence
  derived and/or modified sequence opt3 from SRSF2__Homo_sapiens__NP_001182356
augagcuacggcagacccccuccagacguggaggggaugaccucccugaaggucgauaaccucacauauaggacuucuccggacacgcuucggcgcguuuucgaaaaauacggacgagugggugauguauauaucccccgugacagauacaccaaggagucaaggggcuuugccuucgugcgguuucacgauaaacgcgacgcugaagaugcaauggacgccauggauggggcgguccuggacggaagagaguugagggugcagauggcucgguauggccgcccuccagauagucaucacagccgaagaggucccccuccaaggcgguacgggggaggcggcuaugggcgucgcuccagaucucccaggcggcgacgcagaucgaggucacggagccgcaguagauccaggucucguagccggucccgauacucaagaaguaagagcaggucucgcacacgguccagaucaaggagcacuuccaaaucucgcuccgcccgacggagcaagucgaagucuuccucaguuagucguagcagauccaggucucgcagccggucaagaaguagguccccuccaccggugagcaaacgagaaucuaagucacgcagucggagcaaaagucccccuaagucuccagaggaggaaggagcagucucgagcuga

SEQ ID NO: 63222 - RNA, 495 nt, Artificial Sequence
  derived and/or modified sequence opt3 from SRSF3__Homo_sapiens__NP_003008
augcacagagacagcugcccccuggauuguaagguguacgucggcaaccucgggaauaacggaaauaaaaccgagcuugaaagggccuucgguuauuacggcccucugcgguccguuuggguggcucgcaacccaccgggguuugcauucguagaguuugaagacccccgagaugccgcggacgcugugcgugaguuggauggaagaacauuaugcggcuguaggguccggguggaacugucuaauggugagaagcgcucaagaaacagggggccuccacccaguuggggacggcgcccucgagacgauuauagaaggcggagcccacccccucgucgcagauccccaaggcggcgaucuuucucgcgcucaagaagcaggagucuaucccgggaccgcagaagggagcguucucucagccgggaacgaaaucauaaaccguccagaucauuuaguaggagccgcucucgguccagaucaaacgagaggaaguga

SEQ ID NO: 63223 - RNA, 1395 nt, Artificial Sequence
  derived and/or modified sequence opt3 from SRSF4__Homo_sapiens__XP_011540253
augcccagaguguacaucggcaggcugagcuaucaggcccgggagcgcgacgucgaacgauucuuuaagggguacggaaaaauucucgagguugaucuuaagaacgguuauggcuucguggaauuugacgaucugcgugacgcugaugacgcaguauacgaguugaaugggaaagauuuaugcggagaaagagugauagucgagcacgccaggggcccucggcgcgacgguuccuaugggucuggaagaucaggcuacggcuauaggcggagugggcgcgauaaguacggaccaccgacccgaacagaguacagacugaucguggaaaaccuaagcuccagguguucuuggcaagaccucaaagauuauaugcggcaggcgggugagguuacuuacgcugacgcccauaagggccguaagaaugaaggggugauugaguucgucucguauucagauaugaaacgcgcacuggagaaacuugacggaacggaagugaacggcagaaaaaucaggcugguagaggacaagcccgguagccggcgacgcagaaguuacuccaggucucggagccacucccgcucagggaguagaagcaggucuaaaucccguucacggagccagagucgaucuagauccaagaaggaaaagagcaggucgccuucuaaggagaaaucccgcucacggagucauagcgccggaaaguccagaucuaaaagcaaggaucaggcugaagagaaaauucaaaauaacgacaauguuggcaagccaaagucaaggagucccucccgccacaaaagcaagucuaaaucacgaagucggagccaggagcguagaguggaagaggaaaagaggggcuccgucucucgcgggcggucgcaggagaaauccuugagacagagcaggucacgaagucgcucuaagggagguagccgguccagaucaaggagccguucuaaguccaaagauaagcgcaaaggccggaagagaaguagggaagagagccgaucucggucccgcucaagaaguaaaagcgagaggucgcggaagcgaggguccaagagagacucuaaagcaggaagcucaaagaaaaagaaaaaggaagauaccgaccgcagucaauccaggucuccuagccguuccgugucaaaggagcgggaacaugccaaaagcgagaguucucagagagaaggcaggggugaguccgagaacgcugggacaaaucaggaaacucgcagccgaucgagaucaaacucuaagaguaaaccaaaucuccccuccgagagccggucuaggagcaaguccgccucaaaaacccgcagucguagcaagucuagaucccggucagcgaguaggagcccuucccgcucucgaucgagaagccacucacgguccuga

SEQ ID NO: 63224 - RNA, 819 nt, Artificial Sequence
  derived and/or modified sequence opt3 from SRSF5__Homo_sapiens__NP_001307143
augagcggcugcagaguguucaucgggaggcugaaccccgccgcucgggagaaggacgucgaacgcuuuuucaaaggauacggucguauucgagauauagaccucaagagaggcuuuggguucguugaguuugaagauccuagggacgcagaugacgccguguaugagcuugauggaaaagaacuguguuccgagcggguaaccaucgagcacgcgcgcgcuagaucuaggggcggucgggggcgcggacgauacucagacagauucaguagcaggcggccacguaaugaucgcagaaacgccccgcccgugaggacagaaaaucgguugauugucgagaacuuauccucucgagugucguggcaggaccugaaggauuuuaugcgccaagcaggcgaaguuacuuucgccgacgcucauagaccuaaacuaaaugagggcguggucgaguuugcaucauauggggaucucaagaacgccaucgaaaagcugagcggaaaagagauuaaugguaggaagaucaaacuuauagaaggcaguaagcggcacucccgcucuagaagcaggucccguucacggacgcgaaguagcucuagauccaggucacgcagccggaguagaucuaggaaauccuacagccgcucgcgaucucggucccguucaagaaguaggagcaagucccgcucugugagccggucaccaguacccgagaagagucagaaaagaggguccagcucuaggucaaagaguccugcuagcguugaccgacagcgcucccggucuagaucgaggagccguuccguggacucaggaaacuga

SEQ ID NO: 63225 - RNA, 1035 nt, Artificial Sequence
  derived and/or modified sequence opt3 from SRSF6__Homo_sapiens__NP_006266
augcccagaguguacaucggcaggcugagcuauaacguccgggagaaggacauucagcgcuucuuuuccggguacggacgacuccuugaaguugaucugaaaaaugguuauggcuucguggaguuugaagacucucgugaugccgacgaugcuguauacgaguugaacgggaaggaauuaugcggagagagagugauagucgagcacgcaaggggcccucggcgcgacagagaugguuauucauacgggaguaggagcggaggcggcggguauuccucucggcgcaccucgggacgagacaaauacgguccaccggugagaacagaauacaggcugaucguugagaaucuaucaagccgguguaguuggcaagaucucaaggacuucaugcgucaggccggcgaagugacuuaugcggaugcucauaaagagcgcacgaacgagggggucauugaauuuagauccuacucugacaugaagagggcccuggauaaacuugacggaaccgagaucaauggccggaacauucgacugaucgaagacaagccccgcacaagccacagaagguccuauucagguagucggagccgcucuagauccaggcgucggucacgaagcagaaguaggcgcaguucccggagcagaucgaggucuauauccaagucacgcagucgaagccggucccguucuaaagggagaagcaggucacgcaguaagggacggaaauccagaagcaagucuaagucaaaaccuaagagugauaggggcagccauucccacucucgaucgcgcagcaaagacgaguacgaaaagucccggucaagaaguaggucucguagcccaaaagagaauggcaagggggauaucaaauccaagucacgcagccggucucaguccagaaguaacagccccuugccugugccacccucuaaggcaagguccguaucaccuccaccgaaacgagccacuucucggagccgcucgagauccaggucuaagagccggucacgaaguagauccucuagccgcgacuga

SEQ ID NO: 63226 - RNA, 717 nt, Artificial Sequence
  derived and/or modified sequence opt3 from SRSF7__Homo_sapiens__NP_001026854
augagcagauacggcagguaugggggagagaccaagguguacgucgguaaccugggcacaggggccggaaaaggcgaacucgagcgggcuuucuccuauuacgguccccuucgcacuguuuggaucgcacgaaauccuccaggguuugccuucguggaauuugaggacccgcgugaugcggaagacgcuguaagaggacuggauggcaaggugauuugcggcucuaggguccggguggaguugucaacggggaugccccgcagaaguagguucgaccggccuccagcccgccgacccuuugauccuaacgacagauguuaugagugcggagaaaaaggucacuacgcauaugauugucauagguacagccggcgucgcagauccaggucucggucgcgaucacacagccgcaguagaggcaggcgguacucccgcucuagaagcaggucccgugggcggcgaucaagaagugccagcccaaggcgcucucgguccauaucauuaagaaggagccgcagugcuucucugcgacggucccguagcggaucgaucaagggcucuagauauuuccagucccccucaaggagucgcagccgguccagaucuauuagcaggccucgaucaagucgcuccaaaagccggucuccaucaccgaagagaaguaggagccccuccgguucuccucgucgcucggcaagcccagagcggauggacuga

SEQ ID NO: 63227 - RNA, 666 nt, Artificial Sequence
  derived and/or modified sequence opt3 from SRSF9__Homo_sapiens__NP_003760
augagcggcugggccgacgagagagggggagaaggugauggcaggaucuacguggggaaccugcccaccgacguccgggagaaggaucucgaagaccuuuucuauaaauacggacgcauucgagagauagaacugaagaaucgucacggcuugguuccuuuugcuuucgugagauuugaggauccaagggacgcagaggaugccaucuauggucggaacggguacgacuauggacagugccgcuuaagaguagaguucccgaggacauacggcggccgcgggggauggccccgggguggccgaaaugggccuccaacuagaagguccgauuuucgggugcuggucucuggacuacccccuucaggcaguuggcaagaccucaaagaucauaugcgugaagcgggugacguguguuaugcugauguucagaaggacggggugggaauggucgaauaccugcgcaaagaggacauggaguacgcccuuagaaagcuggaugacacgaaguucaggagccacgaaggcgagaccuccuauauucggguguacccagaacgaucuacaucguauggcuacucacgcagcagaaguggguccaggggacgggauucucccuaucagagccgcgguuccccucauuacuuuucaccauucagaccguauuga

SEQ ID NO: 63228 - RNA, 414 nt, Artificial Sequence
  derived and/or modified sequence opt3 from SRXN1__Homo_sapiens__NP_542763
augggccugagagccgggggaacccucgguagggcuggcgcagggcggggagcccccgagggcccugguccaagcgggggagcgcagggcggcuccauccacucugggcgcauugcugccgugcauaacgucccgcuuucaguucugauacgacccuugccuaguguguuagacccagcaaagguacaaagccugguggauacaauccgugaagaccccgauuccgucccuccaauugacgugcuauggaucaaaggagcccaggguggcgauuacuucuauucuuuugggggaugccacagauacgcugcauaucagcagcuccaaagggagacuauucccgccaagcugguucagucgacgcuuucagaccugcggguguacuugggcgcuagcaccccugaucuccaguga

SEQ ID NO: 63229 - RNA, 615 nt, Artificial Sequence
  derived and/or modified sequence opt3 from SRY__Homo_sapiens__NP_003131
augcagagcuacgccuccgcuaugcugucuguguucaacucagacgauuauagucccgcaguccaagagaauaucccugcccucagaaggagcuccucuuuucuuugcaccgaaucguguaacucaaaguaccagugcgagacaggcgaaaauagcaaagggaacguucaggaccgggugaagcgcccaaugaaugcguucauuguauggagucgagaucagcguagaaaaauggcucuggagaacccgaggaugcgcaauuccgaaauaucuaagcaauugggauaucaguggaaaauguuaacugaggccgagaaguggcccuuuuuccaggaagcacagaagcugcaagccaugcaccgggagaaauacccuaacuauaaguacagaccaaggcggaaagcuaagaugcuacccaaaaauuguagccuccugccugcagacccagccuccgugcuuugcucagaaguccagcuggauaaccgcuuguaucgagacgauuguacgaaggcuacccauaguagaauggagcaccagcucggucaucugcccccuaucaaugccgcgagcucuccacagcaaagggaccgguacucccacuggacaaagcuguga

SEQ ID NO: 63230 - RNA, 1257 nt, Artificial Sequence
  derived and/or modified sequence opt3 from SS18__Homo_sapiens__NP_001007560
augagcguggccuucgcugcacccagacagaggggcaagggggagaucaccccugccgcgauucagaaaaugcuggacgauaacaaucaccucauacaaugcaucauggacucccagaacaagggaaaaacaucugaauguucacaguaccaacagaugcuucauacuaaucuggucuauuuggcuacgauugccgauaguaaccagaauaugcagagcuuacugccagcaccgcccacccaaaacaugccuauggguccaggcgggaugaaucaguccggacccccuccacccccucggucucacaacaugccaucggacggcaugguuggugggggaccgcccgccccucauaugcagaaucagaugaacggccaaaugccaggccccaaucacaugccuaugcaggggccaggacccaaccagcuaaauaugacaaacucaagcaugaauaugccgaguuccucucaugguagcaugggcggguacaaccacuccgugccuucaagucaaagcaugcccguacagaaccagaugacuaugucucagggacaaccaaugggcaauuaugguccucgccccaacauguccaugcagccaaaucaggggcccaugaugcaccagcaaccuccaucacagcaguacaacaugccgcagggaggcggccaacauuaucaggggcagcagcccccuaugggaaugaugggucaagugaaucagggcaaccacaugauggggcagcgacaaaucccacccuaccguccuccacagcagggacccccgcagcaauauagcggccaggaggauuacuacggugaccaguauagucaugggggccagggaccuccagaaggcaugaaucaacaguacuaucccgaugggcacaacgacuacggauaucagcagccuucuuaccccgagcaagguuaugauagaccauacgaagacuccagccagcacuacuaugagggcggaaauucgcaguacgggcaacagcaggaugcuuaucagggcccucccccacaacaggguuacccgccucagcagcaacaguaucccgggcagcagggcuacccaggacaacagcagggcuaugggcccucucagggagguccuggcccacaauaccccaacuacccucaggggcagggacaacaguauggcgguuacaggccgacccagccagggcccccucagccaccccaacagcggccuuauggcuacgaccagggacaguauggcaauuaccaacaguga

SEQ ID NO: 63231 - RNA, 1191 nt, Artificial Sequence
  derived and/or modified sequence opt3 from SS18L1__Homo_sapiens__NP_945173
augagcguggccuucgcuuccgcaagacccaggggcaagggggaggucacccagcaaacaauccagaaaaugcuggacgagaaccaccaucucauucagugcauacuugaguaccagucuaagggaaaaacugccgaauguacgcaauaucagcagauccugcaccggaauuugguuuacuuagcgaccauugcugauucaaaccagaauaugcaaagucugcuaccugccccaccgacacagaacaugaaucucggucccggcgcacugacucagagcggguccucucagggacuucauucgcaaggcucacugagcgacgccaucaguaccgguuugccuccauccucucuccugcaggggcagauuggaaacggccccagccacguguccaugcaacagacagcuccuaauacccugccaacuacaucaaugaguaucagcggccccggguauucucaugcaggaccugccucccaggguguaccaaugcagggccaagggaccauaggaaacuacgugucacgcacgaauaucaacaugcagagcaauccggucaguaugaugcagcagcaagcugccacuucucacuauuccagcgcgcagggcgguucgcagcacuaccaggggcaaucuuccauugcaaugaugggacagggcucacagggcaguagcaugauggggcagcgacccauggccccuuaucguccaucccaacagggaucuagccagcaauaccucggucaggaggaauacuauggcgagcaguacucacauagucagggggcugccgagcccaugggacaacaguauuacccugauggccacggugacuaugcauaccagcaguccagcuauaccgaacaaucuuacgauagaucauuugaggaaaguacacagcauuacuaugaagggggcaacagccaguacucccagcaacaggcuggauaucagcaaggcgccgcgcagcagcagacuuacucucaacagcaguauccaucgcagcaaagcuaccccgggcagcagcagggauaugguuccgcccaaggcgcaccgucacaguacccuggguaccagcagggacaaggccagcaguaugguaguuacagggcuccccaaaccgccccaucugcucagcagcagcggccuuauggguacgagcaaggccaguauggaaauuaccagcaguga

SEQ ID NO: 63232 - RNA, 1227 nt, Artificial Sequence
  derived and/or modified sequence opt3 from SSB__Homo_sapiens__NP_003133
auggccgagaacggcgacaaugaaaagauggcugcacuggaggccaaaaucugccaccagauugaauacuauuucggggauuuuaaccuccccagagacaaguuccuuaaagagcaaauaaagcuggaugaaggaugggugccuuuggagaucaugauuaaauuuaauagguuaaaccggcugaccacagacuucaaugucaucguugaggcgcuaagcaaguccaaggcugaacucauggagauuucugaagauaaaacuaagauccgccgaucaccaaguaaaccgcugcccgaggugacggacgaguacaagaacgaugugaaaaaucguagcguauauauaaaggguuuuccuaccgacgccacacuugaugacaucaaggaauggcuggaggauaaaggccaggucuugaacauucagaugagaaggacucuccauaaggcauucaaaggguccaucuuugugguuuucgacucuauugaaucggccaagaaauuuguggagaccccaggacagaaguacaaagaaacagaucugcugauccucuucaaggacgacuauuuugcuaagaaaaaugaggagcggaagcaaaacaaagucgaagcaaaguuacgcgccaaacaggagcaggaagcuaagcagaagcuggaggaagaugccgagaugaaaucacuugaggaaaagauaggcuguuugcugaaauucagcggugaccuagaugaccaaaccugcagagaggaucuccacauucuguuuaguaaucauggggaaaucaaguggauugacuucgugaggggagcgaaagagggcaucauccuuuucaaggaaaaggcaaaagaggcccugggcaaggcuaaagaugccaacaaugggaacuugcagcuccggaauaaggagguaacuugggaaguucuggagggagaaguggagaaagaggcauuaaagaagauuauagaagaccagcaggagucccugaacaaauggaagucuaaaggucgccgauuuaagggcaaagggaagggaaacaaagcugcccaacccggcagcgguaaggggaagguccaguuccagggcaaaaagacaaaauuugcguccgaugacgaacacgaugagcaugacgaaaauggagccaccggcccugugaagagagcaagggaggagacggacaaagaggaaccagcuucaaagcaacagaagacugaaaacggggccggagaucaguga

SEQ ID NO: 63233 - RNA, 447 nt, Artificial Sequence
  derived and/or modified sequence opt3 from SSBP1__Homo_sapiens__NP_001243442
auguucagaaggcccgugcugcagguccuccggcaauuuguucgccacgagagcgaaaccacaacuucccuugugcuggagcgaucuuugaaccguguacauuuacugggcagaguggggcaggacccuguccuaaggcaaguggaaggaaagaauccaguuacgaucuucucacucgccaccaacgagauguggcggaguggugauagcgaaguguaccagcugggcgacgucucccagaaaacaacuuggcaccgcauuucuguguuuagaccggggcuuagggauguagcuuaucaguacguuaagaaaggaucgcggauauaucuggagggcaagaucgacuacggugaguauauggauaaaaauaacgugcgccgacaggcaaccacaauuaucgccgacaauauuaucuucuugucagaucagaccaaggaaaaggaguga

SEQ ID NO: 63234 - RNA, 1026 nt, Artificial Sequence
  derived and/or modified sequence opt3 from SSBP2__Homo_sapiens__NP_001243662
auguacggcaaggggaaaagcaacuccucugccgugcccucagacagucaggcuagagagaagcuggcacucuaugucuacgaauaucuucugcacguuggagcccagaaaagcgcgcaaaccuucuuguccgagaucaggugggaaaagaauauuacauuaggugagccuccaggcuuucugcauucuugguggugcguguucugggaucuauacugugcugccccggaacggcgcgagacuugcgagcacucgucagaagcaaaagccuuucaugacuauagcgcugcagccgcucccaguccuguacucgggaacauaccacccggagauggcaugccuguggguccagugcccccuggguucuuucaggcccugggaggcgucccaggcucccagccgcuucugcccucugggauggacccuacgcgacaacagggacacccaaauauggguggccccaugcagcguaugaccccuccaagagggaugguucccuugggaccgcagaacuacggcggugcgaugaggccuccccucaaugcacucgggggaccaggcaugccuggcaugaacauggggcccggagguggccggccauggcccaauccuacaaacgccaauagcaucccauauuccucagcuaguccggggaacuacgugggacccccuggcggugggggcccacccggaacuccuauuaugccaagccccgccgauucuaccaauuccggcgacaacauguacacacugaugaaugcagucccgccugggccaaaccgccccaauuucccuaugggacccgguucagauggcccaaugggagggcugggcgguauggagagccaucacaugaacgggaguuuaggcucuggagacauggauuccaucagcaagaacucgccuaauaacaugucucuguccaaucaacccggcaccccaagagacgauggggaaaugggagguaacuuucuuaauccguuccagucagagaguuauagcccuuccaugacuaugucuguguga

SEQ ID NO: 63235 - RNA, 3780 nt, Artificial Sequence
  derived and/or modified sequence opt3 from SSFA2__Homo_sapiens__NP_001123917
auggacagaccccugagcuccucugccgaggcugaagaggaacucgaguggcaaguggcaucaaggcggcgcaaggccugggcgaaaugccgaaguagcuggcaggcuuccgaaaccgaggaucuuucuacagaggccacuacgcaggacgaagaggaagaugaggaggaagaccugccuggcgcacaguugccagccgcugggggacgugguaacgucccgaaugagaagaucgcaauuugguuaaaagauuguagaacaccccugggcgccucgcuagacgaacagucaagcaguacccucaaggggguucuggugaggaacggaggcuccuucgaggaugaccuuucucugggugcugaagccaaucacuugcaugagagcgaugcgcaaauagagaacugcaauaacauccucgcaaaagaacggcgccugcaguuucaccagaaggggagauccaugaacucaacuggaaguggcaagagcucuggcaccguauccucagugagcgagcugcucgaauuauacgaggaagacccugaggagauucuguauaaucuuggguucggaagggaugaaccagacaucgccaguaaaauucccucucgguuuuucaauuccagcucguuugcuaaggguaucgauauaaaagucuucuugucugcccagaugcaacgcauggagguggaaaacccuaauuacgcacugacaucccgauuuagacagaucgagguucuaaccacuguggcuaacgccuucucaagucucuauagccaggucuccggcacaccacugcagaggauugggucuaugagcucagugaccaguaauaaggaaacggaucccccuccaccgcuuacucgguccaacaccgcgaaucgucugaugaaaacauugagcaagcucaaccuguguguagacaagacugagaaaggagagucuucaagucccagcccuuccgccgaaaagggcaaaaucuuaaacguuucugugauugaggaaucggguaauaagaacgaccaaaagagccagaagaucaugaaaaagaaggaguccucaaguaugcuggcaaccgucaaagaggaagugucugggagcuccgcugccgugacagagaaugcugacucagaucgcauaagcgacgaagccaacucuaauuuuaaccagggaaccgagaaugaacaauccaaggagacgcagagucaugagagcaaacucggcgaagagucuggcauugucgaauccaaacuugauucagacuucaacaucaguagccacucggagcuggaaaauuccucugaguugaaaagcguucauauuucaacuccagagaaggaacccugcgcaccucuaacaaucccaaguaucagaaacauuaugacccagcagaaggauuccuuugagauggaagaggugcaaucuacugaaggggaggcuccccacguaccggcuacauaccagcugggacucaccaaaagcaagagggaccaucugcuucggacggcgucccagcacucagauagcagugguuucgcagaggacucuaccgauugucuguccuugaaucaccuccaggugcaagaaagccugcaggccaugggcucgucagcugacucuugcgacagugagacaacugucaccuccuuaggggaagaucuggccacaccuacugcacaggaccagcccuauuuuaacgagagcgaggaagagucucuagugccacuccaaaaaggacuggaaaaggccgcugccguugcagauaaacgaaagagcggcucccaggacuucccucaguguaauaccauagagaacacagguaccaagcagucaacuugcagucccggggaucauaucauugaaaucacggagguggaggaagaccuuuucccagcggagacagucgaauugcugcgcgaggcuagcgccgaaucugaugugggcaaauccucagagagugaguuuacccaauacacuacccaccacauacucaagagccuggcauccauugaagccaaauguucugacaugucgagcgagaauacaaccggacccccuucauccauggauagaguaaacacugcccuucagagggcccagaugaagguuugcagucugucuaaccaacggaugggccgcagcuugcucaaauccaaggaccuguuaaagcagagauaucuguucgcaaaagcuggguacccacuaaggcguucacagucucucccgacaacgcugcuuagccccgugcgggucgugaguuccgucaaugugcgauugagcccuggaaaggaaaccagauguucuccacccucauuuacuuacaaauauacaccugaggaggaacaggagcuggaaaagaggguuauggagcaugauggucaaucccucgugaaaaguaccaucuucaucagcccaucgucuguaaagaaagaagaggcgccccaguccgaggccccgcgcgucgaagagugccaccauggccggacaccuacuugcagcagacuggccccacccccuaugucacagaguaccuguucuuuacacuccauucauagcgaauggcaggagaggccccugugcgaacacacgcgcacccuuucaacacacagugugccaaacaucagcggggcuacuuguuccgcauuugccucuccuuucggaugccccuacagccaucgacacgcuaccuauccauaccggguuuguuccgugaauccgccuucagccauugagaugcaauugcguagaguccuccaugacauaaggaacucucugcagaaucuaagucaguaucccaugaugcgcggcccagaucccgcagcggccccuuacucgacacaaaagagcuccgugcugccacucuaugagaacacuuuucaggaacugcagguaaugcggagaucucuuaauuuguucaggacccagaugauggaccuggaguuagcuaugcuccgacaacagacgaugguguaccaccacaugacagaagaggaacgcuuugagguugaccagcugcagggucuucggaacucagucagaauggagcugcaagauuuggaacuccagcuggaggaaaggcuacuggggcucgaggaacagcugcgugccgugcgcaugcccagcccuuuccgguccagugcacuuaugggcaugugcggaucuagaagcgcugacaauuugucauguccguccccacugaacgugauggagcccgucaccgaguuaaugcaggaacaaaguuaccucaagagcgagcugggccuugggcugggagaaauggguuuugagaucccuccaggcgagucuuccgaaucaguuuucagccaggccacuucggagucuaguuccgugugcagcgggcccucacaugcaaauaggcgaacaggagugccuuccaccgccucuguaggcaaaagcaagacuccgcuagucgcucggaaaaagguguuucgcgcgaguguugcccucacccccacagcaccauccagaacggguagcgugcagaccccucccgaucuggaaucuucagaggaagucgacgcugccgagggggccccagaggugguuggcccuaaaagugaaguggaggaaggacacggcaaguugcccuccaugccagcugcagaggaaaugcauaagaacguagagcaggaugagcugcaacaggucauuagggaaaucaaagagagcaucgugggggaaauucggcgagagauagugucuggauuacucgccgcggucucgucaagcaaggcuuccaauaguaaacaggacuaucacuga

SEQ ID NO: 63236 - RNA, 2079 nt, Artificial Sequence
  derived and/or modified sequence opt3 from SSH1__Homo_sapiens__NP_001154802
auggcccuggugacccuccagagaagccccacaccuuccgcugcaucuucaagugccagcaacuccgagcuugaagcgggcucugaggaagacaggaagcugaauuugucguuaucagagagcuucuuuauggucaaaggggcugcccuguuccuacaacagggaaguuccccacagggucagcggucucuccaacacccgcacaagcacgcaggcgaucugccccagcaucuucagguuaugaucaaccuguugcgcugcgaagaccgaauuaaacucgccgugcgucuggagagcgcuugggcagauagaguaagguacaugguggucguguauuccucagggcggcaggacacugaggaaaauauacugcucggaguugauuuuaguagcaaggagucuaaauccuguacgaucggcaugguguuacgccuguggucagacaccaagauucaccuugauggugacgggggauucagcgucaguacagccggcagaaugcauaucuuuaagccugugucuguacaagcuaugugguccgccuugcagguucugcacaaagcgugcgaaguggcaaggcggcacaacuacuucccaggcggggucgcccuaauuugggcuacuuauuacgagagcuguaucucgucugagcaguccugcauaaaugaauggaacgccaugcaggaucucgagucaacccgccccgacaguccugcacuguuuguggauaagccaacagaaggagagcgaaccgaaagacuuaucaaagcuaagcugaggagcauuaugaugucccaagacuuggagaaugugacuucuaaagagauccggaacgaacucgagaagcagaugaauuguaaccugaaggaauuaaaagaguucauugauaaugaaaugcugcucauccuuggucagauggacaagcccagccugauauuugaccauuuguaucuaggcucagaguggaacgccaguaaucuggaggaacuccaaggguccggagucgauuacauucugaacguuacacgugagaucgacaauuucuuuccuggccuuuucgcguaucacaacauucgcguguacgaugaagagaccacggaccuguuggcccauuggaacgaagcauaccacuuuaucaauaaagcuaagagaaaccacagcaaaugccucguacauuguaagaugggugugucuaggucagccaguacugucaucgcuuaugccaugaaagaguucggguggccacuggagaaggcauacaauuaugugaagcagaaacggagcauuacccgaccgaacgccggauucaugcgccaguuauccgaauacgagggcauacuggaugcuucuaagcagagacacaauaaacuauggaggcaacagacagacucgagccuccagcagcccguugaugacccugcgggcccaggggauuuucugcccgaaacuccugacggaaccccagagucccaacuucccuucuuggaugacgcagcccagccgggucugggcccuccccucccaugcuguuuucggcgccugucagacccucuucugcccaguccagaggaugaaacagggucuuuggugcaucucgaggaccccgaaagagaggcucuguuagaagaggccgcaccuccagccgagguccacaggccggcucgucagccccagcaaggaagcggccugugcgaaaaggaugugaaaaagaagcuagaguucgguuccccuaaagggcggucaggcagccuccugcagguagaagagaccgaacgagaggagggacuuggcgccgggagauggggacaguugccaacgcagcuggaccaaaaccucuuaaauucugaaaaccugaauaacaauuccaagaggaguugucccaacgguauggagguuggccgcgcacggccugcgggguggcauacuccaagccugcccucucacuccaauuggccgacaucagcuaguguggucggaaccacuggcacaagacaccauacccagcuuaucuuuuucuauugcuugcucugggccccuagcucgcaucugcaggguccagaaggguccuuuacgggcuga

SEQ ID NO: 63237 - RNA, 4353 nt, Artificial Sequence
  derived and/or modified sequence opt3 from SSH2__Homo_sapiens__NP_001269058
auggcccuggugaccguccagagaagccccacaccuuccacuacgucuucaccaugcgcuaguagcucccaccucgaggacucugaaucggcagcccuucuguguugcgagugugaagagucagaaaucuucaccgauagcaacgaggcggacaguggcgaggaagagugcaggucccaaccgcggucuauuagcgaauccuuuuugacaguuaagggggcugccuuauuccugccccgcggaaaugguucaaguacuccucgaauaagccaucguagaaacaaacacgcaggcgaucuacagcagcaucuccaggccauguuuauccugcuuaggccagaggacaauauucggcuggcugugcgcuuggagucuaccuaccaaaacagaacaagguauaugguaguggucuccaccaaugggcggcaggauacugaagagucaaucgugcucggaauggacuucagcaguaacgauucuuccacauguaccaugggccugguucugccccucuggagcgacacguuaauucaccuggauggugacgggggauuuucggugucuacugauaaucgcguccauaucuucaagccuguguccguacaggcaauguggucagcccuucagaguuugcacaaggcuugcgaaguugcccgagcgcacaacuacuauccaggcagccuguuucuaaccuggguguccuacuaugagucucauauaaauagcgaccaaucaagugucaacgaauggaaugcaaugcaggaugugcagucccacagacccgacagcccugcccucuucacagacaucccaacugagagggagcggaccgaacgucugauuaagacaaaacuucgcgagaucaugaugcagaaggaucuggaaaacauuaccucuaaggagaucagaacggaauuggagaugcaaaugguguguaaucucagggaguuuaaagaguucauagacaacgagaugauugucauccugggccagauggauucaccgacucagauuuuugaacauguuuucuuagggagugaguggaaugcuagcaaccuggaagaccuccaaaaccggggagugcgauacauccuuaauguaacacgcgagaucgauaacuuuuuccccgguguguucgaguaucacaauauuagagucuacgacgaagaggccaccgaucuguuggcauacuggaacgacacuuauaaguuuauauccaaagcuaagaaacacggcucuaagugccuagugcauuguaagauggggguuucgaggagcgccuccacagugaucgcguacgccaugaaagaauauggauggaaucuggaucgggcauacgacuaugucaaggagcgcagaaccgugacgaaaccuaacccaucauucaugaggcagcucgaggaauaccagggcauucugcuugcuaguaagcagcgucacaauaaacuguggcggucucauagcgauuccgacuugucagaccaccaugagcccaucugcaagccuggucucgaacugaacaaaaaggauauaaccacaagcgccgaccaaauugcugagguaaagacuauggaaucucacccacccaucccgccuguuuuuguggagcacauggucccccaggaugccaaucagaaaggguuauguaccaaggagcgaaugaucugccuggaguucacauccagagaauuucaugcaggacagauugaagacgagcuaaaccucaaugauaucaacggcugcaguagcggcuguugccugaaugaaucuaaauucccacuugacaacugucacgccuccaaggcuuugauucaaccugggcaugugcccgagauggcgaauaaauuuccagaucugacugucgaggaccucgaaaccgaugcacugaaggccgacaugaacgugcaccuucugcccauggaggaauugacaucaccucucaaggauccaccgaugagucccgacccugagagcccaucgccccagccuuccugccagaccgaaauaucugauuucagcacugacaggaucgacuuuuucucagcucuggagaaauuuguugaguuaagucaggaaacgcgcucccggucuuucagccacuccagaauggaggaacugggagguggcaggaacgagucaugucgccuaagcgugguagaggucgccccaaguaaggugacagcagaugaccaacgaucuuccagccucucgaauacuccccaugccucagaagagucuaguauggaugaagaacaguccaaagcuauuagcgaacugguuucuccggacaucuuuaugcagagccacuccgagaacgccaucucagugaaggagauugucaccgaaauagagaguaucagccagggggugggacaaauucagcuuaaaggcgauaucuugccuaauccaugccauacccccaagaagaacucuauucacgaacugcuccuggagcgggcacagacaccugaaaauaaacccggucauauggagcaagacgaggauuccuguaccgcgcagccagaauuagcuaaggacucagggaugugcaacccugagggcugucugacuacacacaguagcaucgccgaucuugaagagggagaacccgcagagggcgagcaggaauugcagggguccggaaugcacccaggugccaaaugguauccgggcucuguacguagagcuacgcucgaguucgaagagaggcugcgccaagagcaggaacaucacggggccgcaccuaccugcacuucgcuaagcacacggaaaaauuccaaaaacgacucaaguguggcugaucuggcccccaagggaaagucugacgaggcgccacccgaacauagcuucguucucaaagagccugaaauguccaagggcaaagguaaguacucagggucugaggccggcagccugagucacuccgagcagaaugcuaccgucccagcacccagagugcuugaauuugaucauuugccugacccgcaggagggaccaggcagcgacacagggacucaacaggaaggagugcugaaagauuuaaggaccgucauacccuaccaggagucugaaacgcaggccguuccucucccacugcccaagcgaguggagaucauugaguauacccacaucgugacaucaccuaaccacacugguccgggcuccgaaauugcuaccagugagaaaagcggggaacaaggacuucgcaagguaaauauggagaagucggucacagugcuguguacuuuggacgaaaaccucaaucggacccuggaucccaaccagguuucucuacauccacaggugcugccucucccccacuccagcucaccagagcauaauagaccuacggaccaccccacaaguauccugucuuccccagaggauaggggcagcucacuuaguaccgccuuggaaacugcagcgccguucgucagccacacaacccaucuguuauccgccucucucgacuaccugcacccucaaacuauggugcaucuugaggguuuuaccgaacagagcuccacaacggaugagcccucagcugagcagguuucuugggaagagagucaggaaucgccacugagcuccgggucugaggugcccuauaaagacucacaacuaagcuccgccgaucucagucugauaucuaaguugggcgacaacaccggagaacugcaggagaaaauggauccuuuaccaguagcaugccgucucccccacagcucauccagugagaacauuaagagccugucucauuccccuggcgucgugaaagaacgcgcuaaggagaucgaaucacggguggucuuccaggccgggcuuacuaagccgagccagaugagaaggucggcaucucuggccaaauugggauaccucgaccugugcaaggacugucuaccagagcgagaacccgcuaguugcgaguccccucaccugaaacuucuccaacccuuucugcggacagauagcggcaugcacgcgauggaggaccaggaaucauuggagaauccaggugccccucauaaccccgaaccaaccaaguccuucguugagcagcugacaacuaccgaauguauugugcagucuaaaccuguagagcgcccguuagugcaauaugcaaaggaguuugggagcagucagcaguaccuccugcccagagcuggacuugaacugacguccagcgagggcgguuugccaguccuccagacacaaggccugcagugcgccuguccugcccccgggcuagcuguggcaccaaggcagcaacacggacggacccauccucugcgaagacuuaagaaagccaaugauaagaaacgcacuaccaaccccuucuauaauacaauguga

SEQ ID NO: 63238 - RNA, 735 nt, Artificial Sequence
  derived and/or modified sequence opt3 from SSMEM1__Homo_sapiens__NP_660311
augggcgaccuguucagccucuuuugggagguggaucccccuccaaucccggucaacugcgccauucccaaucaggacuacgaauguuggaaggaugacuccugcgggaccauaggaucuuuccuucugugguauuuuguuaucguguucguauugauguuuuucucaagagcuaguguguggaugagcgaggauaaaaaggacgaagguuccggcacaucuacuucggucaggaaagcaucaaaggagacgagcuguaaacggcaaaguaaggauuccgccugggacccuucucagaccaugaagaaaccaaagcagaaccaguuaacacccgugacuaauagcgaaguugcgcuggugaacgcuuacccugagcaacgccgagcccguagacagucccaguuuaaugaggucaaccagaaucaacacgauucagacaccacagaauaugggagugaggaaagcaacucugaggcauccucauggaaagagagcgaaagugagcaucacccaucucccgauuccauuaagaggcggaaaauggcccagcgccagagaaaucuaggaagcuaccagaugucggaaaggcauugccuccacuguaaggcucugcggaccaacgaguggcuugcacaucacucucgccaaaagccuuccgugacuccaccgaugaaacgagacucacaggaagagaguagcaucuccgauauuaauaagaaauucucuaaguuuuga

SEQ ID NO: 63239 - RNA, 360 nt, Artificial Sequence
  derived and/or modified sequence opt3 from SSNA1__Homo_sapiens__NP_003722
augacccagcaaggcgccgcucugcagaacuacaauaacgagcucgugaagugcaucgaagaacuuugucagaaaagagaggagcugugcaggcagauucaagaagaggaggacgaaaagcagcgguugcagaaugagguccgccaguuaacagaaaaacuggcacgaguuaacgagaaucuagcccguaagauagcgagcagaaacgaguucgauaggacuaucgcugaaacggaggccgcauaucucaaaauucuggaauccucucaaacccuucugucaguguugaagcgggaggccgggaaucucacaaaggcuacugcacccgaccagaaaaguagcggaggucgcgauuccuga

SEQ ID NO: 63240 - RNA, 732 nt, Artificial Sequence
  derived and/or modified sequence opt3 from SSPN__Homo_sapiens__NP_005077
augggcaagaacaaacagcccagagggcaacagaggcagggagguccuccagccgcugacgcagccggcccggaugacauggagcccaagaaagggaccggagcgccuaaggaaugcggcgaggaggaaccacggacauguugcgguugucgcuucccccugcuccuugcucuguugcaguuagcccuggggaucgcagugacugucguuggauuucuaauggccagcauuuccucuucacuccuggugcgagauacgccuuucugggcuggcauaaucguaugccuuguggcauaccugggcuuguuuaugcucugugucaguuaucaaguggacgaacguaccugcauucaguucagcaugaaacugcuguacuuucucuuauccgcccuggggcuuacaguuuguguguuggcugucgccuucgcggcacaccauuauucucagcugacucaguuuaccugcgagacaacccuagauucgugucaaugcaagcucccaucaagcgagccccugaguagaacuuucguguacagggacguaacagauuguaccuccguuacgggaacuuuuaaacuuuuccuguugauccagaugauucucaaucuggugugcgguuuagucugccugcucgccuguuuugugauguggaagcaccgguaucagguguucuacgucggcguucgcaucugcucucuuaccgcuagcgaagggccucagcaaaagauauga

SEQ ID NO: 63241 - RNA, 15444 nt, Artificial Sequence
  derived and/or modified sequence opt3 from SSPO__Homo_sapiens__NP_940857
augcugcuccccgcccuucuguucggcauggcuugggccuuggccgacgggcgcuggugcgaguggaccgaaacaaucaggguggaggaagaggucgcgccucggcaggaagauuuaguuccaugcgcuucccuggaccacuacucccgccuaggguggcgacucgaucugccguggucuggucguucaggccuuacuagaagucccgccccugggcugugcccaauuuacaagcccccugagacgaggccagccaaauggaaccggaccgugcgcacauguugccccggauggggcggugcccacuguacugaggcuuuggcaaaggccagcccugaagggcacugcuuugcuauguggcaaugucagcuccaggccggauccgcgaaugcaucugccggcucgcuggaggaaugcugugcuagaccauggggccagucauggugggacggguccagucaagccugcagguccuguucuagccggcaucugccgggauccgcaucaagucccgcucucuuacagccucuggccggugcggucggccagcuuuggagccagcaccaacgcccaucugcaacaugcgcauccuggucaggguuccauuaccgaacauuugauggaagacacuaccacuucuugggaaggugcaccuaccugcuagcuggugccgcugacagcacuugggccgugcaucucacacccggggaucgguguccucagccaggacacugccagcgugucaccaugggccccgaggaggugcugauacaggcaggcaacguuagugugaaagggcaacuugucccggaaggacagucuuggcuguugcauggucucucccugcagugguuaggcgacuggcuggugcucagcgggggacuuggcguaguugugcgccuggauagaacggguucgaucucuauuuccgucgaccacgaguugugggggcaaacucagggccuauguggacuguauaauggcuggccugaagaugacuuuauggagcccgggggaggucucgccaugcuggcugcgaccuucggcaacucauggaggcuuccagggagugaaagcggaugccuggaugcaguggagguggcccagggcugugacccuuugggucucaucgacgcugaugucgagcccgggcaucugcgggccgaagcacaggacguuugccaucaauuacuggagggcccauuuggacagugucacgcccaggugucccccgcugaauaccaugaggccugccuauucgcauauugugcgggcgcuauggccgggucuggacaggaaggucgacaacaggcaguaugcgccacauuugcuagcuacgugcaggccugugcacgcagacacauucauaucagguggcggaagccuggcuucugcgagcgccucugcccagggggacagcuguacucagauugugucagucuuugcccgcccuccugugaggcugugggccaaggugaagaggaaagcugcagagaggaauguguuucugggugcgaguguccuaggggcuuguuuuggaauggaacucugugcgugccagccgcgcacugucccugcuauuacugucgucagcgguaugucccuggcgacaccgugcgacagcucugcaacccaugcguauguagagaugggagguggcacugcgcccaggcucugugucccgcagagugcgccguuggaggcgacggucauuaccuuacauucgaugggcgcucauauaguuuuuggggaggccaagguugucgguacagccuggugcaggacuaugucaaaggccaguugcucauacuguuagaacacggggcuugcgaugccggauccugucugcaugcaaucucugugucgcuagaggacacccacauucaacucagagauagcggcgcgguccuggugaaugggcaggacguuggacuuccguggaucggcgccgaagguuuguccgugaggcgcgcuucaagugccuuccugcuccugcgauggccuggggcacagguauuauggggacugucugacccagucgcuuacauuacgcuugauccccggcacgcccaucaggugcaaggcuugugcgguacuuucacacagaaccagcaggacgauuuucucaccccugcaggcgacguugagacuagcaucgccgcuuucgcguccaaguuucaaguggccgggaagggacguugucccucagaggauagcgcacugcuaucuccaugcacaacccacucccagagacaugcuuucgccgaagccgcuugugcaauacugcacaguagcgucuuucaggagugccauaggcucguggacaaagaaccuuucuaccugcgcugccuugccgcgguauguggcugcgaucccgggucugacuguuugugcccagugcuguccgcuuaugcccggagaugugcacaggagggagccucaccgccuuggaggaaucaaacguuaugccccguuauguguccaggcggucaggaauaccgagagugcgcucccgcaugugggcagcacugcggaaagccugaggauuguggcgaacucgguaguugcgucgccggcugcaacuguccacuggggcuucugugggaccccgagggacaaugcgugccuccgagcuuguguccaugccagcucggcgcgcgccgguaugcucccgggucggccaccaugaaagaauguaauagaugcauuugucaggagaggggacuguggaacugcacagcacgucacuguccuucccaggccuuuugcccacgcgagcuaguguacgcucccggcgccugucugcucacuugcgauucuccuagcgcaaaucauucaugcccggcugguaguaccgacgggugugucugucccccaggaacaguucugcuugaugagcggugugugccucccgacuugugcccauguagacacuccggccaaugguaucugccuaacgccacuauccaggaggacugcaauguguguguaugcaggggccgacaguggcauuguaccgggcagcggcgcucuggaagaugccaagcgagcggugcaccccacuacgucacauucgauggcuuagcauuuaccuauccaggggcuugugaauaccuccuggugagggaggccuccggacuuuucacuguuucagcucagaaccugccgugcggcgcaagcggucuaacguguacaaaggcccucgccgugcggcuggaagggaccgucgugcauauguugcgaggcagggcuguuacugugaacggcguaagugucaccccucccaaaguguacacaggcccagggcugucuuuacgcagggcgggacucuuucugcuucuguccacccacuugggucucacucugcuaugggacggcgggacacgugugcugguccagcuuagcccccaguuccggggaagaguugcaggccucugcggugauuuugacggggaugccucgaaugaccugaggucacgccaaggaguguuggagccuacggcugaacuggccgcacacucuuggcgauuaaguccacucugccccgagccuggcgaucugccgcauccauguaccaugaacacucacagagccggcugggcucgggcgaggugcggggcccuucugcagcccuuguucacacucugucaugcagagguaccuccccagcagcacuaugaauggugccuguacgacgcuuguggaugcgauuccgguggcgacugugagugccuauguagcgccauugcaaccuaugccgaugaaugcgcucgccacgggcaucacgugcguuggagaucucaagagcuguguagccuucagugcgagggaggccaggucuacgaagccugcgguccaacauguccucccacuugccaugagcaacacccagaaccuggguggcauugucaggugguugcgugcguggagggauguuucugcccggaaggcacccuccugcacggcggggcauguuuggagcccgccuccugcccaugugaguggggaagaaauucauuuccucccgguagugucuuacagaaggacugcggcaacuguacgugccaggaagggcaauggcacugcggaggcgauggugggcauugugaggaacuggugccagcuugcgccgagggagaagcucucugucaggagaauggccacugcguuccucauggcuggcugugugacaaccaggacgauugcggggacggaagcgaugaggaagguugugcagcccccggcugcggggagggacagaugaccuguucuuccggccacugccuuccgcuggcuuugcuaugugacaggcaagaugacugcggugaugggacagacgaaccaucauauccuugcccccagggccugcucgccugugcagauggacgcugccugccacccgcgcuuuuaugugacggccacccugauugccuggacgccgcugacgaggaaaguugucucggacaggugacuugcgucccgggagagguaagcuguguggaugguaccugcuugggcgccauccagcugugugacgggguuugggauugccccgacggagcagaugagggcccaggucauuguccucuccccucccugccuacaccacccgcuucuacucuuccugggccaucgcccggcagccuggacaccgccucauccccguuggcaagugccucuccugcuccacccugcggaccuuucgaauuucgaugcggcagcggggaguguacgccaagaggauggcggugcgaucaagaagaggacugugcggaugguuccgacgagaggggcugcgggggacccugugccccgcaccaugcaccuugcgcucgcggcccccacugugugucaccagaacagcuaugcgauggugucagacaguguccugacgggucugaugagggccccgacgccugcggaggccugccagcccucgggggacccaauaggacaggcuuaccuuguccagaauauaccugcccgaacgguacuugcaucggguuccaacuggugugugacggacagcccgauugcggccggccuggucagguaggcccaagccccgaggaacagggguguggagcauggggcccuuggaguccaugggggcccugcucccguacauguggaccuuggggccaaggucgcagccgaagaugcucuccgcuugggcugcucguguugcagaauuguccaggacccgagcaucagucacaggcuugcuuuaccgccgcguguccugucgacggcgagugguccacuuggagucccuggagcguuugcucggaaccauguagggguaccaugacacggcaacgccagugccacucuccucagaacggcgggagaacgugcgcugcccugcccggaggccuccacuccaccaggcagacuaagccauguccgcaagaugggugcccuaaugcaacauguagcggagagcugauguuccagcccugcgccccauguccccuuaccugcgacgauauuucaggccaggugacauguccuccagacuggcccugcgguaguccuggguguuggugcccggaaggacaggugcuaggcucugagggcuggugugucuggccacggcaaugccccugccugguggauggggcucgauauuggccuggacagagaauaaaagcagacugucaguugugcaucugucaagauggucgcccaaggcggugccguuuaaaccccgacugugccguugauugcggcugguccagcuggucaccuugggcgaagugucuggggcccugcggaagucagagcauucagugguccuuuagaucuagcaauaacccaaggccguccggccgcggucggcagugucgagggauccauagaaaagcuaggcgcugccaaacugaaccuugugagggaugcgagcaccagggccagguacaucgggugggcgaaagauggcacgggggacccugccgugucugucagugccuccacaaucugaccgcccauuguucaccauacugcccucuugguucuuguccccaaggcugggugcugguugaggggacgggagaaaguugcugucacugcgcacucccaggcgagaaccagacagugcagccuauggccacccccgcugccgcaccggcuccaucgccucagauaagguuccccuuggccacuuacauucugccacccagcggugacccuuguuauuccccgcuagggcuggcgggacucgccgaaggcucucuucaugcaucaagccaacagcuggagcacccaacccaggcugccuuauugggcgcacccacacaagggccuagcccccagggauggcaugcugguggcgaugccuacgccaaguggcacacucggccacacuaucugcagcucgaccugcuucagccucgcaaccugaccgggauccucguccccgagacaggaaguucuaaugcguacgcuagcucauuuuccuugcaauucaguagcaacggccugcauuggcacgacuaucgagauuuacuaccagguauccugccucucccgaaacuuuuucccagaaauugggacgaucuggacccagcaguguggacguucgggaggaugguacaggcccgguuuguccgcguguggccucaugauguucaccauucugacgugcccuugcaggucgaacugcucggaugcgagccaggcuccccucccgcuccgcuguguccaggcguggggcuuagaugcgccucaggagaaugcguucucagggguggcccuugugauggggugcuggacugcgaggauggaagcgacgaggaaggcugugucuugcugcccgaggguaccgggcgauuccacucgacugcaaagacauuagcccuaucuagugcucagccaggacaacugcuccacuggccccgggaaggccuugcggagaccgaacauuggccucccggccaggaguccccaacuagcccuacagagacccguccggugucacccgggccagccuccggaguaccucaccauggugaaucugugcagaugguuacgacuacccccauuccacagauggaggcaagaacacugccucccggcauggcugccgucaccguggugccgccucacccagucacucccgcaaccccugccgggcaaagcguagcuccaggacccuucccuccagugcagugcggccccggucagaccccgugugaaguuuuggggugcguggagcaagcccaggucugugauggacgcgaagacugccuggacggcagugaugagaggcacugugcgcggaaccuccugauguggcuuccuuccuuacccgcacugugggccgcuagcacagugccauuuaugaugcccacuauggcccucccuggcuugccagcaucuagagcucugugcucacccagucagcuauccugugggagcggagagugccugucugccgaaagaaggugcgaccuccgaccugauugucaggacgguucggaugaggacggcugcguugauugugugcuugcuccauggucagucuggagcuccugcagucggucuugugggcugggauugaccuuccaaagacaggaacugcucaggccgccccugccuggcgguagcugcccacgcgaccguuuucggucccagucauguuucgugcaggccugccccguagcaggggcgugggccaugugggaggcuuggggcccuuguagugugucuugcggaggcgggcaucaaagcagacagagguccuguguugauccacccccgaaaaauggaggugccccuugcccaggcgcaucacaggaacgcgcucccugcggguuacagccuuguagcggaggcacggacugcgagcuuggucgagucuacgugucugccgaucugugucaaaaggggcucgugcccccaugcccgccuuccugucuagaccccaaggcaaaccggaguugcagcggccacugugucgagggaugcagauguccacccggccuguugcugcaugauacaaggugccucccucuuucggaauguccaugccugguuggggaggaauugaaauggcccggaguguccuuucugcucgguaauuguucucagugcguaugcgagaagggcgaguuacugugucagccugggggaugcccacuuccguguggcuggucagccuggagcaguugggcgcccugcgaccgcuccugugguucuggcgugagagcucgguucaggagcccuucaaacccacccgccgcauggggaggggccccuugcgaaggcgaccgucaggagcugcaagggugucacaccgucugcggaacugaaguguuuggcuggaccccauggacauccuggaguagcuguucucagucaugccuagcucccggugggggaccuggcuggcgaucccgcagcagacucuguccgucucccggugauaguucgugcccaggcgacgccacucaggaggaaccuugcagcccacccguuuguccugugcccagcaucugggggcugugggcaccauggucaaccugcucugcuccgugugauggaggcauucaaacgcgggggaggagcugcuccaguuuggccccuggagacacaaccugucccggcccacauucacagacucgcgauugcaauacacagcccuguaccgcgcagugcccugagaacaugcuguucagaucugcugagcaaugucaccaggaaggugggccaugcccccggcucugucuuacucagggaccuggcauagagugcacagguuuuugcgccccgggcuguaccugucccccagggcuguucuuacacaaugcaagcugucugccuaggucccagugccccugucaauugcauggacagcucuaugccaguggcgcuauggcacgacuggacagcugcaacaauuguacgugcgucuccgggaaaauggccuguacuucugaacguugcccaguagcguguggauggucaccuuggacccuauggagccuuugcucgugcuccuguaacgugggcaucagacgccgguuuagggccgguacagcucccccagcagccuucgggggagcugagugccagggcccgaccauggaagccgaguucuguagucugagaccuugccccggcccagggggagagugggguccuuggucucccuguagcguuccaugcggcgggggauaccgcaaucggacaaggggcucaucccgaucucucauggaauuuaguacuuguggucugcagccuugcgcagggcccgugccgggaauguguccaagagauaagcaaugguuggacugcgcucagggccccgccagcugugcggagcuguccgccccucggggcaccaaccagacgugccacccagggugccauugucccucaggaaugcuccuucugaacaaugucugcgugccuacacaagauuguccgugcgcacacgaaggucacuuauaucccccaggcagcacugucgugaggccuugugagaacugcucuuguguuagugggcugauugcuaauugcuccagcuggcccugugccgaaggagagccaaccuggucaccuuggacacccuggucucagugcuccgcaucguguggcccagcccgcugccaucgucacagauucugcgcucgaagcccuagugccgugcccucuaccguagcgccguugccucucccagcuacucccaccccucuguguuccgguccagaggcagaagaggaacccugccuacuucaggggugugacagggccggaggcuggggcccgugggggccuuggagccauugcucacggaguuguggagguggccugcgcuccagaacaagggcuugcgaucagcccccaccccaagggcucggagacuauugugagggcccucgggcccagggugaggugugccaggcacugccaugucccgucacgaacugcacugccaucgaaggggcugaguacagcccuuguggaccaccgugcccccgcucuugcgacgauuugguucacuguguguggagaugccagccuggcuguuauugcccacccggccaagucuuaucaagcaauggggcgaucugugugcagccuggacauugcuccugucuggaccuccuuaccggucagcgacaccacccaggcgccaggcuggcacggcccgaugggugcaaccauuguacaugccuagaaggacgucugaauuguaccgaccucccgugcccuguaccaggcgguuggugccccuggucugaguggacuauguguagucagccuugccgcgggcaaacaagaucgaggagccgggccugugcuugccccaccccacagcacggaggcgcaccuuguacgggcgaagccggggaggcuggagcccagcaucagagagaggcgugccccuccuacgcaacuuguccaguggauggugccuggggcccgugggggcccuggucaccuugcgacauguguuugggacaaucucaccgcagccgagcuugcaguaggccacccacaccugaaggcggucggccaugucccgggaaccauacccaguccagaccuugccaggaaaauucaacccaaugcacugauuguggcggaggccagucucugcacccgugcgggcagccauguccccguagcugccaggaccuuuccccuggaaguguuugucaaccagguagcgugggcugccagcccacaugugggugcccucugggacagcucucucaggauggcuuauguguacccccagcccacugccgcugucaauaucagccgggugcaauggggauuccugaaaaccagucaagguccgcuggcagccgguuuaguucuugggagucccuggaacccggagagguggucaccggcccaugcgacaauugcacauguguggccgggauauugcagugccaagagguuccugauugucccgacccaggaguauggucgagcugggguccgugggaagauugcucaguguccuguggcgggggagagcagcugagaucucgaaggugcgcgcgcccucccuguccaggccccgcccggcagaguagaacuugcagcacgcaagucuguagggaagcugguugcccugcagggcgccucuaccgugagugucagccaggcgaaggaugccccuucucaugcgcccaugugacccagcagguuggcuguuuuuccgaggggugcgaggaaggaugucacugcccugaggguacauuccaacaucggcuugcuugugugcaggaaugcccguguguccugacugcauggcuacugcaggagcucggcgccaccaucggggacccaggacagcccuugggcccuggugacgagcuggauagcggccaaacacuuagaaccucuugcgggaacuguaguugcgcucacggaaaacuguccuguagcuuagacgauugcuuugaagccgacggcggguucggacccuggucaccauggggcccuugcucucgaucguguggugggcucggaacuaggacgcgcagccggcagugcgugcugaccaugcccacauuguccggccaggguuguagaggcccaaggcaggaucuggagugcccuaguccggacugucccggggcagaaggaucuacuguagagccagugaccggccucccugggggauggggccccuggucaagcugguccccaugcagucgcucuuguacagauccugccagacccgcguggcggagccgaaccaggcuuugccuggcuaauuguacuaugggugacccgcuacaagaacguccaugcaaccugcccuccuguacagagcucccuguuugcccagggcccggaugcggcgccgguaauuguucauggacgagcugggcaccuugggagcccugcucuagauccuguggcgucgggcagcagcggcgcuugagggccuaucgaccaccuggaccgggcgggcacuggugccccaacauucugaccgcuuaccaagaaagacgguuuuguaacuuacgcgccugcccagugccuggaggcuggaguagguggucacccuggagcuggugugauagaucgugcggugggggacagucccuucggucucguaguuguagcucaccaccuuccaagaauggcggcgcacccugcgcuggggagcgccaucaggccaggcuguguaacccgaugccaugcgaagcgggauguccugcagguauggagguggucacuugcgccaaucgaugccccagacgguguucugaccuccaggaaggcaucguuugccaagaugaccaggugugucagaagggguguaggugcccaaaaggaagccuggagcaggauggcgguugcguaccuauugggcacugcgacugcacagacgcucaaggacauaguugggcccccggcucccagcaccaggaugcuuguaacaauugcagcugucaggcaggccaauugucuugcaccgcccagccgugcccucccccaacccauugugcguggucacacugguccgccuggagccccugcagucacucuugugggccucgcggacagcagucaagauuccgguccagcacaucggguucuugggcuccagagugcagggaggaacaaagucagucccagcccuguccucaaccaagcugucccccgcugugucuccagggcacucgcucacgaacgcuuggggacucuuggcugcagggagaaugccagagauguagcugcaccccugagggcgugaucugugaagauacagagugcgcagucccagaggccuggacucuaugguccaguuggucagacugccccgugagcuguggugggggaaaccaaguucguacccgggcuugcagggccgcagccccucaucaccgcuccccacccugucugggcccugauacacagaccagacagcagccaugccccggcuuacucgaggcuugcucuugggggccguggggaccuugcagucggagcugugguccaggccuggcguccaggucagggucuugccccuguuugauggccaaggcagacccuacuugcaauucgacguuucuucaucuggauacacaaggauguuacagcggccccugcccagaagaaugcgugugguccaguuggucuagcuggacccgauguucaugcagaguccucgugcagcagcgcuaucggcaccaggguccggcuuccagaggggcccgugcaggagcccccuguacuagacuggacggccacuuccgcccuugcuugauaagcaacuguucugaggauaguugcaccccacccuuugaguuccaugcuuguggcuccccuugcgcggggcugugugccacacaccuaucacaucaacucugccaggaccuuccacccugucagccuggaugcuacugcccaaaaggucuguuagaacaagcaggcggguguaucccgcccgaggaaugcaauuguuggcacacuagcgcugccggagccggcaugacccuggcuccuggugauaggcuccagcuggggugcaaggagugugaaugccggcgaggagaguugcauuguacaucucagggcugccagggccuucugccacucucggagugguccgaauggagucccugugggccuugccugccacccagcgcacuagccccggcuucaagaacggcguuggaggaacacuggcugcgcgacccuaccggacucucucccacucuugccccacuguuagcauccgagcaacacaggcaucggcugugucucgacccugccacagguagacccuggaccggcgcuccacaccugugcacugcaccuuugagccagcagcgucuuugccccgauccgggggccuguccagacaguugccaguggucacuguggggacccugguccccuugucaaguaccaugcagcggcgguuuccgccucagguggcgggaagcugaggcccugugugggggcggaugccgagagcccugggcacaggaaucuuguaacggcgggccuugcccagagugugaagcgcaggauacaguuuuuacccuagacugcgccaaucaguguccccauaguugcgcugauuuaugggacagagugcaaugccugcagggaccuuguaggccggguugccgcugucccccaggccaguugguccaggaugggcggugcgugccuauuagcuccuguagaugcggacuccccucugccaacgcaucaugggagcuggcuccagcccaagcggugcagcuugacugucagaauugcacgugugucaacgaaagccugguuugcccucaccaagagugucccgugcucggcccgugguccgccuggucgucuugcagugcuccaugcggugggggcaccauggagcgacacaggacaugugaaggaggcccugggguagcacccugccaggcccaggauacugagcagcggcaagaauguaaucugcagccaugcccugagugucccccaggacagguguugagcgcuugcgcaaccucauguccgugccuuuguuggcaucugcagcccggugccaucugcguccaagagccuugucagccaggcugcgggugccccggaggccagcuacuccacaacgguacaugugugccucccacugccugcccauguacccagcauucccugccuuggggguuaacacugaccuuggaggaacaagcucaggaacucccgcccggcacuguucugacgcgcaauugcacaagaugugugugccacggaggcgcauucucuuguagccuugucgacugccaggugccaccuggggagaccuggcaacagguagcccccggagaacugggccucugugagcagacuugcuuggagaugaacgcgaccaaaacacaguccaacuguaguucagcucgugccagcgguugcguuugccaaccagggcauuuuaggucucaggcaggaccuugugugcccgaagaucacugcgaguguuggcaccugggccggccacaucuuccugguuccgaauggcaggaggccugcgaaaguugucugugcuuaagcggcagaccggucuguacgcagcacugcucaccccuaaccugugcucaaggggaggagauggugcucgaaccaggaucuugcuguccuuccugccgcagggaggcccccgaggaacagucgccaagcugccagcugcugacugaauugcgaaauuucacaaagggcaccuguuaucucgaccagguugaggugaguuacugcuccggguauuguccuucuucaacucaugucaugcccgaggaaccguaccugcaaagccagugcgauuguugcuccuaucggcuugaccccgagucuccagugcggauucugaacuuacgcugucucggaggccacacagaaccuguagugcugcccgucauccauagcugccaguguaguucaugccaggguggggacuuuuccaagagguga

SEQ ID NO: 63242 - RNA, 861 nt, Artificial Sequence
  derived and/or modified sequence opt3 from SSR1__Homo_sapiens__NP_003135
augagacugcuccccaggcuucuguuguuacugcuacucguguucccugccaccguccuguuucggggcgggccacgcggacuucuggcuguugcacaagacuugacagaggaugaagagacuguggaagacagcaucauugaggaugaagacgaugaggccgagguagaagaggacgaaccgacggaucucguggaggacaaggaggaagaggaugucuccggugaacccgaggcgucuccuucagcugacaccacaauacuguucgugaaaggcgaagauuuuccagccaacaauaucguuaaguuccuggugggguuuacuaacaaaggaaccgaggacuucauugucgagagucucgaugccagcuuucgauacccccaagacuaucaguucuacauccagaauuuuacagcauuaccucugaacaccgugguaccaccccagcgucaagcuacuuucgaauauuccuuuauuccugcagagccaaugggcgguagaccguucgggcuuguuaucaauuugaacuacaaggaccugaauggaaacguguuucaggaugccgucuucaaucagacagugaccgugauagaaagggaggacggccuagauggcgaaacgaucuucauguauauguuucucgcugggcugggacuucuggucauuguugguuugcaccagcuccuggagucucggaaacgcaagagacccauccaaaagguggagaugggcacuucgucacagaacgacguagauaugagcuggauuccucaggaaaccuuaaaucagaucaacaaagccaguccaaggcggcugccccgcaagcgagcgcagaaaagauccguggggucugacgaguga

SEQ ID NO: 63243 - RNA, 609 nt, Artificial Sequence
  derived and/or modified sequence opt3 from SSR2__Homo_sapiens__XP_011508225
augcugacccucagcuccugccuuuguggcucugggaaggccuucggaaugcccacaaugagacuguugucauuuguggucuuagcucuguucgcaguuacucaggccgaggaaggugcgaggcuacucgcuaguaaaagccugcuuaaccgguacgccguggagggccgcgaccugacguugcaauauaauaucuacaacguaggguccucugcagcccucgauguggaacugucggacgauucauuuccuccagaggacuucggaauugucagcggcaugcugaaugugaagugggaucgaauagcuccggcaaguaacguuucccauaccgugguccuccgucccuuaaaagccgguuauuuuaauuucacaucugcuacuaucaccuaccuggcccaggaagacgggccugugguaauuggaagcacauccgcgccaggccagggcgggauccuugcacagagagaguuugauaggcgguucucaccccacuuuuuggacugggccgcuuucggaguuaugacccugccuaguauugguaucccacuacuccugugguauagcucuaagcgcaaauacgauacucccaagacaaagaaaaacuga

SEQ ID NO: 63244 - RNA, 2130 nt, Artificial Sequence
  derived and/or modified sequence opt3 from SSRP1__Homo_sapiens__NP_003137
auggccgagacccuggaguucaacgacguguaccaggaagucaagggcagcaugaaugaugggagacucaggcuuucccggcaaggaaucauuuuuaaaaacucuaagacagguaaaguugacaauauacaggcuggcgaacugacugaggggaucuggcgccgaguggcauugggacacggcuuaaagcugcuaacgaaaaacggucauguauauaaguacgauggguuccgugaaucagaguuugagaagcucagugacuucuuuaaaacccacuauagacuggaacuuauggagaaggaucugugcgugaaaggauggaauuggggcacagucaaguucggcgggcaguugcucagcuuugacauuggagaucagcccguguucgaaaucccucuguccaacguuucucaauguacuaccgguaaaaaugaggugacacuggaguuucaucagaacgacgaugccgaagucucgcucauggaggugagguucuacguaccaccgacccaggaagacggcguugaucccguggaggcguuugcucagaaugucuuaucaaaggccgacgugauucaagcaacuggggaugccaucugcauauuccgggaacugcagugucuuacaccucgcggaagauaugacaucaggauuuacccaaccuuuuugcaucugcacggcaagacguucgacuauaaaauccccuacacuaccgugcuaagacucuuccugcuuccucacaaggaucagcgccagauguuuuucgucauuagccuggacccacccaucaaacaaggucagacacgauaccacuuuuugauacuccuguucaguaaggaugaggacauuuccuuaacucugaacaugaaugaggaagagguugaaaaacgguuugaggggaggcucaccaagaacaugucuggaagccuuuaugaaauggugucccggguaaugaaagcucuggugaaucguaagaucacagucccuggcaacuuccagggccauucaggggcacaaugcauuaccuguaguuacaaggccagcucuggauugcuauauccacuggagcgcgguuuuaucuacgugcacaaaccgcccguucauaucagauucgaugagauuuccuuugugaauuucgcuaggggcacgacuacaacccggucauuugacuucgaaauagagacuaagcaggggacacaguauaccuuuagcaguaucgaacgagaggaauacggaaaacucuucgauuucgucaacgccaagaaacugaacauuaagaaucgcggccuuaaggaggguaugaacccuucuuaugacgaguacgcggauuccgacgaagaucagcacgacgcauaccuggagagaaugaaagaagaggggaagaucagggaggaaaaugccaacgacagcucggaugacucuggcgaggaaacggaugaguccuuuaauccaggagaagaggaggaagacguggcugaggaguucgauucaaacgccagugcaagcuccucuagcaaugaaggcgacucagaucgggacgagaaaaagcgcaaacaauugaagaaggcuaaaauggccaaggauagaaaaaguaggaagaaacccguagaaguuaagaaggggaaagacccuaacgcgccaaagcgucccauguccgccuauaugcucuggcugaaugcaagccgggagaaaauaaagucugaucacccgggaauuucaaucaccgacuuaaguaaaaaggcuggugaaaucuggaaaggcaugagcaaggagaagaaagaagagugggaucgaaaggccgaagacgcuagaagggacuacgagaaagccaugaaggaguaugaagggggacgcggcgaguccucuaaacgggauaagucgaagaaaaagaaaaaggugaaagucaagauggaaaagaaaagcacaccuuccagagguucaaguucuaagagcuccucaaggcagcugagcgagucuuuuaaauccaaggaguucgugaguagcgacgaaucuuccucaggggagaacaaaaguaagaagaaacgccgacggagcgaagauucggaggaagaggagcuagcauccacucccccaucuagcgaagacucagccaguggcuccgaugaguga

SEQ ID NO: 63245 - RNA, 600 nt, Artificial Sequence
  derived and/or modified sequence opt3 from SSSCA1__Homo_sapiens__NP_006387
auggcccugaacggcgcugagguggacgauuucagcugggaacccccuaccgaggcagaaacaaagguccuccaggccagaagggagcggcaagaccgcaucucccgacuuaugggggauuaccuguugcguggauauagaauguuaggugaaacuugcgcggacuguggcacgauucugcuacaggauaaacagaggaagauauacugcguugcuugucaggagcucgacucugauguggacaaagauaauccagcccugaacgcacaagccgcucuuucacaggcacgggagcaccagcuggccagugcuagcgaauugccgcucgggucccgccccgccccucagccacccguaccuagaccagagcauugcgaaggagcggcagccggccugaaggcugcccaaggucccccugcaccagcugugccgcccaauaccgacgucauggccuguacacagacugcgcugcuccagaaauuaaccugggccucugcagagcuggggucgucaacaagccuugagaccaguauccaguugugcggacugauuagggcuugugccgaagcucuacggucccuccaacagcugcagcacuga

SEQ ID NO: 63246 - RNA, 351 nt, Artificial Sequence
  derived and/or modified sequence opt3 from SST__Homo_sapiens__NP_001039
augcugagcugcagacuccagugugcccuugcugcacuguccaucguguuggccuuaggcugcgucaccggggcgcccucugacccuaggcugcggcaauuccuacagaagucacucgcugccgcagccggaaaacaggagcuggcuaaguacuuucuugcagaacuguugagugagccaaaccagacagaaaaugaugcccucgagccggaagaccugagccaagcugccgagcaggaugagaugcgccuggaacuccagcgauccgcgaacucuaaucccgcaauggccccucgugagagaaaagcugguuguaagaacuucuuuuggaaaacuuucacgucgugcuga

SEQ ID NO: 63247 - RNA, 1176 nt, Artificial Sequence
  derived and/or modified sequence opt3 from SSTR1__Homo_sapiens__NP_001040
auguuccccaacggcaccgccagcuccccuucuucaaguccaagcccgucccccgggucuugcggagaggguggcgggucgagaggaccuggcgcuggugcagccgacgggauggaagaaccaggaaggaaugcgucacagaacggcacacugagcgaaggccaagggagugcuauccucauuuccuuuauauacucuguggucugucuuguuggacugugcgguaauagcauggugaucuauguaauuuugcgguacgccaagaugaaaacugcaacgaacaucuauauuuuaaaucuggccaucgcugaugagcuacucaugcuguccgugcccuuccuugucaccucaacacuguugcgccacuggccuuuuggcgcacuccugugucgacuggugcucaguguugacgccgugaacauguucacuagcauauacugcuuaaccguccugucuguggaucguuauguagcuguugugcauccaaucaaggccgcgagauacaggcggcccacagucgcaaaaguggugaaucuuggggucuggguuuugucccugcuagugauucucccuaucguaguguuuucacgcaccgccgcuaacagcgacggaacugucgccuguaauaugcugaugccagaaccggcacagagauggcuugugggcuucguucuguauacauuuuugauggguuuccuccugcccgugggggcuauuugcuuauguuacguccugaucauagccaagaugaggaugguggcgcucaaagccggauggcagcagcggaagcgcagugagcgaaagauuacccuuaugguaaugaugguugugauggucuuugugaucugcuggaugccuuucuacgucgugcaacugguuaacguguuugcagagcaggaugacgcuacgguaucucaguuguccgucauucuaggcuaugccaauagcugugcuaacccaauccuguacggcuuccucucggauaauuuuaaaagaucuuuccagaggauccugugccuuuccuggauggacaacgccgcagaggagcccguggauuauuacgccacugcucugaagucacgggcguauaguguugaagacuuccaaccugagaauuuggagagcgggggaguguuucguaacgguaccuguacaucccgcauuacuacccucuga

SEQ ID NO: 63248 - RNA, 1110 nt, Artificial Sequence
  derived and/or modified sequence opt3 from SSTR2__Homo_sapiens__NP_001041
auggacauggccgaugagccccugaacggcagccacaccuggcucuccaucccuuucgaccuuaaugggucuguggucucaacaaacacuagcaaucagacggaaccauacuaugaucugaccagcaacgcuguuuugacauuuauuuacuucgugguaugcauaaucggauuaugugguaauacucuggugauuuaugucauccuaagauacgcaaagaugaaaaccauuacaaacaucuauauacucaaucuggccaucgcggacgagcuuuuuaugcugggcuugccguuccucgcuaugcaaguggcccugguucauuggcccuuugggaaggcaauuugcaggguggucaugaccguggauggaaucaaccaguucacuuccaucuuuugucugacaguaaugucuauugaccgguaccucgccguugugcacccuauaaaaucggcuaaguggcgccgaccacguaccgcaaaaaugauuacgauggccgucuggggcgugucauuacuggugauccuucccauuaugaucuaugcugguuugagaagcaaucagugggggaggaguuccugcacuaucaacuggccuggagaaucuggcgccugguacaccggcuucauuauauacacauuuauccugggguuccuagucccacucacuauuaucugucugugcuaucuuuuuauaauuaucaagguuaagagcuccggaauccggguggguucaaguaaacgcaagaaaagcgagaagaaaguaaccagaauggugucuauugucguggcgguuuucaucuuuuguuggcugcccuucuacauuuucaauguguccucagucagcauggcaauaaguccuacaccagccuugaagggcauguuugauuucgugguaguucucaccuaugcuaacucuugcgccaauccgauccuguacgcauuuuuauccgacaacuucaagaaaaguuuucagaaugugcugugucucgucaaggugucggggacggaugacggagaaaggucugauuccaaacaagacaagucacggcuuaacgagacuacagagacccagcgcacucuguugaacggcgaucuacagacaaguauuuga

SEQ ID NO: 63249 - RNA, 1257 nt, Artificial Sequence
  derived and/or modified sequence opt3 from SSTR3__Homo_sapiens__XP_005261778
auggacaugcugcaccccagcuccgugucuaccacaucagagccugaaaacgccaguagcgcuuggccaccggaugcaacucucggcaaugucuccgccgggcccucuccugcgggacuugcuguuucgggugugcugaucccauugguauacuuaguggucugcgugguuggccugcuagggaacucacucgugauuuaugucgugcugagacauacggccagccccaguguaaccaauguuuacauacuuaaccuggcauuggccgacgaacucuucaugcugggacugccuuuucucgcugcacagaaugccuuauccuauuggccauucggcucucugauguguaggcuugugauggcugucgaugguaucaaccaauuuacaagcauuuucugcuugacugugauguccguggaccgguaccuggccgucguucaccccacccgcucagcgcgauggcguacagcaccuguggccagaaccguaagugcugccgugugggucgcaagcgcugugguugugcuaccagucgugguauuuucugggguuccgaggggaauguccacuugucauaugcaguggcccgaaccugccgcggccuggcgggcaggcuucaucauuuauacagcugcccucggcuuuuucgggccacugcuugugaucugccuguguuacuugcucauagucgugaagguccgcucagcuggaagaagggugugggcccccagcugccagcggcgccgaagaagugagaggcggguuacccguauggugguagcagucguggcccuguuuguuuuauguuggaugccuuucuaugugcugaauaucgucaacgugguaugcccacuccccgaggagccggcguuuuucggucuuuacuuucuggugguugcuuugccuuacgcaaauucuugugccaaccccauucuauauggcuuccuguccuaccgcuucaaacagggguuuagaaggguccuccugcggccaagccgacgcgugagaucgcaagagccuacggugggacccccagaaaagacugaggaagaggaugaggaagaggaagacggcgaggaaucuagggagggugggaaaggaaaggagaugaauggccgggucucccagaucacccagcccggcacaucagggcaggaacgcccuccaaguagaguugcuagcaaagagcaacagcuucugccgcaggaagccuccacuggagagaagucuagcaccaugaggauuucauauuuguga

SEQ ID NO: 63250 - RNA, 1167 nt, Artificial Sequence
  derived and/or modified sequence opt3 from SSTR4__Homo_sapiens__NP_001043
augagcgcccccuccacccugccuccaggcggggaggaaggacucgguacagcuuggccgucugcagccaacgcgucaagugcucccgccgaggcagaagaggccguggcuggcccuggggacgcaagagccgcuggaauggucgccauccagugcauuuacgcgcuuguuugucuggugggcuugguagguaaugcauuagugauauucgucauccugagguaugccaagaugaaaacugcuacgaacauuuaccuacucaaucuggccguggcagaugaacuuuuuaugcugagcguuccauucguggcuuccucugccgcguugcggcacuggcccuuugggucgguccucugccgcgccgugcugucaguagacggacugaacauguucaccagcguguuuugucucacaguuuuaagugucgaucgauauguggcagugguccauccucugcgugcugccacuuacagaaggccauccguugcuaaacuuaucaauuugggcguguggcuggccucucuacucguaacccugcccauugcaaucuucgccgacacacggccugcucgcggcgggcaagcgguggcaugcaaccuucaguggccacacccggccuggagcgcugucuuugugguuuauaccuuccuguugggauuucuccugcccguguuagccauaggucuguguuaccuccuuaucgucggcaagaugagagcaguggcccugagggcuggguggcagcagcggcgccgauccgagaagaaaauuacuagauugguacuaaugguuguggucguguucguccugugcuggaugccuuuuuaugugguucaacuccugaaucuuuucgugacaucacuggaugccaccguaaaccaugucaguuugauccucagcuacgcaaauucuugugcgaacccaauucuguacggauuuuuauccgacaauuucaggcgguucuuucagcgugugcugugccuacgcuguugccuccuggagggcgcugguggggccgaagaggaaccccuugauuauuacgcaacggccuugaagucaaagggaggcgcuggcuguaugugcccuccacugcccugccagcaggaggcccuccaaccggagccugggagaaaaaggaucccccugacucggaccacaacuuucuga

SEQ ID NO: 63251 - RNA, 1095 nt, Artificial Sequence
  derived and/or modified sequence opt3 from SSTR5__Homo_sapiens__NP_001166031
auggagccccuguucccugccagcaccccauccuggaacgcuucuucaccgggcgcagccagugggggaggugacaauagaacacucgugggccccgcgccuagcgcuggggccagggcaguccuuguuccagugcuguacuuguuaguaugcgccgcuggacugggcgguaacacucuagugaucuaugucgugcuccgguuugcaaagaugaaaacgguuaccaauauuuacauacugaaccuugccguggcugauguccuguauauguuggggcuccccuuccuggccacacagaaugcggcauccuuuuggccuuucggaccagugcugugucgccucguaaugacuuuagacggcguuaaccaauuuaccucuguguucugccugacagucaugucgguggaucgauaccuugccgugguccaccccuugucaagcgcucguuggagaaggccucggguugccaagcuggcaagugcugccgcgugggugcuaucccucuguaugucucugccacuucugguauuugccgacgugcaggaaggcgggaccugcaaugcaagcuggccggagcccgucggauuguggggugcuguguucaucauuuauacugccguucucggcuuuuucgcuccucuguuagugaucugucugugcuaccuccuuauugucgugaaaguacgcgccgcagggguuagagugggaugugucaggcggcgcuccgaacgaaaggugacaagaaugguccuggugguuguguugguauuugccggcugcuggcuaccauucuuuaccgucaacaucgugaaucuggcuguugcgcucccccaggagccugcaucagccggucuguauuucuucguggucauacuuaguuacgcuaacagcugugccaauccagugcuguacggguuuuugucugauaacuucaggcaguccuuucaaaaaguacucugccugcggaagggaucaggcgcaaaggacgccgaugcuacggaaccccguccggaccgcaucagacagcagcaggaggccacuccucccgcacauagggcggcugccaauggcuuaaugcaaaccagcaaacuguga

SEQ ID NO: 63252 - RNA, 1128 nt, Artificial Sequence
  derived and/or modified sequence opt3 from SSUH2__Homo_sapiens__NP_001243677
auggacagagaucugaacgaggacgauagcguggucgaccucuccuucgaagccgagucuccccuugcuccuccaaccgaacuguuggagagguuaccgucauacgauuggcugcuacagggcgggcggggacaaaucuuuuucccuccccucgaagcaccaggucgcccccaggagcagcgaaguuggccuagcuuucuggagcaccguguuccagccaugacagaagagguggcgagagaagcccuucuguccuucguagacucuaagugcuguuauucgucaacuguggcuggcgauuuggucauucaggagcucaaaaggcaaacgcugugccgguaccgccuggagaccuuuagcgaaaguagaauauccgaguggacauuccagcccuuuacuaaucauucuguggacgggccucagaggggagcaagcccacggcucugggauaucaagguucagggcccgcccauguuccaagaagacacccgcaaauuucaggugccucacuccucauuagucaaggagugucauaaaugccacggucgagggagauauaaguguaguggaugccauggcgccggcacagugagguguccaagcugcuguggggcuaagcggaaagcaaagcagucucgucgcugccagcugugugccggauccgguagaaggcggugcucaaccugcagcggccgagggaacaaaacuugugcuacaugcaagggagaaaagaaacuuuugcacuucauucaacugguaaucauguggaagaauagucuauuugaguucguuucugagcaccgccucaacugucccagagaacugcuugccaaagcgaagggcgagaaucuguuuaaagaugaaaacuccguggucuacccuauuguggacuucccauugagggauaucagccucgcaucgcagcgggguauagccgagcauucugcugcccuggcaucccgcgcuagaguguuacagcaaaggcagaccaucgaacugauuccccucacggagguccacuauugguaccaggggaagacuuauguuuacuacaucuauggaaccgaccaucagguguacgccguagacuauccggagcguuacugcuguggcugcacaauuguguga

SEQ ID NO: 63253 - RNA, 567 nt, Artificial Sequence
  derived and/or modified sequence opt3 from SSX1__Homo_sapiens__NP_005626
augaacggcgacgauaccuucgccaagagacccagggacgaugcuaaagcaagcgagaagcgguccaaagccuuugacgauaucgcgacauacuucucuaagaaagaauggaagaagaugaaauauucagagaagauuaguuacguguauaugaaacgcaauuacaaggcuaugacuaaacugggguuuaaggucacgcucccuccauucaugugcaacaagcaggccaccgacuuucaaggaaaugauuucgacaacgaucacaaucgacguauacagguugaacauccgcagaugacauuugguagacuucacaggaucauucccaaaaucaugccuaagaaaccagcagaggacgaaaacgauagcaagggcguguccgaggccucugggccccagaaugacggaaaacaacugcauccuccaggcaaggcuaacauuucggagaaaaucaauaagcggucaggucccaagcgcgggaaacacgcauggacucauagauugagggaacggaagcaguuaguaauauaugaggaaaucagcgauccugaggaggacgacgaauga

SEQ ID NO: 63254 - RNA, 567 nt, Artificial Sequence
  derived and/or modified sequence opt3 from SSX2B__Homo_sapiens__NP_001157889
augaacggcgacgaugccuucgcuagaaggcccaccgugggggcacagaucccugagaagauucaaaaagccuuugacgauauagcgaaguacuucagcaaagaagagugggaaaagaugaaggcuuccgagaaaaucuuuuaugucuacaugaagcggaaauaugaagccaugacaaagcugggauucaaagcaacucucccaccguuuaugugcaauaagcgcgccgaggacuuccaggguaacgaucuugacaaugaucccaaccgaggcaaucagguugagcguccucagaugacguuugggagacugcaaggaauuucuccaaaaaucaugcccaagaagccugcugaagagggcaacgacucagaagaggugccagaggcaagugguccccagaaugaugggaaagaauuguguccuccaggaaagccgaccacaagcgagaaaauucacgaaagguccggccccaagcggggcgagcaugccuggacucaccgcuuaagagaaaggaaacagcugguaaucuacgaggagauaucugacccugaagaggaugacgaauga

SEQ ID NO: 63255 - RNA, 1521 nt, Artificial Sequence
  derived and/or modified sequence opt3 from SSX2IP__Homo_sapiens__XP_011538914
augggagacuggaugaccgugacagaucccgggcugagcuccgagucuaagacuaucucacaguacacgagugaaaccaaaaugagcccuuccucucucuauucgcaacagguccuuugcucaagcauuccacugaguaagaacguucacuccuucuuuucugccuucuguacagaggacaauauagaacagagcaucuccuacuuggaucaggaguuaacuaccuuuggauucccgucacuguaugaagagaguaaagguaaggagacaaaaagagaacuaaacauuguggcuguacucaauugcaugaacgagcugcuugugcugcaaaggaagaauuugcucgcacaggaaaacgucgagacccagaaucugaagcugggcagcgacauggaucaucuccagucuuguuacuccaaauuaaaggagcaacuggaaacuucacggcgcgagaugaucgggcuucaggaacgagaccgucaguugcagugcaaaaacagaaaucugcaccaacuacucaagaacgagaaagaugaagugcagaagcugcagaauauuaucgccagcagggcgacacaauauaaccaugacaugaagcggaaagagcgcgaguacaauaagcugaaagaaagacugcaccaguugguuaugaacaagaaagauaagaaaauagcuauggacauccucaauuaugugggaagggccgauggcaagcgggguaguuggcgcaccgggaagacggaggcacgaaacgaagacgagauguacaaaauucuguuaaacgauuacgaauauagacagaagcagauccugauggagaaugccgagcucaaaaagguccuucaacagaugaaaaaggaaaugauuucucuguugagcccccagaagaaaaagccuagggagcggguggacgacuccacuggaaccguaaucucggauguugaagaggacgcuggcgaacuaucucgugaguccaugugggaucugucaugugagacagugcgcgaacagcucacuaacaguauaagaaaacaauggaggauucuuaagagccaugucgagaaacuugacaaucagguguccaaggugcaccuggaaggcuuuaacgaugaggacgucaucucucggcaggaucacgagcaggaaaccgagaaguuggaacucgagauucaacagugcaaagaaaugaucaagacacagcagcaacuguuacagcagcaacuggcaaccgccuacgacgaugacacgacuagccuacuccgagauuguuaucugcuugaggagaaagaacgcuugaaggaggaauggucacuguucaaagagcagaagaagaauuuugaaagagagaggcggaguuucacagaggcugccauccgccucgggcuggaaagaaaagcguuugaggaagagagggcauccuggcuuaagcagcaguuccugaacaugaccacuuuugaccaucaaaauagcgaaaacguuaaauuguucucugccuuuucaggcauucagaguauguacuga

SEQ ID NO: 63256 - RNA, 567 nt, Artificial Sequence
  derived and/or modified sequence opt3 from SSX4B__Homo_sapiens__NP_001030004
augaacggcgacgaugccuucgcuagaaggccccgggacgaugcacagaucagcgagaagcugcgcaaagccuuugacgauauugcgaaguacuucuccaaaaaggaaugggagaaaaugaagucuucagaaaagauaguguaugucuacaugaaacucaauuaugagguuaugaccaaacuuggguuuaaggugacacugccuccauucaugcgaaguaagcgugcugccgacuuucacggaaacgauuucgguaaugacagaaaccauaggaaucaaguagaacggccgcagaugacuuuuggcagcuugcagcgcaucuuccccaaaauuaugccuaagaagccagcagaggaggaaaacggguuaaaagaggugcccgaagccuccggaccucagaaugauggcaagcaacugugcccacccgguaacccuucuacgcuagagaaaaucaauaagaccucggggccaaaaagaggaaagcacgcuuggacacauaggcuccgggagcgcaaacagcuggucguguacgaagagauuucagacccggaagaggaugacgaauga

SEQ ID NO: 63257 - RNA, 690 nt, Artificial Sequence
  derived and/or modified sequence opt3 from SSX5__Homo_sapiens__NP_066295
augaacggcgacgaugccuucgugagaaggccccgggucgggagccagaucccugagaagaugcaaaaacacccauggcgccagguuugcgaccgagguauucaucuggugaaucucuccccguuuuggaagguaggacgugaacccgcuucuucaauaaaagcacuucuguguggcagaggggaggccagggcguucgaugacaucgcuaaguacuuuagugaaaaagagugggaaaagaugaaggccagcgagaaaauuaucuauguguacaugaagcggaaauaugaggcaaugaccaaguugggauucaaagccacauuaccuccauuuaugcgcaacaagagagucgcugauuuccagggcaaugacuuugauaacgaccccaauagggguaaccagguggaacacccucaaaugacuuucgggcggcugcagggaauuuuuccaaagaucacgcccgagaaaccugcagaagagggcaaugauuccaagggcguuccagaggccucugggccgcagaacaauggaaaacagcuacgccccucggguaagcucaacaccucagaaaaagugaauaagacaagcggcccuaaacgagggaagcaugcuuggacucacagagucagggagcggaagcaacuggugauauacgaagagaucagugacccacaggaagaugacgaguga

SEQ ID NO: 63258 - RNA, 1110 nt, Artificial Sequence
  derived and/or modified sequence opt3 from ST13__Homo_sapiens__NP_003923
auggaccccagaaaggugaacgagcugagggccuucgucaaaaugugcaagcaagauccuagcguucuccacaccgaagagaugcgguuucuucgcgaauggguggaguccaugggcgggaaaguaccaccggcuacacaaaaggcaaaaucugaagagaauacuaaggaggaaaagcccgacaguaaaaagguggaggaagaucugaaagccgacgagccuucaagcgaggaauccgauuuggagaucgacaaggaaggagucauugagccagauacggacgcgccccaggaaaugggugaugagaacgcugagauaaccgaagagaugauggaccaggccaaugauaaaaagguggcagccaucgaggcuuuaaacgacggcgagcugcagaaggcaauugaucuauucacagacgccaucaaacucaauccucgacuggcuauucuuuacgccaagcgugcgucuguuuuugugaaacugcaaaagccaaacgcagccaucagagacugugauagggcuauagaaaucaaucccgacucggcccagccuuauaaauggcgggggaaggcacaucgcuugcucggacacugggaggaggcugcccaugaucuggcgcuggccugcaaacucgacuacgaugaagacgcaucagcuauguuaaaggagguccagccaagagcccagaagauugcugaacacaggcggaaauaugagcgcaagcgagaagagagagagaucaaagaaaggauugagcgggugaagaaagcccgugaagaacaugagcgcgcacaaagagaagaggaagccaggcggcagagcggcgcucaguacgguaguuuccccgggggauuuccgggcggcaugccugggaacuucccaggagguaugcccggcaugggagggggcaugccugguauggcggggaugccaggacugaaugagauccuuuccgaucccgaaguauuggcagccaugcaggacccggagguuaugguggcuuuucaagaugucgcccagaacccugcaaauaugucuaaguaucagagcaaccccaaggugaugaaucugauauccaaacuaucagccaaguucggcggccaggcuuga

SEQ ID NO: 63259 - RNA, 2568 nt, Artificial Sequence
  derived and/or modified sequence opt3 from ST14__Homo_sapiens__NP_068813
augggcagcgacagagccaggaaagggggagguggccccaaggauuucggggcuggacugaaguacaacucccggcacgagaaagugaauggccucgaagagggugucgaauuucuuccuguuaacaaugugaagaaaguagagaagcaugggccaggacgcugggugguccuggcagccguguugaucggcuuacugcuaguucuccugggcauuggguuccuuguguggcaucugcaguaucgagacguccgugugcaaaagguauuuaacggauacaugagaauaaccaaugaaaacuucguugaugcguaugaaaauucuaacucaacagaguuugugaguuuggcuagcaaagucaaggacgcccucaaacugcuguacuccggugugccguuccucggccccuaucacaaggaaucugcagugacugccuuuucggaggggucagucaucgcuuacuauuggagcgaguucaguauuccucagcacuuaguugaggaggcagaaagggugauggccgaggaacggguagugaugcugccaccccgcgcuagaucccuuaaaucuuuugucgugacgagcguuguggccuucccuaccgauuccaagacaguccagaggacucaggacaauucaugcaguuuuggauugcaugcgcggggcguggagcugaugcgcuucaccacaccagguuuucccgauagcccuuacccagcacacgcccgaugucaaugggcucuaagaggggacgccgauucuguacucucccugaccuucaggucauucgaccuugcaagcugcgaugaacggggaagugaccugguuacuguguacaacacauugucuccgauggagccccacgcucucguccagcuguguggcaccuauccuccauccuacaauuuaacguuucauagcucgcagaacgugcugcucaucacucuuauuaccaauacagagcgucgccaccccggcuucgaagccaccuuuuuccagcugccuagaaugucuuccugcgggggaagguugcggaaggcgcaagguacuuuuaacucaccauauuaccccggccauuauccgccuaauaucgauuguacauggaacauagagguccccaacaaucagcacgugaaaguucgauucaaguuuuucuaccuacuggaaccaggggugccugccggaaccugccccaaagacuauguagagaucaacggcgaaaaguacuguggugagcgcagucaguuugucgugacgagcaauuccaacaaaauuacuguuagauuccacucugaccagagcuacacagauaccggguuucucgcagaguaucugucauacgacaguuccgauccaugccccggccaauucacuuguaggacaggacggugcauccgcaaggaacuuagaugugacggcugggcugauugcaccgaccauagcgaugagcugaauugcucuugugacgccgggcaccaguuuacgugcaaaaacaaguucuguaagccuuuguucugggugugcgauucagucaaugacuguggagauaacagugacgaacaggguugcagcuguccagcucaaaccuuuaggugcuccaauggcaaaugucucucuaagucgcagcagugcaacgggaaagacgauuguggagacggcagcgaugaggccuccugcccgaaggugaauguagugacaugcacuaaacauaccuaucguugucugaacgguuuaugccugucaaaggggaaucccgaaugugacggcaaggaggauugcagugacggaucugaugagaaagacugugauugcggccuacggagcuucacacgacaggcaagaguugucgggggaacugacgccgaugaaggugaguggccuuggcaagugucccuccacgcucugggccaggggcauauuuguggagcgucacuuaucagcccaaacugguuggugucugcagcccacugcuacauagacgauaggggcuuucgcuauuccgaccccacccaguggacagcuuuccugggucuccacgaccagagucaacggagcgccccugggguccaggaaagaaggcugaagcgcauuaucucucauccauuuuucaaugauuuuaccuucgacuacgauauugcacuucuggaguuggagaaacccgccgaauauuccucaaugguucgaccgaucugucucccugacgcuagucacguguuuccagccggcaaggcaaucugggugacuggauggggccauacgcaguacgggggaacaggcgcgcugauuuuacagaaaggugagauacggguaaucaaccaaaccacuugcgaaaaccugcuaccccagcagauuaccccucguaugaugugugucggguuccucagcggaggcguggauucgugccagggugacuccggcgggccccugucuagcguugaggcugauggaagaaucuuucaagccggcguggucucauggggagacgggugcgcacagaggaauaagccaggcguguacacacgccuuccuuuguuccgggauuggauaaaggaaaacaccgguguuuga

SEQ ID NO: 63260 - RNA, 3144 nt, Artificial Sequence
  derived and/or modified sequence opt3 from ST18__Homo_sapiens__NP_055497
auggacgccgaggcugaagauaagacccugagaacaaggagcaaaggcacugaggugcccauggacucccucauccaggaacuuucugucgcauacgauugcucaauggccaagaaacggacggcggaggaccaagcucuggggguuccugugaacaagcgcaaaaguuuguuaaugaagccacgacacuauagcccgaaggccgauugucaggaagaccguuccgauagaaccgaggacgauggaccccuggagacacauggucacucuacugcagaagagauuaugauaaaaccuauggacgaaucgcuacucucaaccgcccaggagaauagcaguaggaaggaggaucgguacuccugcuaucaggaacugaugguaaaaucucuuaugcaucugggcaaguucgagaaaaacgugagcguccaaacaguguccgaaaauuugaacgacucagggauccagagucucaaggcugagagcgaugaagcagacgaguguuuucugauucacucugacgauggacgcgacaagaucgaugacucccagccacccuucugcucaagcgaugacaaugagaguaacucugaauccgccgagaauggcugggauagcgguucgaacuuuucugaagagaccaaaccuccaagaguucccaaguacgugcugacugaccauaaaaaggaucucuuagaagucccugagauuaaaacagagggggacaaguucaucccaugugaaaauaggugcgauuccgagaccgaacggaaagacccgcagaacgcucuggccgagccccuugacggaaaugcgcaaccuucauuuccagauguggaagaggaggacagugaaagccuugcaguaaugacggaggaaggcuccgaucuggagaaggccaagggcaaccuaucucuccuggagcaggcuauagcccuucaggcagaacgcggguguguuuuccacaauacuuauaaagagcuggaccgauuuuugcucgaacaccuggcuggagagagaaggcagaccaaggugaucgauauggguggccggcaaauuuucaacaauaaacauagcccccguccugaaaagcgcgagacaaaaugcccaauccccgggugugacggaacuggccacgucaccgguuuauacccgcaucacagaucacugagugggugcccucacaaggugagggugccccucgagauucuugccaugcaugaaaacguccugaaguguccaacaccuggaugcaccggccggggccacguuaacuccaaucgaaacacgcaucgcagcuugucugggugccccaucgcggccgcagagaaacuagcuaugucacaggauaagaaucagcuggacaguccacaaacuggacagugucccgaucaggcccacagaacaagccucgugaaacagauagaauuuaacuucccuucccaagcuauuaccucuccaagggccacuguaucgaaggagcaggaaaaauuugguaaggugccguucgacuaugcuagcuuugaugcccaggucuucggcaagcggccccugauccagacagugcaagggcgcaaaaccccuccauuccccgaguccaagcauuuuccuaauccaguuaaauuccccaacagacuuccgucagcuggagcgcacacgcagaguccuggcagggcaucuagcuacuccuacggucagugcucagaggacacccacauugccgcugccgcagccauccugaauuugagcacacguugucgggaagcuacugauauccucucuaacaagccacagucccugcaugccaaaggggcagagauugaaguggacgagaauggcaccuuagaccugaguaugaagaagaaccgaauacuagauaaaagcgcgccccucacaucuuccaauacuucaaucccuacccccaguagcucgccauuuaagacauccucuauucuggucaacgcugccuucuaucaagcacuuugcgaccaggaaggaugggauaccccuaucaauuacagcaaaacucacggcaagacggaggaggaaaaagagaaggaccccgugucaaguuuggaaaaccuggaggagaaaaaguuuccaggggaagccuccauaccgucuccuaagcccaaacuccaugcuagagaucugaagaaagagcuuauuacauguccaacccccggaugcgacgguagcggccacguaacugggaauuaugccucccacaggucaguuagcggauguccucuggcagauaagaccuugaaaagucucauggcugccaacucucaggaacugaagugcccaacacccggcugugacgguuccgggcaugugaccggcaacuacgcgagccaccgcucguuaucaggaugcccucgggccagaaagggcggggucaaaaugacuccgacaaaggaggaaaaagaggauccagagcugaagugucccgugaucggaugcgacggucagggccauaucucugggaaauauacgagucacaggaccgcuuccggaugcccucuagcagccaagcgccaaaaggaaaauccacucaacggcgcuagccugucuuggaaacuuaauaagcaggaguugccccauuguccucugccggguugcaacgggcucggccacgucaauaacguguucguuacucaccgaagccuguccggaugucccuuaaaugcccaggugauuaaaaagggcaaaguaucagaggaacugaugacaaucaaguugaaggcaaccgggggaauugaaagugaugaggagauacggcauuuggacgaagagaucaaagaacucaacgagagcaaucugaagauugaagcggauaugaugaaacuacaaacacagaucacuucuauggaguccaaccugaagaccaucgaggaagagaauaaacucauugaacagaacaaugagucacugcuuaaggaguuggccggccugagucaggcuuuaauaagcucccucgccgacauccaacugccacagauggguccuauuucugaacagaacuuugaggcauacgucaauacgcuuaccgacauguauucgaaccuggaacgugauuacagccccgagugcaaagcauugcucgaaucaaucaagcaggccgugaaggggauucacguuuga

SEQ ID NO: 63261 - RNA, 240 nt, Artificial Sequence
  derived and/or modified sequence opt3 from ST20__Homo_sapiens__NP_001094349
auggccagaagcaggcugaccgcuacauccgugucucagguccaagagaacggcuucguuaagaaacucgaacccaagucaggguggaugacuuuucuugaggugacgggaaaaaucugcgaaaugcuguucuguccugaggcaauuuuguuaacccggaaggacacaccauacugcgaaacuggucugauauuucuaacccucacaaaaaccaucgccaauacuuauuucuacuuuuga

SEQ ID NO: 63262 - RNA, 1023 nt, Artificial Sequence
  derived and/or modified sequence opt3 from ST3GAL1__Homo_sapiens__XP_005251082
auggugacccugagaaagaggacacucaaaguccuuacuuuccugguuuuguuuaucuucuuaacgagcuuuuuccugaacuacucccacaccaugguggccacaacuugguuucccaagcagaugguacuagagcucucugaaaaucugaaacggcuuauuaagcaucgcccuugcaccuguacacacugcauaggccaacgaaaacugucagcuugguucgacgagcguuuuaaccagaccaugcagccauugcucacugcacagaaugcccugcuggaagaugacacauauagaugguggcucagguuacaacgggagaagaagccgaacaaucugaacgauaccaucaaagaacuuuuccgcgugguccccgggaauguggacccuauguuggagaagagaaguguuggauguaggcggugcgcgguggucgguaacagcggcaaucugcgcgaguccucuuacgggccagaaauugauucgcaugacuuugugcuacgaaugaacaaagcucccacggccggauucgaggcagauguaggcacuaagaccacacaccaucucguuuauccugaaucauuuagagagcugggugacaaugugagcaugauccuugucccauucaaaacuauugaucuggaguggguggugagugccaucaccacagggaccauaucccacacguacauccccgucccugcuaagauuaggguuaagcaggacaaaaucuugauuuaucacccagcauuuaucaaguacguguucgauaacuggcuccagggacauggccgguauccgucuacuggcauacugagcguaauuuucuccaugcacgugugugacgaagucgauuuauacggguuuggagccgacucaaaagguaauuggcaucacuacugggagaacaaucccagugcuggcgccuuccguaagacaggggugcacgacgcggauuuugaaagcaacguuaccgcaacucuggccucuaucaacaaaauucgcaucuucaagggaagauga

SEQ ID NO: 63263 - RNA, 1053 nt, Artificial Sequence
  derived and/or modified sequence opt3 from ST3GAL2__Homo_sapiens__NP_008858
augaagugcagccugagagugugguuccucuccgucgccuuucuucugguuuucaucaugucuuuguuauuuaccuacucacaccauaguauggcuacacugcccuaucuagacagcggcgcacucgaugggacucacagggugaaacugguaccuggauacgccggucuucagcggcuguccaaggagcgcuugucuggcaaaucgugugcgugccgacguuguaugggggacgcuggagccucagauugguucgacagccauuuugauggcaacauuaguccaguguggacgagagaaaauauggaccucccgcccgauguccaaaggugguggaugaugcugcagccucaguucaagucccacaacaccaaugaggugcuggaaaaacucuuucagauaguuccaggugagaaccccuaucgguuccgcgacccucaucaaugcagaaggugugcaguggucggaaauucugggaacuuacggggcagcggcuacgggcaggauguggacggacacaauuuuaucaugcgcaugaaccaggccccaacaguagguuucgaacaggauguuggcucccgaacuacccaccauuuuauguaucccgagucagcuaagaaucugccugcaaacgugaguuucguccuugugccauuuaagguguuggaccugcuauggauugccagcgcucucucuacagggcaaaucagauucaccuacgccccggucaaauccuuccugaggguugauaaggagaaagugcagauuuauaaucccgcguuuuucaaguacauccacgaccgguggacugaacaucacggacguuacccuucaacaggcaugcuuguacuguuuuucgcauugcacgugugcgacgaggucaacguguaugguuuuggggccgauagccgcggaaauuggcaucacuacugggaaaacaauagauaugcuggcgaguucaggaaaaccggcguucaugacgccgauuuugaggcacacauaaucgacaugcucgcuaaggccaguaagauugaaguguaccgggggaacuga

SEQ ID NO: 63264 - RNA, 1002 nt, Artificial Sequence
  derived and/or modified sequence opt3 from ST3GAL4__Homo_sapiens__NP_001241687
auggugagcaaguccagauggaaacugcucgccaugcuugcucuggucuugguugugaugguaugguacucuauaucaagggaggaccgguauauugaauuauucuacuuucccauaccugagaagaaagaaccaugccugcagggcgaggcagaaaguaaggccagcaaacuauucgggaacuauucccgcgaucaaccgaucuuucuccgacuggaggacuacuucugggugaagacccccucugcguaugagcuuccuuacggaacaaaggguucggaagaucuguugcuccguguccuggcuauuacuucaagcaguauccccaaaaauauucagucccugagauguaggcggugcgugguugugggcaacgggcaccgccucagaaauucuagcuuaggagacgccaucaacaaguaugaugucgugauaaggcugaauaacgcaccaguagccggcuacgagggugacguuggguccaaaacgaccaugcgguuguuuuacccugaaucagcucauuucgauccaaagguggagaauaaccccgacacacuucugguccuaguggcauuuaaagccauggauuuccacuggaucgagacuauucucagugacaagaagcgcgugcgaaaaggauuuuggaagcagccuccacugaucugggaugucaauccgaaacagauuagaauccuuaaccccuucuuuauggaaauagcugccgacaagcuguugagccucccuaugcaacagccaaggaaaauuaagcagaaacccaccacaggccuguuagcgaucacccuggcacuccaucuuugugaucugguucacauugccggcuucggguauccugacgcuuacaauaagaagcagacuauccauuauuacgagcaaaucacauugaaaucuauggccggauccggucacaacgugucacaggaagcacuagcuauuaagcggaugcuggagaugggcgccaucaaaaaucucaccagcuuuuga

SEQ ID NO: 63265 - RNA, 1188 nt, Artificial Sequence
  derived and/or modified sequence opt3 from ST3GAL5__Homo_sapiens__NP_001035902
auggccagcgugcccaugccuuccgaauacaccuaugucaagcugagaucugacugcucaaggccaagucuccagugguacacacgggcucaaagcaaaaugcgccgaccgucccuucuguugaaggauaucuuaaaauguacucugcuaguuuucggcguguggauucucuauauacugaagcucaacuacacgaccgaagagugcgacaugaaaaagaugcacuauguagaucccgaccaugugaagcgugcacagaaauacgcccagcagguccugcaaaaggaauguagaccuaaauuugcgaagacaucuauggcuuugcuuuucgagcacagguauucgguggaucugcugccauuuguucagaaagcccccaaggacucagaagcagagagcaaguacgauccuccauucggguuucggaaauucaguuccaaggugcagacucucuuagagcugcuucccgaacaugacuugccugagcaccugaaagccaagaccugccgcagaugugucgugaucggaucugguggcauucuacaugggcucgaacugggacacacacuuaaucaguuugauguaguuaucaggcugaacagcgcuccaguggagggcuacuccgagcacgucgguaauaaaaccacuauucggaugacauauccggaaggggcacccuugucagaccucgaguacuauaguaacgaucuguucguggccguguuauuuaagagcgucgacuucaauuggcugcaagcuaugguuaaaaaggaaacccucccuuuuugggugcgccuuuucuuuuggaagcagguagccgagaaaaucccacugcagcccaagcauuuccgaauauugaacccugugaucauuaaagaaacggcguucgauauccuacaguacucugagccacaauccagauuuuggggaagggacaagaauguccccacuauuggcgugaucgcaguugugcuggccacccaccucugcgacgaggucucacuggcuggcuucggguaugaucuuaaccagccgcggacaccucugcauuacuuugacagccaguguauggccgcaaugaauuuccaaacuaugcacaacgugaccacagaaaccaaauuuuugcucaagcugguaaaggagggaguugugaaagauuuaagugguggcauagaccgugaguucuga

SEQ ID NO: 63266 - RNA, 1155 nt, Artificial Sequence
  derived and/or modified sequence opt3 from ST3GAL6__Homo_sapiens__NP_001258074
auguggcaggcccccagagaaaggcaacagccugcuggcgcagccgcgccacaggugagcgaaccgggggcuccccugcgguccucucuccuuggacuggguggcucauuguuaccugccggguucgcagccggacugcacugcccaggcgagcccgcuaugcgcgguuaccuagucgcaaucuuucucagugccguuuuccuguauuacgugcuucauuguauucugugggggaccaacguauauuggguggcuccugucgaaaugaagcgacguaauaaaauacagccaugcuugagcaagcccgccuuugcgucccuccugagauuccaccaauuucauccuuuccugugugcagccgacuuuaggaaaaucgcuucucucuacggaucggauaaguucgacuuaccauauggcaugcggacaucagccgaguacuuucgccuggcacuuagcaaauugcagaguugcgaucuguucgacgaauuugauaacauuccguguaagaagugcgugguugugggcaaugggggaguccuuaaaaacaagacucucggugagaaaaucgacuccuaugaugugauuaucagaaugaauaacggccccguacuggggcacgaggaagagguuggaaggcggacgaccuuccgccuauuuuacccugaaucuguguucagcgacccaauacauaaugaucccaacacaacugucauccugaccgcuuucaagccucacgacuugcgauggcuccuggaguuacugaugggcgauaaaauuaauacaaacgguuuuuggaagaagccagcccucaaucuuaucuacaaacccuaucagauuagaauccuggacccguucauaauuaggaccgcggccuacgaguugcuacacuuuccuaagguguuccccaaaaaccagaagccaaaacauccuacuacagggaucauugcaaucacccuggcuuuuuauaucugucacgaagugcaucucgccggauucaaguacaauuuuuccgaucugaaaucaccccuucacuauuacggcaacgcuacgaugagucugaugaauaagaacgccuaucacaacgucacugcagagcaauuguuccucaaggacauuauagagaaaaaucugguuaucaacuuaacccaggacuga

SEQ ID NO: 63267 - RNA, 3414 nt, Artificial Sequence
  derived and/or modified sequence opt3 from ST5__Homo_sapiens__NP_005409
augaccaugacagccaacaagaauagcuccaucacucacggcgcugggggaacgaaagcacccagagguacccugucuaggucacagagugugagcccuccaccgguccucagucccccucggucuccaauuuacccccuuucggacucagagacaagcgccugccgcuauccuagucauuccucuagccgaguucuguugaaggaucgucacccacccgcgccuuccccacaaaacccgcaggaccccucaccugauacuuccccacccaccuguccuuucaaaacagcuagcuuuggcuacuuagacagaucuccauccgccugcaagagggaugcacagaaagaaucagugcagggggccgcucaagacguagcaggaguggccgcuugucugccccuagcccagagcaccccguucccuggccccgcggcagguccaagagggguccuccugacucgcacaggaaccagagcccauagucuuggcauaagggagaagaucucugcuugggaaggccggcgcgaggccuccccucgaaugagcaugugcggggaaaagagagagggaucggguucugagugggcagcuuccgaaggcugucccucacuggggugcccaagugugguucccagcccuuguuccucugagaaaacguuugauuucaagggauugaggcggaugagccguacuuuuucagaaugcaguuauccagagaccgaggaagagggcgaagcccucccggugcgcgacuccuucuacagacuggagaaaaggcugggucggagcgaacccucugcguuucuccgagggcacggaucacgcaaggagaguagcgccgucuuaucccggauucagaaaaucgaacaggugcugaaggaacaaccuggcaggggccuuccacaguugcccucuucguguuauagcguagaucgggggaagcgcaaaacaggaacucuggguucccuagaggaaccugcaggcggggcuucaguuagugccggaucuagagcugugggcgucgccgguguggcaggggaggccggcccacccccggaaagggagggaagcggcuccaccaagccugggacaccaggaaauucacccagcucucagcgucucccuuccaaaaguagccuggaccccgcugugaacccagucccuaagcccaaacggaccuucgaguacgaagcggauaagaauccaaaaucuaagccguccaacggucuuccucccucaccaacgcccgcagccccuccaccccugccuaguacuccggcuccacccguuacacgaagaccuaagaaagacaugaggggccaucgcaagagccagucgcggaaauccuuugaguucgaagaugccucuagcuugcaaucacucuauccaaguucccccaccgagaaugggacugaaaaccagccuaaguuuggaucuaaaagcacacuggaggagaaugcauacgaagacauugugggcgacuuaccgaaggagaaccccuacgaagauguagaccugaaguccagaagggccggucgcaaaucacagcaacucagcgagaauagucuugauucucugcaccgaaugugguccccacaggaccggaaguauaacagcccucccacccaguugucgcuaaaaccaaauucacagucucugcguagugggaacugguccgagagaaagagccacaggcucccucgccugcccaaacggcauucucacgaugacaugcuucuguuggcucaacucagccugccauccucaccgaguagcuuaaaugaagauucucuguccacgaccucagagcuacucaguagcagaagggcccgacgcaucccuaagcuggugcagcggauaaacuccaucuacaacgcaaagagaggcaaaaagaggcuuaaaaaguugucuaugucgagcauugaaacagcgucacugcgugacgaaaauuccgagagugagucugauagcgacgaucgcuucaaagcucauacucagcggcucguccacauccaguccaugcugaagagagcccccucauauaggacccuugagcuggaauugcucgaguggcaagaacgagagcuguuugaauacuucgugguugugucuuuaaagaaaaagccaagccggaacacauaucugcccgaggucaguuaccaguucccuaaacuagaccgcccaacuaagcagaugagagaggcagaagagaggcucaaagccauuccccaguuuugcuucccugacgcuaaggauuggcugccgguguccgaauauagcucugagaccuuuucauucaugcuuacaggagaagacggcucccggcgauuuggguacuguagacgcuugcugccaaguggaaaaggucccaggcucccugagguauacugcguuaucagccgucugggcugcuucggguuauuuucgaaggugcuggaugaggucgaacggagaaggggaauaucugccgcacuuguguaucccuucaugcgcuccuugauggagagcccauuuccugcucccggcaagaccauuaaagucaagacuuuccucccaggugccgggaaugaagugcuggagcuacgaagaccuauggacucacggcuggagcacguugauuuugaaugucucuucacgugccugagugugaggcaacuuauccgcauuuuugcgucuuugcuguuagagcguagaguaaucuucgucgccgacaaacucuccacacugagcucauguagucaugcugugguugcacuucuguacccguucagcuggcagcacaccuuuauccccguguugccagccuccaugauugauauagucugcuguccuacucccuuccucgugggccugcuaucuagcucccugccaaagcucaaagaacugccuguagaggaagcucuuauggugaacuugggaucagaccgguuuaucaggcagauggaugacgaggauacccuguuaccccgcaagcuccaggccgcacuggagcaagcgcuugaacgaaagaaugagcugauuucucaggacagugauucggacagcgacgaugaaugcaacacacuaaauggccucguuuccgaggucuucaucagauuuuucguggaaaccguggggcauuauucucuguuuuugacucagucagagaaaggagagcgggccuuccaaagggaggcuuuucgcaagagcgucgccuccaaaaguauaagaagguuccuggagguuuuuauggaaucucagauguucgcaggcuuuauucaggaccgggaguuacguaagugucgcgcuaaaggucucuucgaacagcgaguggagcaauaccuggaggaacuuccggauacagagcagagcgggaugaacaaguuccugagaggauugggcaauaagaugaaauuucuccacaagaaaaacuga

SEQ ID NO: 63268 - RNA, 1221 nt, Artificial Sequence
  derived and/or modified sequence opt3 from ST6GAL1__Homo_sapiens__NP_775323
augauccacaccaaccugaagaaaaaguucagcugcugugugcucgucuuucuucuguucgccguuauuugcguguggaaagagaagaaaaagggcuccuacuaugacucuuuuaaguugcagacaaaagaguuccaaguauuaaagucacuggggaaacuagcuaugggaagugauagccaguccgugucuucgucaagcacucaggacccccauagagguaggcagacgcucggcagucugcgggggcuugcaaaggccaaaccugaagcguccuuucaagucuggaauaaggauucuagcuccaagaaccugauaccacgcuugcagaaaaucuggaagaauuaccucucaaugaacaaauauaaggugaguuacaaaggaccgggccccgguauuaaguucagcgcugaagcccugcgaugucaccuucgugaccauguuaaugugucuauggucgaggugaccgauuuuccuuucaacacauccgaaugggagggguaucucccaaaagagucaaucagaacuaaggcaggacccugggggaggugcgccguaguuagcagugcuggcucuuuaaaguccagccagcugggccgggaaauugacgaucacgacgcagugcuucgcuuuaauggagccccuaccgcuaacuuccagcaagaugucgguacaaaaaccacuaucagauugaugaacucgcagcuggugacaaccgagaagagguuucuaaaagacucucucuacaaugaaggcauacugaucgugugggauccauccgucuaucauucagacauucccaagugguaccagaauccugauuacaacuucuuuaauaacuauaaaacguaccggaagcugcacccaaaucagccguucuauauccugaagccccaaaugccuugggaguugugggacauucuccaggagaucaguccagaagagauacagcccaacccuccaagcuccgggaugcugggaauuaucauuaugaugacuuuaugugaccaaguugauaucuacgaguuccugcccucuaaacgcaagaccgacgugugcuauuacuaucagaaauuuuucgauagcgccuguacaaugggcgcguaccacccgcuccuuuacgaaaagaaccugguaaaacauuugaaucaggguacugacgaagauaucuaucuacuggggaaggcaacccucccuggauuucgaacaauucacugcuga

SEQ ID NO: 63269 - RNA, 1401 nt, Artificial Sequence
  derived and/or modified sequence opt3 from ST6GAL2__Homo_sapiens__NP_001135824
augaagccccaccugaaacaguggagacaaaggaugcuuuucggcaucuuugccugggggcuccuguucuuguuaauuuuuauauacuucaccgacagcaacccugcugagccagugccguccucucugucauuucuagaaacacggcgccuccugcccguccagggaaagcagcgagcaaucaugggugccgcgcaugagccuaguccacccggcgggcuugaugcucgucaggcccugccuagagcacacccagccggcagcuuccaugcuggacccggugacuugcaaaaaugggcacagucccaggauggguuugaacacaaggaguucuuuucuucgcagguuggaaggaaaucacaaagcgccuucuauccugaagacgaugacuacuuuuucgcugccggccagccaggcuggcauagucacacucaggggacgcucggauuuccgucccccggugagccuggcccacgggagggggcguuccccgcagcccaggugcaacgcagaaggguaaagaagcggcaccgccgacagagaaggucucaugugcuggaagagggagaugacggcgaucggcuguauagcuccaugucacgugcuuuccucuaccgcuuauggaaagguaaugucaguagcaagaugcugaacccuagacuucagaaagccaugaaggacuauuugaccgcaaauaaacacggggugagguuucggggaaagcgagaagcuggccugucucgcgcccaacuacucugccagcugagauccagggcgcggguucgcacacuugauggcacugaggccccauucucagcacugggguggagaagguuggugcccgcugucccgcucagccagcugcauccucguggauuacggaguugugccgugguaaugucugcuggugccauucugaacuccagccucggcgaggaaaucgacucgcacgaugcaguucuucgauuuaauucugcccccaccagaggguacgagaaggacgugggaaacaaaacaaccauuaggaucauaaauucccagauccugacuaacccaucacaccauuucauugacaguagcuuguauaaggaugucauccuaguggcuugggacccugcgcccuacuccgcaaaucugaaccucugguacaaaaagccagauuauaaucuguuuacacccuacauucaacaccgccagcggaacccuaaucagccauucuauauccuucauccgaaauuuauauggcagcugugggacauuauccaagaaaacaccaaggagaaaauucagcccaauccuccaucuagcggcuucaucgguucauuugugaagaucgggcacauuagagccugcagugaacccaggucccgcgauuguacgccugcuuggacuaccgaguga

SEQ ID NO: 63270 - RNA, 1803 nt, Artificial Sequence
  derived and/or modified sequence opt3 from ST6GALNAC1__Homo_sapiens__NP_060884
augagaagcugccuguggaggugucggcaccucucccagggcgugcaauggucucuucuguuggccgucuuaguuuucuuucuguucgcucuacccucauuuaucaaggagccucagaccaaaccaagucgccaucagcgaacagaaaacauuaaggagcguagccuccagucccuggcaaaaccgaagucucaagcccccacuagagcgaggcggacgaccauauacgcugaaccugugccagagaauaacgcccuuaauacacagacucagcccaaagcacacaccacaggggaccgcggaaaggaagccaaccaggcuccuccagaggagcaagauaagguaccccauaccgcacagagagccgcuuggaaaucgccugaaaaggagaaaacuauggugaauacacugucaccaaggggucaggacgccggcauggcgagcgggcggaccgaagcacagaguuggaagucccaagauacgaaaacuacccagggaaacggcggucagacacgcaaguugacugccucucgaaccgucagcgagaagcaccaagggaaagcugccacaaccgcaaagacgcucaucccgaaaucccagcauagaaugcuggcucccacuggagccgugucaacaaggacccggcagaagggcguuacuacagcggugauuccuccaaaagagaagaaaccccaggccaccccuccacccgcaccguuccaaaguccuacgacccagcguaaucagcgccugaaggcugccaacuuuaagagcgaacccagaugggacuucgaggaaaaauauucuuuugagaucggcgggcuccagacaacuugcccagauuccgucaagauuaaagcaucaaagagcuuauggcugcaaaaacuuuucuugccuaaucugacccuauuucucgacaguaggcacuucaaccagucugaaugggaucggcuggagcacuuugcucccccauucggauuuauggagcuuaauuacucccuggugcagaagguaguuacacgauuucccccugugccacagcaacaguugcuccuggcuagcuuaccggccgguucgcugcgcuguaucacuugcgccgucgugggcaacgggggaauacucaauaacucucauaugggccaggaaaucgacucccacgauuauguguucagacuuucaggugcgcugauuaagggguacgagcaggacgucggaaccaggacaaguuucuauggcuucaccgcauuuagcuugacucaaucccuacugauccucggcaaucggggguucaaaaacguuccccugggaaaggaugugcgcuaccuucauuuucuggaagguacgagagacuaugagugguuggaagcccuccugaugaaccagacaguaaugucuaaaaauuuauucugguuuaggcaccguccucaggaggcuuuccgggaggcccugcacauggaucgauaccuacuccugcauccagacuuucuuagauacaugaagaacagguucuugcgcagcaaaacccuggacggcgcacacuggcggauuuauagacccacuaccggggcccuccugcuucugacagcuuugcaacucugugaucaggugucagccuacggauuuaucaccgaaggccaugagagguucagugaccacuauuacgauacuuccuggaagcgccugauauuuuauauuaaucaugacuucaaguuagaacgagaggucuggaaacggcugcacgaugaagguaucauucgucuauaccagagaccugggccaggcacagcaaaggcgaaaaacuga

SEQ ID NO: 63271 - RNA, 1125 nt, Artificial Sequence
  derived and/or modified sequence opt3 from ST6GALNAC2__Homo_sapiens__NP_006447
augggacugcccagagggagcuucuuuuggcuccuucuguuguuaaccgccgcuugcuccggacugcuauucgcacucuacuuuucugccgugcagagguauccugguccagcggcuggcgcccgggacacaacuucauucgaggcauuuuuccaaaguaaggccagcaacuccuggacggggaaaggacaggcuugucgccaucugcuucaccuggcaauccagcgacacccgcauuuucguggcuuguucaaucucucuauucccguccugcuguggggugaucucuuuaccccugccuuaugggacagacugucgcagcacaaggcuccauacggguggaggggacuuucacaucaaguuauagccagcacauugagucugcuaaacggcuccgaaucugcgaaacucuucgcacccccucgggauacuccacccaagugcauccgcugugccgugguaggcaauggggguauucugaacggaagcagacagggcccuaauaucgacgcucacgauuauguguuuaggcuuaacggggccgucauuaaaggauucgagcgggacgugggcaccaagacauccuuuuacgguuucaccguuaauacuaugaagaacucacuggugaguuauuggaauuugggguucacaagcgucccacagggacaggaucuccaauacaucuuuauaccgucugacauccgcgauuaugugaugcugcgauccgcaauuuuaggcguacccguuccugaaggccuggacaaaggggauagaccacacgcuuacuucggacccgaggccucagcgagcaaguuuaaacuccuucauccugacuucaucaguuaccugaccgaaagguuuuugaagucuaaacuaauuaacacgcacuucggugaucuguauaugccauccacuggcgcccucaugcugcuuaccgcacugcauacaugcgaccaggugagcgcuuacggguuuaucacuucgaauuauuggaaguucucugaccacuacuuugagcggaagaugaaacccuugauauucuaugccaaccacgaucucucccuggaggcugccuuauggcgugaccugcauaaggcaggcauucuacagcucuaccagcgcuga

SEQ ID NO: 63272 - RNA, 909 nt, Artificial Sequence
  derived and/or modified sequence opt3 from ST6GALNAC4__Homo_sapiens__NP_778204
augaaggcccccggcagacuggugcucaucauucuuugcagcgucguuuucuccgcuguguacauacuguuguguugcugggcaggguuaccucugugucuagcgaccugccucgaccaccauuuuccaacaggaucuaggccgacuguacccgguccucugcacuucucaggcuauaguagcgugccagaugggaaaccccuuguccgggagccuugucgcuccugcgccgugguuucuucgucaggacagaugcugggcagcgguuugggggcugaaaucgacagugccgaguguguguuucgaaugaaccaagcaccaacggucggauucgaagccgaugugggccagcguuccacccucagaguaguuucucauacaagcgugccccugcugcucaggaauuacucccacuauuuucagaaggcucgggacacuuuauacauggucuggggccaggggcgccauauggauagagugcugggagguaggaccuaucggacacuuuugcaacugacccgcauguacccuggccuacagguguauacuuucacagagcgaaugauggcauacugcgaccagauuuuucaggaugaaaccgggaaaaacagaaggcaaucaggaaguuuccucagcacgggcugguuuacuaugauccuggcccuugagcugugugaggaaauugucguuuacgguauggugucugacuccuauugccgggagaagucacacccaagcguaccguaccacuauuucgaaaaagggcguuuggaugagugucagauguaccucgcucaugagcaggcgccccgcagugcccacagauuuaucaccgaaaaggcaguguucucuaggugggccaagaaacggccuauagucuuugcucauccauccuggcgaacagaguga

SEQ ID NO: 63273 - RNA, 1125 nt, Artificial Sequence
  derived and/or modified sequence opt3 from ST6GALNAC6__Homo_sapiens__NP_001273928
auggccugcagcagacccccuucccagugugagccaaccucucugccgcccggcccuccagcugggaggcggcaccucccccuuucacgccgacguagagaaaugaguagcaacaaggagcaaagguccgcaguguucgucauccuguuugccuugauuacaauauuaauccuguacucuucaaauucggcgaacgaaguuuuccauuauggaagccuacggggucgcaguagaaggccugugaaucucaaaaagugguccauuacugacggcuacguaccaauccuggggaacaaaacgcuucccucucggugccaccagugugugauugucagcuccucaagucaucuguugggaaccaagcucggcccugagaucgaacgcgcugagugcacaauacgaaugaaugaugccccaacuaccgguuauagcgcagacguggggaacaaaacaaccuacagaguuguggcccacucuuccgucuuuagggugcugcggcguccgcaggaguucguaaaucgcacucccgaaacaguuuuuaucuucuggggaccuccaucaaagaugcagaagccccaaggcagccuggugagagucauucagagggcuggccucguguuuccuaacauggaggcauaugccgugaguccagggcggaugcgacaguucgaugacuuauuucgcggagaaaccgguaaagauagagagaagucucauuccuggcugagcacgggcugguucacuauggucaucgcuguugagcuuugugaccacgugcacguauacgggauggugcccccgaauuauugcucgggaccugccucuuccgcgugucccaccacaacuaccucaccaaggggccggacaaacgucaguccuaccagccgcauguccacgguggcaagagccacuacaaccgcuucuagccccaggaaagguucaagucaucgugggccauccugcauggccagccccucuccuacuccaccgggaccccggccuccaucauugugggaucugcgaagaguuaggggcgaagcagcuagugcccagccccuaggccaagggccuagcuccggacagucucgccucgcgggugugucgccaagccaguccggccccuga

SEQ ID NO: 63274 - RNA, 1665 nt, Artificial Sequence
  derived and/or modified sequence opt3 from ST7__Homo_sapiens__NP_060882
auggccgaggcugcaaccggcuuccuggaacagcucaagagcugcaucgugugguccuggacauaccuuuggacugucugguuuuucauuguucuguuuuugguguauauauuaagaguaccccugaaaaucaacgacaaucuaucuacggugucaauguuccucaacacccugacaccuaaguuuuacgucgcccuuacugggaccaguagccugauuuccggauugauccucauuuucgaguggugguauuuuaggaaauacgguacaucuuucaucgaacaagugucgguuucacaucugcggccacugcucggcgggguggauaauaacagcaguaauaacuccaauucuagcaacggagacuccgauucaaaucgccagagugucagcgaguguaagguguggcgaaacccguuaaaucuguuucguggcgcggaauauaacagauacaccuggguaacugguagggagccccuuacauauuacgacaugaauuugucugcucaggaucaccagaccuucuuuacgugcgacuccgaucaucugcggccugccgacgcaauaaugcaaaaagccuggcgcgagagaaacccacaggcuaggaucucagcagcccacgaagcucuagagauuaaugaaugugccacugcguacauccuccuggcagaggaggaagccaccacaauugcugaggccgaaaaacuuuucaagcaggcacugaaagcuggggauggaugcuaucggcgcagccagcaauugcagcaccauggcagucaguacgaggcccagcaccgaagagacacuaacguucucguguauaucaagaggcggcuggcgaugugugcccgucgcuuaggcagaaccagggaagcagucaaaaugaugcgggaucugaugaaggaguuuccccuccuuucuauguucaacauacacgagaaucuguuggaagcucuacuggagcuccaagccuacgcugacgugcaggccgugcuggcaaaauaugaugacauuucccuuccuaagagcgccacaaucugcuacaccgcugcgcuguugaaggcacgagccgucucggacaaauucucuccagaagcugccucccgcagagggcucucaacggcagagaugaacgccguugaagcuauucauagggccguggaguuuaauccccacguaccuaaguaucuguuagagaugaaaagucugauccuaccaccggaacauauccucaagcggggagauagcgaggcaauugcguacgcuuucuuucaccuggcccacuggaaacgcguggaaggugcacuuaacuugcugcauuguacuugggagggcacauucagaaugauacccuacccucucgaaaaggggcaccuguuuuauccauaccccaucugcaccgagacugccgacagggagcuucugccuuccuuccaugaagucucuguguauccaaagaaggaguugcccuuuuucauucucuuuacagcuggacuguguagcuucaccgccauguuagcacugcuaacgcaccaguuuccggaacucaugggcguuuucgcuaaggccuuucugucaacccuuuucgcgccuuugaauuucgugauggagaaagucgagaguauccugcccuccagccucuggcaucaacugacacguauauga

SEQ ID NO: 63275 - RNA, 1560 nt, Artificial Sequence
  derived and/or modified sequence opt3 from ST7L__Homo_sapiens__XP_011539931
augagccccuuccuguuuagagacgauaugaaggaccucaccguguuccuuaacucccugacaccuaaauuuuacgucgccuugacuggcacgucuucauuaaucagugggcugauuuucauauuugaguggugguauuuccacaagcauggaaccagcuuuaucgaacagguuuccgugucucaccuacaaccacucauggguggcacagagucgucaauuagcgaaccggggagucccuccaggaaucgggagaacgaaacuucucgccagaaucugagcgagugcaaaguauggcgaaacccucuuaaucuguuccguggagcugaguacagaagguauaccugggugacaggcaaggaaccauugaccuacuaugauaugaaccucuccgcacaggaccaucagacauuuuucacuugugauaccgacuuucugcggcccucagauacggucaugcaaaaagccuggcgcgagagaaauccuccagcgaggaucaaggcugccuaccaggcacuggaacucaacaaugacugcgccacugcuuauguguuacuggcagaggaggaagccaccacaauuguugaugcugagcggcuuuucaagcaggccuugaaagcgggugaaacuaucuaccgccagagucaacagugucagcaccagagcccccaacaugaggcacagcugcgaagagacaccaacgugcuagucuacauaaagaggcggcucgccaugugcgcucguaaacuggggcgcaucagagaagccgugaagauuaugagggaucuuaugaaagaguuuccuccacugacaauguugaauauccacgagaaccuccuggaaucuuuacuggagcuccaggcauauccggacguacaagcuguucuugccaaguacgaugacauuucccugcccaagucagcggccaucuguuauaccgcagcuuugcuaaaaacgcggacugugagcgaaaaguucaguccugagacagccucucgacgcggacuguccaccgcugaaauaaaugccgucgaggcaauucacagagccguggaguucaacccacaugugcccaaauaccuccuggaaaugaaaagccuuauccugccuccagagcacauuuugaagaggggcgacucggaagcuaucgcguaugcauuuuuccaucuccagcacuggaagcggaucgagggcgcccugaauuuacugcagugcacuugggaagggacauuucgcaugauucccuacccgcuagagaaaggacaccucuucuauccuuaccccucuuguaccgagacggcugauagagaacugcuuccaaccuuucaucacgucuccguuuacccuaagaaggaguugccccuguucauacauuuuacagccgguuucugcucaaguacugcaaugaucgccauucucacccaccaguuuccagaaaucaugggcauauucgcuaaagccgugcuggggcuuugguguccccaaccuugggcaagcuccggauuugaggagaacacacaggaccugaagucugaagauuugggccucagcucagguuga

SEQ ID NO: 63276 - RNA, 642 nt, Artificial Sequence
  derived and/or modified sequence opt3 from ST8SIA1__Homo_sapiens__NP_001291379
augaccggcagcuucuacacacacucuccccugacuauccagcucacgcuuuccucacauagaugcaaccugccuccauugaguagcgaguauaccaaggacgugggguccaaaucucaauuagucacagccaauccgucgauuauaaggcagcgguuucagaaccugcuauggucacgcaagacuuucguugauaauaugaaaaucuacaaccacagcuauauuuacaugcccgcuuuuaguaugaagaccggaacagaaccuucccuccgaguguauuacacccugucugacguaggugcaaaucagacugugcuuuucgccaacccaaauuuucugcguagcaucggcaaauucuggaaguccagagggauucaugcgaagagguugucaacaggacucuuucuggucagugcugcccugggccucugugaggaaguggcaaucuaugguuucuggcccuuuagcguuaacaugcacgagcaaccuauaucucaucacuacuacgauaauguguuaccauucuccggguuucacgccaugcccgaagaguuccugcagcuuugguauuugcauaaaaucggagcucugcggaugcagcuagacccuugcgaggauaccucacuccagccaacgagcuga

SEQ ID NO: 63277 - RNA, 1128 nt, Artificial Sequence
  derived and/or modified sequence opt3 from ST8SIA2__Homo_sapiens__NP_006002
augcagcugcaauucagaagcuggaugcucgccgcucuuacccuguugguggucuuuuuaaucuucgcagacauuuccgagauagaagaggaaaucggcaacucugggggaagggguacaauucggucagccguuaauagucugcacagcaaguccaaccgcgcggaggugguaaucaaugggucuucgucacccgcuguggucgaucgaagcaacgaaaguauuaaacauaauauccagccugccuccucuaaguggcgucacaaccagacucuaagccucagaauaaggaaacagauccugaaguuucuugacgcagagaaagauauuuccgugcugaagggcacguugaagccaggagacaucauucauuacaucuucgaucgggacucaaccaugaauguuagucaaaaccucuaugagcugcugccgcgcacaagcccccucaaaaauaagcacuuuggcacuugcgccauaguggguaacucuggggucuuacuuaauuccggauguggccaggaaauugaugcucauucauucgugaucagaugcaaccuggcaccuguacaggaguacgccagggacguuggcuugaaaaccgaucuggugacaaugaauccaagcgucauucagcgggcuuuugaagaccuagugaacgccaccuggcgcgagaagcuccugcaacgacuucacagucugaaugggucuaucuuguggauccccgcguucauggcaagaggagguaaagagaggguggaaugggucaacgagcucauucugaagcaccauguuaacgugcggacugccuauccuuccuuacgucugcuccacgcuguacgcggcuacuggcuuacaaauaaggugcauauaaaaagaccaaccacggggcuguugauguauacucuagccaccagguuuuguaagcagaucuaccuguauggauucuggcccuuuccucucgaucagaaccagaauccagucaaauaccacuacuaugacagccugaaguacggcuauacaucgcaagcaucuccgcacacuaugccccuugaguucaaagcucugaaguccuugcaugaacagggugcccucaaacugaccguggggcagugcgauggagcgacauga

SEQ ID NO: 63278 - RNA, 1143 nt, Artificial Sequence
  derived and/or modified sequence opt3 from ST8SIA3__Homo_sapiens__NP_056963
augagaaacugcaagauggccaggguggcuagcguccugggccucguuaugcuuuccguggcacuguugaucuuaucucugauuucauacguaagucuuaagaaggagaauauauucaccacacccaaauaugccagcccuggggcgccacggauguacauguuucacgcuggauuccgcucccaguuugcccucaaguuccuggacccgucuuuugugcccaucacuaacucgcuuacgcaagaacugcaggagaaaccuucaaaguggaaguucaaucgaaccgcauuuuugcaucagcgucaggaaauucuccaacacgucgaugugaucaaaaacuucagccugacaaagaauaguguuagaauuggucagcugaugcauuaugacuacuccucucacaaauauguguuuagcaucuccaacaauuucaggucacucuuaccagaugucagucccauaaugaacaagcauuacaauaucugugccgugguaggcaacagcgggauucugacuggaucucagugcggccaggagaucgacaaauccgauuuuguuuuccgguguaauuuugcuccuaccgaagcauuccaacgcgacguggguagaaagacaaaccuuaccacuuucaauccaucaauuuuggagaaguauuacaacaaucugcuaacaauccaggauaggaacaacuuuuuccucagccugaaaaagcuagacggggccauacuguggauucccgccuuuuucuuucacaccagugcuacggucacucggaccuugguggauuucuuuguggagcaccgcggacagcucaaaguccagcuggcguggccuggcaauaucaugcaacauguuaaccgauacuggaagaauaaacacuuaucuccaaagagacuguccacaggcauucucauguauacucuugcaagcgccaucugcgaagagauccaucuguacggguucuggccguuuggauucgaccccaacaccagggaagauuugccuuaucacuacuaugacaaaaaggguacaaaguuuaccacgaaauggcaggagucgcaccagcuaccagcugaguuccaacugcucuaccggaugcauggcgaagggcugacuaaacuuacacugucucacugugccuga

SEQ ID NO: 63279 - RNA, 1080 nt, Artificial Sequence
  derived and/or modified sequence opt3 from ST8SIA4__Homo_sapiens__NP_005659
augaggagcaucaggaagcgguggaccauuugcacaauaucccugcuccuuaucuucuacaaaacuaaggagauugcccgcacggaggaacaccaggaaacccaacugaucggcgacggggaguugucuuuaucacgaagucuggugaacagcuccgauaaaauuauccguaaggcuggaucuucgauauuucagcauaaugucgaagguuggaaaaucaacucaagccuaguucucgagauuagaaagaauauccugagguuccuugacgcagagcgggaugugaguguagugaaguccucuuuuaaacccggcgacgucauucacuaugugcuggaucgcagaaggacauugaacaucagccaugaccuccacucccugcugccugaaguuucaccaaugaagaaucggcgcuucaaaacuugugccguggucgggaacaguggaauacucuuagauagcgagugcggcaaggaaauugacucucauaauuuugugauccgauguaaccuggcgccgguaguugaguucgcugccgauguggguaccaaauccgacuuuauuacaaugaaucccucagucgugcagagagcauucgggggauuuaggaacgagagcgaucgggaaaaguucgugcaccgucuuaguauguugaaugacucuguccuguggaucccugccuuuaugguuaagggcggcgagaaacacguggaauggguaaacgcucuaauccucaagaauaaacugaaggugcgcaccgcauacccaucccuuagacugauucaugccgucaggggguauugguugacuaacaaagugcccauaaagcggccuagcacaggacuccugauguacaccuuagcuacgcgauucugcgaugagauccaccuguaugguuuuuggccauuccccaaagaccucaauggcaaggccguuaaguaccauuauuacgacgaucuuaaauaccgcuauuucucgaacgcgucuccucacagaaugccacuggaauuuaagacuuugaacgugcuacacaauagaggggcacugaaacucaccacaggaaagugugucaaacaguga

SEQ ID NO: 63280 - RNA, 1197 nt, Artificial Sequence
  derived and/or modified sequence opt3 from ST8SIA6__Homo_sapiens__NP_001004470
augagacccggcggggcccugcucgcacuucuggcuagcuuguuacugcuacuccugcuuaggcuguuguggugcccugccgacgcgccaggacgggcucgcauccucguggaggaaucccgagaggccacccacgguacaccggcagcccugcguacucugagaucucccgcuacggcagucccuagggccaccaacucaacauaccucaaugaaaagaguuuacagcugacugagaaauguaagaaccuucaauauggcauugagagcuucuccaauaaaaccaagggguacucugaaaacgauuauuugcagauaaucacagacauucagucgugcccauggaaacggcaggcugaggaauacgccaauuuucgcgcgaagcuggcaucauguugcgaugccguucaaaacuucgugguaagccagaauaacacccccgugggaacuaauaugaguuaugaggucgaauccaagaaagagaucccuauuaagaaaaacaucuuucauauguucccagugucucagcccuuuguugacuacccuuauaaucagugugcuguggucggcaacggugggauacuaaauaagagccucugcggaacagagaucgauaaauccgacuucguguuuagauguaaccugccaccgaccacgggcgauguaucaaaggacguuggcaguaagacuaaucuugugaccauuaaccccagcaucauuacacugaaauacgggaacuugaaggagaaaaaggcccucuuccuggaagauaucgcaacuuacggagacgccuuuuucuuacugccugcuuuuucuuucagggcgaauaccgguacauccuuuaaagucuauuacacccucgaagagucaaaggcccggcaaaaagugcuuuucuuccacccaaaguaucugaaggauuuggcacuauuuuggcgcacgaaaggcgugacugcuuaccgacugagcacagggcucaugauaaccagugucgccguugaacugugcaagaacgugaaacuuuauggauucuggcccuuuucuaagacuguagaggacauuccugugucccaucacuacuaugauaauaaacugccaaagcauggcuuccaccagaugcccaaggaguacagccagaucuugcagcuccacaugaaagguauucugaaguuacaauuuucgaaaugugaagucgcuuga

SEQ ID NO: 63281 - RNA, 7713 nt, Artificial Sequence
  derived and/or modified sequence opt3 from STAB1__Homo_sapiens__NP_055951
auggccggccccagggggcugcucccucuuugccuguuggcuuucugcuuagcaggauuuagcuucgugaggggucagguccuguuuaagggcugcgacguuaagaccacauucgugacucacguaccaugcacguccugcgccgcgaucaagaaacaaaccuguccgucuggguggcuacgggagcuccccgaucagauuacacaggacugccgcuacgaagugcagcugggaggcucaauggucaguaugagcgguugucgacguaagugccgaaaacaagugguucagaaggcuuguugcccuggguauuggggauccaggugucacgagugcccaggcggcgccgaaacucccugcaacgggcacggaaccugucuugaugguauggaccggaauggcacaugcgugugucaggagaacuuucgcgggucugcaugccaggaaugucaagauccuaauagauucggaccagacugccagucggucuguucaugcgugcauggcguauguaaccacggucccagaggggauggaagcugccuguguuuugccggcuacaccggcccucauugcgaccaggaguugccaguuugccaggagcuccgguguccgcaaaauacucagugcagugcugaagcacccuccugucgcugccugccuggguauacacagcaaggaucugagugucgagccccaaaccccugcuggccuagcccauguucccugcucgcucagugcucagugagucccaagggucaggcccagugucacugcccggaaaauuaccacggcgaugggauggucuguuuaccuaaagaccccugcaccgauaaccugggaggcugcccaagcaauucuacgcuuuguguguaucaaaagccuggucaggcguucugcacuuguagacccggguugguguccauaaacucaaaugcaagcgccggcugcuuugcuuucuguaguccauuuucuugcgacagguccgccaccugucaggucacagcagauggaaaaacuagcugcguuugucgggagucggaggugggcgacgggcgugcuugcuacggacaucugcuacacgaaguacagaaggccacccaaacaggucgcguguuccuccagcugagagucgcgguggccaugauggaccagggcuguagggagauccuuaccacggcagggcccuuuacuguucuggugccuucugucuccucauucaguagccggacaaugaacgcuuccuuggcccagcaacucugccgacagcauauuaucgcuggacagcacauucuggaagauacccgcacucagcaaacaagaaggugguggaccuuagccggccaggagaucacggugaccuucaaucaguuuacaaaauauucuuacaaguacaaggaccaaccacagcagacuuucaacauauauaaagcaaauaacaucgccgcuaacgguguauuucacguugugaccgggcugcgguggcaggcgccgagcggcacacccggagauccuaagcgcacuauuggccaaauccucgcaucaaccgaagccuucaguagauuugagacaauucuugagaauugcgggcugccauccaucuuggacggacccgguccuuucaccgucuuugcuccaagcaacgaagccguggauucucuaagggacggccgucugauauaccucuucacugcagggcugucaaaacuucaggagcugguccgguaucauauuuacaaucacggacaguugacgguggaaaagcucaucaguaaaggcaggauucugacaauggccaaccagguuuuagcugugaauaucagcgaggaagguagaauccugcuagggcccgagggcguaccgcuccaaagagucgaugugauggccgcaaacggaguuauucauaugcuggacggcauacuuuugccuccaaccauccugcccauucucccuaagcacuguuccgaggaacagcauaaaaucguggcggggucuugcgucgauugucaggcucugaauacuucgaccugucccccaaacagcgugaaacuugacauauuuccuaaggaguguguauauauucacgaucccacaggacugaauguguugaaaaagggcugcgccuccuacuguaaccagaccaucauggaacaagguugcuguaaaggguucuuuggaccagacugcacucaguguccgggcgguuucucaaauccuugcuauggcaaggggaacugcagugacggaauccagggcaauggggcaugucucugcuuucccgauuacaaaggaauugccugucacaucugcucuaacccaaauaagcauggcgagcaaugucaggaagacugcgguuguguucacgggcugugcgauaaccgccccggaagcggcggugucugucagcagggcacaugcgcuccuggguucuccggacgguucuguaacgagucaaugggcgacugcgggccaacgggauuagcccaacauugccaucugcacgcaagaugugugagccaggagggcguggcuaggugccgcugucuagaugguuuugaaggggacggauucucuugcacccccuccaauccuuguagucauccggaucgaggcgguugcagcgagaacgccgaaugugucccaggcucucucgggacucaccauugcacaugucacaagggaugguccggcgacgggcggguuugcguggcgauugaugagugugagcuggacaugcguggaggcugccauaccgaugcccuuuguucauacgugggucccgggcagaguagaugcacaugcaaauugggauuugcuggcgacggcuaucaguguagcccuauagauccaugcagggcagggaauggagguugucacggccuggccacuugccgcgcuguagggggaggccaacgggucuguaccugucccccugguuucgggggagacggcuuuucguguuacggcgacaucuucagagaacucgaggccaacgcacacuuuuccauuuucuaucaguggcugaagucugcggggaucacguuaccggccgauaggcgagugaccgcucugguucccagcgaagccgcagugcgccagcuuucaccagaggaccgggcuuuuugguugcagccuagaacacuccccaaucuggucagggcccauuuccuacaaggagcacuguuugaagaggagcucgcccgucuggguggccaggaaguggcuacucuuaacccaaccacacgcugggagauccggaauauuagugggagaguuugggugcagaacgcguccguagaugucgccgacuugcuggcaacuaauggaguguuacacauacucucucaggugcugcuuccucccaggggcgaugucccaggugggcaaggacuguugcagcagcucgaccugguuccggcuuucagccuauuucgagaacugcuccaacaucacggccuggugccucagaucgaggccgccaccgcuuacacgauuuucguacccacaaaccggucccuugaagcacagggcaauucaagccauuuggaugccgacaccgugcgccaccacgucgugcugggggaggcguuaaguauggagacucucagaaaaggaggucauaggaacucucugcuuggcccagcucacuggaucguuuucuauaaucauuccgggcagcccgaagugaaccacgucccucuggagggaccaaugcuagaagcccccggccggagccucauuggucugucggggguguugacaguuggaucaucucgaugccugcacagucaugcagaggccuuaagagaaaagugugugaauugcacccgcagguuucguuguacucaaggcuuccagcuccaggauaccccucggaaauccugcgucuacagaagcggcuuuucuuucagcagggggugcuccuauacaugugcuaagaagauccagguaccggacugcuguccaggauuuuucgguacgcugugcgagcccuguccuggcgggcuuggaggcgugugcucaggucacgggcaaugucaggaucgcuuucugggaaguggcgagugccauugucacgaaggcuuccaugggaccgcaugcgagguuugugaauugggacgauacggucccaacugcacuggcgugugcgacugugcccacgggcucugccaggagggacugcagggcgaugguagcugugucugcaacgugggguggcaaggccuaagaugugaccagaaaauaacaucuccacagugcccucggaagugugaccccaaugcgaacugcguacaagauuccgcuggagccucaaccugugcaugcgccgcuggcuacagugggaauggaaucuuuuguagcgagguggacccaugcgcccacggucauggcgggugcuccccucacgcaaacuguacaaaagucgcuccgggacagaggacuugcaccugucaggauggcuauaugggugacggggaacugugccaggagauuaauucuugucuuauccaucacggcggaugccacauucaugccgaauguauccccacgggcccacaacagguuucgugcagcugucgcgagggguacucaggagaugguauacguacaugcgaacuccuggacccuuguuccaagaacaauggcgggugcagucccuaugcgaccugcaaaucuacuggagauggccagagaaccuguacaugcgacacugcccacaccgugggugauggguugacaugucgggcaagggugggccuggaguuacuccgcgacaagcaugcuagcuucuuuucccugcgacuucuggaguacaaggaauugaaaggagauggcccauucacgauuuucgucccucacgccgaccucaugucaaaccugucucaggacgagcuagcuagaauccgggcacauaggcaacugguguuucgcuaucacguuguagggugcagaaggcuucggagcgaagaucuccuggagcagggauacgccaccgccuugaguggccaccccuuacguuucuccgaacgcgaggguagcauuuaucugaaugacuuugcucgaguggucucuucagaucaugaggcggugaacgggauccuccacuucauagacagaguucugcuuccgccagaagcacugcauugggagccugaugacgcccccaucccaaggcggaaugugacugcugccgcacagggauuuggcuacaagauuuucuccgguuugcuaaaagucgccggccugcucccccugcuucgcgaagcuagucacagaccuuuuacaauguuauggccgaccgaugcggccuucagggcacugcccccagaccggcaggcuuggcucuaccacgaggaucaucgagacaaguuggccgcaauccugagagggcacaugauucgcaacguggaagcccucgcuagcgaucugccuaaucuuggaccccugaggacuaugcauggcacaccuaucucguuuucuuguucccggacccgugccggggaguugaugguaggagaggacgaugcgagaauaguccaaaggcaccuaccauucgaaggcggucuggcauaugggauugaccagcucuuagagcccccuggacugggcgcccgcugcgaccauuuugaaacgcggccacuucgacugaacacuuguagcaucugcggucucgagcccccguguccugagggcucacaggaacaggggaguccagaggcuugcuggagauucuaccccaaauuuuggaccucuccuccauugcacucccugggacucaggagcguguggguucaccccucacuguggggccgcccgcaagggcuuggacggggcugucauagaaauugcgugacaaccacuuggaagccuaguugcugucccggucacuaugggagcgaaugccaggccuguccaggaggcccuuccucucccugcagcgaucguggcgucuguauggacgggauguccggaucaggucagugccuauguaggucuggcuucgcugggacagcaugcgagcugugugccccaggagcuuucggcccccauugccaagccugucggugcaccgugcacggucgcugcgaugaaggguugggaggcaguggcucguguuuuugcgacgagggguggacaggaccucgaugugagguucaguuagaacugcagccagugugcacuccgcccugugcaccugaggcggucugcagagccgguaacagcugugaaugcucccucggcuacgagggggauggaaggguguguaccguagcugaccugugccaggauggccaugguggguguucugaacacgccaacugcucacaagugggaacgaugguuacaugcaccugucuuccagacuaugagggcgauggcuggagcugccgggcacgcaaucccuguacugacgggcacagaggagguugcuccgagcaugcuaacugucugaguaccggccucaauacaaggcgaugcgaaugucacgccggguacgucggagauggcuugcagugccuggaggaaucugagccuccaguggaccggugucuaggucagcccccuccgugccauagcgaugcaauguguacugaccugcacuuccaggaaaaacgugccgggguguuucaccuccaagcuaccucaggaccauauggccuuaacuucuccgaggcggaggccgcaugcgaagcucagggcgccguccuggccaguuuuccccaguuaagcgcagcucagcaauugggguuccaucugugccucaugggauggcuggccaaugguucuacggcgcacccuguaguguuucccguugcugacuguggcaacgggagagugggaaucgucucccuuggcgcccgcaagaaucugucagagaggugggaugcauacugcuuccgggugcaggacguugccuguagaugccgcaacgguuuugugggggauggaauuagcacauguaauggcaagcucuuggacguccuggcugcaaccgccaacuucucgacuuuuuacggcauguuacuaggguaugcgaaugcuacacagaggggacuggauuuccucgacuuucuugaugacgaacugaccuacaaaacuuuguucgugccaguaaacgaggguuucguggauaauaugacacugucuggcccugaccucgagcugcaugccaguaacgcaacccuucucuccgccaaugcuagccaagggaagcuguugcccgcccacucaggacuguccuuaaucauuucugaugcaggcccagacaacagcaguugggcuccgguugccccugguacggucguggugucccgaauaaucgucugggacauuauggcguuuaaugggaucauucaugcccuagcaagcccccugcucgcuccaccccagccucaggccguucuugcaccagaagcucccccuguggccgccggaguaggcgcggugcuggcugcaggcgccuugcuggggcucgucgcuggagcccuguaucuucgggcaagagguaaaccgaugggcuucggguuuucugccuuccaggcugaggaugacgcggaugacgauuuuucaccauggcaagaaggaacuaaccccaccuuagugaguguuccuaacccaguguucggcuccgacacauuuugcgagcccuucgaugacagccugcucgaagaggauuuuccugacacccagaggaucuugacagucaaguga

SEQ ID NO: 63282 - RNA, 7656 nt, Artificial Sequence
  derived and/or modified sequence opt3 from STAB2__Homo_sapiens__NP_060034
augaugcugcagcaccucgugaucuucugccuuggccuggucguucaaaacuuuuguagccccgccgagaccacagggcaggcuagaaggugcgaccggaaguccuuguuaacuauucgcacggaaugucgaucuugcgcacugaaucuaggagugaaauguccugaugguuacaccaugauaacaucaggcaguguaggggugcgugacugcagauauacuuucgaggucaggaccuacagccucucccugccaggaugucggcauaucugccgcaaggauuaucuucagccgagauguugccccggcaggugggguccugacuguauugaaugcccagggggagccggcucucccugcaacggccgggggucgugugcggagggaauggaagguaauggcacaugcucaugucaggagggguuuggaggcaccgcuugcgagacuugugccgaugacaaccuguucgguccuagcugcaguuccguguguaauugcguucacgggguguguaacucuggauuggauggcgacggcacaugcgaauguuacagcgcauauaccgggccaaaaugcgauaagcccaucccugagugcgccgcucuccuguguccagaaaauucccgcugcucaccgaguacggaggacgagaacaaacuggaauguaagugccuccccaauuaccgaggagaugguaaguauugugacccuauuaacccaugcuuaagaaaaaucugucauccccacgcacauugcacuuaccugggcccuaauaggcacagcuguaccugccaagagggguaccggggagauggccaggucugucuuccaguggaccccugccagauaaacuuugguaauugcccgacaaagucuacuguauguaaauaugacgggccuggccagucccacugcgaauguaaggagcauuaccaaaacuucguucccggagugggcugcucaaugaccgauaucuguaaaagcgacaauccaugccaccguaacgccaacuguacaaccgucgcuccugggcgcacggaaugcauuugucagaagggauaugugggugauggcuugacuugcuacgggaauaucauggagagacugagggagcuaaacacagaaccccggggaaaguggcagggccgacucaccaguuuuauuucucugcuugacaaagccuaugcguggccacuguccaaguugggucccuucacugugcuccugccuacagauaaaggguuaaagggcuuuaaugucaacgagcugcucguugacaauaaagcagcccaguacuucgugaagcuucauaucauagcuggacaaaugaacauugaauauaugaauaacaccgauauguuuuacacgcugaccggcaaaagcggggagaucuucaauucggacaaggauaaccagauuaaguugaaacuacacggagguaagaaaaagguaaaaaucauccagggcgacauuauagccucuaaugggcugcuccacauccuggaucgcgcaauggacaagcuugaaccaacauuugaguccaacaaugagcaaacuauuaugaccaugcugcagccgagauacucaaaguucaggaguuugcucgaagagacaaaccugggacaugcuuuagacgaagauggcgugggugggcccuauacuaucuucgucccuaauaacgaggcccugaacaauaugaaagacggcacccuagauuaccuccugagcccagaaggaucccggaagcuuuuggagcuggugcgcuaucacauaguucccuuuacacagcucgagguggcgacccugauuucuacuccucauaucagaagcauggccaaccagcuuauccaauucaauacgacagacaacggccagauucuggcaaaugaugucgcuauggaagagaucgaaauuaccgccaaaaacgggaggauauacacuuugaccggagugcucaucccacccucaauuguaccgauccugccucaccguugugacgagacaaagcgggagaugaaauuaggcaccugcguuaguugcucccugguguauuggagccgauguccagcuaauucugaacccacugcccuauuuacacauagaugcgucuacucagguagguucgggagucucaagagcggaugugcacgcuauugcaacgccacggugaagaucccuaaauguugcaagggcuuuuacggucccgauuguaaucagugcccaggcggguucuccaacccuuguucuggaaauggccagugcgcugacucgcuggggggaaacggcaccuguauuugcgaggaagguuuucaagggagccagugccaguucuguuccgaucccaauaaauacggaccacggugcaacaagaaaugucuuugcguccacggcacuuguaauaacagaauagacucagauggugcgugcuugacaggcaccuguagggacgggagugcaggacgccugugcgauaagcagacaucugccuguggcccguaugugcaauuuugccacauccaugcuacuugugaguacagcaacgggaccgccuccugcauuugcaaggcaggauaugaaggcgacgguacgcucuguucagagauggacccuugcaccgggcugacacccggaggcuguagccgaaaugccgagugcaucaaaacugguaccggcacacacacuuguguuugccagcagggguggaccggaaacggccgggauuguucugaaauuaauaacugcuuacugccauccgcugggggaugucaugacaaugccaguugccuuuacgugggccccggucagaacgagugugaaugcaagaaaggguuccguggaaauggcaucgauugugagccuauaacgagcugcuuggaacaaacaggcaagugccacccacucgcaucuugucaguccaccucaagugggguauggagcugcgucugucaggagggauaugagggugacggcuuucugugcuacgggaacgcggcuguggaacuaucguuccuguccgaggccgcaaucuuuaauagauggauuaacaaugccucucuccaacccacucugagcgcuacaucaaaccuuaccguuuuggugccuagucagcaggccacugaagauauggaccaggaugagaaauccuucuggcugucucaaagcaauaucccggcauuaauuaaguaucacaugcuccugggaaccuacagggucgcugaccuucagacacuguccucaagcgauauguuggccacgagucuccagggcaacuuccugcaucuagcgaaaguggacgguaauaucaccauagaaggggccucuauuguagauggagacaacgcugcaacuaacggcgugauccacauuaucaauaagguucuggucccacagcgccggcucacaggcucccugcccaaccuuuugaugagacuggagcaaaugccugauuacagcauauuuaggggguauaucauucaguacaauuuagccaacgcuaucgaggccgcagacgcguauaccguguucgccccaaauaacaaugcuauugaaaacuacauccgagagaagaaagugcucucgcuggaagaggacguccuucgcuaucauguugugcuggaggaaaagcuacucaaaaaugaucugcacaacggaaugcaucgggagacaauguuggguuuuucauacuuccugucuuuuuucuuacacaaugaccagcucuaugugaacgaagcccccauaaauuacacuaacguagcaaccgauaagggcgucauucacgggcugggaaaagugcuugagauccagaagaauagaugugacaacaaugauacgacaaucauuaggggccguugccgcaccuguaguuccgaacugacuugcccuuuugguaccaagagcuuggggaacgagaaacggagauguaucuacacaucuuauuucaugggaaggcgaacucucuuuauuggcugccaaccgaaguguguucggaccgugauaacacgcgagugcugcgcuggcuucuuugggccccagugucagccaugcccuggaaacgcccaaaaugucuguuucgguaacggcaucugccuggacggggugaauggaacgggcguuugugaaugcggugagggguuuagcggaaccgcaugugaaacuugcacagagggcaaauacggcauucauugugaucaggccugcuccugugugcacgggagaugcaaccagggaccccuaggugacggcucaugcgauugugacguaggguggaggggaguccauugcgauaaugcuaccacugaagacaacuguaauggcacaugccacaccagugcgaacugucugacgaauagcgacgguacugccucuugcaagugugcagcuggguuccagggaaacggcaccaucugcacagccauuaaugccugugagaucuccaacggcgggugcucagcuaaagcagauuguaagcggaccacuccaggacgaagagugugcacaugcaaggccgguuauaccggcgacgggauagugugucuugagaucaauccuugccucgaaaaccauggaggcugugauaaaaaugcggagugcacacaaacuggucccaaccaggcugccuguaacugccugccagcauacaccggggacggcaaggucuguacguugauuaauguuugccugacaaaaaacggaggcuguagugaauucgccaucugcaaucacaccgggcagguggagcgcacuuguaccugcaagccgaacuauauuggagaugguuuuacaugcaggggcagcaucuaccaggaauuaccuaaaaaucccaagacuucccaauauuucuuucagcuccaggagcacuucguaaaggaccugguggggccaggacccuuuaccgucuucgcuccucuuucugcagccuuugaugaggaagcgcgugugaaagacugggauaaguacggccugaugccacagguuuugcgguaccauguggucgcuugucaccaacuccugcuagagaaccugaaacuuauaucgaaugccacgagccuccagggugaacccauugugaucucaguuucccagaguacaguguauaucaacaauaaggcaaaaauuauaucuagcgacaucauuuccaccaacgggaucguccauauuaucgauaagcuguugucaccuaaaaauuuacugauaacuccgaaggacaacucuggcagaauccuccagaaucugacaacccuugccacuaacaauggauacauuaaguucagcaaccugauccaagauaguggcuugcuauccguaauuacagacccaauccacacccccgugacgcuguuuuggccuacugaccaggcucuccacgcccugcccgcagagcagcaagauuuccuuuuuaaccaggacaauaaagauaaguuaaaagaguaucugaaguuccauguuauaagggacgcuaaagugcucgccgucgauuugccaaccagcacagcguggaagacccugcaggggucugaacucucagugaagugcggagccggucgcgacauuggcgaucuguuccuuaacgggcagacaugucgaaucguacaaagagagcuguuguuugaccuaggaguggcauacggcaucgauugccugcucauugacccuacuuuaggugggcggugugauaccuucacgacauuugacgcuuccggcgaaugcggaaguugugucaauacucccagcugcccaagguggucgaaaccuaagggcguuaaacagaagugucuguauaaccuuccguucaaacgcaaucuggaggggugccgugaaagauguucucucgugauccagauaccccggugcugcaagggauacuuuggcagggauugucaggccugcccaggugggccugacgcucccuguaacaaucgcggagugugcuuggaccaauauuccgcaaccggcgaguguaagugcaacacagguuucaauggcaccgccugugagaugugcuggccagggcgauuuggaccugauugucugcccugcggcuguagcgaccacgggcagugcgaugacggaauuacuggcucaggucagugccucugugaaaccggguggacaggaccgaguugcgauacgcaggccguccugccagcuguguguacuccucccugcucugcgcaugcaaccuguaaagagaacaauacaugcgaauguaaccuugacuacgagggcgaugguaucaccugcacuguuguagacuucuguaagcaagauaauggcgggugcgccaaaguggcuagauguucccagaagggaacaaaagucagcugcucaugccagaagggcuacaagggggacggacacaguuguaccgaaauugauccaugcgccgacggccuaaacggugggugucaugagcacgcaacgugcaaaaugacuggacccggcaagcacaaaugugagugcaagagccauuaugugggcgacgggcugaauugugaaccugagcaauugccgaucgaucggugcuuacaggacaacggacagugucacgccgaugcuaaaugcguugaccugcauuuucaggauacaaccgugggugucuuccaccucagguccccccugggccaauacaagcuuaccuuugacaaggcgcgcgaagccugugcaaacgaggcugccacuauggcaacauauaaucagcugucuuacgcccagaaagcuaaguaucaccucugcagcgccgggugguuggaaaccggaagaguggcguacccaacagcauucgccucccagaacugcggcucagguguagucgggauaguggauuauggaccuaggcccaauaaaucugagaugugggacguuuuuuguuaccggaugaaggaugugaacugcacuuguaaagucggcuacgugggcgacggguucaguugcucgggaaaucugcuacaaguucugaugagcuucccuucccucacgaacuuucuuaccgaggugcuggcuuauucuaauucaagcgcccguggucgcgcuuucuuagaacauuugacagaucuguccauucgaggcacucucuuugucccacagaacagugggcugggagagaaugaaacccuuucuggcagagacaucgagcaccaucuggcaaacgugagcauguucuuuuacaaugaucucguaaacgguacaaccuugcagacuaggcuggggucaaaguuacuaaucacggccucccaggacccccugcaaccuaccgagacacgguucguggacggacgcgcuauucuccagugggauaucuuugccaguaauggcauuauacacguuaucagcagaccacuuaaagcacccccggcgccugucacucugacccauacaggcuugggggccggaauuuucuuugcuaucauccuggugaccggugccguggcacucgcugccuauucuuacuucaggauuaaccggcgaacuauaggcuuucagcacuucgaauccgaggaagacaucaaugucgcagcccuggggaagcagcaaccagagaacauuucaaacccccuuuaugaaagcacaacgucggcuccuccagagcccucuuacgauccguuuaccgacagugaggaaagacagcucgagggaaaugauccucugcgcacuuuguga

SEQ ID NO: 63283 - RNA, 978 nt, Artificial Sequence
  derived and/or modified sequence opt3 from STAC3__Homo_sapiens__NP_001273185
auggagcugcccccugaaccacaggccaacggcgaggcugugggggcaggagguggcccgaucuacuauauuuacgaagaggaagaggaggaagaggaagaggaggaagaacccccuccagaacccccuaagcucgucaaugacaaaccacacaaguucaaagaucacuuuuucaagaaacccaaguuuugcgacguuugugccagaaugauagugcuuaacaauaaguucgggcugaggugcaaaaacuguaagaccaauauccaugagcauugccaaagcuauguagaaaugcagcgguguuuuggaaaaauuccuccaggcuuccaccgcgcguacuccucuccguuguauucaaaccagcaguacgcuugcgugaaggauuuaagugccgcaaaucgaaacgaccccgucuuugagacacugcguacuggugugaucauggccaauaaagagagaaagaaggggcaagcugauaaaaagaacccuguugcagccaugauggaagaggaaccagagagcgcuaggcccgaagagggaaaaccucaggacggcaauccagagggcgauaagaaagccgaaaagaaaacgcccgacgauaagcauaagcagccgggguuccagcaaucccacuauuuuguggcgcuauaccgguucaaagcacucgagaaggacgaucuggacuuuccucccggagagaaaauuaccgucaucgaugacucuaacgaggaaugguggcgcgguaagauaggcgagaaagugggguucuuuccaccuaauuucaucauuagaguaagggccggagagcggguucaccgcgugacacgaucguucgucggcaacagagaaaucggucagauuacucuuaagaaggaccagaucguggugcagaaaggggaugaggcuggaggcuacgucaagguuuauaccggcaggaaaguggggcuguuucccacagacuucuuggaagagauauga

SEQ ID NO: 63284 - RNA, 1209 nt, Artificial Sequence
  derived and/or modified sequence opt3 from STAC__Homo_sapiens__NP_003140
augauucccccuagcuccccaagagaggacggcguggaugggcugccgaaggaagccgucggagcugagcagcccccuucuccagcaucaaccaguagccaagaauccaaacuccagaaacuuaaaaggucucugucguucaagacaaaaucauugcggagcaagagugccgacaacuuuuuccagcgcacuaauuccgaggauaugaaguuacaggcgcacaugguugcugaaaucucucccagcuccucaccucugccagcccccgguagucuaacgagcaccccugcacgagccggccuccauccagggggaaaagcucacgcauuucaagaguacauauucaagaaaccgacauuuugcgacguguguaaccauaugaucguaggcacuaaugccaagcacggucugcguugcaaggcuuguaagaugucuauucaucacaagugcaccgaugggcuugcgccccagagauguaugggaaaacugccuaagggcuucaggcgguauuacuccucaccauugcucauccacgagcaguuuggcugcauuaaagaagugaugcccaucgccugugggaacaaggucgacccuguguaugagacacugcgcuucggaaccagccuggcacagagaacuaaaaaggguaguucuggcuccgggagcgauucgccacauaggacaucuaccuccgaccucguugaagugcccgaggaggccaauggaccgggcgguggguacgauuuacggaaacgcucaaacagugucuuuacguauccugaaaauggaacugacgauuuccgagaccccgcuaagaacauaaaucaccaaggcagccuguccaaggauccacuucagaugaacaccuacguggccuuguauaaauuuguaccucaggagaaugaagaccuggagaugagacccggcgacaucauuacacuacucgaagauucuaacgaggacugguggaaggggaaaauccaggauaggauuggauucuuuccagcaaauuucguucaacggcugcagcagaacgagaagaucuuccguugcgugcgcacuuuuauagguuguaaagaacaaggccagauuacccuuaaggagaaucagaucugcgucagcucagaagaggaacaggacggguucauuagagugcugaguggaaagaaaaagggcuugaucccccucgaugugcuggagaacaucuga

SEQ ID NO: 63285 - RNA, 3777 nt, Artificial Sequence
  derived and/or modified sequence opt3 from STAG1__Homo_sapiens__NP_005853
augaucaccagcgagcugcccgugcuccaggacuccacaaacgaaacuacggcccacucugaugcuggcucagagcuugaagagaccgaagucaaggggaaaagaaagaggggacggccuggucgcccaccgaguacaaauaaaaagccccgaaaaagcccuggcgagaagucccguauugaggcagggauaagaggagccggcaggggucgggcgaacgggcauccacaacagaauggagaaggcgagcccguuacucuguucgaagugguaaaguugggcaaaucugcuaugcagucgguggucgacgauuggaucgagucauacaagcaggaccgcgauauugccuuacuggaccuaaucaacuuuuucauucaaugcagcggguguagaggaaccgugaggaucgagauguuucggaauaugcagaacgcagaaauaauccgcaaaaugacagaggaguucgaugaagacaguggugauuauccucucaccaugccaggcccccaguggaagaaauuucgauccaauuucugcgaauuuauugggguucugaucagacagugucaauacucuauuaucuaugacgaguacaugauggauacugugauaagccuucugacaggauuguccgacucacaggucagggccuuccggcacaccaguacgcucgcugcaaugaagcugaugacugcccuggugaacguagcucucaauuuaagcauucaucaggauaacacccagcgucaauaugaggccgaacgcaauaagaugaucggcaaaagagcgaacgagaggcuggaacuuuugcugcagaagcggaaagagcuacaggaaaaucaagacgagauugagaacaugaugaacucuaucuuuaaggguaucuucguucaccgauaccgcgacgcaauugccgaaauaagagcuaucugcauugaggaaaucgggguguggaugaaaauguauuccgaugccuuucucaaugacucauaccugaaguacgucggauggacacuucaugauaggcagggcgaggugcggcugaaauguuugaaggcacuccagagccuguauacuaaccgcgaauuauucccuaagcuggagcucuuuaccaauagauucaaagacaggauagugaguaugacacuugauaaggaguacgacgucgcuguugaagccauucgucuggugaccuugauccuacacggcucugaggaagcgcuguccaacgaggauugcgagaauguauaucaccucguguacagcgcccaucggccagucgcaguggcugccggggaguuccugcacaaaaagcucuuuucgcgacaugacccgcaggcugaagaagcccuggcaaaaagaaggggacgcaacucucccaaugguaacuugauccggaugcucguucuguucuuuuuagaguccgaacugcacgagcacgccgcuuaucuaguggauucacucugggagaguagccaagaacugcuuaaggacugggaguguaugacggaauugcugcucgaggaaccuguccagggcgaggaggcgauguccgauagacaggaaucugcacugauugagcuuauggugugcacuaucaggcaggccgcugaagcccauccacccguagggcgcggaacaggcaagcgaguucugaccgcaaaagagcggaagacucaaauugacgaccguaauaaauugacagaacacuucauaaucacccucccuaugcuguuaagcaaguacucagccgaugcugagaaaguggccaaccugcuacagauuccacaguauuuugaccucgagaucuacaguacggguagaauggaaaagcaucuggaugcacuuuugaagcagaucaaauucgucguggagaagcacgucgaauccgacgugcuggaggcguguagcaaaaccuacucuauucucugcucagaggaauauacaauacaaaauaggguugauaucgcucgcagucagcugauugacgaguuuguggaucgguucaaccauagcguagaagacuuacugcaggagggggaagaggccgaugacgaugacaucuacaauguccuuuccacuuugaagagacucaccucuuuucacaacgcacacgaucugacaaaaugggaccuauucggcaauuguuauaggcugcucaagacuggaauugagcauggcgccaugcccgaacagaucgugguucaagcucugcagugcucgcacuacagcauacuuuggcaguuggugaagaucaccgacggguccccgucaaaagaggaucuguuaguccuccgaaagacagugaaaaguuuucuggccguaugccaacagugucuuucuaacgugaauaccccuguuaaggaacaggcauucaugcuguugugcgaccuccugaugauuuuuagccaucagcuaaugacuggaggucgcgagggccugcaaccccucgucuucaacccagauacggggcugcaguccgaacuuuugucauucgugauggaccacguguuuaucgaucaggacgaggagaaccagagcauggaaggagaugaggaagacgaggcuaauaaaauugaagcccugcacaagcggagaaacuuacucgcggccuucucuaaacugaucauauaugauauugucgacaugcaugcugcagccgauaucuuuaagcacuacaugaaguauuacaaugacuacggcgauauuaucaaagagacacuuuccaagaccaggcaaauagacaaaauccagugugcuaagacucugauucuaagucuccagcagcuguucaacgaguugguucaagaacaggguccuaaucuggaccguaccagcgcccaugugucugggaucaaagaguuagcacgccgguuugcgcucacauucggccuggaucagauuaagaccagagaagccguggcuacucuucacaaggacggaaucgaguuugccuucaaauaucaaaaccagaagggccaggaguaucccccacccaaucuggcauuuuuggaaguacucuccgaguucucaaguaaacugcuaaggcaggauaagaaaacaguccauagcuaccuggaaaaguuucuuacggagcaaaugauggaacgacgggaggacguguggcucccucugauaucguaccgcaacuccuugguuaccgggggagaggaugacagaaugucugugaauagcgguucaaguuccucuaagacuagcuccgucaggaacaaaaagggccggccaccgcugcacaaaaagcgaguggaagaugagucauuagacaauacauggcucaacagaaccgauacaaugauucagacucccgggccucugccagcuccccagcuuaccagcacgguucugcgcgaaaauaguaggccuaugggagaccagauccaagagccagaaucugagcacggcuccgagcccgauuucuugcauaacccgcagaugcagaucagcuggcucggucagccuaaacuggaagaccuaaaucguaaggaccggaccgggaugaacuauaugaaggugagaacaggcguaaggcacgccguccgcggacugauggaggaagaugcagagccaauuuuugaagacgugaugaugucgucacgaucucaacuugaggauaugaacgaggaguucgaagacacuauggugaucgaucuucccccuaguagaaaucggagggaacgcgccgagcugcgucccgacuucuuugauuccgcugcgauuauagaggacgauagcggcuucgggaugccaauguuuuga

SEQ ID NO: 63286 - RNA, 3807 nt, Artificial Sequence
  derived and/or modified sequence opt3 from STAG2__Homo_sapiens__NP_001036215
augaucgccgcucccgagauuccuaccgacuucaaccugcuccaggaaagcgagacacacuuuuccucugauacugacuucgaagauauagagggcaagaaucaaaaacaggggaagggaaaaacgugcaagaaagguaagaagggcccagcagaaaaagggaagggaggcaacggugggggaaaaccgcccucaggcccuaauagaaugaacggccaucaccagcagaaugggguggagaacaugaugcuuuuugaggucguuaagaugggaaaaagugccaugcaaagcgugguagacgauuggaucgaauccuacaagcaugacagggauauugcgcuguuggacuuaaucaauuucuuuauucaguguucugguugcaagggcguggucaccgcugagauguuccggcacaugcagaacucggaaaucauacgcaaaaugacagaggaguuugaugaagacucaggggauuauccacugacuauggccggaccccaguggaagaaauucaagagcaguuuuugugaguucaucggcgugcuaguucgacaaugccaguacuccauuaucuaugacgaauacaugauggauaccgugauuucucuccugacaggucuuagcgacucccagguccgugcauuuagacauaccucaacucuggccgcuaugaaauugaugacagcacucgugaauguagcccugaaccugaguaucaauauggacaacacccagaggcaauaugaggcugaacggaauaagaugauagggaaacgcgccaacgagagacucgaguuacugcuucagaagaggaaggaauugcaggagaaucaagaugaaauugagaacaugaugaacgcgaucuucaaaggaguuuuugugcaccgguaccgcgacgcaauugccgaaauccgagcuaucuguauugaggagauaggcaucuggaugaagauguauagcgaugccuuccugaaugacucuuaccuaaaauacgucggcuggacgaugcacgauaagcagggggaagugagacucaaaugccugacugcacuucagggacuguauuacaacaaggagcucaauuccaaguuggaacuguucaccucaagguuuaaagaccggauugugagcaugacauuagauaaggaguaugacgucgcuguucaggccaucaaacugcucacucuugugcugcaaaguucugaagagguauugaccgcggaggauugugaaaacguguaccaucuagucuauuccgcccaccguccuguggcaguugcugccggugaguuccuguacaagaaacucuuuagccgcagagacccagaagaggauggcaugaugaagaggcgggggcgacagggacccaaugcuaaccuggugaagacacuugucuucuuuuuccuggagucggaauugcaugagcacgccgcauaucucguggacucuaugugggacugcgccaccgaacuguuaaaagauugggaguguaugaacucccugcuacucgaagaaccucugucaggcgaggaagcucuuacggaccgccaggagagugcguugauagaaauuaugcugugcacuaucagacaggcagccgagugucacccaccgguagguagggggacaggcaagcggguucucaccgcuaaagaaaagaaaacucaacuggaugaccgcacaaagaucaccgagcuuuuugccguggcacugccccaguugcucgccaaguacagcgucgaugcugagaaagugacgaaucuguuacagcugccucaguacuucgaccuagaaauuuauaccacaggaagacucgagaagcaucuggaugcccuuuugaggcaaauccguaauauugucgaaaaacacacugacaccgaugugcuggaggcaugcuccaagacauaccaugcgcucugcaacgaagaguuuacuauauucaaucggguugacaucucucgaagccagcugauugaugaguuagcugacaaauuuaacagacugcuugaagauuucuugcaggagggcgaggagccagacgaggacgaugccuaucaggugcucucaacccugaagaggaucacagcauuucacaaugcccaugaccuaaguaaaugggaucuguucgcuuguaacuacaagcuccugaagaccgggaucgaaaauggagacaugcccgagcaaauuguaauacacgcccuucagugcacucacuaugucaucuuguggcagcuggcaaaaauuacggaauccagcucuacaaaggaggauuuacuccgccugaaaaagcaaaugcggguguucugucagaucugccagcauuaccuuaccaacguuaacacuaccgugaaagaacaggcuuuuacaauucugugugacaucuugaugauauucucacaccaaaucaugagugguggcagagauaugcucgagccucuggucuauaccccagacagcucccuacagucugagcugcucucguuuauucuggaucauguguucaucgaacaggacgaugacaauaacagcgccgaugggcagcaagaggacgaagcguccaagauugaggcccuucacaagaggcgcaauuugcuggcugcauuuugcaaauuaaucguauacacugugguugaaaugaacacagccgcugacauauucaagcaguacaugaaauauuacaaugauuauggagacauuaucaaggagacgaugucaaaaacccgacagauugauaagauccagugugccaagacucucauacugagucuucaacagcuguuuaacgagaugauccaggaaaauggcuacaacuucgaccggucuagcuccacauuuucagguauuaaagagcuagcacguagauucgcgcucaccuuugggcuggaucaauugaagacaagggaagccaucgcuaugcugcacaaagacggcauugaguucgccuuuaaggaacccaauccgcagggagagagccauccucccuuaaaccucgcauuccuggauauccuuucugaguucuccaguaaacuguugcgccaggacaagcggacugucuauguguaccucgaaaaguuuaugaccuuccagaugagccugagaagggaggauguguggcuaccacugaugucuuaucgaaauucccuucucgcuggcggggacgaugacacgaugucagucauaaguggaauuagcucgcgcgguuccaccguucggucuaaaaagagcaaaccuucaacaggcaagagaaaagugguggaagggaugcaacugaguuugacugaggaguccucuagcuccgacucaauguggcugagcagggaacagaccuuacacacacccguaaugaugcagacuccacagcucaccaguacgaucaugcgugagcccaagcgccugcggccugaagauucuuuuauguccgucuacccaaugcaaacagagcaucaccagaccccgcuugacuacaacacucaggugacauggaugcuggcccagagacaacaggaagaggcaaggcagcagcaagagcgagccgcuaugagcuauguuaaauugcggaccaaucuccagcaugcgauccgcagaggaacuucgcugauggaagaugacgaggaacccauuguggaggaugucaugaugucaucugaaggcaggaucgaggaccuaaacgaggguauggauuucgacaccauggauauugaccugccuccaaguaagaaucggcgagaaagaacagagcuuaagcccgacuuuuucgauccugccuccauaauggaugaaagcgugcucgggguuucuauguuuuga

SEQ ID NO: 63287 - RNA, 3681 nt, Artificial Sequence
  derived and/or modified sequence opt3 from STAG3__Homo_sapiens__NP_001269646
augagcaguccccugcagagagccgugggcgacaccaagagggcucucucugcaucaaguagcuccucugccucgcuuccuuucgaugaccgggauucaaaccacacaagcgaggggaauggagacagucuguuggcggaugaagacacugauuuugaggacuccuuaaaccgcaaugucaaaaagcgagcugccaaacguccaccgaagacgacccccguugcaaaacauccuaagaaggguucuagagugguacacaggcauagccggaaacaauccgaaccacccgccaacgaucuguucaaugcugugaaggcagccaaaucagacaugcagagucuagucgaugaguggcucgacagcuacaagcaggaucaggacgcuggcuuucuggaacuugugaacuucuuuauccaaucuugcggguguaaaggaauuguuacaccugagauguucaagaagauguccaauucagagauaauccagcaccugacugaacaguuuaacgaggacagcggcgauuauccauugauugcccccgguccuaguuggaaaaaguuccaggggucuuuuugcgaguucgugcgcacccucgucugucaaugccaguacucccugcuguaugacggauuuccaauggaugaccucaucagcuuacugacaggccuuucggauucucaggugagagcguucaggcauaccuccacuuuggcagccaugaaacugaugacaucacugguaaagguugcucuccagcugagugugcaccaagacaauaaccagcggcaguacgaagccgagcgcaauaaaggcccggggcaacgagcacccgaaagacuugagagccuguuggaaaagaggaaagagcuccaggaacaccaggaggagauugaaggaaugaugaacgcucuguuucggggugucuucgugcaucguuaucgcgauguguuaccugagaucagagccauauguaucgaagagauuggcugcuggaugcaguccuacucuaccagcuuccugacggacucauaucucaaguacaucggguggacucuucacgauaagcauagggaaguccggcugaaauguguuaaggcguugaaaggacuauacggcaaucgagaccugaccacacgccucgagcuguuuacuuccagauucaaggauaggaugguguccaugguaauggaccgggaguaugacguggccgucgaagcagugcgccuucugauuuugauccucaaaaacauggaggguguucugaccgaugcugacugcgaaagcguguacccagucguguaugccucucacagaggguuagcuucagccgcaggagaguuucuguacuggaagcuauucuaucccgaaugugagauaaggaugaugggcggccgugagcaacggcagaguccuggggcccagcgaacauuuuuccagcuccugcuuagcuuuuucguagaauccgaguugcacgaucaugcugcguaccugguugacucucucugggauugcgcaggagccagacugaaggacugggaaggucuuaccucgcuguugcucgagaaagaucaaaaucugggcgacgugcaggagagcacguuaauugaaauccuggucuccucagcuaggcaggccagugaggggcacccacccgugggacgcgucacuggccggaagggucuaacaucuaaagaaagaaagacccaggcagaugacagggugaaacucacugagcaucugauuccgcuuuugccucaacugcucgccaaguuuagcgcugaugccgaaaagguuacaccccuguuacagcugcuuuccuguuucgacuugcacaucuauugcaccgggcgccucgagaaacaucuggagcuauuucugcagcagcuccaagaagugguagucaagcacgcagagccagcggugcuggaagcuggcgcccacgcacuuuacuugcugugcaacccugaguucacguuuuucucacgagccgauuucgcucggagccaguuaguugaccuccugaccgaccguuuucagcaagaacuugaggagcuguugcagucuuccuuccucgaugaagacgagguguacaaccuggccgcaacacuaaaaagacugagugcuuuuuauaauacucaugaucucaccaggugggaacuguacgagcccuguugccagcuuuugcagaaggccgucgacacaggagaagugccacaccaaguaauccugcccgcguuaacucucguguauuucagcauucuguggacccuuacacauauaucuaaauccgaugccucacagaagcagcugaguagccuacgcgaccggaugguugcuuuuugugagcucugccagucgugucuguccgaugucgacaccgagauccaagaacaggcauucguguugcugucugauuuacuccugauuuuuagcccucagaugaucgugggcgggagagacuuccuuaggccacuggucuuuuucccggaggccacuuugcagucagaacucgcuaguuuucugauggaucacguuuucauacaacccggagaccuagguuccggcgauucucaggaggaccaccuacagauugagcgacuucaucaacgccggagacuccuggccggguuuugcaaguugcuguuauacggagugcucgaaauggacgcagcgagcgauguguucaaacacuauaacaaguucuacaaugacuauggcgauaucaucaaagagacgcugacaagggcccgucagauugaccgcucccauuguucacggauccuucuguugagccucaagcagcuguacaccgaacuacugcaggagcacgguccucaagggcuuaacgaacucccagcuuuuauugagaugagagaucuggccaggcgauucgcauugaguuuuggcccccagcaguuacagaaucgggaccugguagucaugcuccauaaagagggaauacaauucucucuguccgaacuuccuccagcuggcagcucgaaccagcccccgaaucuggccuuuuuggagcuacugucagaguucucuccucgccucuuucaccaggauaagcagcugcuuuuaaguuaccuggaaaaaugccuccaacacgugucccaggcaccagggcaucccuggggaccuguuacuaccuauugucacagcuugucucccguggaaaacacagccgagaccagcccacagguccugccuuccucaaagagaaggcggguggagggucccgcuaagccaaaucgagaagacguuaguagcucucaggaggaaucccuccaacugaacucaaucccgccuacucccacacuuacgaguaccgcggugaaaagcagacagccacuguggggcuugaaggagauggaagaggaggauggguccgaacuagacuucgcccagggaucucaacccguagcaggcacugagcgcucgagguuucuggguccucaguacuuccagacaccacauaaucccagcgggccuggccucggaaaccaguuaaugcgucugucacuuauggaagaggaugaggaagaggaacuggagauucaagacgaauccaaugaggagcggcaggacaccgauaugcaggcuaguucuuauagcuccacaucagaaagaggccucgacuugcuggauucuacugagcucgacaucgaagauuuuuga

SEQ ID NO: 63288 - RNA, 1578 nt, Artificial Sequence
  derived and/or modified sequence opt3 from STAM2__Homo_sapiens__NP_005834
augccccuguucaccgccaacccuuuugagcaggacguggaaaaggcuacaaaugaguacaacacuacggaagauuggagccucaucauggacauuugcgauaaagucggcuccaccccaaauggggcaaaggacugucuuaaagccauaaugaagagaguuaaccacaaagugccgcauguagcgcugcaggcuuugacauuacugggagccugcguggcaaauugugguaagaucuuccaccuagaggucugcucuagggauuuugccacugaagugcgggcuguuauuaagaacaaagcacaucccaaggugugugagaaacucaagucacugauggucgaguggagugaagaguuccaaaaagacccucaguuuagccuuaucuccgccaccauuaagucuaugaaggaagagggcaucacauucccacccgcugggucgcagaccgugucagccgcggcaaagaauggaacuagcaguaacaagaauaaagaggaugaagacauagccaaggcuaucgagcuguccuugcaagaacagaaacagcagcacacagagaccaagucucucuauccuagcuccgaaauucaacugaacaauaaaguagcccgcaagguucgagcacuguacgauuuugaggcuguggaggacaacgaacucacguucaagcauggcgagaucauuaucgucuuagaugacucagaugccaauugguggaaaggugaaaaccaccgugggauaggacuguuuccaaguaauuucgugacuaccaaccuuaacauugagacagaagcggccgcaguggacaaguugaaugucaucgacgaugacguugaggagauuaaaaagagcgaacccgagccuguguauaucgaugaagacaaaauggauagagcucugcagguacuacagucuaucgacccaacugauuccaagccggacucacaggaucuccuggaccuugaggauauuugccaacagaugggccccaugauagacgaaaagcuggaggagaucgacaggaaacacagcgaauugagugagcucaacgugaagguccuggaagccuuagagcuguacaauaaacucgugaacgaggcuccuguuuauucuguguacuccaaacuucauccacccgcccacuauccuccagcaagcucgggcguccccaugcagaccuacccggugcaaucucaugggggaaauuacaugggucaguccauucaccagguaacaguugcccagucauauagucugggcccugaucaaaucgggcccuugcggagccuaccaccuaacgucaauuccucugugaccgcucagcccgcgcagacgagcuaccugucaacuggacaggacacagugaguaacccaaccuauaugaaucaaaacuccaaucuccagagcgcaacuggcacaaccgccuacacgcagcagauggguaugucugucgauaugucaaguuaucaaaacaccacaagcaaucugccccagcuugcuggguuuccugugacuguuccagcccacccgguggcacagcagcauaccaacuaccaccaacagccccuguuguga

SEQ ID NO: 63289 - RNA, 1275 nt, Artificial Sequence
  derived and/or modified sequence opt3 from STAMBP__Homo_sapiens__NP_998787
augagcgaccacggcgaugugucccugcccccugaggacagagucagggcccucucucagcuugggucagcuguugaagugaacgaggauaucccaccgcggcgcuacuuccgaaguggaguagaaauuauacguauggcaagcaucuauuccgaggaagguaauauugagcaugccuuuauccuguacaacaaguauauuaccuuguucaucgagaaauuacccaagcacagagacuacaaaucugcggugauaccugaaaagaaagauacagucaagaagcugaaagagaucgcuuuuccaaaggccgaggaacuaaaagcagagcuccugaagagguauacuaaagaauacacggaguauaaugaagagaagaagaaagaagccgaggagcuugcucggaacauggcaauucaacaggaacuggagaaggaaaaacagcgcguggcccagcaaaagcagcagcaguuggagcaagaacaguuccaugcuuuugaggagaugaucagaaaucaggaacucgagaaagaaaggcugaagauuguucaggaguucggcaaaguggaccccgggcugggaggcccucucgucccagauuuagaaaagcccucgcuggacguguuuccuacccuuacaguaucaagcauccaaccaagugauugccacacuaccguucggccggccaagcccccuguggucgaccgcuccuugaaaccaggugcgcugucuaacagcgaguccauacccacaauugaugggcuacgacaugugguggucccuggaagacucuguccacaguuccugcagcuugcaucagccaauaccgcuaggggcguugagacuugcggcauccugugugggaaguugaugcggaacgaauuuacaauuacccacgugcucauccccaaacaaagugccggaagcgacuacugcaauacggagaacgaagaggagcuguucuuaauccaggaucagcagggucugauuacucucggcuggauacacacccauccgacacaaacugcauuucuuucuuccguagaccugcacacccauuguucauaccagaugauguugccugaaagcguggcuaucgucugcagucccaaguuccaggagacaggguuuuucaaacuaaccgaccacggacuggaagagauuucuuccugucgucagaagggcuuccacccacauagcaaggauccuccccucuuuugcucguguucucacgugacgguuguggaccgcgccgucacuaucacagaucugagauga

SEQ ID NO: 63290 - RNA, 1311 nt, Artificial Sequence
  derived and/or modified sequence opt3 from STAMBPL1__Homo_sapiens__NP_065850
auggaccagcccuucaccgugaacagccugaagaaacucgccgcuaugccugaucacacagacgucucccuuucuccagaggaaagaguuagggcacugucaaaguugggcugcaauaucacuauuagugaggauauaacgccgcggcgcuacuuucgaagcgggguggaaauggagcguauggccuccguauauuuagaagagggaaaccuggagaaugcguucgugcuauacaacaaauuuaucacccucuucgucgaaaagcugcccaaucauagagacuaucaacagugugcugugccugagaaacaggauauuaugaagaaacuuaaggaaaucgccuuuccaaggacagacgagcugaagaacgauuugcucaaaaaguacaauguugaguaucaggaauaccugcaaucuaaaaacaaguauaaggcagagauucugaaaaagcucgaacaccagcgguuaaucgaggccgaacgcaaaagaauagcucagaugaggcagcaacagcuggagucggagcaguuccuuuucuucgaagaccaguugaagaaacaagagcuggcacggggucagaugcgcucacagcaaacuagcggccuaagugaacagaucgauggguccgcccucucuugcuuuagcacccaucagaauaacucccugcuuaauguguucgcugaccagcccaacaagucagaugccacaaauuacgcgagucacagcccuccagucaaccgagcacugacccccgccgcuacuuugucugccgugcaaaaucucguaguugagggacugagauguguggucuuaccugaagaccugugccauaaauuucuccagcuugcagaguccaacacagugaggggcauugagaccugugguauccugugcgggaaguugacgcacaacgaauuuacuauuacccacgugaucgucccaaagcagucagcuggaccggauuacugugacauggagaauguugaggaacuauuuaacgugcaggaccaacaugaucugcucacacugggcuggauacacacucaucccacccagacagccuuccuuagcaguguagaccugcacacccacugcucuuaucaguugaugcucccugaagcgauugccaucguguguuccccaaaacauaaggauacgggcauuuuccggcugacuaaugcagggauguuagaggucagcgcuugcaaaaagaaaggauuucacccccauacaaaggagccucgucuguucucgaucuguaagcacgugcuaguuaaagacaucaagauuauagugcucgaucugcgcuga

SEQ ID NO: 63291 - RNA, 1623 nt, Artificial Sequence
  derived and/or modified sequence opt3 from STAM__Homo_sapiens__NP_003464
augccccuguucgccaccaacccuuuugaccaggauguggagaaggcuacaagcgaaaugaauacugcagaggacuggggccucauccuugauauuugcgacaaggucgggcaauccagaacgggaccaaaggauugucugaggucuauaaugcggcgcguuaaccacaaagacccgcauguggccaugcaggcguugaccuuacugggugcuugcguaucaaauuguggcaagaucuuccaccuagaagugugcagucgagauuuugccagcgaggucuccaacgugcucaauaaagggcaucccaagguuugugaaaagcugaaagcacuuaugguggaguggacagacgaguucaagaacgauccucagcugucuuugauuucggccaugaucaaaaaucucaaggaacagggagucacuuuuccagcuauuggcucacaagcagccgagcaggcuaaagccagccccgcgcugguggcaaaggacccugguaccguagccaacaagaaagaagaggaggaucuggcuaaggccaucgaacucaguuuaaaagagcagcgucagcaauccacaacccugucuacucuuuacccaagcacauccucauugcugaccaaucaccagcaugaagggagaaagguuagggcaauauaugacuucgaggcugccgaagauaacgagcuaacguuuaaagcgggagagaucauuacugugcucgacgacagugaucccaauugguggaagggcgaaacccaccagggcaucgggcuguucccuagcaacuuugucacagccgaccuuacugcagagccagaaaugauuaaaaccgagaagaagacagugcaguucucugaugacgugcaagucgaaaccaucgagccggagcccgaaccugcuuuuauagaugaggacaaaauggaucagcuguugcagaugcuccaauccacggacccaucagaugaccagcccgaucugccugaauuacugcaccucgaggccaugugccaucagaugggaccacuuauugacgaaaagcuggaggacaucgaucggaaacacagcgaguugagugaacuaaauguuaaggugauggaggcucugucucucuacacuaaacugaugaacgaagaccccauguauuccauguacgccaaacuucagaaucaaccguauuacaugcagagcucggguguaucuggcucccagguguaugcagggccucccccaucaggagccuaccuggucgcuggcaacgcgcagaugagucauuugcaaagcuacucccucccucccgagcagcugucuagcuuaucacaggcagugguuccacccagugccaacccugcucugccaucccagcaaacacaggccgcauauccgaauaccauggugagcucuguccaggguaacacuuaccccucacaggccccuguguauaguccacccccugcugccacagcagcggcugccaccgcagauguaacgcuauaccaaaaugccgggccaaacaugccccagguuccgaauuauaaccucaccagcuccacacugccucagccaggaggcucucaacagcccccucagccccagcaaccauacucgcagaaggcucuuuuguga

SEQ ID NO: 63292 - RNA, 888 nt, Artificial Sequence
  derived and/or modified sequence opt3 from STAP1__Homo_sapiens__NP_036240
augauggccaagaaacccccuaagccagcuccgagaaggaucuuccaggagcggcugaaaauuaccgcacucccccuuuacuuugaaggcuuccuguugauaaagcgcagcggguaucgagaguacgaacacuauuggacagaguuacguggaacuacgcuguuuuucuacaccgacaaaaaguccaucauuuauguggauaagcuagacaucgucgaucucacaugccugacugaacaaaacucuaccgagaaaaauugugccaaguuuacacuuguucugccuaaagaggaagugcaguugaagaccgagaacacugaaucaggugaggaguggagaggcuucauucucacaguaaccgaacugagugugccacagaaugucagccugcuccccggacaggugaucaaauuacaugagguucuggaaagggagaagaagcggcgcauagaaacggagcaauccacuucuguggagaaagaaaaggagccuaccgaagacuacgucgaugugcuuaacccaaugcccgcgugcuuuuauacaguaucgagaaaagaggcuacugaaauguugcagaagaauccuucacuggggaacaugauccuaaggccaggcagcgacagucggaauuacuccauuaccauccgccaggagauugauaucccgcgaauaaaacacuacaagguuaugucugugggucagaacuauacaauugagcucgaaaaacccgucacccugccuaaucuuuucagcgugaucgacuacuuugugaaggagacgagagggaaccugaggccauucauuuguuccacugaugaaaauacaggacaagagcccucaauggaaggccggagugagaaguugaaaaagaacccucauaucgccuga

SEQ ID NO: 63293 - RNA, 1212 nt, Artificial Sequence
  derived and/or modified sequence opt3 from STAP2__Homo_sapiens__NP_001013863
auggccagcgcucugagacccccuagggugccaaagccgaaaggcguccuccccucccacuacuaugagucuuuccuugaaaagaaagggccuugcgaccgggauuacaagaaauuuugggcaggacugcaggguuugaccaucuauuucuacaacucaaaucgcgacuuucaacauguugagaaguuaaaccugggcgccuucgaaaagcuaacagaugagauuccaugggggaguagccgagaccccggaacucacuuuucccucauacugcgugaucaggaaaucaaauucaagguggagacgcuugaguguagagaaauguggaaaggcuuuauucugaccguaguggaguugagggucccuacagaccucacucugcugccaggucaucucuauaugaugucugaaguguuagcgaaggaggaggcucggcgcgcccuggaaacccccucgugcuuccuuaaaguuucaagauuggaggcacagcugcuacucgaaagguacccugagugugggaaucugcuucugcggccaagcggagauggcgccgacggcgugagugucacaacccgccagaugcacaacgggacucaugugguacgacacuauaagguuaagagagaaggaccgaaauacgugaucgaugucgagcaacccuuuuccugcacaucuuuggacgcuguggugaauuacuucgucagccacaccaagaaagcacucguuccuuuucuguuagaugaggacuaugaaaaggugcuggguuacguagaggccgauaaagaaaacggcgagaaugugugggucgcuccauccgcccccgggccuggaccagcgcccuguacgggcgguccgaagccucucucacccgcaaguagccaggacaaacuuccaccucugcccccauugcccaaccaggaagagaauuaugugacuccuauuggggacggaccagccguugauuacgagaaccaggacguggcuucuuccucauggccggucauccuaaagcccaagaaacugccuaagccacccgccaaacucccuaagccacccgugggcccgaaaccugaaccaaagguauucaauggcgggcugggaaggaaacuucccguuagcagugcacaaccucuguuucccaccgcugguuuggccgauaugacagcggagcuccagaagaagcuggaaaaacggcgugccuuagagcauuga

SEQ ID NO: 63294 - RNA, 876 nt, Artificial Sequence
  derived and/or modified sequence opt3 from STARD10__Homo_sapiens__NP_006636
auggagaagcuggccgcuagcaccgaaccccagggcccuagaccagugcucgggagggaguccguccaaguuccggacgaucaggacuuccggucuuuucgcucagaaugcgaggcagaagugggauggaaccuuacauacagucgagccgguguaagcguguggguccaggcgguggagauggaucguacucugcacaaaaucaaguguagaauggagugcugugacguucccgcugaaacguuguaugauguguuacaugacauugaguacaggaaaaagugggauuccaaugucauagaaaccuucgacaucgcccggcugacagugaacgcagauguaggcuauuacucuuggcgcugcccuaaaccacuaaagaauagagacguuauuacucucaggucguggcugcccaugggggccgauuauaucauuaugaacuacucagugaagcacccuaaauauccaccccggaaggaccuuguccgcgcugugagcauccagaccggauaccugauacaaaguacaggcccuaaauccugugugaucaccuacuuggcacaggucgauccaaaggguucucucccgaaauggguugugaauaagagcucccaguuucuggcccccaaggcuaugaaaaagauguauaaagccugccugaaguacccugaguggaaacagaagcaucucccacacuucaaacccugguuacauccugagcaaucaccacugcccagucuugcguugagcgaacugucuguacagcacgcagacucccuagagaacauugacgaaucagccguggcugagagccgagaagagagaaugggaggggccggcggcgaggggagugaugacgauacuucucucacauga

SEQ ID NO: 63295 - RNA, 2064 nt, Artificial Sequence
  derived and/or modified sequence opt3 from STARD13__Homo_sapiens__NP_001230395
augcuggagcccagcuccgugcuccacgccaacgucaaucaggcuccucuuuggugccugguuuugagaugguguagggaaugcaaggacaccguguguggcgggaaacaaaagucucggguaaaccauacauuccagcgccgagagaucgaagcaaaagaggccugcgauugguuacgugcggcuggauuuccacaguacgcccagcuguaugaagacucacaauucccgauuaauauaguggcagucaagaacgaucacgacuuucuagagaaagaucucguggagccccuguguagaaggcuuaauacucugaacaagugcgccaguaugaaguuggacguuaauuuccagcggaaaaagggugaugacagcgaugaagaggaccucuguaucuccaacaaauggacguuucagcgcaccucuagaagguggucgcggguggaugaccuguacacacugcucccucgcggcgaucgaaaugggucaccaggaggcacugguaugagaaacaccacaagcagugaauccgucuuaaccgaccugucugagcccgaggugugcagcauucauuccgaaucaagugggggaagcgacucuaggucccagccuggccaauguugcacugauaauccaguaaugcuugacgcucccuugguuucaagcagucugccucagccaccgcgggaugugcuaaaccaccccuuccauccuaagaaugagaaaccaacacgugcacgcgccaagucuuuucucaagagaauggaaacccugaggggcaaaggggcucacggacggcacaaggguuccggccgaacugggggacuugucaucagcggccccaugcugcagcaggagccugaaucguucaaagccaugcaauguauucagaucccaaacggugacuugcaaaauucucccccgccugcgugccgcaaggggcuccccugcuccggaaaaucaaguggcgagagcuccccaucugagcauagcucaaguggcguguccacgccuugucugaaggaaagaaaaugccacgaggcaaacaagaggggagggauguauuuagaagaucuggacgugcucgccgguaccgcccuucccgaugcuggcgaccagagccggaugcaugaguuucacucucaggaaaaccuggucguucacauaccaaaggaucauaaacccgggacauucccuaaggcauugucaaucgagagucuaagcccaacugacuccucuaauggagugaacuggcgcaccggcucgauuagccuggguagagagcagguaccgggggcuagggaaccccgucucauggccuccugucaccgggcgucacgagugaguaucuacgauaaugucccuggcucucaucuguaugccagcacaggagaccuucuggacuuggagaaagaugaccucuuuccacaccuggaugacauuuuacagcaugugaacggccugcaagaaguuguggaugacugguccaaggauguccuacccgagcuccagacccacgacacgcuggugggggaaccuggacuuucaacuuucccaagccccaaucagaucacauuggauuuugaggguaacucuguauccgagggcagaaccacuccgagugacguugaaagggaugugacaagccugaaugagucugaaccuccagggguccgcgaccggagagauuccggagugggcgcaucacucaccaggcccaaccgccgacugcgguggaauaguuuccagcuuagccaccaaccucgucccgcuccagccucgccucauauauccucucagacggcuagccagcugucauugcuccagagauucagucuguuaaggcugaccgccauuauggagaaacacuccaugucuaacaagcaugguuggacauggagcguccccaaguuuaugaaacgcaugaaggugccagacuacaaagacaaggcaguuuucggggugccgcuaaucguacacguccaacggacuggccagccucucccccaguccauucagcaagcccugagauaucuuaggucaaauugcuuggaucaggaguga

SEQ ID NO: 63296 - RNA, 1338 nt, Artificial Sequence
  derived and/or modified sequence opt3 from STARD3__Homo_sapiens__NP_001159409
augagcaagcugcccagagagcucaccagggaccuugaacggucccugccugccguggcuucuuugggcucaaguuuaagccacucccagucucugucgucacaucuacucccaccgcccgagaaacgccgagcaaucagcgauguccguagaacauucugccuguuuguuacuuucgaccuucuguuuauuaguuugcucuggauaaucgaacugaacacgaauaccgggauuaggaagaaccuggagcaagaaaucauucaguacaauuucaaaacauccuuuuucgauaucuuugugcucgccuucuuucgguucucuggauuacugcuugguuaugcgguauugcgccugagacacuggagcaggcggugguguccugugcauuccucacuaagucgcucuagcucccucucaugcagcgcuaagggccaccuggccacuuguaguccaucuucccuucugagcucgcccggguggcgaccuggaucuuugaccuccaaaucauacccaagaaagcucaagaggagugacagcgcacccccuggcuaucuggccgcucaggucgcaguggcccgggguccauuacuguuuuccggggcucucucugagggacaguucuacagcccgcccgagucauuugccggcagugauaacgaauccgacgaggaaguugcgggcaaaaagagcuucucugcacaagagcgugaguauauacgccaggggaaagaagccacagcuguggucgaucagauccuugcccaggaggaaaauuggaaguucgagaaaaacaaugaauacggagacaccguguauacuauugagguaccuuuucaugguaagacauucauccugaagaccuuuuugccaugccccgcagagcuaguuuaccaagaagugauucugcagccugagagaaugguccucuggaacaaaacggugacugcuugucagauccugcagaggguggaagauaauacccuuauaucauacgacgucagugccggcgcggccgggggaguugugagcccacgggauuucguaaacgugcgacgcauugagagaaggcgggaccgcuaucuguccucuggcaucgcaacaucgcacagcgcuaagcccccgacucacaaauacgucagaggugaaaaugggccuggaggcuuuauuguguugaaguccgccucaaaccccaggguuugcaccuucguguggauccucaauacagaucugaaaggccguuuaccacgguaucugauccaucaaagucuagcugccaccauguuugaguucgcauuucaccuccgacagagaauuucugagcugggggccagggcuuga

SEQ ID NO: 63297 - RNA, 705 nt, Artificial Sequence
  derived and/or modified sequence opt3 from STARD3NL__Homo_sapiens__NP_114405
augaaccaucugcccgaggacauggaaaaugcccucaccggcagccaguccucucacgcuucacuuagaaacauccacaguauuaauccuacacaacugauggcaaggauagagagcuacgaagggcgggagaagaaaggaaucuccgaugugcgccgaacuuucugcuuguuugucacguucgacuuacuguuuguuacccuacucuggauuaucgaacugaacgugaaugguggcauugagaacacacuugagaaggaaguaaugcaguaugauuacuauucuucguacuucgacaucuuucuguuggccguguuccguuuuaaaguccucauacuggcguaugcuguguguagacugaggcauuggugggccaucgcacucacuaccgccguuacaucagcuuucuuacuggcaaaggugauucuuagcaaauuguuuagucagggggccuucggauacguccugccaaucauuuccuuuauccuagcuuggauagagaccugguuccucgauuuuaaggugcugccgcaggaagccgaggaggaaaaucggcuucugauuguacaagacgcgucugagcgcgcagccuugauccccggcggucucagcgaugggcaguucuauuccccuccagaaucagaggcuggaagugaagaggccgaggaaaagcaggacagcgagaaaccccuguuagaacuguga

SEQ ID NO: 63298 - RNA, 642 nt, Artificial Sequence
  derived and/or modified sequence opt3 from STARD5__Homo_sapiens__NP_871629
auggaccccgcccuggcugcacagaugagcgaggccguggcggaaaagaugcuccaauacagaagggauaccgcuggcuggaaaaucugccgggaggggaacggagucuccguuucuuggcgcccuucaguggaguucccagguaaucuuuaucgaggcgaagggauuguauacggaacacuggaagaggugugggacugugucaagccggccgugggcgguuugcguguuaaaugggaugagaacgugacuggguuugaaauaauccagaguauuacggacaccuuaugcgucagcagaacauccacucccucugcagccaugaagcugaucucgccuagggauuucguggaccuaguacucguuaaacgguaugaggauggaaccauuucaagcaaugcuacacacguggaacauccacugugucccccuaagccaggcuuuguccgcggcuucaaccaccccugcggguguuuuugcgagccucuuccaggagagccgaccaagacuaaucuggugacauucuuucauaccgacuugagugguuaccucccccagaacguggucgauuccuucuuuccuagaucuaugacgagguucuaugcaaaucugcagaaagccguuaagcaauuucacgaauga

SEQ ID NO: 63299 - RNA, 1113 nt, Artificial Sequence
  derived and/or modified sequence opt3 from STARD7__Homo_sapiens__NP_064536
augcugcccagaaggcuccuugccgcuuggcuggcaggcacccgagggggagguuuguuagcccugcuagcgaaccagugccgcuucgugacaggccuccgaguccguagagcucaacagaucgcccagcuguacgggaggcuuuauagcgaguccucucggcgcguucuguugggaagacucuggaggcggcugcacggccgcccuggucaugcaucagcccugauggcugcacucgccgggguguuuguaugggacgaagaacggauucaggaagaggaauuacaaagaaguauaaaugagaugaagaggcuggaggaaaugagcaacauguuccaguccucuggagugcagcaccauccaccggagcccaaagcucagacugaaggcaaugaggauucggagggcaaggaacaacggugggagauggucauggacaaaaagcacuuuaaacuuuggcgucgcccuaucacggggacccauuuguaccaguauagaguguucggaacauacacugauguuaccccaaggcaguuuuucaacgugcagcuggacacagaauaucggaagaagugggaugcccuagucauuaaacucgaggugaucgaacgagacguaguuucagguagcgaggugcugcacugggucacccacuuucccuacccuauguauagucgcgauuacguguacgugagaagguauuccgucgaccaagagaauaacaugaugguucuugugucucgggcgguagaacauccaagcgugcccgaguccccugaguucguccgcgugagaucauacgagagucagaugguuauuaggccacacaagagcuuugaugaaaauggcuucgacuaucuguugacuuacucugauaacccgcagacaguguuuccccguuauugugucuccuggauggugucaagcgggaugccugacuuccucgagaaacugcauauggcaaccuuaaaggccaaaaauauggagaucaagguaaaggauuacauaagugcuaaaccacuggaaaugucuuccgaggccaaggcaacgagccaaucgucugaacggaaaaacgagggauccugcggccccgcucgaaucgaauaugccuga

SEQ ID NO: 63300 - RNA, 3312 nt, Artificial Sequence
  derived and/or modified sequence opt3 from STARD8__Homo_sapiens__NP_001135975
augccccugcucgacguguucuggagcugcuuuagaaaggucaaauguuucccucuucugcagguuaagaaaaacgccgaggcugaagcaaagagggccugcgagugguugcaagcgaccggcuuuccacaguacgugcaguuauucgaagagggguccuuuccgcuggauaucggaucugugaaaaagaaucacgguuuccuagacgaagauucacucggcgcucugugucggcgccuuaugacacugaacaauugcgccaguaugaaguuggagguacauuuucagagcaaacaaaacgaggacuccgaagaggaggaacaguguacuauuucuucgcacugggcauuccagcaggagucaaagugcuggagccccauggggaguuccgaucuccuggccccuccaucucccggacugccugcuacgagcuccugugaaucaguccucaccgaguuaagugcaacaagccugccagugauaacuguuucucuucccccugaaccagccgacuugccgcugcccggccgagcuccuuccucaagcgaucguccacuacucagucccacccaaggucaggaggggccucaggacaaagccaagaaaagacauaggaaucggucuuuucugaagcaccuugaaucccugcgcagaaaggagaaaagcggaucgcagcaagcggagccaaagcauucucccgcaacauccgaaaaagugucaaaggccaguagcuucagguccugccggggcuuuuugucugcuggcuucuaucgcgccaaaaacugggcagcuaccagcgccgggggaucaggugcgaauacucgaaaggccugggaggcauggccggucgcuaguuuuagacacccucaguggacacacaggggcgauugucucgugcauguacccggggaccacaaaccaggaaccuucccucggucccugagcaucgaaucuuuaugccccgaggauggccaucgucuggccgacuggcagccaggucgcagaugggggugugaaggaaggcggggcucaugcggcaguacggggagccacgcuuccacuuacgauaaccuccccgagcuuuauccugccgagccaguuauggugggagcagaagccgaggacgaagacgaugaggaaucugguggcucguacgcucaccuggacgauauuuugcaacaugucugggggcuacagcagcgaguggagcuguggagccgcgcgauguauccggaccucggacccggcgaugaggaagaggaagaggcaaccuccucaguggagaucgccacagucgaaguuaagugccaggcugaggcccugagucaaauggaagugccugcacacggugagucuccagccugggcucaggccgaaguacagcccgcagugcuugcgccugcucaggccccagcagaggccgagcccgucgcucaagaagaggccgaagcaccggcuccugccccagcgcccgccccugcucaggacagcgagcaggaagcacauuccgggggcgagcccacuuucgccucaagccugucuguggaggaaggacacuccauuagugauaccguugcuucgucuuccgaguuggacucaaguggcaauagcaugaacgaagccgaggcagcggggccacucgccggacugcaggcuucgaugccuagagaaaggcgggauuccggugugggcgccucuuuaacacgccccuguagaaagcugagguggcauagcuuucaaaauucacaccguccaagucuaaacuccgagucucucgagaucaaucggcaguucgcagggcagauaaaccugcuucacaaaggaagccuucugcgacucaccgcuuuuauggaaaaguacacggucccgcauaaacagggcugggugugguccaugccuaaguucaugagaaggaauaaaacucccgacuaucgcggucaacacguauuugggguuccaccccugauccaugugcagcggacaggccagccucuuccacaaucaauucagcaggccaugagauaccugaggagccagugcuuggaucaagucggaaucuuccgcaagaguggcgugaagucucggauucagaaccuccgacagaugaacgagaccucccccgacaaugucuguuacgaagggcagagcgcauaugacguggccgaucuguuaaaacaauacuuucgugaccugccugagccgaucuucacuucgaagcuaacaaccacguuucuccagauauaucagcugcuuccaaaagaucagugguuggcugcggcccaagcagcuacccugcuccugcccgacgagaacagagaaguuuuacagacacugcuuuacuucuugucagauauugccucugccgaggaaaaucagaugacugcuggaaaccucgcagugugccuggccccuaguaucuuucaccuaaauguauccaagaaagacagcccaucucccaggauuaagagcaagcgcucccugaucggucggccuggcccgagagaucucucagacaacauggcggcuacccaagggcugagucacaugaucagcgauuguaaaaaguuguuccaggucccccaggacaugguguugcagcuguguucuuccuauucagccgcagaguuaaguccaccuggacccgcccucgcugaacugaggcaagcacaggccgcgggcguuagccuuucccuguacauggaggagaauauucaggauuugcuccgagacgcugccgaacgcuuuaaagguuggaugucugugccagggccucagcauacagagcuggcaugccggaaggcccccgauggccacccacuaagacuguggaaagcuagcacugaagucgccgcaccgccugcugugguacuccauagggugcugcgugagcgcgcccuuugggacgaagacuugcugcgggcgcaaguuuuagaggcccucaugcccggagucgagcuguaucacuacgugaccgauagcauggcaccacaucccugcagagacuucgugguccuuaggauguggcgaucagaucugccucggggcgggugucuacucguuucccagagucuggacccagaacagcccgugccugagucuggagugcgcgcuuugaugcugacaagccaguacuuaauggaaccgugcggccucgguagauccaggcugacccacauaugucgggccgaucuucgagggagaucaccagacugguauaacaagguauucggacaccugugcgcuauggaggucgcaaagauccgcgauucuuuucccacuuugcaagccgccggcccugaaacgaaacucuga

SEQ ID NO: 63301 - RNA, 14103 nt, Artificial Sequence
  derived and/or modified sequence opt3 from STARD9__Homo_sapiens__NP_065810
auggccaacgugcaggucgcuguucgggugaggccccugagcaagcgggagaccaaagaaggcgggcgcaucauuguagagguggacggaaaggucgcaaaaauacgaaaucuaaagguggauaaccguccugacgguuucggcgauuccagagaaaaaguuauggccuuuggguucgacuacugcuauuggucugugaauccagaggauccgcaauacgcgucacaggacgucguguuucaggaucuuggaauggaaguacugaguggcguugcuaaggguuauaacaucugcuuguucgccuacgggcagacuggaagcggcaagacuuauacgauguuaggcacccccgcauccguggggcugacuccuaggauuugcgagggacuguuuguccgggagaaagacugugccucucucccaucgucaugccgcaucaaggugagcuuccuggaaauuuacaaugagagagugagggaucuucugaaacaaaguggucagaagaaauccuauacuuugcggguccgcgaacaccccgagaugggcccuuacguucaggggcucucucagcacgugguaaccaacuacaagcaagugauccagcugcuggaggaaggaauagcuaaucgaaucacagcagccacccacguccaugaggcuagcuccagaucacacgccauuuuuacuauccauuauacacaggcgauucucgaaaacaauuuaccaagugagauggcaagcaagaucaaccugguggaccuugccggcucugaaagggcugaucccuccuacuguaaagaccggauagccgagggugcaaauauuaacaagucauugguuacccuggggaucgugauuagcacgcuagcucagaauagucaagucuucucuuccugccagagccucaacucgucuguguccaauggaggcgauucaggcauccugaguagcccuuccgggacuucuagcggaggugccccaucacgucgccagaguuauaucccguacagagacuccguacuuaccuggcuguugaaagacagccucggcgggaacucuaagacaauuaugguugcgacugugucacccgcccacaccaguuauagcgagacaauguccacccugagguacgcaucuucggcuaaaaacauaaucaauaagccucgggucaacgaagaugccaauuuaaaacugauucgagagcuccgcgaagagaucgaaagacuuaaggcucuguugcucagcuuugagcugaggaacuucuccucacucagugacgagaaucugaaggaacuugugcugcaaaacgaguugaaaauagaucagcucacgaaggacuggacucagaaauggaaugauuggcaggcccugauggaacacuauucugucgacauuaaccggcgcagagcaggagugguuaucgauagcuccuuaccacaucugauggcccuagaggacgaugugcucucaacaggcguaguccuguaccaccuuaaggaagguaccacuaaaaucgggaggauugacagcgaucaagagcaggacaucguguugcagggccaguggauugagcgugaccauuguacaauaaccucugcuugcggaguugugguccugcggcccgcgcgaggcgcaagauguacggugaaugggagggaaguaaccgccuccugccgccucacacaaggagcugugaucacucuggguaaggcccagaaguuucgguucaaccacccugcagaggccgcuguucuuagacagaggcgccaggucggcgaagccgcagcggggcgaggaagucuggagugguuggaucucgacggcgaucuggcugccagccgguuaggucugucuccacuacucuggaaagagcguagagcacuggaagaacaaugugacgaagaucaccagacccccagggacggggagacaucccaucgcgcccagauucagcaacagcagucauacguggaagaucuucggcaccaaaucuuggcugaggagaucagagccgcaaaggaacuggaguuugaccaggcuuggauuagucagcagauaaaagaaaaucaacagugccuccugagggaggaaacuugguuagccagccugcagcagcaacagcaggaggaucagguggcggagaaggaacuugaggccucggucgcuuuggacgcauggcuccaaaccgauccggaaauccagccuucccccuucguucagucucaaaaacgaguggugcaucugcagcuacugcgccggcacacacucagagccgcugagaggaacguacgucgcaagaaggucagcuuccagcuggaacggauuaucaaaaagcagagacuuuuggaggcccagaagaggcuggagaaguuaaccacucucugcuggcugcaggacgauucaacgcaggaaccaccuuaucaggugcuuagucccgacgcaacaguuccacgacccccuugucgguccaaacugaccucuugcagcuccuugucaccacaacgccucuguagcaagcauaugccgcagcugcacaguauuuuucuaucuugggaccccuccacuacccugccuccaagacccgauccuacacaccagaccagcgagaagacuucgucagaagaacaccucccacaggcggccucuuaccccgcuaggacaggcugccugcggaaaaauggacuucacaguuccggccaugggcaaccguguacggcccgagcagcuuuggccagaaagggagcaagcgccccugacgcuugccugaccaugucuccaaacagcguggguauccaggagauggaaaugggcgucaaacagccccaccagauggugucccaaggguuagcgucacuccgcaagagugccaauaaacugaagccuaggcacgagcccaaaauauucacuagcacaacccagacacguggagcaaagggccuugcugauccaucucauacucaggccgguuggcggaaggaagggaaccugggcacccacaaagccgcuaagggagcauccuguaacucacuauauccucauggccccagacaaacggccgggcacggaaaagcgguuaagaccuuuuggacagaguacaaaccaccgaguccuagcagggcuuccaagcgccaucagcgagugcucgccacuagaguacggaauaucaccaagaaaucuucgcaucugcccuugggcagcccacugaagaggcagcagaacacacgcgaccccgauacuauggucccuuuaaccgacuucucaccagugauggaucacucccgugaaaaagacaaugaucucagugacacggauucuaacuauagccuggacucccuuucaugcguguacgcaaaggcccugauugagcccuugaaaccugaggaaagaaagugggauuuuccggagccagaaaauucugagagcgacgacagucaacucuccgaagauagccuggcugagaagcgguaucagucucccaaaaacaggcuaggugggaaucgcccuacaaacaaucgaggacagccaagaacccggacuagggcaucaguccgcggcuucacagccgcguccgacagugaucugcuugcucagacccauagauccuuuucgcucgacucucugaucgaugccgaggaagaguugggugaagaccaacaggaggaacccuucccuggcuccgcagaugagauuccgacugagaccuuuuggcaccuggaagacagcucauuacccguuauggaucaggaggccaucuguaggcucgggccaauaaacuaccggacagcugcccgucuggacgcagugcuuccuaugaguucuuccuucuaccuggauccccaguuucaaccacauugcgaauugcagccucacugugagcuccagccccauugcgagcugcaaccacacugcgaacaggcugagagccagguagaaccgucauauagugagcaggccgacagccuacaaggaaugcagcugucccgcgaaucuccucuuaugagcauggacuccugguucucaugugauucuaagauuaaucccaguucgccacccggcaucguggggagccucugcccuuccccagacaugcaggaguuucacucuuguaaaggagagcgacccggcuacuggccuaacacggaagaacugaagccgucagaugcggaaaccgucuugccauauagcuccaaauuacaucaggguaguacugagcugcucugcucugccagagacgaacacacagcaagcgcugccgauaccucaaggcugucccuuugggggauucaacggcugauccagcccggagcugacggcacauuccagggucgcuguauaccugauaugacucagcaaggcaguagcgaggcaucucauaauuccucagugagcaacguuuuggccgccucggcuaccacgcuaacacacguggggucuacccacgagagagacuggagugcgcugcagcagaaguaccuccuggaacuuuccugccccgucuuagaggcaaucggagccccaaagccugcuuaucccuaccuggaagaggauagcggcucacucgcccaggcauccucuaaagggggagacacuuugcugccagugggcccuaggguuagcaguaaucucaaccugaacaauuucccggugcaucuuucccggauucgaagacugcgcgccgaaaaggagcaagauagcuugaacgcuaaacuagagggugucucugacuuuuucucaaccagugaaaaggaggcguccuaugaugaaacauacagcgccgaccuggagucucucucggcaucaaggagcacuaaugcucagguauuugccaccgagaacgcaauccccgacuccaugacagaagccugugaggugaaacagaauaacuuagaagagugccugcaaaguugucggaagccagggcuuaugacgucuagcgaugaagacuucuuucagaaaaaugcuugccacuccaacguuaccacugccacaaaggcggaucauuggucacagggaugggcaccucugcguaagaauagugccgugcagcccggccaacucucuccagacagccacuacccuuuggaggaggagaaaaccgauugucaggaguccucaaaggaagcugucagaaggcauauuaacgugagcuucgcccugcccucugguccggagcucuaucugcacuccgcuccauggaauccucuuaguagcucgcuacagcccccacuguuggaaacuuuuuacguaacaaaaucccgcgacgcauuaaccgagacggcccuggagauccccgcuugccgggaagugcgagucccuucuccgcccccaagagaggccuggggcuucgggcacaaccaucaggcacuccaaggagcguaucugaagaauaaccuuccuguucugcuccagaaucagaacucaaaaauagccagcagucagcaagugacugcugaaauucccguggauuugaacaccagggaggucauccgcgaauccggcaagugcccugggaauaucacagaggagucucacgacagcguguacucauccguuacccagaaccggcauuuucugccaaguacuagcacaaagguaugugaguucgagaaucagguggucauucuaaacaaaaagcacucuuuucccgcccuggaaggaggcgaggugaccgcacaaucaugcuguggugcuuccagcgauucuacagagagugggaaaucgcuccuuuucagagaauccgaggcccgugaagaggaggaacuggaccagaauacuguuuuaaggcagaccaucaacgugagcuuggagaaggauaugccuggagaaucagcagucucucugaaaagccgguccguggaccgccgaguaaguucaccagucaugguggcccagggcggcgggcccacgccgaagugggagggaaagaaugaaacaggucuccuggagaaaggccuuagaccuaaggauucuagcgaagaguuuaaacugccagggaccaagcccgcuuaugagagguuccaacucguugcgugcccucaggaacggaacccauccgaguguaaaagucaggaaauguugaaucccaaccgcgagccgagcggaaagaagcagaauaaaagagugaacaauacugacgaaauggccaggcugauucgauccgucaugcaauuagagaacggcauacuagagaucgaaucuaagcagaauaaacaggugcacgcaucacauaccccugguacagacaaggagcugguuuuccaggaucaaaaagaacaggagaagacugaccacgcuuuucggcccgauagcucggggaacccacucccuuccaaggaccagcccaguucuccacgucaaaccgaugacacgguguucagagauagcgaggccggagccauggaagucaauucaauuggcaaccauccccaggugcagaaaaucacaccuaacccauuucgcuccagggagggcguacgggaaucugagccggugagagaacacacccaucccgcagggagugaccgcccugcuagggauauuugcgacagccuuggaaagcacacuacaugucgagaguucaccaauacuucccugcacccacagcggaugaaagccuuggcgagagcucugccccuccaaccuaggcuggagcgcucaagcaagaacaauggucaguuuguuaaagccucugcaagucuuaagggccagccaugggggcucggaucccuggaagaguuggaaacagucaaaggcuuccaggagagccaaguggccgaacaugugucaucuuccaaccaggaggagcccaaggcucaggguaaggucgaagagaugccuaugcagcgugggggaucgcugcaagaagagaauaaaguaacccagaaguuuccgagcuuaagucagcuaugccgggauacguucuuuagacaggaaacugugucuccacugcucuccaggaccgaguucuguacagcaccccuucaccaagaccugagcaacaccuugccucuaaauucaccccgcuggccacgacggugccuccauguuccuguggcccugggcaucaguucccuugacugugucuuagaucugacaaugcucaaaauacacaacagccccuuggugacuggcguugagcaccaggaccagucuaccgaaacgagaucacauagcccagaggggaaugugaggggacgcuccucugaagcgcacacagcuuggugcgguagugucagaucgauggccaugggcagccauucccaaucaggggugccggagucuaucccucugggaacugaggaucggauuagcgcaaguaccagcccccaagaccacggcaaggaucuaaggaucacacugcucgguuuuucaaccucugaagacuucgccagcgaggcugaaguagccgugcagaaagagauucguguuuccagucuuaacaaggucagcucucagccagaaaagcgagugucauucucccuggaggaggauagcgaccaagcaaguaaaccccgccagaaggcugaaaaagagacugaagaugugggguugaccucuggagucucccuggccccuguuucgcucccaagagugcccagcccugagccgcggcuguuagaaccaucagaccaugcguccaugugccuugccauccuggaggagauaaggcaggcaaaggcucagcgcaaacaacuccacgauuuuguagccagaggcacagugcuaucuuacugugaaacgcuguuggagcccgaaugcaguagccgggucgcaggcaggccucaguguaagcagauugaccagucauccagcgaucaaacucgaaaugagggggaagcuccaggauuccacguggccucucugagugccgaggcgggucagaucgaccuccuucccgacgagcguaagguucaggcuaccucccugagcgcagauucauuugaaucuuugccuaacacagagaccgacagagaacccugggauccagugcaagccuucucgcaugcugccccggcacaggaccgcaaacggaggacuggcgagcugagacaguuugccggggcuagcgagccuuucaucugccacuccaguucuucagaaauuauagagaagaaaaaggaugcgacacgcacccccagcuccgccgacccacucgcaccugauaguccccggucuagcgcuccagucgaagagguaaggcgagugguuuccaaaaagguggucgccgcauuaccuucacaggcccccuaugacgauccgagagugacgcugcaugaacuuagccaaucugucccacaggagacugcugagggaaucccucccggcucccaggacaguucaccagaacaccaggagccccggacacuggauaccaccuacggugaagugagcgacaaucuacucguuacugcccaaggggagaagacagcgcauuuugaaucgcaguccgugaccugugacguacagaacucuacaagugcaagcggaccuaaacaggaucacgugcaaugcccggaggccucaacuggcuucgaggaaggcagggcuuccccaaagcaggacacgauucugcccggggccuugacccgcgucgcacuggaggcuccuacacagcaguguguucaaugcaaagaaucugugggaagcggucucacugaggucugucgugccggcaguaagcacuccagacccaucccacuuccugaucagcgacccagcgcuaauccagggggaauuggcgaagaggccccuugcaggcauccgcgggaggcacuggacggucccguguuuucucgcaacccagaagggucaagaaccuuauccccuagcaggggcaaagagagucggacacugcccugucgccagccauguucuucacaaccuguagcgacccacgccuacuccagccauucgucuacuuugcucugcuucagagauggagaccugggcaaggaacccuuuaaagcugccccgcacacgauccacccaccuugugugguucccagucgagcauaugagauggaugagaccggggaaauauccaggggaccagacgugcaucuaacacacggucuugagcccaaggaugucaaccgggaguuccgucugacugagagcucaaccugcgaaccuucuacaguggcugccguccucagccgcgcacagggcuguagaucccccagugccccagacgugaggaccgggucauuuagccauuccgcgacugauggaucuguuggccugaucgguguaccugagaagaaaguggcugagaagcaggccaguacagaauuggaggcagccagcuucccggcugggauguacuccgaaccccugcggcaguucagagacucaucugucggcgaucaaaaugcccaggugugccagacgaacccagagccucccgcaaccacucagggaccacacacacucgaccuuucggaaggcagcgcugaguccaaacugguuguggagccucaacaugaauguuuagagaauaccacccgcugcuuucuggaaaagccccaguucaguacagaguugcgagaccacaacaggcucgauucucaggccaaauuugucgcgcggcugaagcacacuuguagcccgcaggaagacucaccuuggcaagaggaggaacagcauagagaucaggcuuccgggggaggugagggcuucgcccaaggggugaauccacuacccgacgaagauggacuugacggcugccagauucuggaugcaggucgugaggagguagccguggcuaagccuccaguuagcaaaauccucucucagggguuuaaggaccccgcaacggucagucugcgccagaacgaaaccccucaaccagccgcgcagagguccggccacuuguauacaggacgggagcagcccgccccgaaucauagaggcucauuaccugugacuaccauuuucagcgggcccaaacacucucgaucguccccaacaccccaguuuaguguggucggaagcucaaggucucugcaagaacucaaccuuuccguugagccuccaagccccaccgaugaagacacucagggcccuaaucgccuguggaacccacaccuacgggguuacaguucagggaaguccguggcuagaacgagccugcaggcagaggauucuaaucagaaagccaguagcaggcucgacgauggaacaaccgaccaucgccacuugaagccggcuacucccccuuauccaaugcccuccacccugucucauaugccuacaccagacuucacuaccucauggaugagcggcacacuugagcaagcccagcaggguaagcgugaaaaacugggcguacaagugcggcccgagaacugguguucccagauggauaaggggaugcuccacuuuggaucgucugacaucaguccguacgcauuaccuuggagaccagaggaacccgcucgaauaagcuggaaacaguauaugucaggcuccgccgucgaugugucuugcagccagaagccucaagggcugacguuguccaauguugcgagguguaguucaauggacaacggacuggaagaucagaauagccccuuccauucucaccucuccaccuacgccaacauuugcgaccuuaguacuacacacagcucaaccgagaacgcacagggcucuaaugaggcuugggaaguguuucgcgguuccucgagcaucgcccugggggauccacauaucccgacaagcccugagggagucgcacccacauccggccacgaccggagaccacaguucaggggucccucuggcgaagccgauugccuacgcucaaaaccuccacuggcuaaggggagcgccgcgggacccguggacgagauuaugcucuuguacccuuccgaagcuggcuguccaguagggcaaaccagaacgaacaccuuugagcagggaacacagacucugggcucucggcgacauuggagcaguaccgauaucucauucgcacagccggaggccuccgcuguuagcgccuucgaccuugcaucuuggacaaguaugcacaaucuguccuuacaucucagccaacuguugcacucaacuucggaacugcucgguucucuuagccagcccgacguggccaggcgugagcagaacaccaagagagauauaccugacaaagcuccacaggcgcugaugauggauggguccacacaaaccacugucgacgaaggaagucagacggaucuaacacugcccacccucugcuugcagacuucagaggccgagccucaaggcgcaaaugugauucuggaaggcuuagggucugacaccagcacagugucccaggaggaaggagaugucccagguguuccccagaagcgggaggccgaagagacggcucagaaaauggcacaacuucuguaucuccaggaggaaaguaccccuuacaagccgcagagccccucuaucccauccucacaucugcgcuuucagaaagccccugugggccaacauuugcccagcguaucgccauccgugucugacgcuuuccugccucccaguucacagccagaggaaagcuauugucucgucguguccucuccgagcccuaguucaccccacuccccagggcuuuuucccagcacuucugaguacccuggagauuccaggguucagaagaaacugggcccaacaagugcccuauucguggaccgagcgagcucacccauucugaccuuaucugcauccacucaggaaccuggucucagcccggggucgcugacauugagugcccccucuacccauccagucgagggacaccaaaaacuugauucauccccugaccccguggaugcuccaagaacaccuauggacaacuauagccagacuaccgacgagcugggcggcucucagcgggggcgcagcucccuccaaaggaguaauggaagaucauuucuggaauugcacagcccccauuccccacagcagucuccgaagcugcaguucaguuuucuaggucaacacccucagcagcuccagccccggacgaccaucggcguacaaucacgucuucugccaccucccuuacgccauaggagccagcgacuggggaacuccuucguuccagagaaaguggccucuccugaacacugcccccucucgggaagagagccgagccaguggcagucccggacagaaaauggcggugagaguucagcaucuccaggggagccccaaaggacucuggaucgcccuagcuccuggggaggcuugcagcaucuuaguccaugucccgucucugaacugaccgacacagcuggccucagagggagcgcccugggacuaccucaggcgugccagccggaggaauugcuguguuuuucaugccaaauguguauggcccccgagcaccagcaccauucccuccgggaucuuccagugcacaacaaguucagcaauuggugcgguguucagaaaggcucuccugggggacuggacaugacugaggaagaguuaggcgcuucaggugaucugaguuccgaaaagcaagagcagagucccccacagccucccaacgaccauucgcaggauucugaaugguccaaaagggagcaaauaccacuccaggugggggcacagaaucugagcuugucagucgagcuuaccgaagccaagcugcaccacggauuuggcgaggcugacgcacuccugcaagugcuacaaaguggcacgggggaagccuuagcugccgaugagccuguaacaucuaccuggaaggaacuguacgcacgccagaaaaaggccauugagacuuugcgaagagagcgugcggaacggcucggaaacuucuguaggacacgcucccugagcccccagaaacagcuuucacugcucccgaauaaggaccuguuuaucugggauuuggaccuuccuaguagacggagggaguaucugcaacagcuacgaaaagauguggucgaaaccacuagauccccagagagcguuucucgcucggcucauacccccagcgacaucgaacucaugcugcaggacuaccaacaggcccacgaggaggcaaagguggaaauugcccgggcuagggaucaguuacgugagagaacagaacaggagaagcugcgcauccaucagaaaauuauaucccaguugcucaaggaggaagacaaacugcacacgcuugccaacucaucuagucugugcaccagcuccaacgguucucucucaagcggcaugacaaguggguacaauuccucuccugcauugagcggacagcugcaguucccagagaacaugggccauacaaaucuucccgauuccagggacgucuggaucggugaugaaagagggggacacucagcugugcgaaagaacagugccuauagccacagagcgucucugggcuccuguugcugcucgccgagcucauuaaguucccuaggcaccuguuucucuagcucauaccaagaccucgcaaaacauguaguggauacuuccauggccgacguuauggcugccugcucugauaaucugcacaaccuguuuagcugucaggcuacagcaggguggaauuaucagggagaggaacaggccgugcaauuguacuauaaggucuucaguccuacccgccaugguuuucucggcgcgggggugguuucccagccccugagcagggucugggccgcugugucugacccaacgguguggccccuuuacuauaagccuauucagacagcacggcugcaccagagaguaaccaacucaaucaguuuagucuaccucgugugcaauacuacccugugugccuugaaacaaccacgugauuucugcuguguuugcguggaggcuaaggagggacaccuuuccgucauggccgcacagagcguguacgacacaucuaugccccgcccuucgaggaaaaugguucggggcgaaauccugccaucagccuggauucuacagccgauaacuguggaggguaaggaaguaacccgagucaucuaucucgcucaaguggagcugggggcgcccggauuuccuccacagcuguugagcuccuucauuaaaagacagccccucgugaucgccaggcuggcaaguuuucuuggccgcuga

SEQ ID NO: 63302 - RNA, 858 nt, Artificial Sequence
  derived and/or modified sequence opt3 from STAR__Homo_sapiens__NP_000340
augcugcucgccaccuucaagcugugcgcuggcagcuccuacagacacaugaggaacaugaaagggcugcggcagcaagcagugauggccaucucucaggaguugaaucgccgagcguuaggaggucccacaccuucaacuuggauuaaccagguccguagaaggaguagccugcuaggcucccggcucgaagagacgcuguauucugaccaggaacuugcuuaccugcaacagggggaggaagccaugcagaaggcauugggaauacucucgaaucaggagggcuggaaaaaggagucacaacaggauaacggugacaaaguuaugagcaaggugguaccagauguggggaaggucuuucgccuggaagugguuguggaccagccgauggagagacuguaugaggaacucgucgagaggauggaagccaugggagaguggaaucccaacgugaaagaaaucaagguauuacagaaaauuggcaaggauaccuucaucacacaugagcuggcugcagaagccgcuggcaaucuuguugggccucgggacuuugugaguguccgcugugccaaacgaagaggauccacuugcguguuggcggguauggcaaccgauuucggcaacaugccagagcaaaagggggugauuagggccgagcacggacccacauguaugguccugcauccucuagcuggcucuccaagcaagaccaaacucacuuggcugcuuuccaucgaccugaaggguugguugcccaaaucaauaaucaaucagguucucagucagacacaaguggauuuugccaaccaccuucggaagcguuuagaaagccauccugcaucugaggcucgcugcuga

SEQ ID NO: 63303 - RNA, 2253 nt, Artificial Sequence
  derived and/or modified sequence opt3 from STAT1__Homo_sapiens__NP_009330
augagccagugguacgagcugcaacagcucgacuccaaguuccuugaacaggugcaccagcuguaugaugacucuuuucccauggagaucagacaauacuuggcccagugguuagaaaaacaggauugggagcaugcugcaaacgacgucucauucgccaccauuagguuucacgaucugcuaagucagcucgacgaucaauauagccgguucucccuggaaaauaacuuucuucugcagcauaauauacgcaagucuaaacgaaacuugcaggacaauuuccaggaggauccuauccaaaugucgaugauuaucuacucaugccucaaggaggaacguaaaauucuggagaacgcgcagagauuuaaucaggcucaaagcggcaacauccagaguacaguuaugcuggacaagcagaaggaacucgauuccaaagugaggaauguaaaggacaaagugauguguauagagcacgagaucaagucuuuagaagaucugcaggacgaguaugacuucaaaugcaagacucuucaaaaccgggaacaugagacgaauggggucgccaagagcgaucagaaacaggaacaguugcugcuaaagaaaauguaccucaugcuggacaacaagcgcaaagaggugguucacaagauuaucgagcuucugaaugugaccgaauugacacaaaacgcacucauuaaugaugagcuggucgaauggaaaagaaggcagcaguccgccuguaucggagguccaccgaacgcuugcuuagaccagcugcaaaacugguuuacuauaguggcagagucacuccagcagguacggcagcaacuuaagaagcuggaagaguuggagcagaaauauaccuacgaacacgaucccauuacaaagaauaaacagguucuaugggaccgcaccuucagucuguuucaacagcucauccagagcucuuucguggucgagcgacagccuuguaugccaacucauccccaaagaccucuggugcuuaagacaggcgugcaguuuaccgucaaacugagguugcucguuaagcugcaggaauuaaacuacaaucugaaggugaaaguacuauucgauaaggacgugaacgagcggaauacggucaaaggguuccguaaguuuaacauucucggaacucacaccaaagugaugaauauggaagaguccacaaacggcucacuggccgcugaguuccgccaucuucaguugaaggaacaaaagaaugccgguacuagaaccaacgaggggccacugaucguuacagaagaacuccacagccugaguuuugagacccagcuuugccagcccggacuggugaucgauuuggaaacgacuucucucccugucgugguaauuuccaauguuagccagcugccaucgggcugggcgucuauauuaugguauaacaugcugguggcagagccgaggaaucuauccuucuuucucacacccccuugugcccggugggcucaacugucagaaguccuuaguuggcaguucagcuccgugaccaaacgaggcuugaacgucgaccagcugaauaugcucggggagaagcuguuaggaccaaacgccucucccgauggucugaucccuuggacucgcuuuugcaaagaaaacauuaaugacaagaacuucccauuuuggcuuuggaucgagagcauauuggagcucauuaaaaagcaucugcuaccccuguggaaugacggcuguaucaugggguucaucucaaaggaaagagagagggcacuccugaaagaucaacagccgggaacauuucuuuugcgguucagugaauccagccgcgagggcgcuauuaccuuuacguggguggaaagaucucagaacgguggggagccugacuuccacgccguugagcccuacaccaagaaagaacugucagcggugacauucccagauaucauuaggaauuauaagguaauggccgcagagaacauaccugaaaaucccuuaaaauaccucuauccaaacaucgacaaggaucacgcuuuuggaaaauacuauagucgucccaaggaggccccugaaccaauggagcuggacggcccgaagggcacuggguacauuaaaaccgagcuuaucagcgucuccgaagugcaucccucucggcugcagacaacugauaauuugcucccuaugucgccagaggaguucgacgagguuagccgaaucgugggauccgucgaguuugauucaaugaugaacaccguguga

SEQ ID NO: 63304 - RNA, 2556 nt, Artificial Sequence
  derived and/or modified sequence opt3 from STAT2__Homo_sapiens__NP_005410
auggcccagugggagaugcugcaaaaccucgacagccccuuccaggaucagcuucaccagcuguacucccauucuuuguuaccuguggacaucagacaauaucuggcugucuggauugaagaucagaauuggcaggaggcagcccuaggcucagacgauaguaaggcgaccaugcucuuuuuccacuuucuggaccagcuuaacuacgaaugcgggagguguagccaagauccagagucccuguugcuccagcauaaucugcggaaauucugccgcgacauacagccguuuucucaggaucccacacaacuggcugaaaugaucuucaaccucuuacuggaggagaagcguauucuuauccaggcccagcgagcacaauuggaacagggagagccuguucuggaaacuccaguggagucgcagcagcacgagauugaaucaagaauccuagaccucagggccaugauggagaaacugguaaagagcauaagucaacuuaaagaucagcaggacguguuuuguuuccgguauaagauccaggcuaaggguaaaacgcccucccuggauccucaucaaaccaaggaacagaaaauuuugcaggagacacucaaugaacuggacaagcgcagaaaagaggucuuagacgcaucuaaggcccugcucggcaggcuuacuacccugaucgaguugcuacugccaaagcucgaagaguggaaagcucagcaacagaaggccugcauucgggcgcccaucgaucacgggcuggaacagcuugagacaugguuuaccgcaggagccaaacuguuguuccaccuccgccagcuguuaaaggaacugaaaggccuaagcugucucguguccuaccaagacgauccucugacuaaggguguugaccuucgaaacgcucaggugacagaguugcugcagagacuccugcauagggccuuugucguggagacccaaccaugcaugccgcagacgccccaccggccucuuauacugaaaacugggucaaaguucaccguacguacacgcuugcucguuagacugcaggaaggaaaugagaguuuaacuguggaagucagcauugauaggaacccaccccagcugcaaggcuuucggaaguucaauauccuaaccucuaaccagaaaacacucaccccugagaagggccagucccaggggcugauuugggacuucggauaucuuacguugguggaacaacgaucagguggcagcgggaaaggaaguaauaagggcccacugggugugacugaggagcuccauaucaucucuuuuacagucaaauacaccuaucaggggcugaagcaggaauuaaagacugauacacugcccguugugauuauauccaacaugaaucagcuuagcaucgcaugggcuucgguauugugguucaaccuccugucuccgaaucuacaaaaccagcaguuuuucuccaacccucccaaagccccauggucacugcucggaccugcgcugaguuggcaauuuagcuccuacgugggccgcggccuuaauucugaccaguugagcaugcugagaaacaaguuauucgggcagaauuguaggaccgaggauccccuccugucaugggccgacuuuacgaaacgggaaaguccacccggaaaacuuccuuucuggaccuggcuggauaagauuuuggagcucguccacgaccaccugaaggaccuauggaacgauggucgcaucaugggcuuuguguccagaagccaggagaggcgucugcucaagaaaacaaugucugggacuuuccugcuucgguuuucagaaaguagcgagggaggcauaaccugcuccuggguugaacaucaagacgaugacaagguguugauuuacucuguccagccauauacaaaagaggugcugcagucguuaccgcucacugaaaucauccgacacuaccagcugcuuaccgaggagaauauucccgaaaacccucugagauuccuauauccaaggaucccccgcgaugaggcauuugguuguuacuaucaagaaaagguaaaucuccaggagcggagaaaauaccugaagcauagguugauuguugugagcaaccgccaggucgacgaacugcagcaaccuuuagagcucaagccagagcccgaacuggagucccuugaacuggaguuggggcucgugccggaaccugagcugucacuagaucuggagccacuucucaaagcuggccuggacuugggacccgaacuggagagugucuuagaaucuacacucgagccugugauagagcccacccugugcaugguuagccagacugugccagaaccugaucagggccccguaucccagccagucccggagccugaccuucccugugaucugcgacacuugaauacggaaccaauggagaucuuccggaacugcgugaagauugaagagaucaugcccaauggggacccucuccuggccggacaaaacacaguugaugagguguaugucucacguccaagccauuucuacaccgacgguccccuaaugccuucugacuuuuga

SEQ ID NO: 63305 - RNA, 2310 nt, Artificial Sequence
  derived and/or modified sequence opt3 from STAT3__Homo_sapiens__NP_003141
auggcccaguggaaccaacugcagcagcucgacaccagauaccuugagcagcugcaccaauuguauagcgauuccuuccccauggaauuaaggcaguuucuggcuccuuggaucgagucucaggacugggcauacgccgcgucaaaggaaagucaugcuacucuaguguuccacaaucuccugggcgagauugaucagcaauauagccgguuucuucaggaauccaacguccuguaccagcauaauuugcgccgaauaaaacaguuccuccaaucucguuaucuggagaagccaauggagaucgccagaauuguugcaaggugccugugggaagagucgcggcucuuacagacagccgcuacggcagcccagcaagggggacaggcuaaccacccgaccgccgcggugguaacagaaaaacagcagaugcuggagcaacaucuucaggacgugcgcaagagaguccaggauuuggagcagaaaaugaaggugguugaaaaucugcaagacgauuuugacuucaacuacaagacucuaaaaucacagggugauaugcaggaccucaauggcaacaaucagagcgugaccaggcaaaagaugcagcagcuggagcagaugcuuacagcacuggaucaaaugcggcgcaguaucgucuccgaauuggccgggcuccugucugcuauggaguaugugcagaaaaccuuaacugacgaggaacuggccgauuggaagcgaagacagcaaauugcauguaucggagggcccccuaacauaugccucgacaggcuugagaauuggaucacaagccuggcugaaucccaguugcagacccggcagcaaauuaaaaagcuagaggaacugcagcagaagguaucauacaaaggugacccaaucguucagcaccgucccaugcucgaggaacgcauuguggagcuguuuagaaaccuuaugaagagugccuucgucguggagaggcaaccuuguaugccaaugcaccccgaucggccucuggugaucaaaacggggguccaguuuacuaccaagguucgauugcucgugaaauucccagaacugaauuaccaguuaaagauaaaaguaugcauugacaaggauagcggagacguggcggcccugcgcggcucuagaaaguuuaacauccuaggcacaaauacuaaagucaugaacauggaggaauccaacaaugggucacucagcgcagaguucaagcaucugacccuuagggaacagcgguguggaaacgguggccgcgcuaauugcgaugccaguuugauugugacagaggagcugcaccucaucaccuuugaaacggagguuuaucaucaagggcugaaaaucgaccuugaaacucacucucugccgguggucgugauuuccaacauaugucagaugcccaaugcuugggccagcaucuugugguacaacaugcucacaaauaacccuaagaauguaaacuucuucaccaaaccacccauuggaacuugggaucagguugcagaggugcugucguggcaauuuucuuccacaaccaagagaggcuuaucaaucgagcagcugacgacccuagccgaaaagcuccuggguccuggggucaauuauaguggaugccagauaacaugggcuaaauucuguaaggagaacauggcgggcaaaggcuuuagcuucuggguguggcuugacaauauuaucgauuuggucaagaaauacauccuggcacucuggaacgaaggguauauuaugggauuuaucuccaaggagagggaacgugccauucugucuacuaagccacccgguaccuucuuacugcgguuuagcgagucaaguaaagagggcggggugacauucacuuggguugaaaaggacauauccggaaaaacccagauccaaagcguggagccguacacaaagcagcagcuuaauaacaugucuuuugcugaaauuaucaugggcuauaaaaucauggaugccaccaacauuuugguaucaccucucgucuaccuguaccccgacauaccaaaggaggaagcauucgguaaguauugccgaccugagagucaggagcaccccgaagccgacccaggggcugcccccuaccuaaaaacuaaguuuaucugugugacgccuacaaccugcagcaauacuauugaucugccaauguccccgagaacccucgacucucugaugcaauucggcaacaauggagagggcgcagaacccucggcgggcggacaguuugagagccuuacauucgauauggaauugaccuccgagugcgcuacuucaccuauguga

SEQ ID NO: 63306 - RNA, 2247 nt, Artificial Sequence
  derived and/or modified sequence opt3 from STAT4__Homo_sapiens__NP_003142
augagccaguggaaccaagugcagcagcuggagaucaaguuccucgaacaggucgaccaauuuuacgaugacaauuuccccauggagauuagacaccuucuggcccaguggauagaaaaccaggauugggaggcugcauccaauaacgaaaccauggccacaaucuuguuacagaaucugcuaauucaacucgacgagcagcugggcaggguuucuaaagagaagaaccuucuguugauccauaaucucaaacggauucgcaaggugcugcaggggaaauuucacggaaacccuaugcauguagcgguggucaucucaaauugccugcgagaagaacguagaauacucgcugccgcaaacaugccagugcaggguccguuagaaaagagucugcaaagcuccucuguuucggagaggcagcggaauguggagcacaaggucgccgcuaucaaaaacucagugcagaugacugaacaagauacgaaguaucuugaggacuugcaggaugaguucgacuaccgcuauaaaaccauucagacaauggaucagagcgacaagaauagugcaaugguaaaccaagagguucugacucuacaggaaaugcucaauucccuggauuuuaaaagaaaggaggcccuuucuaagaugacccagaucauucaugagacagaccuguugaugaacaccaugcucaucgaagaacugcaggauuggaaaaggcggcaacagauagcuuguauuggcgggcccuuacacaacggacuggaccagcuccagaauugcuucacucuucuggccgaaucauuguuucaacuacgccgacagcuggagaagcucgaggagcaguccacaaaaaugaccuacgagggcgacccuaucccaaugcagagaacgcacaugcuggaaagggugacuuuccuuauuuauaaccuguuuaagaauagcuucgucguggagcggcaacccuguaugccuacccauccacagcgucccuuggugcucaaaacacugauccaguuuacugucaaguuacgccugcuaaucaaacucccugaacugaacuaccaaguuaaggugaaggcgaguauugauaaaaauguaagcacccuuucuaacagaagguucguguugugcgguacaaaugucaaggcaauguccauagaggaaucaagcaacgggagucugucuguggaguuucggcaccuccagccaaaagagaugaaguccagcgccggaggcaaaggcaaugaagggugucauaugguuaccgaggaacugcacucgaucacguucgagacucagauuugccuuuauggacugacaaucgacuuggagaccucuucccucccgguggucaugauaucaaacgugagucagcugcccaaugcuugggccagcauuaucugguacaacguauccacuaaugauucucaaaacuuaguuuucuuuaauaacccuccacccgcaacacugagccagcuacucgaagugaugucauggcaguucaguuccuacgucggucgaggccugaacagcgaccagcuucacauguuggcugagaagcugaccgugcaaucuucauauagugaugggcaucucacgugggccaaguuuuguaaagaacaucugccuggaaagagcuucaccuuuuggacaugguuagaggcgauccuggaccuuauuaaaaagcacaucuugccacucuggauugauggcuacgucauggguuucguguccaaagaaaaggagcgccugcuacugaaggacaaaaugcccgggacuuuucuccugagauucucugagucgcaccuuggaggcauaaccuuuacauggguugaucauagcgaauccggcgaggugagguuccacucaguagaaccguauaauaaggggcgguugagugcccugccuuuugcagacaucuuacgcgauuacaaagucauuauggcugagaacauccccgaaaauccacucaaguaucuguacccugacauccccaaagacaaggccuucggaaagcacuauucuagccagccaugcgagguguccagacccacugagaggggugauaaaggcuacguuccuucaguguuuauuccaauaagcaccauccguucugacuccacagaaccgcauagucccagcgaucuucugccuaugucuccauccgucuacgcuguguugcgggagaaccucucacccaccacuauugaaacggccaugaagaguccuuauagcgcagaguga

SEQ ID NO: 63307 - RNA, 2295 nt, Artificial Sequence
  derived and/or modified sequence opt3 from STAT5A__Homo_sapiens__NP_001275648
auggccggcuggauccaggcucaacagcugcagggggacgcacucagacagaugcaagugcuuuacggacagcacuuccccauugaggucaggcauuaucuggcccaguggauagaaagccagccuugggaugcgaucgacuuggauaacccacaagaccgggcucaggccacccaguuacuggagggucuaguucaggaacuccaaaagaaagcagagcaccaggugggcgaagauggguuucugcuuaagauuaaacugggacauuacgccacacaguugcaaugcuccucuccggcuggcauccucguagacgcaaugucacagaagcacuuacagauuaaucagacuuucgaggagcugcgccucgugacgcaagauaccgaaaacgagcugaaaaagcugcagcagacacaggaauauuuuaucauacaauaccaggagagucuucgaauccaggcccaguucgcucaauuggcccagcugagcccccaggagcgucuauccagagaaacugcgcuccagcaaaagcaggucucucuggaggcauggcuucagagggaagcccaaacccugcagcaguaucggguggaguuggcugaaaaacaucagaagacacuccaacuguuacgcaaacagcagaccauuauccuggacgaugagcucauucaguggaagagaaggcaacagcuugccgguaaugggggaccuccagagggcucgcuggacguuuugcagucauggugugaaaaacuagcagagaucauauggcagaaccggcaacagauucgccgagcugaacaccugugccagcaacuccccaucccuggcccaguggaggaaaugcuggccgaggucaaugcgacuauuacagauaucaucagcgcccuugugaccaguacguuuauuauagagaagcagcccccucagguacugaagacucagaccaaauucgcagcuacaguuagauugcucgucgggggaaagcugaacgugcacaugaauccaccgcaagugaaagccacuaucauuuccgaacagcaggcuaagucuuuacugaaaaacgagaauaccaggaacgaauguagcggugagauccuaaauaacugcugugugauggaauaccaucaggccacaggcacccucuccgcacacuuucggaauaugucacugaagcguauaaaacgcgccgacagaaggggagcugagagugucacggaggaaaaguucacuguucuuuuugagagccaauucucugugggguccaacgaauugguauuucaggugaagacacugucacuccccgucgugguuauugugcauggcagccaggaucacaaugcgaccgcaacuguccugugggacaacgccuucgcugagccuggucgggugccauuugccguacccgacaaaguucuuuggccucagcugugcgaggcauugaacaugaaguucaaagccgaagugcaaaguaaucgagggcucacaaaggagaaccuggucuucuuagcucagaaacuguuuaauaacucuuccagccaccuagaagauuauucgggacucucuguguccuggucacaguucaaucgcgagaaccugccaggcuggaauuacaccuuuuggcagugguucgacggcgucauggaagugcuuaagaagcaucacaaaccccauuggaacgauggggccaucuugggauuuguuaauaagcaacaggcacacgaccugcucaucaacaaaccggaugguacguuccuguuaagauuuagugacagcgagauuggcgggaucaccauugcguggaaguucgauuccccugagaggaaucuguggaaccuuaaacccuuuacaacucgggacuucucuauacgcagcuuggcugauagacucggagaccugucauaccuaaucuauguguuuccagauaggccuaaggacgaaguauucaguaaguacuauacccccguccuggccaaagcaguggacggcuacguuaagccacagauuaaacaagugguccccgaguuugugaaugccuccgcugaugccggugggagcucugcaacauauauggaccaggcuccuucaccagccguauguccgcaggcgcccuacaacauguauccucagaauccagaucaugugcucgaccaagauggcgaguucgaccuggaugagacuauggacguugcccgucacgucgaagaacuuuugcggcgacccauggauagucuggacagcagauuauccccuccagcuggacucuucaccucugcaaggggcucgcugagcuga

SEQ ID NO: 63308 - RNA, 2364 nt, Artificial Sequence
  derived and/or modified sequence opt3 from STAT5B__Homo_sapiens__NP_036580
auggccguguggauccaggcucaacagcugcagggcgaggcacuccaccagaugcaagcccuuuacgggcagcauuuccccauugaagucagacacuaucugagccaguggauagagucccaggcgugggacucuguugauuuggacaacccucaagaaaauaucaaggcuacccaguuacuggagggucuagugcaggaacuccagaaaaaggccgagcaucaaguaggagaggauggcuuucugcuuaaaauuaagcuggggcacuacgcaacacaguugcagaacacuuaugacaggugcccaauggaacucgugcgguguauccgccauauucuguacaaugagcaacgacugguccgugaagccaacaauggaucaaguccggcuggcagccucgcagaugccaugucccagaaacacuuacagaucaaccagacguucgaggagcugagacuugugacccaagacacagaaaaugaguugaagaagcugcagcagacucaggaauauuuuauaauccaauaccaggagucucuaaggauucaggcucaguucgguccccucgcccaacugucgccucaggaacggcuuucacgcgagaccgcgcugcagcagaaacaaguuagcuuggaggcauggcuccagagagaagcccagacacugcaacaguauaggguggaguuagcugaaaagcaccagaaaacccugcagcuccuucggaagcaacagacuaucauucuggaugacgaguugauccaguggaaacgccgacagcaacuagccgggaacggaggcccacccgaaggcagucuggauguccuccaguccuggugcgagaagcuggcagagauaauuuggcagaauagacagcaaaucaggcgggcugaacaucuuugucagcagcugccuauuccagggcccguggaggaaauguuggccgagguaaacgcgacaaucaccgacaucauuucugcccucguuacgagcacuuuuauaaucgaaaagcaaccuccacaggugcugaaaacccagacaaaguucgcagcuacuguccguuuacuggugggagguaaacuaaaugugcacaugaacccgccccaggucaaggccaccauuaucuccgagcaacaggcuaaaucacuccugaagaaugagaacacacgcaaugauuacaguggcgaaauacuuaacaacugcuguguuauggaguaccaucaggccaccgggacguugagcgcacacuuuagaaauaugucucugaaaaggauuaagcgguccgaccgacgcggagccgaaucagugacugaggagaaguucacaauccucuuugaaagccaguucaguguaggcgguaacgagcugguguuucaagucaaaacccuuucucugccugugguugugaucguccacgggucccaggauaauaacgcuacugcgacaguguugugggacaaugcauucgccgaaccaggaagaguacccuuugcuguuccugacaaggugcucuggccacagcugugcgaggccuuaaacaugaaauucaaggcagaaguccagagcaauaggggccugaccaaagagaaccuaguguuccucgcccaaaagcuguuuaauaacucgucuucccaucuugaggauuauucaggcuugagugucagcuggucccaguucaaucgggaaaaccugcccgggcgcaauuacacguuuuggcagugguucgacggagugauggagguucucaagaaacaccugaagccgcauuggaacgauggugcuauuuuaggcuuugugaauaaacagcaagcccacgaccugcuuaucaacaagccugaugggaccuucuugcucagauuuucugacagcgaaauuggaggcauaacaaucgcauggaaauucgauucacaggagaggauguuuuggaaccugaugcccuucacuacccgugacuuuaguauucggucccuagcggaucgacugggugaccucaauuaucugaucuacguauucccagauagaccuaaggacgaagucuauagcaaguacuauacacccgugccaugugagucugcuacugccaaagcaguugacggguacgugaagccccagaucaaacaagucgugccugaguuuguaaacgccucagcugaugccggcggaggcagugcaaccuacauggaccaggcuccaagcccggccgugugcccccaggcgcauuauaauauguacccucagaacccagauuccguucuugacacagauggggacuucgauuuggaagacaccauggaugucgccaggcgcguggaggaacuguuaggacggcccauggacucucaauggauuccucacgcucagucguga

SEQ ID NO: 63309 - RNA, 2544 nt, Artificial Sequence
  derived and/or modified sequence opt3 from STAT6__Homo_sapiens__XP_006719637
augagccuguggggccucguguccaagaugcccccugagaaaguccagagacuuuacguugacuucccacaacaccugaggcauuuguuaggggauuggcuggaaucucagccgugggaguuucuagugggaucagacgccuucugcuguaaccucgcuagugcacugcuuagcgauaccguacagcaucugcaggccuccgugggugaacaaggcgaggggucuacaaucuugcagcacauuucgacucucgaaucaauauaucagcgggacccccugaagcuggucgcgacguuucgccagauccuccaaggagagaaaaaggcugugauggagcaguuccgacacuuaccuaugccauuucauuggaaacaggaggaacugaaguucaagaccggccuucguagauugcagcacaggguuggugaaauucaucugcuacgggaggcccuccaaaaaggggcagaggccggacaggugagccugcacagucuuaucgaaacacccgcuaauggcacuggcccuuccgaggcacuggccauguugcuccaggaaaccacaggggagcuggaagcugccaaggcguuaguccugaaacgcauucaaaucuggaagagacagcagcagcucgcaggaaacggugccccauuugaggagucucuugcuccccugcaagaaaggugcgagagcuugguggauauauacucccagcuacagcaggaaguaggcgccgcagggggagagcuggaaccuaaaacccgggcuucacucacuggccgccuggacgagguucuucgaacacuggugaccaguuguuucuuggucgagaagcaaccaccccaggugcucaagacgcagacuaaauuucaggccggugugagauuccuguuagggcugagguuucuaggagcgcccgccaagccuccacucguccgggcagauaugguuaccgaaaaacaagcucgugagcugagcgugccccagggcccuggcgccggggcugaaucuacaggagagaucauuaauaacacuguaccacuugaaaauuccauccccgguaacugcuguucagccuuguucaagaaucugcuccugaaaaagauuaaacgcugcgagagaaagggcaccgagagcgugacagaagagaagugugcaguccuuuuuagugccucuuucacccuggggccgggaaaauugccuauccagcuccaggcucuguccuuaccccuggugguuauagugcacggcaaccaagacaauaacgcgaaggcaacgauucuaugggauaaugccuucagcgaaauggacagggucccauuugugguagcugagcggguuccuugggagaaaaugugcgaaacucucaaccugaaguucauggccgagguggguacaaaucgagggcuuuugcccgaacauuuucuguuccucgcacagaaaaucuuuaacgauaauucgcugucuauggaggccuuccagcaccgcuccgucucauggagucaauuuaacaaggaaauuuuacugggcagaggauucaccuuuuggcagugguucgacggcgugcuugauuugacuaagaggugucuccggagcuauugguccgaccgccugaucaucggguuuauuucuaaacaguacgucacaagccuacugcucaacgagccagacggaaccuuccugcuuagauuuucagauagugagauagguggcaucacgauugcucacgugaucagggggcaggacggauccccgcaaauagaaaauauucagccuuucagcgccaaggauuugucuauccguucacugggcgaccggauccgagauuuagcacagcucaaaaaccuguauccaaagaaaccgaaggacgaggcguucagaagucauuacaagcccgaacagauggguaaagaugggaggggcuauguuccugcuaccauuaagaugacaguggagcgcgaccaaccacuucccacuccugaacugcagaugccaaccaugguacccagcuacgauuugggaauggccccggacuccucuaugucgaugcagcucggcccugauauggucccacagguguaucccccucacagccauuccauucccccauaccaagggcugucaccugaggagaguguuaaugugcuaucugcauuucaggaaccccaucugcagaugccaccgagccucggacaaaugucccugccuuucgaccagccccacccacagggucuuuugcccugccagccucaagagcacgccgucucaagcccagacccccuguuauguucugaugugacaaugguagaagacuccugccucagucagccugugacugcuuuuccgcagggcaccuggaucggggaggauauauucccaccccugcuuccuccaacagaacaggaccugaccaaacuacuccuggagggacaaggcgagagcggugggggcucuuugggagcccagccccuguuacagccuucccacuacggccagucagggaucaguaugagccauauggaucuccgggcaaacccgucgugguga

SEQ ID NO: 63310 - RNA, 159 nt, Artificial Sequence
  derived and/or modified sequence opt3 from STATH__Homo_sapiens__NP_001009181
augaaguuccugguguuugccuucauccucgcucuuauggucagcaugauuggcgcagacuccucugaggaauacggguauggacccuaccagccuguuccagagcaaccgcuguauccccagccuuaccagccacaguaucaacaguacaccuuuuga

SEQ ID NO: 63311 - RNA, 1713 nt, Artificial Sequence
  derived and/or modified sequence opt3 from STAU2__Homo_sapiens__NP_001157852
auggccaaccccaaggagaaaaccgcuaugugccuggugaaugaacucgcaagauucaacaggguccagccucaauacaaacuucugaaugagcggggcccagcccacagcaaaauguuuuccguucaguugucuuuaggggaacagaccugggagucagaaggaaguagcaucaagaaagcgcagcaagcuguggccaacaaggcacugacugaguccacgcuaccgaagcccguacagaaaccuccaaagucuaaugugaacaauaaccccgguucgauuaccccuacagucgagcucaauggccuggccaugaaacgcggggaaccagcuauauaucgaccccuugacccuaagccauucccgaacuaccgugcaaauuauaacuuuagaggaauguacaaucagagguaucauugucccgugccuaaaaucuucuacguucagcugacugugggcaacaaugaguuuuucggugaagggaagacccggcaagccgcucgccacaacgccgcgaugaaggcauugcaggcccuccagaacgagccaauucccgagagaucaccucagaauggagaaagcggcaaagaugucgacgaugacaaggaugcuaacaaaagugagaucucccugguguuugaaauugcccugaagaggaauaugccaguaucuuucgagguuaucaaagaaagcgggcccccgcauaugaaguccuuugugacacgggucucagugggcgaguucagugcagagggagaagguaacagcaaaaagcucucuaagaaacgcgcugccaccacuguguuacaagagcugaagaaacuuccucccuugccagucguugaaaagccuaaacuguuuuucaagaagcgacccaaaacaauagugaaggcgggcccagaguaugggcagggaaugaaucccaucuccagacuagcccagauucaacaggcaaagaaggaaaaagagccugacuacguacuccugucagagaggggcaugccacggcgucgcgaauuugugaugcaggucaagguggguaacgagguugcuaccgggacgggaccgaauaagaaaaucgccaagaaaaacgcugccgaagcaaugcuucugcaguugggcuacaaggccagcacuaaucuccaagaucagcuggagaaaaccggcgaaaacaagggguggaguggacccaagccugguuucccagagcccacaaauaacacuccuaaaggcauuuuacaccugucuccagacguguaucaggagauggaggcuuccagacauaaggucaucagcgggaccacacucggauaccuuucgcccaaagauaugaaucagccgucuuccucauucuuuaguauaagcccuaccuccaacucuagcgcgacgauugcaagggaacuguugaugaauggcacuucaaguacagccgaagcuaucggucuaaagggguccagcccaacacccccuugcucucccgugcaaccaucaaaacagcuggaguaucucgcccggauucagggcuuccaggcagcccugagugcucuuaagcaauuuagcgagcagggacuggacccuaucgauggcgccaugaacaucgaaaaaggguccuuggagaagcaggcaaagcaccuccgagaaaaagcggacaacaaucaggcucccccaggaucuauugcccaagauuguaagaaaucgaacagcgcaguauga

SEQ ID NO: 63312 - RNA, 1077 nt, Artificial Sequence
  derived and/or modified sequence opt3 from STBD1__Homo_sapiens__NP_003934
augggcgccguguggagcgcucugcucgucgggggaggucuugcaggcgcccuguucguuugguuguuaagagggggacccggcgacaccgguaaggauggggacgcggagcaggaaaaagaugcuccucugggaggcgccgcaaucccaggcgggcaccaauccggaucuucaggucuaaguccgggccccagcgggcaggagcucgugacaaagccugaacaucugcaggaguccaacggacaccuuauuucuaaaacuaaggaccugggcaaauugcaggccgcuucguggaggcuccaaaauccaucacgggaaguaugcgauaacagccgcgagcaugugcccaguggucaguuuccugacacggaggcaccagccaccuccgaaacaucuaauagccgauccuacucagaggucagucguaacgaaagccuggagucucccaugggggaguggggauuccagaagggccaggaaauauccgcuaaggccgcgacuuguuuugcagagaaacugccuucaagcaaucucuuaaagaacagagccaaagaagagaugagucugucugaucuuaauucccaagacaggguggaucacgaagagugggagaugguuccacggcauagcucguggggcgacgugggggucggagguucuuugaaggcuccggugcugaaccuaaaucagggcauggauaacgggcgcuccacccucguagaagccagaggacagcagguucacggcaaaauggagaggguggcagucaugcccgcugguucacaacaggugagugugcgguuccagguccacuauguuacaagcaccgacgugcaauuuaucgccguaacuggggaucaugaaugccugggccgcuggaauacauacauuccucuucacuauaacaaggacggauucuggucccauucuaucuuucugccagcggacaccguggucgaguggaaguucguguugguugaaaauggcggggugacgcgaugggaggaguguagcaacagauuucucgaaacuggacacgaggauaaagucgugcacgccuggugggguauucauuga

SEQ ID NO: 63313 - RNA, 744 nt, Artificial Sequence
  derived and/or modified sequence opt3 from STC1__Homo_sapiens__NP_003146
augcugcagaacagcgccgugcuccuuguccugguuaucuccgcuucugcaacccacgaggccgaacaaaaugacucagugagucccagaaagagcaggguagcggcucagaacuccgccgaggugguccggugccuuaauucugcauuacaggugggcuguggggccuucgcuugccuggaaaacucgacaugugauacugacggaauguacgauauuugcaaaucauuucuauauagcgcagccaaguucgacacgcaggguaaggcuuuuguuaaagagagucucaaauguauagccaauggcgugaccuccaaggucuuccuggcgauccgccgaugcucuacauuucaacguaugauugcagaagugcaggaggaguguuacagcaaguugaacguaugcuccaucgccaaaagaaauccugaagcuauuacugagguugugcagcugccaaaccauuucucaaauagguauuacaaccgguugguccgcagucuccuggaaugugaugaggacaccgugagcacaaucagagauucucugauggagaagauagggccgaauauggccucccucuuucacaucuuacagaccgaccauugcgcacaaacucaccccagggcugauuucaaccggcgccgaacaaaugaaccucagaaacugaaggugcuuuugagaaaccugaggggagaggaagacucaccaagccauauuaaacggaccagucacgagucugccuga

SEQ ID NO: 63314 - RNA, 909 nt, Artificial Sequence
  derived and/or modified sequence opt3 from STC2__Homo_sapiens__NP_003705
augugcgccgagagacugggccaguucaugacccucgcucuugugcuggcaacauuugaccccgccagggggacugaugcgacgaacccuccagaaggaccgcaagaccggagcucccagcagaagggucgcuugucuuuacagaauaccgcugagauccaacacugucuggucaacgccggcgauguugggugcggaguguucgaauguuuugagaauaacucaugcgaaauucgaggccuacaugguauauguaugacauuccuccacaaugcagggaaauuugacgcccagggaaagaguuucaucaaagaugcucugaagugcaaagcacaugcccuucgucacagauuuggcuguauuagcaggaagugccccgcuauccgggagaugguaucccagcugcagcgcgaguguuacuugaagcaugaccucugcgccgcggcacaagaaaacacuagagugauugucgagaugauccacuucaaagaucugcugcuccacgaaccuuauguggacuuaguuaaucugcuuuugaccuguggcgaggaggugaaggaagccauaacacauucuguccaggugcagugcgagcagaacugggggucgcugugcucaauccugagcuuuuguaccagugcuauucaaaaaccacccacugccccuccagaaaggcagccccagguagaucggacaaagcucucccgcgcacaccauggagaggcuggucaccaccuaccugaaccaucuagccgagagaccggcagaggggccaaaggagagaggggcuccaagucacauccgaaugcgcacgcccggggucguguugggggacuuggcgcacaaggccccagugggagcucugaaugggaggacgaacaguccgaguacucagauauccgcagauga

SEQ ID NO: 63315 - RNA, 1020 nt, Artificial Sequence
  derived and/or modified sequence opt3 from STEAP1__Homo_sapiens__NP_036581
auggagagcagaaaggacaucaccaaccaggaggaacuguggaaaaugaagcccaggcggaaucucgaagaggaugacuaccuucacaaagauacaggcgaaacuuccaugcugaagcgcccuguguuguuacaucugcaccaaacggcccaugcugacgaguucgauugcccaucugagcuacagcacacccaggaacucuuuccgcaguggcaucugcccauuaaaauagcagccaucauugcgucacuuacauuccuguauacuuugcuccgagaggucauccacccucuggcuaccagucaccaacaguacuuuuauaagauuccaauccugguuauaaacaaggugcuccccaugguaagcaucacauuacuggcccuuguguacuugccuggggucauugcagccaucgugcagcugcauaauggaaccaaauauaagaaauucccacacuggcuagacaaguggaugcucacucguaaacaguuuggucugcuuuccuucuuuuucgcuguucugcaugcaauuuacucuuugucguaucccaugagaaggucauaccgguacaagcuccugaacugggccuaucaacaggugcagcagaauaaggaagaugcuuggaucgagcacgacgucuggcgcauggagauauacgugagcuuaggcauuguagggcuggccauccucgcgcuucuggcaguuacaaguauuccuuccgugucugauagcuugaccuggagagaauuucacuauauccaauccaaacuaggaaucgucucacugcuccugggcacgauucaugcccuuauauucgcuuggaacaaguggaucgacauuaaacaguuugugugguacacuccaccgaccuucaugaucgccguguuucugcccauagucguuuugauuuucaagaguauccucuuccugccuuguuuaaggaaaaagauccugaaaauucggcacgguugggaggaugugacaaagaucaauaagacugaaauuugcagccagcuauga

SEQ ID NO: 63316 - RNA, 1473 nt, Artificial Sequence
  derived and/or modified sequence opt3 from STEAP2__Homo_sapiens__NP_001231873
auggagagcaucuccaugaugggcucucccaagucacugagugaaaccuuccucccuaacgggauuaauggaauaaaagacgccagaaaggugacagucgguguuaucggcagcggggauuuugcuaaaucccuuacuauuaggcugauccggugcggauaccacgugguaauuggcucucgcaacccaaaguucgcaucggaguuuuucccgcauguggucgacgugacgcaccaugaagaugccuugaccaaaacaaauaucauauuuguugcgauccaccgagagcauuauacuucauuaugggaccugcgucaccuacucguggguaagauucugaucgaugucagcaacaauaugagaauuaaccaguaccccgaaaguaaugcugaguaucuugccucccuguucccugacucuuugaucgugaagggguuuaacguaguuagcgcaugggcccuccaacugggaccaaaagaugcuuccaggcaaguguacauauguucaaauaacauucaggcacggcagcaggucaucgagcuggcccgccagcucaauuucauucccaucgacuuaggcagucugagcucugcuagagaaaucgagaaccuuccuuugaggcuguuuacccuauggcggggcccagugguggucgccauuucccucgcgacauucuuuuuccuguauucauuuguucgcgaugugauacaccccuacgcacgaaaucagcagagcgacuucuauaagaucccuauugaaaucguaaacaaaacccuuccaauaguggccauuacucuguugagucucgucuaccuggcuggguuacuggccgcagcuuaccaacucuauuacggaacaaaguauagaagguucccgcccuggcuugagaccuggcugcagugccggaaacaguugggucuacugagcuuuuucuuugccauggugcauguugcguacucccucugucugccuaugcgucgcagcgagagauaucuuuuccugaauauggccuaccagcaagugcacgcaaacaucgaaaacucguggaaugaggaagaggucuggaggaucgaaauguauauuucuuuuggcaucauguccuuggggcuccugucauuacuggcugugacgaguauuccaagcguauccaacgcccuaaauuggcgggaguucucuuuuauacagagcacucucggauacguugcucugcuuaucucaaccuuccauguguugauuuacggcuggaagcgagccuuugaggaagaguauuaccgcuucuauacacccccuaacuuuguccuggcacucgugcugccaaguaucgucauccuugguaagauuauacuguucuugcccugcaucuccagaaaacucaagaggauuaaaaaggggugggaaaaaucucaguuucuggaggaaggaaugggcggcacuaucccgcacgugucuccugagcggguuaccgugauguga

SEQ ID NO: 63317 - RNA, 1467 nt, Artificial Sequence
  derived and/or modified sequence opt3 from STEAP3__Homo_sapiens__NP_001008410
augcccgaggaaauggacaagccucugaucagccuccaccuuguggauuccgacucuucacuggccaaagucccagaugaggcuccgaagguuggcauuuuggggaguggagacuucgcacggagcuuagccaccaggcugguggguuccggcuuuaaaguaguggucgggucucggaaccccaagcgcacagcgcgacuauucccuucggcugcccaggugacuuuucaagaagaggcaguuucaagcccagaagugauauucgucgccguguuucgugagcauuacaguucccucugcucucugagcgaucagcuugcuggaaaaauccugguagacguuuccaaucccacggagcaggaacacuugcagcauagagagucaaacgcagaauaucucgccagucuguucccuaccuguacaguggucaaggcuuuuaaugugauuagcgccuggacucugcaagcgggcccaagggaugguaacagacaggugcccaucugcggggaccagccugaggcaaagcgcgccgucucugagauggcucucgccaugggauucaugccaguugauaugggcuccuuagcaucagcuugggaaguggaggccaugccgcugagacuuuugcccgcguggaaaguaccuacccugcuagcccucggccuguuuguguguuucuacgcauauaauuuugucagggacgugcuucagccauacguucaagaaagccagaacaaguucuuuaaacugcccgugagugucgugaauacaaccuugccuugcguagcuuauguucuccugucuuuaguguaccugccagggguccucgccgcugcccuucagcugcggcgcggaacuaaguaucagcgauuccccgauugguuggaccacuggcuacaacauagaaaacagauuggucugcucuccuucuuuugugcagcccugcacgcucuuuacagcuucugccugccguugaggcgggcgcaccguuacgaucucgugaaccuggcagucaaacagguguuagccaauaagucgcaucuguggguugaggaagagguguggcgcauggagaucuaucuaucucucggcguacuggcucuugggacauugucccugcucgccgucaccucacugccuaguauagcaaacagccuuaauuggagagaauuuuccuucgugcaaucuagccugggauuuguugccuuggugcucucaacgcugcacacuuuaaccuacggcuggacaagggcuuucgaggaaagucgguauaaguuuuaccugcccccaacuuucacccuaacacuccuggucccuugugugguaauccuugccaaggcauuguuucugcuccccugcauuucccgacgccuggcgagaaucaggcgggguugggagcgcgaaagcaccauuaaauucacguuaccaacugaccaugcucuggccgagaagacaucucacguguga

SEQ ID NO: 63318 - RNA, 852 nt, Artificial Sequence
  derived and/or modified sequence opt3 from STEAP4__Homo_sapiens__NP_001192245
auggagaagaccugcaucgacgcccugccccucacaaugaacagcuccgaaaaacaggagacuguguguauuuucggcacgggggauuuuggaagaucucuuggucugaagauguugcaaugcggcuacucagucguuuucgggaguaggaauccucagaaaaccacauuacugccaagcggagcugaagugcuauccuauucugaggcagccaagaaaucgggcauaaucauuaucgcgauucaccgggaacauuacgacuuucucacugagcugaccgagguacuuaacgguaagauccugguggauauaucaaauaacuugaagaucaaucaguauccggaaagcaacgcugaguaccucgcccaccugguccccggggcacaugugguuaaagccuucaauacaauuagugcuugggcacugcaguccggagcccucgacgcuucucgccaagccaucuuaaagaaagaaaacccuuuuagcaccuccucagcguggcugagugauagcuauguggcacuuggcauuuugggcuucuuucuguucguccuacucgggaucacuucucugccauccgugucaaaugccguaaacuggcgagaguuucguuucguucagagcaaacuuggauaccugacauugauacucuguaccgcucacacgcugguguaugguggcaagagauuuuuaagucccucuaaucugaggugguaccucccugccgcauacguccuugggcugauuaucccaugcacuguguuggugauuaaguucguccuaaucaugcccuguguugacaacacccugacacggauccgccagggaugggagagaaauuccaagcauuga

SEQ ID NO: 63319 - RNA, 387 nt, Artificial Sequence
  derived and/or modified sequence opt3 from STH__Homo_sapiens__NP_001007533
augagcgagggcgggggacagguguccugcaucuucgccgcucccaccagacuguguagguggccugcacucauugaaugcggugucaaccuuacacaaccacugugugaguggaugauacagguugcccgggaccgcacuuugucuuuagcgugggaaguggcuucacugcuaacgcucaguagcuccgagguaggccuggaaggggugggaaccaucuggccgucuucguacucaagcgaggagaguucccgaaauggcgccgaacagggucgucagcuuucuauugaggggcccuuucaaggacagaacugcccuagccacccagcagccgcucugcccuugccuaugagaggcgaaucccaggcaacaucaugucaggucuga

SEQ ID NO: 63320 - RNA, 3867 nt, Artificial Sequence
  derived and/or modified sequence opt3 from STIL__Homo_sapiens__XP_011540294
auggagcccaucuacccuuucgccagaccacagaugaacaccagguuuccgagcucccggauggugcccuuccacuuuccuccaucuaagugcgcucuguggaaucccacaccuacuggcgacuucauuuaucuccaucuuucauacuaucgcaacccaaaacuggucguuacggaaaagaccauacgauuggcauaccgucacgccaaacaaaauaagaaaaacaguagcuguuuucugcuggggucccuaacagcggaugaggacgaagagggagugacucucaccguagauagauucgaccccgguagggaagugccugagugccuggagaucacaccaaccgcuucucuuccgggcgauuuucugauucccuguaagguccauacucaggaauugugcucgcgggagaugaucgugcacucaguugacgauuucagcagugcccucaaggcacugcagugucauauuugcuccaaagacucucuggauugugggaagcucuuaagccugcgcgugcacaucacauccagagaaucacuugacagugucgaguuugauuugcacugggccgcugugacccuggcaaauaacuucaaaugcacgccuguaaagccaauacccaucauuccuacugcccuagcuaggaaucucagcucuaaccugaauaucucccagguucaaggaaccuauaaauacggcuaucuuacaauggacgagacucggaagcuguugcuccuguuagaaucagauccaaagguguacagccugccccucgucgguauuuggcuuagugggaucacccauauauacucuccucaggugugggccuguugccugcgcuauauuuuuaacuccagcgugcaggagcgagucuucucggaaucuggaaauuuuaucauuguuuuguacuccaugacacacaaagagccggaauuuuaugaguguuuccccugcgacggcaagaucccagacuuuagauuccagcuacugaccucaaaagagacgcuccaucuguuuaagaacguggaaccucccgauaaaaauccaaucaggugcgagcuuagugcggaaagccaaaacgcagagacugaguucuuuuccaaggccucuaaaaauuucagcauuaagcggucaagucagaagcuguccagcggcaaaaugcccauacacgaccacgauucugggguagaggacgaggauuuuucaccucguccaaucccgaguccccauccugugagccagaagauuuccaaaauccagccaucuguccccgaauugucgcucgugcuggacggaaacuucauagagagcaacccuuuaccaacaccccuggaaaugguuaauaacgagaauccgccucuaauuaaccaccucgaacaucugaagccacuucaaccccaguuguacgaugagaaacacuccccugagguggaagcuggugagcccucacugcgcggcaucccaaaucagcucaaccaagacaagccugcccugcuuagacauuguaaggucaggcagcccccagcauauaaaaaggggaauccgcacacccggaacaguaucaaaccuucuagccacaauggacccucccaugauauuuuugaaaagcugcagacugugucagcuggcaacguacagaaugaggaguacccaauccgacccagcacauugaacucucgccaauccagucucgccccucagagccagccacacgacuucguuuucucuccccauaauuccgguagaccuauggaacugcagauuccgaccccacccuuaccuucauauugcaguacgaacguguguaggugcugucaacaccacagccauauacaguacucgccauuaaauuccuggcagggggcgaacaccgucggaucuauccaggaugugcaaagcgaggcccuacagaaacacucacucuuccaucccaguggcugcccugcacuguacuguaacgcuuuuugcuccucuagcuccccgauugcccuucggccccagggcgacauggggucauguagcccacacaguaauaucgaaccuucucccgucgcucgcccaccuucccauauggacuugugcaacccccagccauguacagugugcaugcacacuccgaagaccgagagcgauaauggaaugaugggucugucgccugacgccuauagauuccucacagaacaagauaggcagcugcguuuacugcaggcacaaauccagcggcuuuuggaggcccagucacucaugcccugcucuccaaagacuaccgcuguugaggacacagugcaggcgggccgacaaauggaacugguaagugucgaggcacaguccagccccgggcuacacaugagaaaaggagugucuauugccguuagcaccggcgcuucccuguucuggaacgccgccggugaagaucaggagccugacucacagaugaagcaagaugacacuaaaauaaguagcgaagauaugaauuuuucuguggacaucaacaaugaggucacgucccucccagggucagcaaguagccugaaggcuguggauauucccuccuucgaggaaucuaacaucgccguagaggaagaguuuaaucagccucuuucggugagcaacucauccaguuugguugucaggaaagaaccggacgugccaguguucuuucccucuggccagcuggcagagagcgucuccauguguuuacagacaggaccuaccggcggggcgucaaauaacucugagacuagcgaagaacccaagauugaacauguuaugcaaccacuccugcaccagccuagugauaaucagaagaucuaccaagaccuucugggacaggugaaccauuugcucaauuccagcucuaaagagaccgagcagcccucaacaaaggcugugauaaucucccacgaaugcacccgcacucagaacguauaucauacaaagaagaaaacgcaccacagucggcuggucgacaaggauugugugcuaaacgccacccugaaacaacucagaagccuggguguuaagauugacucgccaacuaaggugaaaaagaaugcacauaacgucgaucacgccucugugcuugcuugcaucuccccugaggccguuauuagcggcuugaauuguaugucauucgcaaacguggggaugaguggacugucuccgaauggcguagacuuauccauggaagcuaacgccaucgcgcucaaauaccugaaugagaaccagcuuagccagcugucagucacaaggaguaaucagaacaauugcgaucccuuuagccuacuccauauaaacaccgaccgcuccacagugggucugucuuugauuagcccaaauaacauguccuucgccacuaagaaauauaugaagcgauacgggcuguuacaaucaucugauaauagugaagacgaggaggaaccucccgauaacgcugacucgaaaagcgaguaucuccugaaccagaaucuucgguccaucccagaacagcugggcggacagaaagagccuucuaagaacgaucacgaaauuaucaauuguucaaacugcgagagcgugggcaccaaugcagacacgcccgucuugcguaacauaaccaaugagguucuccaaacaaaagccaagcagcagcugacugaaaaaccggcuuuucuagugaagaaccugaagccauccccugccguaaaucuuagaaccgggaaagcagaguucacacagcaccccgaaaaggagaacgaaggagauaucacuauuuuuccagagagucuccaacccucugagacccugaaacagaugaauagcaugaacucaguggguacguucuuggacgucaagaggcugcgccaguuaccuaaacucuuuuga

SEQ ID NO: 63321 - RNA, 2058 nt, Artificial Sequence
  derived and/or modified sequence opt3 from STIM1__Homo_sapiens__NP_003147
auggacgugugcgucagacuggcccucuggcuucuguggggcuuguuacugcaccaggggcaaagccuaucccauucucacucagagaaggcuaccggaacaaguagcggugcaaacuccgaagagucuacugccgcggaguucuguaggaucgauaaaccccucugccauucggaggacgaaaagcugucauuugaggcuguucggaauauucacaaacuuauggaugacgaugccaacggcgacguggauguagaggaaagcgacgaguuccugcgcgaagauuugaauuaccaugacccuacggugaagcacaguaccuuucacggggaggauaaacucauauccgucgaggaccuguggaaggcauggaagucuagcgaaguguauaacuggacaguugaugaggugguccaguggcugaucacuuacguggaacucccacaguaugaggaaaccuuccgaaaauuacagcuguccggacaugccaugccgcgucuugcuguaacaaauaccacuaugacaggcaccguuuugaagaugacggacagaucacacaggcaaaaacugcagcuaaaggcacucgacacugugcuguuuggucccccucuucugacccggcauaaccacuugaaagauuucaugcucgucgugaguauugugaucggggucggaggcuguugguuugccuacauucagaaucgcuauagcaaggagcacaugaagaaaaugaugaaggaccuggagggcuuacauagagcugaacagucucugcacgaucuccaagagaggcuucauaaagcccaggaagaacaccggacaguugaaguggagaagguacaucuggagaaaaaguugcgcgacgaaaucaaccuagcgaaacaggaggcacagcgacugaaggaacucagagaggggacugaaaaugagaggucccggcaaaaguacgccgaggaagaacuggaacaggugcgugaggcccuucgcaaagcugagaaggaacuggagucacacagcaguugguaugcaccagaggcuuugcagaaauggcuccaacugacccacgaggucgaagugcaguacuacaacauaaagaaacagaaugccgagaagcaguuacugguugcgaaggagggagccgagaaaaucaagaaaaagagaaacacacuauucgguaccuuucauguggcacacucuuccagccucgaugacgucgaucauaaaauucugacggcuaagcaagcccuuucggaagugacugcugccuugagggaacggcugcaccgauggcagcagaucgagauucucugcggcuuccagaucguaaauaaccccgggauacacucucugguugcagcccuuaauauugacccuuccuggaugggaucaacacgcccaaaccccgcucauuuuaucaugaccgaugacguggaugacauggacgaagagauugucaguccucugagcaugcaauccccaucuuugcagagcucagugagacagaggcucacugagccgcagcacggccuggguagucaacgggauuuaacacauuccgacagcgaaucuucacugcacaugagugaucgccagagagucgcgcccaagccuccacagaugagcagggcagccgacgaggcucuaaacgccaugaccuccaaugggucucaucgucucaucgaaggagugcaccccggcucgcugguugagaaacuuccugauagcccagcauuggccaagaaagcucugcucgcccugaaccacggcuuagacaaggcacauucccugauggaacuuucacccagugcgccgccugggggaucuccccacuuggauagcucccggucacauagcccaucuuccccugaccccgauacgccaagucccgugggugacagccgagcucuccaggccucuagaaauaccaggaucccucaccuggcaggcaaaaaggccguagcugaggaggauaacggguccauuggagaagagacagacucaaguccaggccgcaagaaauucccgcuaaagauauuuaaaaagccccugaaaaaguga

SEQ ID NO: 63322 - RNA, 1800 nt, Artificial Sequence
  derived and/or modified sequence opt3 from STIM2__Homo_sapiens__NP_001162588
augcuggugcucggccuucuggucgccggggcugcagacggaugcgaguugguucccagacacuuaaggggucggcgcgccaccggcagcgcggcuacagccgcauccucuccugccgcugcagccggggauucaccagcucugaugacugacccguguaugagucuaagcccucccugcuucacggaagaggaucgauuuucccucgaagcccugcagaccauccauaagcaaauggacgaugacaaagauggaggcauugagguggaagagucugacgaguucauacgugaagauaugaaguacaaagacgcgacaaacaagcacucgcaucuucacagagaggauaaacauaucacuauugaagaccuguggaagagguggaagaccucagagguacacaauuggacauuggaggauacccuccaguggcugaucgaauuuguggagcugccacaguaugagaaaaacuuccgggacaauaacgucaaggguacuacacucccccgcauugcagugcacgagccuagcuuuaugaucagucaguuaaaaauauccgacagaucucauaggcaaaagcugcagcuuaaagccuuggauguugugcuguucgggccacuaacccggcccccucacaauuggaugaaggacuuuauccucacggucagcauugugaucggaguaggcggcuguugguucgcuuacacucagaacaagaccuccaaagaacauguugccaagaugaugaaagaucuggagucacuucagacagcagagcaaagucugauggacuugcaggaacgccucgagaaggcucaggaagagaaucgaaacguggccgucgaaaaacagaaucuggagagaaagaugauggaugagauuaacuaugcgaaagaagaggccugcagguuacgggaacugcgugagggggcagaaugugagcucagccgcagacaauacgcugagcaggaacuugaacaggugaggauggcccugaagaaggcugaaaaagaguuugaguugcggucuuccuggucagugccagacgcccuacaaaaguggcugcagcucacucacgaagucgagguucaguauuacaauaucaaacgacagaacgcagaaaugcaacuggccauagcuaaggaugaggcggagaaaauuaagaagaaacgcagcaccguguucggaacacuucacguagcacauaguucuucccuggacgaaguggaucacaagaucuuggaggccaaaaaggcucucagcgaacugaccacgugcuuaagagagaggcuguuucgguggcagcagauugagaaaaucugugguuuccagaucgcccauaauucgggccuaccgucucucacuuccucacuguauagugaccacagcugggucgugaugccccgcguuuccauuccuccauaccccauagcagggggaguggaugaccuugacgaagauacaccuccaaucgucucucaauuucccggcaccauggccaagccgccugguagcuuggcuagaucaaguucccugugcaggagccgucggucuauugugcccucaaguccacagccucagcgagcccagcucgcaccccaugcgccacaccccagccacccuagacauccacaccauccgcaacacacuccccacucccugccuucuccagaccccgauauccuuucgguaagcuccuguccugcucuguacaggaacgaagaggaggaagaggccauauauuucucagcagaaaagcagugcauucauuuggggcucggagccuguaaaagugaguga

SEQ ID NO: 63323 - RNA, 1632 nt, Artificial Sequence
  derived and/or modified sequence opt3 from STIP1__Homo_sapiens__NP_006810
auggaacaggugaacgaacugaaggagaaaggcaauaaggcccucagcgucgggaacaucgacgaugcacuucaaugcuacuccgaagcuauuaaacuggacccccacaaucauguuuuguauucuaacagaucagccgcguacgcuaagaaaggagauuaucagaaggccuacgaggacgguuguaagaccguggauuuaaaaccugacuggggcaagggguauaguaggaaagcagccgcucuggaguuccuaaaucgguuugaggaggcaaagcgcacauacgaagagggacucaaacacgaagccaacaauccacagcugaaggagggccuucagaacauggaggcucgacuggccgaacguaaguucaugaauccguuuaacaugcccaauuuguaucaaaaacucgagagcgauccuagaacuaggacgcugcuguccgacccaaccuaccgggaacucauagagcaguuacgcaacaagcccucugaucuggguacaaaacuucaggacccuagaaucaugacuaccuugucgguacugcuagggguggaucucggaucaauggacgaagaggaggaaauugcgacaccacccccuccaccgcccccuaagaaagagaccaagccagaacccauggaggaagaucugccugagaauaaaaagcaggcacuuaaggagaaagaacugggcaacgacgccuacaagaaaaaggacuucgauacugcuuugaaacauuaugacaaggccaaggagcucgauccaacaaauaugaccuacaucacgaaccaagcagcugucuauuuugaaaaaggcgacuacaacaagugcagggagcugugugaaaaagccauugagguggggcgggagaaucgcgaagauuaucgacagaucgcgaaggccuacgcaagaauaggaaacagcuauuucaaagaggaaaaguacaaggacgcuauccacuuuuacaauaaaaguuuagccgagcauaggacucccgauguucugaagaaaugccagcaggcugagaagauucucaaagaacaagagcggcuugccuauaucaacccggaccuggcauuggaagagaagaauaaggguaacgaauguuuccagaaaggcgauuacccucaggccaugaagcacuauaccgaggcuauuaaacguaaucccaaggacgcgaaacuauacuccaaccgcgcagccugcuauacaaagcugcucgaguuucaacuggcucuuaaagauugugaagagugcauccagcuggaaccaacuuucauaaagggguacaccagaaaggccgcagccuuggaggcuaugaaagacuauacaaaggccauggacguguaccagaaagcacucgaucuggacucuagcuguaaggaagcggcugauggauaccagaggugcaugauggcccaauauaaucggcacgacuccccugaggaugucaaacgacgcgcaauggccgaccccgaggugcagcagauuaugucagauccagcuaugagauuaauccuggaacagaugcaaaaggacccccaggcccuaagugagcaucucaagaacccuguaauugcacagaaaauccagaagcugauggauguuggccuuaucgcuauuagguga

SEQ ID NO: 63324 - RNA, 2907 nt, Artificial Sequence
  derived and/or modified sequence opt3 from STK10__Homo_sapiens__NP_005981
auggccuucgcuaacuuuagaaggauccugcggcucagcaccuucgagaagcgcaaaucccgagaauacgagcacgugcguagagaccuugaucccaaugaagucugggagauuguuggcgaacugggggacggagcauuugguaagguguauaaagccaagaacaaagagacaggcgcguuggcugccgcaaagguaauagagacuaagucugaagaggaauuagaggauuacaucguggagauugaaauccuggccacgugcgaccauccuuauauugucaaacuacucggggcuuacuaucacgauggaaagcuguggaucaugauagaguucuguccaggcggugcaguggacgccaucaugcuugaacuggauaggggguugaccgagccgcagauucaaguugugugccggcagaugcucgaagcucugaauuuucugcauucaaaacgcaucauucacagagaccucaaggccggaaacgucuuaaugacacuggagggcgauaucaggcuugcggacuucggcgugagugcaaagaauuugaagacucugcagaagcgggauagcuuuauagggacccccuacuggauggccccugagguaguuaugugugaaacaaugaaagacaccccauaugauuacaaggcugacauuuggucccuaggaaucacucucauugagauggcccagaucgaacccccucaucacgagcugaacccaaugcgcgugcuucugaaaaucgcaaagucugaucccccuacauugcucaccccaucgaaauggucagucgaguuccgagacuuucugaagauugcuuuagacaaaaauccggagacgagacccagcgccgcgcaacugcucgagcacccuuucgugaguuccauaacuucuaacaaggcccuuagggaacugguggcagaggcuaaggccgaagucauggaggaaaucgaggauggucgggacgagggcgaagaggaagaugcuguugacgccgcaagcaccuuggagaaucauacacagaacuccucagaggugaguccacccagccuaaaugccgauaaaccucuggaagagucuccauccacuccccucgcuccgucacagagccaggacaguguaaacgaaccuugcucucaacccuccggggaucguagccugcagaccacaucgccaccuguggucgcgcccggaaaugagaacggccuugcagugccaguuccccugcgcaagucuagaccuguguccauggacgccaggauucaggucgcucaggaaaaacaaguggccgagcaggguggggauuugucaccagcagccaaucggagucagaaggcuagccaaucccgaccgaacucuagcgcccucgagacccugggaggcgaaaaauuagcaaacggcucacuggagcccccugcgcaggcugccccagggcccaguaagcgcgacuccgacuguagcucucuaugcacgucagaaaguauggauuacggaacuaaucucagcacagaccugucccuuaacaaggagauggguucuuugucgaucaaagauccuaagcuguauaaaaagacccucaaaagaacuaggaaguuuguaguugacggcguggaagucagcauaacaaccuccaagauuaucucagaggaugagaaaaaggacgaagagaugcgguuccugcgcagacaggaacuuagggagcugcguuugcuccagaaagaagaacaccggaaucaaacgcagcugaguaacaagcaugaguuacagcuggaacagaugcacaaacgauuugagcaagaaaucaaugcaaagaagaaauucuucgauaccgagcuagagaaccucgaaagacagcagaagcagcaaguggagaaaauggaacaggaccacgccgucaggcgccgggaggaagcuagaaggauucgccuggagcaggaucgagacuacacacgguuucaggagcaacuuaaguugaugaaaaaggaagugaaaaaugagguugaaaagcugccacgucagcagagaaaggagucuaugaaacaaaagauggaagaacauacucagaaaaagcagcuccuggauagggacuucguggccaaacagaaggaggauuuagaacuggcaaugaagcgccuuaccacagacaaccggagagagaucugugacaaagaaagggagugcuugaugaagaaacaagaacuccugcgagaucgcgaggcugcccuaugggagauggaggagcaccagcugcaggaacggcaucagcucguaaagcaacagcugaaagaccaguauuuucuucagagacacgaguugcugaggaagcaugagaaggaacgugagcaaaugcagcgcuacaaucagcggaugauugaacaauuaaaagucagacagcagcaggagaaggcgaggcuccccaaaauacaacgaagcgaagggaagacucggauggccauguauaaaaagucccugcacaucaacggaggcgguucagcugcagagcagcgcgagaagauuaaacaguucagccagcaagaagagaagagacagaaaucugaaaggcuucagcagcaacagaagcacgagaaucagaugcgggauaugcuggcccagugugaauccaacaugagugaguugcaacagcuccagaaugagaaaugccaucugcuaguggaacacgagacccaaaagcugaaagcucucgacgaaagccauaaccagaaucugaaggaguggcgagauaaacuuagaccgcgcaaaaaggccuuggaagaggaccugaaccagaaaaagagggagcaggaaauguuuuucaaauuaucugaggaagcagaguguccuaacccauccacacccucaaaggcggccaaguuuuucccuuacaguagcgcugaugccucguga

SEQ ID NO: 63325 - RNA, 1302 nt, Artificial Sequence
  derived and/or modified sequence opt3 from STK11__Homo_sapiens__NP_000446
auggagguggucgacccccagcaacugggcauguucaccgaaggggagcucaugagcguuggaauggauacauuuauccacagaauugacuccacugaagugauauaccagccuaggcggaagcgcgccaaacuuaucgguaaguaucugaugggcgauuuguuaggggagggaucuuacggcaaaguaaaggaagugcuggacucagagacgcuaugccgacgugcugucaaaauucucaagaagaaaaagcugagaaggaucccaaacggugaggcaaaugugaaaaaggaaauucagcuucugcggcgcuugagacauaaaaacguuauccagcucguggauguccuguauaaugaggaaaagcaaaagauguacauggugauggaguauuguguaugcgggaugcaggagaugcuggacaguguuccggagaaaagguuccccgugugucaggcccacggauacuuuugccagcucauagauggcuuagaauaucugcauagccaaggcaucguccacaaggacauuaaaccugggaaccuuuugcugaccacaggagguacucuaaagaucuccgaucucggcguggcggaagcucugcauccauucgccgcagacgauaccugucggacaucucaggggucgcccgccuuucagccuccagagauugcuaauggacuugacaccuucucaggcuuuaaaguggauaucuggagcgccggugucacucuguacaacauaacaaccggguuguaccccuucgaaggagacaauauuuauaagcucuuugagaacaucggcaaaggcaguuacgcaauuccuggggacugcggaccaccgcuguccgauuuacugaaggguaugcucgaguaugaacccgcuaagcgcuucucuauccgacagaucagacaacacagcugguuuaggaaaaagcacccuccagccgaggcgcccguuccuauuccacccuccccggacacgaaagaucgguggcguucaaugacugugguaccuuaccuugaagaccugcauggcgcagaugaggacgaagauuuguucgacauagaggaugacaucauuuauacccaggauuuuacagugcccgggcaggucccagaggaagaggccagucacaauggacaacgcagaggccuaccuaaggcuguguguaugaacgguacugaagccgcacagcugagcaccaaaucuagggcugaggggcgggcccccaauccagcgcgaaaggccugcuccgcaucaagcaagauccgcagacucagugcuuguaaacagcaguga

SEQ ID NO: 63326 - RNA, 3267 nt, Artificial Sequence
  derived and/or modified sequence opt3 from STK11IP__Homo_sapiens__NP_443134
augaccacagcccagagagacagccugcucuggaaacuugcuggccuguugagggaguccggggauguggucuuaucuggaugcucaacucugagucuacucacgcccacccugcaacagcuuaaccacguuuucgaacugcauuuggguccuuggggcccagggcagacaggauuuguggcacucccgagccaccccgccgacuccccuguaauccugcagcugcaauuccucuuugauguguuacagaaaacucugucucuuaaguugguccauguggcgggcccaggucccaccgggccuauuaaaauauucccauuuaagucgcugcggcaccuagagcuccgcggaguuccccugcauugucuucacggccugcgaggcaucuacucacaguuggaaacacucauuugcagccguagucugcaggcuuuagaggaacugcucuccgccugugggggagacuucugcucugcacuuccuuggcuggccuugcuaagcgcuaauuuuuccuauaacgcacugaccgcccucgauucaagucugagacuucugagcgcuuugagguuccucaaucugucucacaaccaagugcaggacugucaggguuuucuaauggaucugugcgagcuacaucaccucgacaucuccuacaaucggcugcaucuugucccacgcaugggcccgucaggggccgcguugggagugcugauucucagaggcaacgagcugaggagccuucacggucuggaacaguugcggaaucuccgccaccuggauuuagcauauaaccugcuagaggggcaucgagaacucaguccccuguggcuuuuggccgagcugagaaaacucuaccuggagggaaauccuuuaugguuccacccagaacauagggcugccacugcacaauaucugucuccccgggcucgugacgccgcgacaggcuuucuuuuggauggcaagguacucucccugaccgacuuccagacgcacacuagccuagggcugucgccuaugggaccaccccucccguggccuguugguucuacccccgagacauccggcgggccagaucugucagacagucuuagcuccggaggcguggucacucagccuuugcugcauaaggugaaaucucgcgugagagucaggcgggccagcaucucagaacccagugacaccgauccagagccccgaacauuaaacccuuccccagcagguugguuuguucaacagcacccggaacucgagcugaugagcucuuuccgcgagagauucgggaggaauuggcuucaguaccggucacaccuggaacccaguggcaacccuuugccagcuacccccacgacuagcgccccuuccgcuccacccgccucuucgcagggaccggacacagcaccucgcccaagcccaccucaagaggaagccagaggcccccaggaguccccacagaagaugucagaagaggugagggcugagccucaggaagaggaagaggaaaaagaggggaaggaggaaaaagaggaaggagagaugguagagcaaggugaagaggaagcgggcgaggaagaggaggaagaacaggaucagaaggaaguggaggcagaacucugucguccccugcuagucugcccacuggaggggccggagggagugcggggccgagaauguuuucucagaguuaccagugcccaucuguucgagguggaacuucaggcugccaggacuuuggagcgccuggaauuacaaucucucgaggcagccgagauagaaccugaggcucaggcccagcggagccccagaccaacagguuccgaccugcuucccggggcaccuauccugucacuaagguuuagcuauauuugcccagaucgccagcuccgacgguaccuggucuuggaacccgacgcgcacgcugccgugcaagagcuguuagcaguacucaccccuguuacgaauguggcccgugagcagcugggcgaagcuagagaucuucuguugggaagguuccagugucuccgcugcggccaugaguuuaagccggaggagccacggauggggcuggacucugaagagggauggagaccccuauuccaaaagaccgaguccccugccgucugcccaaacugugguagugaucacgugguccugcuugcagugagcaggggcacacccaaucgagaacgcaagcagggggagcagucucucgcuccuuccccgucagccagucccguuugccacccaccuggacauggcgaccaccuggaucgggcgaaaaacagcccaccccaggccccuucgacuagagaccaugguuccuggucuuugagcccacccccggaaaggugugggcugcguucaguggaccaccgcuuacggcucuuucuggauguagaggucuucagugacgcucaagaagaguuucagugcugucuuaaggugccuguugcacuggccggccauaccggagaguucaugugcuugguggucguguccgauagaaggcucuaccugcuaaaaguaacaggcgaaaugcgagagcccccagcuucuuggcugcagcuuacucucgccgugccccugcaggacuugagcgggaucgaauuaggacuggcaggccaaucccuccggcuggagugggcggccggugcugggcgcuguguucuucugccuagagaugccaggcacugccgggcauuuuuggaagaguuacuggacguccuccagucacugccacccgcuuggcgaaacugugugagcgccaccgaggaagaggugacaccucagcacagacuuuggccguuacuggaaaaggauaguucucucgaggcacgccaguucuuuuauuugagggccuuccuggucgagggaccaucaaccugccucguuagccugcuucugacucccucgacguuguuccuacuggacgaagaugcugcgggcuccccugccgagcccucucccccugcagcuaguggugaagccuccgagaaagugcccccaagcggcccugggccggccgugcguguacgggaacaacagccccucucuagcuuauccucaguccugcuuuacagaagugcuccagaggaccugaggcucuuguuuuaugaugaggugagccgccuggaaucuuucugggcacuccgaguugugugucaggagcaacugacagcccuucuagcguggauuagagaaccuugggaggaacuguuuuccaucggauugcggaccgucauacaggaggcuuuagcccuggacagguga

SEQ ID NO: 63327 - RNA, 1245 nt, Artificial Sequence
  derived and/or modified sequence opt3 from STK17A__Homo_sapiens__NP_004751
augaucccccuggagaagccuggcagcgggggauccucuccaggugccaccucaggcagugggagagcuggaaggggccucagcgguccgugccggcccccuccacccccucaggcacgcgggcuucugacagaaauucgagccgugguccguacugagccauuccaagacggauacuccuugugucccggcagagaauuaggcagggggaaauuugcgguugugcggaagugcauaaagaaggauucuggaaaagaguucgcugccaaguuuaugcgcaagagaaggaaaggucaggacugucggauggaaaucauucacgagaucgcaguacuggagcuagcccaggauaacccuugggugauuaaucuccaugaagucuaugagacggcuucggaaaugauccuggugcuugaguacgcagccggcggggagauauucgaccagugcguugcugaucgcgaagaggccuuuaaggaaaaagacgugcaacgacugaugagacagaucuuggagggaguccacuuccuccauaccagggaugugguacaccuggaccugaagccacagaacauucucuuaacaucagaaagcccgcugggcgauaucaaaauuguugacuuuggucuuagucggaucuugaaaaauuccgaggagcugcgugaaauaauggggacucccgaguauguggcgccugaaauucuaucuuacgauccaaucagcauggcaaccgacaugugguccauuggaguccucacauaugugaugcugaccggcaucucacccuuccuuggcaacgauaagcaggagacuuuucugaauaucagucaaaugaacuugagcuacucugaagaggaguucgacgugcucuccgaaucagccgucgacuuuauucgcacacuguuaguuaaaaagccugaggauagagcuaccgccgaagagugucugaaacauccauggcucacgcagagcaguauacaggaacccucuuucaggauggagaaggcacuugaggaagcuaaugcccugcaggaggggcacuccgugccggaaaucaacagcgacacugauaaaucggagaccaaggagucuauuguaacagaagaguugaucguggucacuuccuauacccuaggacaaugccggcagucagaaaaagagaagauggaacagaaggcgauaaguaaacgauuuaaguucgaggagccucugcuccaagaaauucccggugaguucaucuacuga

SEQ ID NO: 63328 - RNA, 1119 nt, Artificial Sequence
  derived and/or modified sequence opt3 from STK17B__Homo_sapiens__NP_004217
augagcagaaggcgguucgacugccgcuccaucucuggccugcucaccacaacuccccagauuccuauaaagauggagaacuuuaauaacuucuacauccuuacgucaaaagaacuggggcgaggaaaguuugccgugguccgucaauguauuaguaaaagcaccggucaggaguaugcugcaaaguucuugaaaaagagaaggcggggccaggauugccgcgccgaaaucuuacacgagauugcgguucuggaacuagcuaaguccuguccaagagugaucaaucuccaugagguauacgagaacacaucugaaauaauccugauucuugaguaugccgcagggggagaaaucuuuucgcugugcuugccggagcucgccgagauggugucagaaaaugacgucauuaggcugaucaaacagauacuggagggcguguacuaucuccaccaaaacaauauuguucauuuagaucugaagccccagaacauccuuuugagcaguauuuacccucugggugacaucaaaaucguggauuucgggaugucccggaagauuggacacgcuugugaacuacgcgagauaaugggcacuccagaauaucucgcacccgagauccugaauuacgacccuauuaccacagccaccgauauguggaacaucggcauaauugcuuacaugcuucugacucauacaucuccauuugucggggaggacaaucaggaaaccuauuugaacaucagccaggugaauguagauuacuccgaggaaacguucucaaguguuagccaacucgccacugacuuuauccagucucuguuagugaaaaaccccgagaagcgaccuaccgcggaaauuugccugucccacucauggcuccagcagugggauuucgagaaucuuuuucacccagaggaaacaagcaguucuucccaaacucaggaccauagcgucagaucgucugaggauaagaccuccaaaucaaguuguaacggaacaugcggugacagggaagacaaggagaacaucccggaagauagcuccauggugucuaaacgguuccguuuugacgauagccugcccaauccucacgaguuggugucagaccuacuguguuga

SEQ ID NO: 63329 - RNA, 1095 nt, Artificial Sequence
  derived and/or modified sequence opt3 from STK19__Homo_sapiens__NP_004188
augcagaagugguucagcgccuuugacgaugcuaucauucaaagacaguggagggcaaaccccucccggggcgggggaggugugucuuucaccaaagaggucgacacaaauguugccacuggcgcgccuccacgccgacagcgugugccggggagagcuugccccuggagggaaccuauacggggacgcagaggcgccaggccaggugggggagaugcaggcggcacgcccggggagaccguacggcacuguucagccccugaagacccaaucuuucgcuucaguagccugcauuccuaccccuuuccuggaacaauuaagucucgagauaugucguggaaaagacaccaucucaucccagagacuuucggugugaagaggcggcguaaacgcggcccggucgaaucagacccccuuagaggggagccuggaagcgcuagggcagccgugagugagcugaugcaguuguuuccacggggcuuauucgaagaugcucugcccccuauuguucuacgaucccaaguguauucucucgucccagaccgcaccguggccgauagacagcugaaggagcuucaggaacagggugagaucaggauaguacaacugggguuugacuuggaugcgcacggaaucauuuucacagaggacuaccggacccgcguucucaaggcaugcgauggcagacccuaugccggcgcugugcagaaauuucuggccagcguccugccggcauguggggaccucuccuuccagcaggaccaaaugacucagacauuuggauucagggauucagaaaucacccauuuagugaacgcuggugugcugacgguccgugacgccggcaguugguggcuugcgguuccuggggccggacgguucauuaaguacuuugugaaaggccgacaggcaguauugagcauggugagaaaggcuaaauauagggagcugcuacucucugaacugcuuggucgccgggcccccgucgugguuagacugggguugacuuaccacgugcacgaucucaucggcgcucaacuggucgacugcauauccaccacaucaggaacuuuacugaggcucccagagaccuga

SEQ ID NO: 63330 - RNA, 1296 nt, Artificial Sequence
  derived and/or modified sequence opt3 from STK24__Homo_sapiens__NP_001027467
auggcccacagccccgugcaguccggccugccugggaugcaaaaccucaaggcugacccagaggaacuuuucaccaaacuggagaagaucggaaaagguucuuuuggcgaagucuucaaggggauugauaauagaacacagaaaguuguggcaauaaagaucauugacuuggaggaagccgaggaugagaucgaagacauucagcaggagaucacuguauuaucacaaugcgauaguccguacgugacgaaguauuacggaagcuaucugaaagacaccaagcuauggauaaucauggaauaccucggcgguggguccgcgcuggaucuucuggagcccggaccuuuggacgagacacagauugcuacuauccucagggaaauucugaaaggccuggauuaucuccauucugagaagaaaauccaccgggacauaaaggccgcaaacgucuuacugucggaacauggcgaggugaagcucgccgauuuugggguugcuggacaguugaccgacacacagauuaaacgcaauaccuucguggguacuccauuuuggauggcacccgaagucaucaagcaaucagccuacgauagcaaagcugacauuuggagucugggcaucacagccaucgagcuagcgcgaggggagccuccacacuccgaacuccaucccaugaaggugcuguuccuuauuccuaaaaacaauccaccgacccuggagggaaacuauucuaagcccuugaaagaauuuguagaggcaugucucaauaaggaaccuagcuuccguccaacggccaaggagcuguuaaaacacaaguuuauacugagaaacgcuaaaaagacuuccuaccucaccgagcuuaucgacagguacaaacgguggaaggccgaacagucacacgaugacaguagcucugaggauuccgacgcagaaacagauggccaggcuucaggugggagcgacaguggagauuggauuuucacuauccgcgagaaggaccccaaaaaucuggaaaacggcgccuugcagccuucugaucuagacagaaauaagaugaaagauauaccaaagaggcccuuuucccaaugccugagcaccauuaucucgccgcuuuucgcggagcugaaagagaagucucaggccuguggcgggaaccuuggauccaucgaggaacugcggggugcaauuuauuuggcugaagaggccugcccuggcaucucagacacaaugguugcucagcucgugcaacgccugcagcgauacaguuuaagcgggggaggcaccuccucucauuga

SEQ ID NO: 63331 - RNA, 1281 nt, Artificial Sequence
  derived and/or modified sequence opt3 from STK25__Homo_sapiens__NP_001258907
auggcccaccugagaggcuucgcuaaccagcauagcaggguggaccccgaggaacucuuuaccaaacuugaucggaucgggaagggauccuucggugaggucuacaagggcauugacaaucacacaaaagaaguuguggcaauaaagaucauugaucuggaggaagccgaggacgagaucgaagauauucaacaggagaucacuguauugucucagugcgacucaccuuauauaacgcgcuacuuugggaguuauuuaaaaagcaccaagcuguggaucauuauggaauaccuaggaggcgguuccgcgcucgaucugcuuaagccagggccgcuggaggagacauauaucgcuacuauuuugcgagaaauccucaaaggacuggacuaccugcauucugagcguaagauacacagagauauuaaagccgcaaacgugcucuuaucggaacagggcgacgucaagcuggccgauuucggcguggcugggcaacuuaccgacacacagaucaaaaggaauaccuuuguuggaacucccuucuggauggcaccugaggugauuaagcagucagccuaugauuuuaaggcugacaucuggagcuuggguaucacagccauugaacuggcgaaaggcgagccacccaacagugaccuacauccuaugcggguccucuuccugauaccaaagaauagcccucccacccuugaggggcagcacucuaaaccauuuaaggaguucguggaggcaugucugaacaaagauccgcgcuuuagacccacggccaaggaauugcucaaacacaaguucaucacuagguacaccaagaaaacauccuuucugacugaguuaauugaccgguacaagcgcuggaaauccgaaggacauggcgaggagucaaguagcgaagauucugacaucgauggugaggcugaagacggggagcaaggaccuauauggaccuucccacccacaauucgaccuuccccacacucaaagcugcauaaaggcaccgcccuccacagcagucagaagcccgcagaaccgguaaagagacagccuaggucucagugccuuuccacgcugguucggcccguguucggcgaguugaaagagaagcacaaacaaagcgggggaucggucggugcucuagaagaacuggaaaaugccuuuucucucgcggaggaguccuguccaggcaucucagauaagcugauggugcaucuuguggaacguguccagcgcuucagucacaacagaaaucaucugacuagcacaagguga

SEQ ID NO: 63332 - RNA, 1065 nt, Artificial Sequence
  derived and/or modified sequence opt3 from STK26__Homo_sapiens__NP_001035917
auggcccacagccccguggcuguccagguuccuggcaugcaaaacaauaucgcagacccagaggaacuguucaccaagcucgagagaauugggaaaggauccuuuggugaaguguucaagggcauagauaacaggacacagcagguaguggccaucaaaauuaucgaccuugaggaagcggaggaugagauugaagacauccagcaagagauaacuguccugucucagugcgauucaaguuacgugacgaaguauuacgggagcuauuugaaaggauccaaguuauggaucauuauggaauaccugggcggugggucugcucuagaccuccugcgggccggaccguuugaugaguuccagaucgcaaccaugcuuaaggagauucugaaaggcuuggacuaucuccauucggaaaagaaaauccaccgcgauauaaaggccgcuaauguucugcugucagagcagggcgacgugaaacucgcagauuuuggggucgccggacaauuaacagacacucagauuaagcgaaacaccuucguggguacacccuuuuggauggcuccugaaguaauccagcagagcgccuacgauaguaagcguccaaccgcgaaagagcugcuuaagcauaaauucauuguuaaaaauuccaagaagacuucuuauuugacagaacugaucgacagauuuaaaagguggaaggcagagggccacagcgacgaugaguccgacucagaagggagugauagcgagucuaccucccgggaaaacaauacgcaucccgaguggucauucacuaccgugcgcaagaaaccugacccaaagaaaguccaaaacggagccgaacaggaucuagugcagacacucagcugucugaguaugaucauuacucccgcuuuugccgagcuuaagcaacaggacgagaauaacgcaucuagaaaucaggcuauagaggaacuggaaaaauccaucgccguggcggaggccgcaugcccuggcauuaccgauaagauggucaagaaauugaucgaaaaguuccagaaauguagcgcugacgagucgccauga

SEQ ID NO: 63333 - RNA, 2991 nt, Artificial Sequence
  derived and/or modified sequence opt3 from STK31__Homo_sapiens__NP_001247433
auggacgaggauacccacuacgacaagguggaagaugucguuggcagccauaucgaggacgccgugacauucugggcucaguccauuaacagaaauaaagauauaaugaagaucgggugcucucugucagaaguauguccccaagcaaguagcgugcucggaaaccuugacccuaauaaaauuuaugguggccuguuuuccgaggaucagugcugguacagguguaaggucuugaaaaucauuucuguggaaaagugcuuaguucgguauaucgacuacgggaacacugagauacugaaucgcucggauaucguggagauuccacuagaacuccaguucucaagcgucgccaagaaauauaagcuguggggacuucacaucccgagugaccaggaggugacgcaauuugaucagggcaccacauuccuggguuccuugauuuuugaaaaagagaucaagaugcgaauaaaagcgacuucugaggacgggaccguaauugcucaggccgaauacggaagcguugauaucggcgaggaagugcucaagaagggcuucgcagagaaaugucgucuggccuccagaacagacauuugcgaagagaagaaacuggaccccgggcagcucgucuuaaggaaccugaagucaccuaucccacuuuggggacaucggaguaaucaaagcaccuuuucucgccccaaaggucacuuguccgagaagaugacucuggaucuaaaagacgaaaacgaugcuggcaaucucaucacauucccuaaggagucacuggcagugggggacuuuaaccuuggaagcaaugugagucuggaaaagauuaaacaggaucagaaguugauagaggaaaacgagaaacucaagaccgagaaagacgcccuguuagaaucuuauaaggcucuggagcucaaggucgaacagaucgcccaagagcuucagcaggaaaaagcggcagccguugaucugacgaaucauuuggaguacacucuaaagaccuacauugacacaagaaugaaaaaccuggcugccaagauggagauccucaaagaaaugaggcacguggauauauccguacgguucggcaaggaccugagcgaugcaauucaagugcuugacgaggguuguuuuacuaccccagcuucgcugaauggguuggaaaucaucugggccgaguauucucucgcgcaggagaacauuaagacaugcgaauacgucuccgagggaaacauccugauugcccagcgcaaugaaaugcagcaaaaauuauauaugucaguggaggacuucauacuggaaguugaugagaguagccuaaacaagcgacucaaaacccugcaggaccuuuccgugucuuuggaggcagucuacggccaggcuaaggaaggcgccaauagcgaugagauccugaaaaaguuuuaugacuggaagugugauaaaagagaagaguucacgucagugaggagugaaacugacgcuucccuccaccggcugguagccugguuccagcguacacuuaagguuuuugaucugagcguggaggggucuuugauuucagaggacgcaauggauaacaucgacgaaauccucgagaaaaccgaaaguagcgucugcaaggagcuggaaauugccuuaguggaucaaggagacgcugauaaagagauaaucuccaauacuuacucucagguccugcagaagauucauucggaggaacgccuaaucgcgacagugcaggcaaaauauaaggacagcauugaguucaagaaacaacucaucgaauaccugaacaagucccccucaguugaccaccuuuugaguaucaaaaagacccugaaaucucucaaggcccuguuaagauggaagcugguggagaaaagcaaucuugaggaauccgaugacccugaugguucacagauagagaagauuaaagaagagaucacgcaguugaggaacaauguauuucaggaaauuuaccaugagcgggaggaauaugagaugcucaccagccuggcucaaaagugguucccagaacuaccgcugcuccaccccgagaucggccugcuuaaauacaugaacucugggggauugcugacaauguccuuagaacgagaccuccuggaugccgagccuaugaaggagcuuaguagcaagcgcccacuggucagaucugaagugaauggccagauaauuuugcucaaagguuauuccguugacguggauacugaggcaaaggucaucgaaagggccgcuaccuaccaccgggccuggcgcgaggcagaaggggacucaggccugcuaccccugauuuuucucuuccuguguaaaagugauccuauggcguaucuuauggugccauacuaucccagagcuaacuugaaugccguacaggcaaacaugccgcugaauagcgaggagacauuaaaggugaugaaaggaguugcccaaggccuccauacucugcacaaggcugacaucauacaugggucgcuucaccagaacaacgucuuugcccugaauagggaacagggaaucgugggugauuucgacuuuaccaaguccgugucucagcgugcaagcgucaacaugaugguuggcgaucuaucacucaugaguccugagcugaaaauggggaagcccgcuuccccaggaucugacuuguacgccuacggcugccuguuacucuggcugagcgugcaaaaucaggaguucgaaauuaacaaagacgguaucccuaagguggaucaguuucaucuugacgauaaaguaaagucccuguugugcucacucauuuguuaucggagcaguaugacagcggagcagguccugaaugccgaaugcuuccuaaugcccaaagagcaaucugugccaaaccccgaaaaggacaccgaguacacucuguauaagaaagaagaggagaucaagacggaaaaucuugauaaauguauggagaagacacgaaacggggaagcuaauuuugacugcuga

SEQ ID NO: 63334 - RNA, 1191 nt, Artificial Sequence
  derived and/or modified sequence opt3 from STK32A__Homo_sapiens__NP_001106195
augggcgccaacaccagcagaaagcccccuguguucgacgagaaugaagaugucaacuuugaccacuucgagauccugagggcuauugggaaaggauccuuugguaagguuugcauagugcagaaaaaugauacaaagaaaauguacgcaaugaaguauaugaacaagcaaaaauguguagaacggaaugaggugcgcaacgucuucaaggaacuccagaucaugcagggccuugagcauccauuucuggugaauuugugguacucuuuccaggacgaggaagauauguuuaugguuguggacuuacugcuagggggagaucuccgauaucaccuucaacagaacguccauuucaaagaggaaacugugaagcuguuuauuugcgagcugguaauggccuuggacuaccuccagaaucagcguaucauucacagagauaugaaaccggacaacauccugcuggaugagcauggccacguucacauaacggacuucaauaucgcggcuaugcuccccagggaaacccaaauuacaacuauggccgguaccaagccuuauauggcaccagagauguuuucaagucggaagggggccggauacagcuucgcuguggauuggugguccuuaggcgucacagcauaugaacugcuucgcggcagaaggcccuaccauauccggucuucgaccucaagcaaagagauugugcacacuuuugaaacaaccguggucacguacccuagugccuggucccaggagaugguuucuuugcugaagaaacuacucgagccaaaccccgaccagcgcuucagccagcuguccgacgugcaaaauuucccuuauaugaacgauaucaauugggacgcuguauuucagaagcgacuuauaccaggguucauuccgaacaaaggaagacugaacugugaucccacuuuugaauuggaggaaaugauccucgagucaaagccucugcauaaaaagaagaaaagguuagccaagaaagaaaaggacaugcggaaaugcgauaguagccagaccugucugcuccaagagcaccuugacucugugcagaaggaguucauuaucuuuaaucgugaaaaggucaaccgcgauuucaauaaaagacagccaaaccuggcguuggagcagacaaaggacccccaaggugaagauggccagaauaacaaucuauga

SEQ ID NO: 63335 - RNA, 1245 nt, Artificial Sequence
  derived and/or modified sequence opt3 from STK32B__Homo_sapiens__NP_060871
augggcgggaaccacagccauaagcccccuguguucgacgagaaugaagaggucaacuuugaucacuuccagauccugagagccauuggaaaagguuccuuuggcaagguuugcauagugcaaaagagggacaccaagaaaauguacgcuaugaaguauaugaauaagcagaaauguaucgaacgggaugagguacgcaacguguuccgagaacuccagauuaugcaggggcuugagcauccauuucuggucaauuugugguacucuuuccaagacgaggaagauauguuuauggugguugacuuacugcuaggaggcgaucuccguuaucaucugcagcagaacgugcacuucacagaggguacugucaaacuuuacaucugcgaacuggcauuggcccucgaguaucugcagagauaccacauuauccacagggacauaaaaccggauaauauccugcucgacgagcaugggcacgugcauauuacggauuuuaacaucgcgaccguaguuaagggagcugaacgggccucaaguauggcaggcacaaaacccuauauggccccugagguguuccaagucuacauggaccgcggcccaggguacagcuaucccguggauuggugguccuuaggaauuacugcuuacgaacugcuuagagguuggaggccuuaugagauccacucugugaccccaauagacgaaauuuugaauauguuuaaggucgagcggguucacuacucgucaacaugguguaagggcaugguggcacugcuacgcaaacuccugaccaaggaccccgagagccgaguaaguucccuucaugauauccagucugugccuuaucuggccgacaugaacugggaugcugucuucaaaaaggccuugaugccaggguuugugccgaauaaaggaagacucaacugcgaccccacuuucgaacuggaggaaaugauuuuagagagcaagccucugcacaaaaagaagaaaaggcucgcgaagaaucggucccgugauggcacaaaagacucauguccacuuaacggucaucugcagcacugcuuggaaaccguucgcgaggaguucaucaucuuuaauagagaaaagcuaaggcggcagcaagggcagggaagucagcugcucgauacggacagccgaggcggcgggcaagcacagucuaaacugcaggauggauguaacaacaaucuucugacucauaccugcacacgcgguuguuccucauga

SEQ ID NO: 63336 - RNA, 1461 nt, Artificial Sequence
  derived and/or modified sequence opt3 from STK32C__Homo_sapiens__NP_775846
augagaagcggcgccgagaggcggggguccucugcugcagccucacccggaaguccuccaccgggucgcgcgcgacccgcuggcagcgacgccccuuccgcacugccacccccugccgcugggcagccacgugcaagagauucuggagacgugaggucgcaaccccggccucucuuccaguggucaaaguggaaaaagcgcaugggcagcaguauguccgccgcuaccgccagaaggccagucuuugaugacaaagaagauguuaacuucgaccacuuucagauccuucgggcgauugguaaggggucuuucggaaaagugugcauaguacagaagcgcgauacagagaagauguacgcaaugaaauauaugaauaagcaacaguguaucgaacgagacgaggugagaaacgucuuuagggaacuggagauuuugcaggagaucgaacauguguucuuaguuaaucugugguacagcuuucaggaugaggaagacauguucaugguggucgaucuacuccugggcggcgaccuucgguaucaucugcaacagaacgugcaguuuuccgaggauacuguacguuuguacauuugcgagauggcccucgcucuggacuaucugcgcgggcagcacaucauacacagagacguuaaaccggauaauauccucuuagacgaaaggggacaugcccaccugacggauuucaacauugcaaccaucauuaaggacggugagcgggcuacagcccuugcgggcacuaaacccuacauggccccugaaaucuuucacucauucgugaaugggggaaccggcuauaguuuugaggucgauugguggagcgugggugugauggcauacgaauugcugcgaggguggcgcccauacgacauacauucuuccaacgcugucgagucacuuguucaacucuucagcacagugaguguacaguaugugcccaccuggucuaaggagauggucgcccugcuuagaaagcuguugacugugaauccugaacacaggcucuccagccugcaggauguucaagcugccccagcauuagccggagugcugugggaccaucucucggagaaacgggucgaacccggcuucgugccgaacaagggccgccuucacugugauccuacauuugagcuggaagagaugauuuuggagucuagaccccuacacaaaaagaaaaagaggcuggcuaaaaauaagucccgugacaacucacgggauaguagccaguccgaaaaugacuaccuccaggacugccuggaugcgauccagcaagacuucguaauuuuuaaccgagagaagcuaaaaagaucucaggaucugccaagggaaccuuugcccgcaccagagagccgcgacgccgcugaacccguugaggaugaggccgaacggucagcacucccuaugugugggccaaucugcccgagugccggauccgguuga

SEQ ID NO: 63337 - RNA, 1545 nt, Artificial Sequence
  derived and/or modified sequence opt3 from STK33__Homo_sapiens__NP_001275990
auggccgacagcggccuggauaagaaguccaccaagugccccgacuguucuucagcuagucagaaagaugugcucugcgucuguagcuccaagacaagaguuccuccagugcuuguaguggagaugucucaaacuucgucaaucgggagcgcagaaagucugauuuccuuggagaggaaaaaggaaaagaacauaaaucgggacaucacgucucgcaaagauuuaccgagccgaaccuccaacgucgagcguaaggccucacagcagcaguggggaagagguaauuucacagaaggcaaagugccccacauuaggaucgagaacggggcggcuauugaggaaaucuacacuuuuggacggauacugggcaaggguaguuucgggaucguuauugaggccaccgacaaagaaacagagaccaagugggcaaucaagaaagugaauaaggagaaagccggaagcucugcugucaagcuacucgaacgcgaggugaacauucugaaauccguaaagcaugaacacaucauacaucuugagcaaguuuuugaaacuccuaaaaagauguaucuggugauggaguugugcgaggauggcgaacucaaggagauucuggacagaaaaggccacuucucagaaaaugagacaagguggaucauucagagccuggcaagugccaucgcuuaccuccauaacaaugauaucguccaccgggacuuaaagcuggaaaacauuauggugaaaucuucccuuauagaugacaauaacgagaucaauuugaacauuaaggugaccgauuuugggcuggccgucaaaaagcagagccgcucggaggcgaugcuacaggcaacguguggaacuccaaucuauauggcccccgaaguuauaucugcucacgacuacucccaacagugcgacauuuggucaaucggugugguaauguauaugcuccugcgaggcgagccuccauuccuugccaguagcgaagagaagcuguuugaauugaucagaaaaggggagcuccauuucgagaaugcaguguggaacuccauuucugauugugcuaagagcguccugaaacaguuaaugaagguggaccccgcccacaggaucaccgcgaaagaacugcucgauaaccaguggcuuacaggaaauaagcugucaaguguucggccuacuaacguguuggagaugaugaaggaauggaaaaauaacccagaguccgucgaggaaaauaccacagaggaaaagaacaaaccgagcaccgaggaaaagcuaaaaucuuaccaacccuggggcaaugugccugacgccaacuauacgucagaugaggaggaagagaagcagaguacugcauacgaaaagcaguuuccagcuacaagcaaagacaauuucgauaugugcuccucuucguuuaccagcuccaagcugcuccccgccgagauuaaaggugaaauggagaagacuccuguaacaccaucacaagggaccgcuacgaaauaccccgccaagaguggagcacugucucguaccaaaaagaaacuuuga

SEQ ID NO: 63338 - RNA, 1605 nt, Artificial Sequence
  derived and/or modified sequence opt3 from STK35__Homo_sapiens__NP_543026
augggccaccaggagagcccccuggccagagcuccugcagggggagccgcguacgugaagaggcucugcaaaggucuuuccuggcgggaacaugucgagucucacggcucacugggggcucaagccaguccagcaagcgccgcugcagccgaaggauccgcuacccgccgagcccgugcggcaacaucuagagccgcuaggucgcggcgccagccgggccccggugccgaccauccucaggcaggggcuccaggaggcaagagagccgcgaggaaauggcggugugccggccagguuacuauccaagggcccgcaccuccacgcccccgagcuggaagaagggaugaggccgguggcgcucgggccgcaccuuuguuacugccaccgcccccugccgcuauggaaacggggaaggacggagcgcgucgcggcacccagucaccagagagaaaaaggcggagccccgugccucgagcaccaaguacaaagcuacgccccgccgcugccgcaagagccauggauccgguagcugccgaggcaccuggugaagcguuccucgcuaggcggcgccccgaagggggaggcggcuccgccagaccaagguauucucugcuugcagagauugggcguggaagcuacgguguggucuaugaggccguggcuggccgguccggggcccgaguugcagugaagaaaauaagaugcgacgcuccugagaacgucgaacuggccuuggcggaguuuugggcccucacuucacugaagaggcgccaccagaaugugguacaguucgaagaguguguucugcaacggaacggacucgcucagagaaugagucauggcaauaaaagcucucaguuauaccugaggcuuguggaaaccuccuugaagggugagcgcauccugggguaugcagaggaacccugcuaccuaugguuugucauggaguucugugaaggcggagaucucaaccaguaugugcugucacgacggccagaccccgccacaaauaagagcuuuaugcuucaacugaccagugcuauugccuucuugcacaaaaaccacaucgugcaucgugaucucaagccugacaauauucugaucacugagagaucuggcacaccaauauuaaaagucgcagauuuugggcuguccaagguuugcgcgggacucgccccgagggguaaagaaggcaaccaggacaauaagaacgugaauguaaacaaauacuggcuuagcucggcuugugggucugauuucuacauggcccccgaggugugggagggacacuauaccgcaaaggcugacaucuuugcccugggcauuaucauuugggcaaugaucgaacgcauaacguucauugauuccgagacuaaaaaggaauugcuagguaccuacaucaagcaggggacagagauugucccugugggcgaagcccugcucgagaauccaaaaauggagcugcauaucccccaaaagcggagaacuucaaugagugaaggaaucaaacagcuucugaaggacauguuggcugcgaacccucaggacaggccagaugccuuugagcucgaaacccgaauggaccagguuacaugcgcagcuuga

SEQ ID NO: 63339 - RNA, 1395 nt, Artificial Sequence
  derived and/or modified sequence opt3 from STK38L__Homo_sapiens__NP_055815
auggccaugaccgcuggcacaacuacgaccuuccccaugagcaaccacacaagagagagggugacugucgcaaagcugacccucgaaaauuuuuacuccaaccuuauccugcagcaugaggaacgggagacacgccagaaaaaguuggaaguugccauggaggaggaaggguuagcggacgaggagaaaaagcugcgacguucucaacacgcuagaaaagaaaccgaguuccuaaggcucaagcggacucgccugggacuugaugacuuugaaucacugaaggugauugguagaggcgccuucggggagguaagguuggugcagaaaaaggauacaggacauauauaugcaaugaaaauccuccggaagagugacaugcuggaaaaagagcaggucgcccacauucgcgcugaacgagauauccugguggaggcagacggcgccuggguugugaagauguuuuacagcuuccaagauaagagaaaucucuauuuaauuauggaguuucugccugguggggacaugaugacccuuuugaugaaaaaggauacgcugacugaagaggaaacccaguucuacaucuccgagacaguccuagcuauagacgccauccaucagcucggauuuauucacagggauaucaaaccagacaaccugcuucuggaugcgaagggccacgugaaauugucugacuucggccucugcacugggcugaagaaagcacaucggaccgaauuuuaucguaauuuaacacacaacccgcccucggacuucucauuucagaauaugaacagcaagcgcaaggccgagaccuggaaaaagaauagaaggcaacuggcuuacaguacgguaggaacuccugauuauauugccccagagguuuucaugcagacagguuacaacaaacucugugacugguggucccuuggcgugaucauguacgaaaugcugauaggguaucccccuuucugcucugagaccccacaggaaacuuaccggaaggucaugaauuggaaagagacauugguguuucccccugaagugccaauuagcgagaaggcaaaggaucuaauccugcgauucuguauugacuccgagaaccgcaucggaaauucaggcgucgaagagaucaaaggucauccguuuuucgaagggguugauugggagcacauuagagagaggcccgcugccauaccuaucgaaauuaagaguaucgacgauaccagcaacuuugacgauuucccagagucugacauacuccagcccgugccuaauacgaccgaaccagauuauaaauccaaggacuggguauuucugaacuacacauauaaacgguucgagggacuuacucaacgcggcucaauucccaccuacaugaaggcgggcaagcuguga

SEQ ID NO: 63340 - RNA, 1638 nt, Artificial Sequence
  derived and/or modified sequence opt3 from STK39__Homo_sapiens__NP_037365
auggccgagcccagcggcuccccugugcacguccagcugccacaacaggcugcaccgguuaccgccgcggcugccgcagcccccgcugcagccacagcugccccugcgccagcagcccccgcugccccugcaccagcucccgccccugcggcccaggcagugggguggccaaucugcagagacgcuuacgaacuccaggagguaauuggaucuggugccacugcugugguccaagccgcacuuuguaagccgaggcaggaacggguggccauaaaacgcaucaaccuggagaagugccagacgucaauggaugaauuguuaaaagagauucaggcuaugagucaauguagccaucccaauguugugaccuauuacacauccuucgucgugaaggacgagcuguggcuaguaaugaaacuccugucuggcgggucgaugcuugauaucauuaaguauaucguuaaccgaggagaacacaagaauggcgugcuggaggaagcgauaaucgcaacuauuuugaaagagguccucgagggucuggacuaccugcaucguaacgggcagauccacagagaucucaaggccggaaauauuuuacugggcgaagacggcucagugcagaucgcugauuuuggggugagcgccuuccuugcaaccggaggugacgucacaaggaacaaaguucggaagaccuuugugggcacuccuugcuggauggccccagagguaauggaacaggugcgcggguaugauuucaaagcugacauguggaguuuuggaauaacagccauugaguuggcaaccggcgcggcucccuaccauaaguauccuccaaugaagguccugaugcuaacgcuccaaaaugaucccccgacucuggaaaccgguguggaggacaaagagaugaugaagaaauacgggaaguccuucagaaaacuucugucuuugugucuccagaaggauccuagcaaaaggcccacagccgcagaacuguuaaagugcaaguuuuuccagaaagccaagaaccgggaguaccugaucgaaaaacuccuuacucgcaccccagacauugcucaacgagccaagaaaguuagaagggugccuggauccucaggccaucugcacaagacagaggacggcgauugggaauggagugacgaugagauggacgagaagucugaagaggggaaagcagcuuuuucucaggaaaagucccggcgugucaaagaggaaaaucccgagaucgccgugucagcgagcaccaucccagagcagauucagaguuugucuguacacgauucccaaggacccccuaacgccaaugaagacuaucgcgaggcuagcucgugugcaguuaaccuagugcugagacucaggaauagccggaaggaacugaacgauauacgauucgaguuuacgccaggucgcgacacugccgauggcgucucccaggagcuuuucucagcugggcugguggacggacacgaugucgugaucguugccgcaaauuugcagaaaauuguggacgacccgaaggcgcucaagacacugaccuuuaaauuagccaguggcugcgaugguagcgaaauccccgacgagguaaagcugauaggguucgcucagcuauccgucucuuga

SEQ ID NO: 63341 - RNA, 1476 nt, Artificial Sequence
  derived and/or modified sequence opt3 from STK3__Homo_sapiens__NP_006272
auggagcagcccccugccccaaagagcaaacugaagaaacucuccgaagacucucuuaccaagcaaccggaggaaguguucgauguccuggagaaauugggcgaagggucauacggaaguguuuuuaaggcuauccacaaggagagcggucaggugguagcaauuaaacaggugcccgucgaguccgacuuacaggaaauaaucaaggagauuucuaucaugcaacagugcgauucgccuuaugugguuaaauacuauggcucauacuucaagaacacagaccuguggauugugauggaauauuguggggccggaagcgucagugauaucauaagacuaaggaauaaaacucucaucgaggacgagauugcgacgauccugaaguccacccuuaagggccuggaauacuugcauuuuaugcggaaaauucaccgcgauaucaaggcugguaacauacuccugaauacagaggggcaugccaaacuggcagacuucggaguggccggccagcucacugauaccauggcuaagcgaaacacaguaauuggcaccccauuuuggauggcacccgaaguuauccaggagauuggguauaauugcguggccgacaucuggucuuuaggaaucacuagcauugaaauggcugaggguaaaccuccauacgccgauauacaccccaugcgugcgaucuucaugauuccuacaaacccaccgcccaccuuuagaaagccugagcugugguccgacgauuucacggacuuugucaaaaagugucuugugaagaauccagaacaaagggcaacugccacccaguugcugcagcaucccuucaucaaaaacgcuaagccugugucaauacuacgggaccucauuacagaggccauggaaaucaaagcaaagcgccacgaggaacagcaaagagagcuggaggaagaggaagagaauagugaugaagacgagcuugauagccacacuauggucaaaaccucuguugaguccgugggcacaaugagggcuaccucaacgaugagcgaaggggcccagacuaugaucgagcauaacaguacaaugcuggaaucugacuugggaaccaugguaauuaauuccgaggaugaggaagaggaagacggcacuaugaagcggaacgcgacaagcccacaggugcaacgccccucguuuauggauuacuucgacaagcaggauuuuaaaaauaagucucacgagaacugcaaucagaacaugcaugaaccguucccuauguccaaaaacgucuuccccgacaauuggaaggugccacaggauggugacuuugacuuccucaaaaaccugucauuagaggagcugcaaaugcgacucaaggcccuugauccuaugauggaaagagagaucgaggaacugaggcagcgguauaccgcaaagcgucagcccauuuuggacgcuauggaugccaaaaagcgcagacagcaaaauuuuuga

SEQ ID NO: 63342 - RNA, 1464 nt, Artificial Sequence
  derived and/or modified sequence opt3 from STK4__Homo_sapiens__NP_006273
auggagaccgugcagcugagaaaucccccuaggcggcaacucaagaaacuugacgaagauagccugacaaagcagccagaggaagucuucgacguuuuggagaaauuaggcgaaggguccuacggaucuguguauaaggccauccacaaagagacuggucagauuguagcuauaaaacaggugccggucgagucagaucugcaagaaaucauuaaggagaucaguauuaugcagcagugcgacagcccccaugugguuaaguacuauggcuccuacuuuaagaacacggaucuauggaucgugauggaauauuguggggcaggaucugucucggacauaauccgccuccgaaacaaaacccugacagaggaugagauugccacuauccuucagucaacccugaagggcuuggaauaccuccacuucaugcguaaaauucauagagacaucaaggcggguaauauacugcugaacacagaggggcacgcuaagcucgccgauuuuggaguggcaggccaauuaaccgacacuauggccaaaaggaauacaguaauuggcaccccuuucuggauggcuccagaaguuauccaggagauuggguauaacugcguggcagauaucuggagccugggaaucacggccauugaaauggcugaggguaagcccccuuacgccgacauacauccaaugcgggcgaucuuuaugauucccacuaauccuccaccgaccuuccgcaaacccgagcuuuggagugauaacuuuacagacuucgucaagcaguguuuggugaaauccccugaacagagagcaacugccacccaacugcuacagcacccauuugugaggucugcuaagggcgucagcauccuccgggaccugauaaaugaggccauggauguuaaacuuaagcgccaggaaucccaacagcgagagguggaccaggaugacgaagagaacucagaggaagaugagauggacagugggacaaugguaagagcagugggagaugaaaugggcaccgucaggguggcuagcacgaugacugacggugccaauacaaugauugagcacgaugacacccugcccucucaguuggggacuaugguuaucaacgcggaagaugaggaggaagagggaacaaugaagcggcgugacgaaaccaugcaaccugccaaaccauccuuccucgaguacuuugagcagaaggaaaaagagaaucagaucaacucauucggcaagagcgugcccggcccgcugaaaaauaguucugacuggaagauuccucaggauggggacuaugaauuuuuaaaguccuggacggucgaggaucugcaaaaacgccuccuugcacuggaccccaugauggaacaggagaucgaggaaauuagacagaaguaccagagcaaaaggcaaccaauauuggaugcuaucgaggccaagaaacggcgacagcagaacuucuga

SEQ ID NO: 63343 - RNA, 564 nt, Artificial Sequence
  derived and/or modified sequence opt3 from STMN2__Homo_sapiens__NP_001186143
auggccaagaccgcuauggcauacaaagagaagaugaaagaacugagcaugcucucccuuaucugcucuuguuucuaucccgagccuagaaacauuaauauauacacauaugacgauauggaagugaagcagaucaacaaaagggccucaggccaagcguuugagcugauuuugaagccaccgagucccaucagcgaagcuccucggacuuuagccuccccaaagaaaaaggaccugucucuagaggagauucagaaaaagcucgaagcagccgaggaacgccgaaaaucgcaggaggcucagguccugaagcaacuugcagagaagcgugaacacgagagagaaguucugcagaaagccuuggaggaaaauaacaauuucucaaagauggcugaggagaaacucauccugaagauggaacagauaaaagagaacagggaagccaaucuggcggcaaucauugagcggcuccaggaaaaguuagugaaauuuaucagcagugagcugaaggaguccauugaaucucaauuccuugaguugcagcgcgaaggggagaagcaguga

SEQ ID NO: 63344 - RNA, 510 nt, Artificial Sequence
  derived and/or modified sequence opt3 from STMN3__Homo_sapiens__NP_001263239
augaaggagcugagcgugcucucccuuaucugcucuuguuucuacacccagccccacccuaacacagucuaucaauacggcgacauggaaguuaaacagcuggauaagagagccucagggcagaguuuugaggugauuuugaaaagcccauccgacuuaucuccggaaucgcccaugcugucaagcccuccaaagaaaaaggauacgagucuagaggaacuccagaagaggcuggaggcugcagaggaacggcgcaaaacucaagaggcccagguacuuaagcagcuggcggaacgacgugagcaugagagagaaguguugcacaaagcucucgaggaaaauaacaauuucuccaggcaggccgaggaaaagcugaacuauaaaauggagcugucuaaggagauacgggaagcacaucucgccgcuuuacgcgagagacugagggaaaaggagcuucacgcagccgaaguccggcgcaauaaagagcaacgagaggaaaugagcggauga

SEQ ID NO: 63345 - RNA, 570 nt, Artificial Sequence
  derived and/or modified sequence opt3 from STMN4__Homo_sapiens__NP_001269983
augacccuggccgcuuacaaggagaaaaugaaggaacucccccuugugagccuguucugcuccugcuuuuuggcagacccuuuaaacaaaucuucauauaaguacgaggccgauacagucgaccugaauugguguguuaucagugauauggaagugauugagcuaaacaaauguacuagcggccaguccuucgaaguaauacucaagccaccgucuuuugacggggugcccgaguucaaugcgucgcugccuagaaggcgggauccaucacuugaggaaauccaaaagaaacuggaggcugccgaggaacgccgaaaguaucaggaggcagaauugcucaaacaccuggccgagaagcgugaacaugagagagaagucauucagaaagcuaucgaggagaacaauaacuuuauuaagauggcaaaggaaaaacuggcccagaagauggagagcaauaaagaaaacagggaggcucaccucgccgcgauguuagaacggcugcaagagaaggacaaacaugcagaggaagugcgcaagaauaaagagcuuaaggaagaggccaguagauga

SEQ ID NO: 63346 - RNA, 867 nt, Artificial Sequence
  derived and/or modified sequence opt3 from STOM__Homo_sapiens__NP_004090
auggccgagaagagacacaccagggacagcgaagcucagcggcugcccgauuccuucaaagacucuccuucaaagggccucgggccaugcggauggauccuuguggcauuuaguuuccuguuuacagucauuacuuucccgauaagcaucuggauguguauuaaaaucauuaaggaguacgaacgcgccaucauauuucgauugggucguaucuuacaaggcggggcgaaaggacccggccuguucuuuauucuaccuugcacggauuccuucaucaagguugacaugagaaccauuucuuuugauaucccaccccaggagauacucacaaaggacucggugacuauuucaguagaugguguggucuauuacagggugcagaacgcuacccuggccguugcaaauaucacaaacgccgacagcgcuacccggcuucuggcacagacuacauugcgcaaugugcucgggaccaaaaaccugagucaaauucuguccgauagagaagagaucgcccauaauaugcagucuacgcucgacgaugcuacugacgccuggggaaucaaggucgagaggguggaaauuaaagauguaaaguuaccuguucagcugcagcgggcgauggcagccgaggcugaagccagccgcgaggcacgagcuaaagugauagccgcggagggcgaaaugaacgccuccagagcacuuaaggaggcuucaauggucaucaccgaaaguccagccgcuuugcaacugagguaucuacagacacucacuaccauugccgcagagaagaauagcacaaucguguucccccugccuauagacaugcuucagggcauuaucggggccaaacacucucaucugggauga

SEQ ID NO: 63347 - RNA, 1047 nt, Artificial Sequence
  derived and/or modified sequence opt3 from STOML1__Homo_sapiens__NP_001243602
augcugggcagaagcggguacagggcccucccccuuggagacuucgaucgguuucagcaauccucuuucgguuuucugggcucacagaaggggugcuugaguccugagcgcggaggcguggguaccggggcugacgucccacagagcuggccguccuguuuaugccacggacugaucucuuuccuaggcuuucuccugcuucugguuacauuccccauuucgggcugguuugcauugaaacucgccucaaaggauggggcggugcugagcguaggagcugacgugcaguuccgaauaugggauccuguccugagugugaugacuguuaaagaccucaacacggccacccguaugacagcacaaaaugccaugacuaaggcuuuacugaaaagaccacuuagggaaauccagauggagaaguugaagauuuccgaucagcugcuacucgaaaucaacgacgugacccgggcauggggucuggaggucgaucgcguggaacuugccguagaggcuguucugcagcccccucaagacucuccagccggccccaauuuggauagcacacuccagcagcuggcguuacauuuucugggaggauccaugaacucaauggcaggcggugccccuaguccagggccggcugacaccguggagauggucagcgaaguggagcccccugccccacaggugggagcaagaucuucccccaaacaaccucucgcugaaggccuucugacugccuugcagccauuccuaucagaggcgcuggucagccagguuggcgccuguuaucaauuuaaugugguacuccccagugggacacagucugcauacuuccuggaucuuaccacgggaaggggucgggugggccacggggucccggacgggauuccugacgugguuguggagauggcugaagccgaucugcgcgcuuugcucugccgagagcugagacccuuaggcgccuauauguccgguaggcugaaggucaaaggggaccuagcaauggccaugaagcucgaagcugugcugcgggcgcuuaaauga

SEQ ID NO: 63348 - RNA, 936 nt, Artificial Sequence
  derived and/or modified sequence opt3 from STOML2__Homo_sapiens__NP_001273960
augcuggccagagcugcaaggggcaccggggcccuccuucugcggggaagccuuuuagcguccggucgcgcuccccgacgugccucuucaggccugccuagaaacacagugguccuauucguuccacagcaagaggcaugggugguagaaaggauggggcgguuucaccgcauccucgagccgggacugaauauucuuauacccgugcuggacagaaucagguacguccagaguuugaaggaaauugugaucaacguuccugagcagagcgccgugacucucgauaaugucacgcugcagauugacggcgugcuguaucuccggaucauggauccauacaaggcuuccuaugguguagaagaccccgaguacgcaguuacccaauuagcccagacaacuaugcgcucugagcuggggaaacuuucguuggauaaaguguuccgagucgaagcugagagaaggaagcgggccaccgugcuggaaucagagggaacacgugagagcgcgauaaacguggcagaaggcaaaaagcaggcccagauccuagcuagugaggccgaaaaggcagagcaaauuaaucaggcugccggcgaagcguccgccguccucgcaaaagcuaaggccaaagcugaggccauccgcauucuggcagccgcucuuacccagcauaacggggacgcggcagccucucugacuguugcugagcaguaugugagcgccuuuuccaaguuggcaaaagauucaaauacaauccuccugccuaguaacccaggagacguaaccagcaugguggcccaagcuaugggugucuacggcgccuuaacgaaggcacccgugccugggacuccagauucucuguccucaggaagcaguagagacguucagggcaccgaugcgucucucgacgaagaguuggauagggugaagauguccuga

SEQ ID NO: 63349 - RNA, 849 nt, Artificial Sequence
  derived and/or modified sequence opt3 from STOML3__Homo_sapiens__NP_001137505
augaacagcagaggcgagcuggugggggucaauaacaagaggcucggaguuugcgguuggauccuuuucucccugucauuuuuguuagugauuauaaccuuccccaucucuauuuggaugugucugaaaaucauuaaggaauacgagcgggccguaguguuucgccuaggccgaauccaggcugacaaagcaaaggggccuggacucauacugguccuuccaugcaucgauguguucguuaaaguggaccugcguacagucacuuguaauauuccgccccaagaaaucuugacgagagauagugugaccacacagguagacggcguuguguauuacaggauuuauagcgccgucuccgcgguggcuaacgugaaugauguccaccaggccacuuuucuccuggcacagaccacacugcggaacguucucgguacccaaacuuuaucucagauccuggccgggcgcgaggaaauagcucauucgauucagacacuuuuggacgaugcaaccgagcuguggggaaucagaguggccaggguagagauuaaggacgugcggaucccuguccagcuacaacgcucaauggcugccgaagcggaggcaacgcgagaagccagagcuaaggugcucgccgcagagggcgagaugaaugcuagcaaaagucugaaguccgccucuaugguucuugcggaaagcccaaucgcccugcaguugagguaccuccagacucuguccaccguggcaacagagaaaaacucaacuauugucuuccccuuaccuaugaauauacuggaaggcaucgggggagugaguuaugauaaccacaagaaacucccaaauaaggcuuga

SEQ ID NO: 63350 - RNA, 3477 nt, Artificial Sequence
  derived and/or modified sequence opt3 from STON1-GTF2A1L__Homo_sapiens__NP_001185522
augugcagcaccaaccccggcaagugggugacauucgacgaugacccugccguccaguccucucaaaaaucaaagaauuuuccacuggagaaccaggggguuuguagaccgaauggacucaaacuuaaccugcccgguuugagggaauuuccuaguggcagcuccucuacuucgucaacgccauuaagcagucccaucguggauuuuuacuucuccccugggccacccucuaauagcccucuguccaccccaacaaaggacuuuccgggauuccccggcauuccuaaagcugguacucacguacuauauccaauacccgagucaaguagcgauucuccucucgcaaucuccgggggagaaucaagccugcuuccaacccggcccacaugccugagucaugccuugcucccgucugaccacuccuguacccauccuacucccaaggugggccugccagaugaggucaacccucagcaggcggaaagccugggcuuucaaucggacgaucucccccaguuccaguacuuucgcgaggacugcgcuuucucuuccccauuuuggaaggaugaggggucagacagucacuucacauuagaucccccuggaagcaaaaagauguuuuccucucgaaauaaagaaaugccaauugaccaaaagagccugaacaaauguucacuuaauuauaucugcgagaaguuggaacaucugcagagugccgagaaccaggacucccuacguagccucucuaugcacugucugugcgcagaggaaaaugccucaaguuucgugccgcacacccuuuucagaagccagcccaaguccgguuggucuuuuaugcugaggauuccugagaaaaagaacaugaugucgagccggcaguggggcccaaucuucuugaaaguucuccccgggggaauacugcaaauguacuaugaacagggcuuagagaagccuuuuaaagaaauccagcuggauccauacugucgccucuccgagcccaagguggagaauuucucagucgcugguaaaauucauacggugaagaucgaacacguaaguuauacugagaagagaaaauaccauucuaagaccgaaguugugcacgagccggacauugaacaaaugcuuaaacuggggagcacauccuaccacgauuucuuggacuuccuaacuaccgucgaggaggaacugaugaagcucccugcagugucaaaaccaaagaagaacuaugaggaacaggagaucagccuggaaauaguggauaauuuuuggggaaaagucacaaaggagggcaaauucguugagucugccgugauuacccagaucuacugccuuuguuuuguaaacggcaaccuggaaugcuucuugacgcucaaugaccuggaguuacccaagagggaugaauccuauuacgagaaagacagugagaagaaggggauugauauccuggacuaucauuuucacaaaugcgugaacguccaggaguucgagcaaagccggaucauuaaguuugugccucuagaugcuugucgcuucgaacucaugcgauucaaaacucuguacaauggagacaaccuucccuuuucuuugaaguccguuguggucgugcagggugccuauguagagcugcaggcguucguuaauauggcaucacucgcccagagaaguagcuacgcuggcucgcugagguccugcgacaacauacggauccauuuuccagugccuucucaauggauuaaagcccuuuggacaaugaaucugcagcgucaaaagagcuugaaggcaaaaaugaaccgcagagcuugucucgggucacugcaggaauuagagagugagcccgucauccaggugaccgucggauccgccaaguacgaaucugcguaucaggccgugguuuggaaaauagauaggcugccagacaagaauagcucccuagaucacccgcauugccucucauacaaacuggagcuuggcagcgaccaggaaauuccuagugauugguaucccuucgcaacugugcaguuuucuguaccagacacaugugcuucccggaccgagguccgcagcuuggguguggaaucggauguucaaccccagaagcacgugcagcaacgagccugcuacaacauccagccuaaacuguauagaucagucaucgaggacgugauugaggggguaaggaaucucuucgcugaagagggcaucgaagaacaggugcugaaggauuuaaagcagcugugggaaacgaaaguucuucaaucuaaggccaccgaggacuuuuuccggaacaguauucaguccccauuguuuacacuccagcugccccacagccuacaucagacucugcaaucuagcaccgcaucccucgucauaccugccggacgcacacugccgucauucacuaccgcugagcuuggcacaaguaauagcucugcgaacuuuaccuucccaggguaccccauccacgugccugcaggagugacuuugcagacggucuccggucaucuguauaaaguuaaugugccaauuauggugacagaaaccucaggcagagccgggaucuuacagcaccccauccagcaaguauuucagcagcucggacaaccuagugucauucagacuagcgugccgcagcugaaccccuggucccuucaggcuaccacagagaagucucaaaggauagaaaccguucugcagcagccagccaucuugccuucgggccccguggaucguaaacaccucgagaacgcaacuagcgacauucuggucucaccagguaaugagcauaagaucgugccugaagcccuacugugucaccaggaguccagucauuacauuucucuccccgggguuguguucagcccacaaguaucccagacaaacucaaaugucgaaucugugcugagcggcagugcuuccauggcccagaaccuucacgaugagagcuugucuacgucaccgcauggagcacugcaccagcacgugaccgacauccaauuacauauacucaagaaucggauguacggcugcgacuccgucaaacagccucgaaacaucgaggaacccaguaauauuccaguuagcgagaaggauucgaacucucagguggaccuguccaucagaguaacugaugacgauauuggggaaaucauacagguggacggaagcggugauacaucaaguaaugaggaaauuggcucuaccagggacgcggaugagaacgaguuccuugggaauaucgacggaggcgaucugaaaguccccgaagaggaagcugacuccauuagcaacgaggauucagccacaaauaguagcgacaacgaagacccucaagugaauaucguugaggaagauccacuaaacuccggugacgaugugucugagcaggacguccccgaucucuuugacacugauaacgugauaguuugucaguaugacaagcaaggggauacccgcgugcggcacggccagcaguga

SEQ ID NO: 63351 - RNA, 2208 nt, Artificial Sequence
  derived and/or modified sequence opt3 from STON1__Homo_sapiens__NP_001185524
augugcagcaccaaccccggcaagugggugacauucgacgaugacccugccguccaguccucucaaaaaucaaagaauuuuccacuggagaaccaggggguuuguagaccgaauggacucaaacuuaaccugcccgguuugagggaauuuccuaguggcagcuccucuacuucgucaacgccauuaagcagucccaucguggauuuuuacuucuccccugggccacccucuaauagcccucuguccaccccaacaaaggacuuuccgggauuccccggcauuccuaaagcugguacucacguacuauauccaauacccgagucaaguagcgauucuccucucgcaaucuccgggggagaaucaagccugcuuccaacccggcccacaugccugagucaugccuugcucccgucugaccacuccuguacccauccuacucccaaggugggccugccagaugaggucaacccucagcaggcggaaagccugggcuuucaaucggacgaucucccccaguuccaguacuuucgcgaggacugcgcuuucucuuccccauuuuggaaggaugaggggucagacagucacuucacauuagaucccccuggaagcaaaaagauguuuuccucucgaaauaaagaaaugccaauugaccaaaagagccugaacaaauguucacuuaauuauaucugcgagaaguuggaacaucugcagagugccgagaaccaggacucccuacguagccucucuaugcacugucugugcgcagaggaaaaugccucaaguuucgugccgcacacccuuuucagaagccagcccaaguccgguuggucuuuuaugcugaggauuccugagaaaaagaacaugaugucgagccggcaguggggcccaaucuucuugaaaguucuccccgggggaauacugcaaauguacuaugaacagggcuuagagaagccuuuuaaagaaauccagcuggauccauacugucgccucuccgagcccaagguggagaauuucucagucgcugguaaaauucauacggugaagaucgaacacguaaguuauacugagaagagaaaauaccauucuaagaccgaaguugugcacgagccggacauugaacaaaugcuuaaacuggggagcacauccuaccacgauuucuuggacuuccuaacuaccgucgaggaggaacugaugaagcucccugcagugucaaaaccaaagaagaacuaugaggaacaggagaucagccuggaaauaguggauaauuuuuggggaaaagucacaaaggagggcaaauucguugagucugccgugauuacccagaucuacugccuuuguuuuguaaacggcaaccuggaaugcuucuugacgcucaaugaccuggaguuacccaagagggaugaauccuauuacgagaaagacagugagaagaaggggauugauauccuggacuaucauuuucacaaaugcgugaacguccaggaguucgaacaaagccggaucauuaaguuugugccucuagaugcuugucgcuucgaacucaugcgauucaaaacucuguacaauggagacaaccuucccuuuucuuugaaguccguuguggucgugcagggugccuauguagagcugcaggcguucguuaauauggcaucacucgcccagagaaguagcuacgcuggcucgcugagguccugcgacaacauacggauccauuuuccagugccuucucaauggauuaaagcccuuuggacaaugaaucugcagcgucaaaagagcuugaaggcaaaaaugaaccgcagagcuugucucgggucacugcaggaauuagagagugagcccgucauccaggugaccgucggauccgccaaguacgaaucugcguaucaggccgugguuuggaaaauagauaggcugccagacaagaauagcucccuagaucacccgcauugccucucauacaaacuggagcuuggcagcgaccaggaaauuccuagugauugguaucccuucgcaacugugcaguuuucuguaccagacacaugugcuucccggaccgagguccgcagcuuggguguggaaucggauguucaaccccagaagcacgugcagcaacgagccugcuacaacauccaggucgagaucgagaaaaaguggauuaagaucgacggggaagauccugacaaaauuggcgauuguauaacgcaguga

SEQ ID NO: 63352 - RNA, 684 nt, Artificial Sequence
  derived and/or modified sequence opt3 from STOX1__Homo_sapiens__NP_001123631
auggccagacccgugcagcuggcuccuggcagccucgcacuuguccugugcagguuggaggcccaaaaggcggcuggggccgcagaggaaccaggaggucgggccguuuuccgcgcuuuucgacgugcaaacgccagauguuucuggaaugcuagguuagcccgggcggcaucccgccuggccuuucagggcuggcuaagaaggggagugcuccugguacgggcuccgcccgccugccuucaggugcugcgcgacgcauggcgaagaagggcuuugcggccuccacguggguuccgcaucagagccgucggcgauguguuucccguucagaugaacccuauuacccaaucucaguucgugccacucggugaaguccuguguugcgcgauaucagacaugaauacagcccagaucgugguaacucaggagagucugcucgaaagguuaaugaaacacuaccccgggauugcaaucccuagcgaggauauucuguauacgacccuuggaacauugaucaaggagcggaaaauauaccauacuggcgaaggcuauuuuaucguuaccccacaaacauacuucauuaccaacacuacaacccaggagaauaagcgaaugcugccguccgacgaaucucgccuaaugcccgcuucgaugacguaucucgauacugagucagggaucuga

SEQ ID NO: 63353 - RNA, 246 nt, Artificial Sequence
  derived and/or modified sequence opt3 from STRA13__Homo_sapiens__NP_001257935
auggagggcgccggggcuggaagcgguuucagaaaggaacugguguccaggcuccuucaucugcacuuuaaagacgauaagaccaaagucucuggcgacgcauugcaguuaaugguugagcugcuaaagguguucguaguggaagccgcgguccgcggggugcggcaagcucaggccgaggaugcacuccgaguugacguggaucagcuggaaaaaguccuuccccagcuguugcucgacuuuuga

SEQ ID NO: 63354 - RNA, 1977 nt, Artificial Sequence
  derived and/or modified sequence opt3 from STRA6__Homo_sapiens__NP_001136091
augagcucccagcccgccggcaaccaaaccucuccuggggcuacagaggacuacucauauggaaguugguacaucgaugaaccacaggguggcgaggaacugcagccggagggggaagugcccagcugccacacuuccauuccuccaggacucuaucaugcaugucuugccucucugucgauauuggucuuacugcuacucgcgaugcugguuagaaggcggcagcuuuggcccgacugcgugcgcggccgaccuggucugccacgucccagagcuguaccugccgcaguguucauggucuugcucucaagccugugucugcucuuaccagaugaggacgcccugccguuucuuacguuggcuagugcacccucccaagaugggaagaccgaggccccuaggggagcuuggaaaauccugggccuauucuacuaugccgcgcucuacuauccacuggcagccugcgcuacagccggccacacugcagcucaucuucuggggucuaccuugagcugggcccaccucggagugcagguuuggcagcgggcggaauguccccaggugccuaagauuuacaaauacuauucccuguuagccucacugccacuccuucuggguuugggcuuucuaagucugugguaccccguccaacucgugcgcagcuucucuagaaggacaggggcaggauccaagggccugcagucaagcuauagugaggaauaccuucggaaucuguugugccgcaaaaagcucgguucuuccuaucauaccagcaagcacggguuucugucgugggcucgaguauguuuaagacacugcaucuacacuccgcagccuggauuccaucugccccuaaaacucguucugucugccacacuuaccggcacggcuauuuaucagguggccuugcugcuccuggucggcguggugccaacuauccaaaaggucagggcagggguuaccacagacguguccuaccuucuggccggauuugguauaguauugucagaggauaaacaggagguggucgaacucgugaagcaccaucugugggcuuuagagguuuguuacaucagugcgcuggugcuaagcugccuccugacuuuccuugucuugaugcggucccuggugacccaccguacaaaccuccgcgcacugcacagaggcgccgcuuuagaccugucuccucuucauaggagcccccacccaucacggcaggccaucuuuuguuggaugaguuucuccgcauaucaaaccgccuuuauuugcuuggggcuccugguacagcagauuaucuucuuucuaggaacgacugcucuggccuuccucguucugaugcccgugcuucauggccgaaauuugcuguuauuccgcagccucgaaucuucauggccuuuuuggcugacacuugcacuggcggucauauugcagaacauggcugcccacuggguguuccucgagacccaugauggucacccacaacugacuaauagaaggguccuauacgcagccacauuuuuacucuucccgcugaacgugcuuguuggggcuaugguggccaccuggcggguauugcugagugcauuauauaaugcuauucaccucggccagauggaccugagccuucugcccccucgcgccgcgacgcuagauccaggauacuauaccuacagaaacuuucucaaaaucgaagucucccagucucaucccgccaugacagcuuucugcucgcuguugcugcaggcacaaagccugcucccuaggacuauggccgcuccacaggacucccugcgucccggcgaggaggaugaagggaugcagcuucugcagaccaaggacucaauggccaagggagcacggccgggugcgagucgaggcagagccagguggggguuggcuuauacacuccugcacaauccuacucuacaaguguuucgcaaaaccgcccugcuuggagcaaacggcgcucagccauga

SEQ ID NO: 63355 - RNA, 993 nt, Artificial Sequence
  derived and/or modified sequence opt3 from STRA8__Homo_sapiens__NP_872295
augggcaagaucgacguggauaaaauucuguucuuuaaccaggagauaagacucuggcaacuuaucauggccacccccgaagagaauagcaacccucacgacagggcuacaccacagcugccggcacaguugcaggaauuagagcaucgggucgcccgccgacgucugucccaagcgagacacagggcuacucuagccgcacucuucaauaaccugcggaagacgguuuacucucagucagaucuuauugccaguaaauggcagguacugaauaaggcuaaaagccauauccccgaauuggagcagacccucgacaaccugcugaagcucaaggcauccuuuaauuuagaggaugggcacgccucuucgcuggaagaggugaaaaaggaauaugcuucaauguacagcggaaacgacaguuucccucaaaaugguuccucuccaugguaucuuaacuuuuacaaacagacaauggauuugcugacuggcagcgggauuaucacaccccaggaggccgcgcuaccuauaguguccgcagccaucucacaucucuggcagaaucugagugaggaacgcaaggcuagccuuagacaagccugggcacagaaacacaggggaccagcuacccuggccgaggcgugccgggaacccgccugugcagagggcucugucaaggacuccgguguggauucacagggggcuagcugcaguuugguuucuaccccugaagagauucucuucgaggacgccuuugauguggcuuccuuccuggacaagagcgaagucccaucgacuucuuccucaaguagcguguuagccuccuguaacccggagaaucccgaagagaaauuucaacuguauaugcagaucauuaacuucuuuaagggacucucuugcgcaaauacacagguaaaacaggaagccagcuucccuguugaugaggagaugaucaugcuucaauguaccgaaacguuugacgacgaggaucuguga

SEQ ID NO: 63356 - RNA, 1296 nt, Artificial Sequence
  derived and/or modified sequence opt3 from STRADA__Homo_sapiens__NP_001003787
augagcuuccugguguccaagcccgagagaaucaggcggugggucucugaaaaauuuauuguugagggccuccgcgaccuugaacuguucggggagcagccuccaggagauacccgacguaagacaaacgacgccucaagugaaagcauagcuuccuuuucuaaacaagaggugaugucgucauucuugccggaggguggcugcuacgaauuacugacuguaaucgggaagggauuugaggaucuaaugacggugaaucucgcaagauauaaacccaccggcgaauacgucacagugaggcggauuaaccuggaggccuguagcaaugagaugguuacuuuccuucagggugaacugcacgugaguaaguuguuuaaccauccuaauaucgucccauaucgcgcgaccuucauugcugacaacgagcucugggugguaacauccuuuauggccuacgggucugcaaaggaucugaucugcacccacuucauggacggaaugaaugaacuggccauagcuuauauccuccagggcguuuuaaaagcacuggauuacauucaucacaugggcuaugugcauagaagcgucaaggccucccacauccuuauuucaguggacgggaaaguguacuugaguggacugaggagcaaccuaucuaugaucucccacggucagcggcaacgcgucguucaugauuuucccaaguacucagugaaaguacucccuuggcugagcccagaggugcuucagcagaaucugcagggcuaugacgcuaagagugauauauacucugucgggauuacugccugugaauuggcgaacggacacgugcccuucaaggacaugccugcaacacaaaugcuccuggagaaauuaaauggcaccguuccaugccugcucgauacguccacuaucccggccgaggaacuuaccaugagccccucgcgaucuguggcuaacuccggucugucagacaguuugacaacuagcaccccuagaccauccaauggggacucucccagccauccuuaucacaggacauuuucaccacacuuccaucacuucgucgagcagugucuacagcggaaccccgaugcccguccgagugcauccacccugcucaaucauagcuuuuucaagcagauuaaacgcagagcuucugaagcccugccugagcuucugaggcccgugacgccaaucacuaacuuugaaggaucacaaagucaggaccacagcggcaucuucggcuugguaacaaaccucgaggagcuggaaguugaugacugggaguuuuga

SEQ ID NO: 63357 - RNA, 1134 nt, Artificial Sequence
  derived and/or modified sequence opt3 from STRADB__Homo_sapiens__NP_001193793
augagccugcucgacugcuucuguaccuccagaacacagguggagucucuuaggcccgaaaagcaaucagagacuucuauccaccaguaccuggucgaugaaccuacguugagcuggucccggccaucuacccgcgccucggagguuuuaugcucaacaaacgugagccauuaugaacugcagguagagauuggccgaggguuugacaaucuaaccagugugcaccucgcucgucauacuccgacaggaacccuggucacuauaaaaaucacaaaccuugagaauuguaacgaagagagacugaaggcauugcagaaagccgugauucucucccacuucuuuaggcaucccaauaucaccacguacuggacuguuuucaccguggguucuuggcugugggucauuagcccuuuuauggcguauggcuccgcuucacaacugcuccggacauacuucccagaagggaugagugagacuuuaauccgcaacauacuguuuggagccgugagaggccuuaauuauuugcaccagaacgguugcauccacaggagcauuaaggcaucucauauccugauuuccggggauggccuaguaacccucucaggacugagccaccuucauagucugguuaaacacggccagcggcaccgcgccguguacgacuucccccaguuuucuacauccguccaaccuugguugagcccagagcuccugcgacaggauuuacauggguauaaugugaagucggacaucuacucugugggaauaaccgcuugugaacuggcauccggucagguccccuuccaggauaugcacagaacgcaaaugcuccuucagaagcugaaaggcccuccauacucaccguuggacauuaguaucuuuccccagagcgaguccaggaugaagaacucucaaagcgggguugauucaggaauuggcgaaagugugcuaguauccagcgguacucauacagugaauagugaccggcugcacaccccuucaaguaaaacuuucagcccagccuuuuucucccucguccagcugugccuucagcaggaucccgagaagcguccuucugcuucgagccuguugucccauguguucuuuaaacaaccauauuucgaauuucucuga

SEQ ID NO: 63358 - RNA, 1053 nt, Artificial Sequence
  derived and/or modified sequence opt3 from STRAP__Homo_sapiens__NP_009109
auggccaugagacagacaccccugaccugcagcggccacacuaggccuguggucgaccucgcuuucuccgggaucacgccauacggauauuuucuuauuucugcauguaaggaugguaaaccgaugcugcggcaaggcgacaccggggauuggauaggaacauucuugggccauaagggugccguuuggggagcgacuuuaaacaaagacgcuaccaaggccgcaacagccgcugcagauuuuaccgccaaagugugggacgcuguaucaggggaugagcugaugacucuagcccacaagcauaucgugaagacagucgacuucacccaggauaguaauuaccuccugacgggcggccaggacaaacuucugcgcauuuaugauuugaacaagcccgaagcggagccuaaagaaaucagcgggcacacuuccggaauuaagaaagcacucuggugcucugaggacaagcagauccugucggccgaugacaagaccgugcgacugugggaccaugcuacaaugacugaaguuaaaucacucaauuuuaacaugagcgugaguuccauggaguacauaccagagggugaaaucuuagucauuaccuauggccguucuaucgccuuccacagcgcagugucccuggaucccauuaagucauuugaggcuccugccacaaucaauagugcgagccuucacccagaaaaagaguucuugguagccgggggagaggacuuuaagcuguacaaauaugauuacaacucuggcgaggaacuagaauccuacaagggucauuucgggcccauacacuguguuagauuuucaccugacggagagcucuaugcaagcggcagugaagauggcacccugaggcuuuggcaaacgguggucgggaaaacuuacggacuguggaagugcguguugccagaggaggacucuggugaacucgcuaagccgaaaauuggcuuccccgagacaaccgaagaggaacuggaggagaucgccuccgaaaauagcgauuguauuuuuccuucggcuccagacgugaaggccuga

SEQ ID NO: 63359 - RNA, 5328 nt, Artificial Sequence
  derived and/or modified sequence opt3 from STRC__Homo_sapiens__NP_714544
auggcccugagccucuggccccuucuguuguuacugcuacuccugcuucuguuguccuucgcugugacccucgcaccuacaggcccacacucucuggacccggggcugucauuucucaagaguuuacugagcacucuugaucaggcaccccagggguccuugucuagaucgagguucuuuacguuccuggcgaacaucucaagcaguuuugagccuggucggaugggcgaagggccagucggagagcccccuccacuacagcccccugcucuccgccugcacgacuuccuuguuacccugcgaggcuccccagauugggaaccgauguugggucuccugggggacauguuagcccugcucggacaggagcagacaccccgugauuuucuugugcaccaagcaggcguccugggcggguugguggaaguccuacugggagcccucgugccugguggcccacccacuccuaccagaccacccugcacaagggacgggccgucugauuguguucuggcugcagacuggcuuccuagccuguugcuccuguuagagggaacccgguggcaggcccuggugcagguccagcccuccguggauccaacuaaugcuacaggccuagacggucgcgaggccgcgccucacuuccuccaagggcugcuuggauugcugacccccacgggcgaacucggcucaaaagaggcacuguggggagggcuucugagaacuguaggugccccauuguacgcugccuuucaggaaggccuccugaggguuacccacaguuuacaggaugagguguucagcauucuggggcagcccgagccugacacaaacggacaaugccagggcgguaaucuacagcaacuccugcuuuggggaguccggcauaacuugucuugggaugugcaggcacugggcuuucucuccggaucaccaccgcccccuccagcucuguuacacugucugagcacuggcgugccccuuccucgcgccagucagccaucugcgcacauaagcccccgacagagaagggccaucaccgucgaagcauugugcgagaaucaucucgggccggcuccuccauauagcauuucgaacuucucuauccaucugcuaugucaacauacaaagcccgccaccccucagccccacccauccacgacugcuauuugccagacagccguuugguacgcagugucaugggccccuggagcucaggguuggcugcaagcgugucacgaccaguuucccgacgaguuccucgaugcaaucugcaguaaucugagcuucuccgcccuuucuggcagcaaccggcguuugguaaaacgccugugugcuggguuacucccaccgccuaccucaugccccgagggacugccacccgugccucuuacuccagacauauuuuggggcuguuuccuggaaaaugagacauugugggccgagagacucugcggugaagcaagucugcaggccguacccccuuccaaccaggcuugggugcaacauguuugccaggggccgaccccagaugugacggccucucccccuugucacaucggcccaugcggagagaggugucccgacggcggguccuuucuagucauggugugcgcaaaugauaccauguaugaaguacugguuccuuucuggccguggcucgcgggacagugucggauuucacgagguggcaacgacacaugcuuucuggaggggcuuuugggaccccuguuaccaagucucccuccccugggcccaagcccucuuugucugacucccgguccauuccuacucgggaugcugucccaguugccgcgcugccaaucuucggugccugcucuggcccaucccaccagauuacacuaccuccugaggcuucugacauuuuugcucggcccaggagcaggcggggccgaagcucagggaaugcugggccgggcccuacugcuuagcucccuccccgauaauuguucauucugggacgcauuucgcccugaggguagaaggaguguccugcguacuaucggggaguauuuggaacaggaugaggaacaaccaacccccucuggauucgagccuacagugaacccgagcuccggcauuucaaagauggaacuguuagcuugcuuuagcccaguccucugggaccugcuucagcgggagaaaucugugugggcccugcagaucuugguucaggcguaccuccauaugcccccugagaaucugcaacagcuagugcuguccgccgaacgagaggcugcacaggguuuccuuacccucaugcugcagggcaaguugcaagggaaguuacagguacccccaagugaagaacaggcccugggaagacucacugcucugcuucugcagagguauccucgcuugacgagccaacuauuuauagaucugucuccccucauuccauuccuggccgucuccgaccuuaugcgguucccuccgucauuacuggcaaacgacagugugcucgcggccaucagagauuacagccccggcaugaggccagagcagaaagaggcuuuggccaagcgccugcucgcaccugagcuguuuggggaaguucccgcuuggccacaggagcuucugugggccguguugccucuacugccccaccucccguuagaaaacuuccugcaacuuucgccacaccagauucaggcacuggaggacuccuggccugccgcuggacucggccccggucaugcgcgacacgucuugcggucucuggugaaucagagcguacaagauggggaggaacaggugcguagacucggaccacuggccuguuuucuuucacccgaggaacuacagagucugguuccuuuguccgacccgacaggccccgucgagagggguuuacuggaaugcgcagcuaacggcacccucucuccagaggggcgcguggccuacgagcugcuuggagugcugcggagcuccggcggggccguccucucaccuagagaauugaggguuugggcuccccuguucagccagcuaggacugcgauuucuccaagagcuuagugaaccucagcugcgcgcaauguuaccaguguugcagggcacuucugugacccccgcccaggcgguacugcuccugggucggcuucugccuagacaugaucucuccuuggaggaacugugcagcuuacaccuacugcucccagggcuuucgccccaaacacugcaggcuaucccgaggcgugucuuggugggagccuguucaugccuggcaccugagcucucucgccugagugccugucagaccgcugcacuucuccagacuuuccggguuaaagacggcgugaagaauauggguacaacgggcgccgggccagcggucugcauccccggacaaccuauuccaaccacuuggcccgauugucuguugccgcuguuaccucuaaaacugcuccagcuugacucccuggcuuugcuggccaacagaaggcgauauugggagcuccccuggagcgaacagcaagcacaguuucuguggaagaagaugcaagugccaacaaaucuuaccuuacggaaccugcaggcccucggcacauuggcugggggaaugucuugcgaguuccugcaacagauaaauagcaugguugauuuucuagaagugguacacaugaucuaccagcugccuacucgcgucagaggcucccucagggccuguauuugggcagagcuucagcggcgaauggcuaugcccgagccagaauggaccacggugggucccgagcugaacggguuggacucaaaacugcuccuggauuuaccuauccaacuuauggacagacugaguaaugaaagcauaaugcucguggucgagcuaguucagcgcgccccagaacagcuguuggcgcugaccccgcuccaucaggccgcacuugcugagagggcccugcaaaacuuggcucccaaggagacaccugugucuggagaaguacuggagacucucggcccauuagugggcuuccuggggaccgaauccacacgucagauuccccuucagauccugcuaucacaccucagucaacugcagggauuuugcuugggugagacuuucgcaaccgaacugggcuggcuccuucugcaggagagcgucuuagggaaaccugagcuguggucccaggaugaaguggagcaagccggacgguugguuuuuacgcucucuacagaagccaucucgcugauuccaagagaggcucuaggccccgaaacccuugagaggcugcucgagaagcagcagagcugggaacagucacgcgugggucaacugugucgagagccucaguuggcggccaaaaaggccgcucuggucgccggggugguuagaccggcagccgaagaccucccagagcccgugccuaauugcgcugacguccggggaacuuuccccgcggccugguccgcaacacagaucgcugagauggaacuuagugauuucgaggacugucugaccuuauuugccggcgauccaggccuggggccugaagaguugagggcagccaugggaaaagcuaagcagcucuggggucccccacgcggcuuccguccggaacaaauucugcagcuagggagacuucugauaggacucggcgaccgggagcugcaggaguugaucuuaguagauuggggugugcugucuacucucgggcagauugacggauggagcaccacacaacuuaggaucguuguguccucauuucugcgccagucuggccgacaugucagccaccuagauuucgugcaucugacggcccucggcuauaccuugugcgggcugagaccugaagaacuucagcacaucaguuccugggaauuuagccaagcggcacuguuccucggaacuuuacaucugcagugcucugaggaacaguuggagguacuggcccaucuccuugugcugcccgguggcuuugggccaauuucaaacuggggacccgagauauucacagaaaucggcaccauugcugccgguaucccugaccuagcucuguccgcacucuugcgggggcagauucaaggagucacaccacuggccaucaguguuauacccccuccgaaguuugcugugguguucagcccaauccagcuuucgucucugacuuccgcccaggcagucgcggugacccccgagcagauggccuuuuuaagcccugaacaaaggcgcgcuguugccugggcacagcacgagggcaaagaaucaccagagcagcagggcagaaguacggcuugggggcuccaagauuggucuaggcccuccuggagccugguauugacaauuucauuccugggacaucuccuuuga

SEQ ID NO: 63360 - RNA, 2394 nt, Artificial Sequence
  derived and/or modified sequence opt3 from STRN3__Homo_sapiens__NP_001077362
auggacgagcuggccggcgggggagguggcgggcccggaauggcugcaccuccaagacagcaacagggcccgggugggaaccucggacuuagccccggcggcaauggggccgcgggagguggcgggccuccagcuuccgaaggagccggccccgcagccgguccugagcugucuaggccacagcaguacaccauccccgggauuuugcacuauauacaacaugaaugggcucgguucgagauggaacgcgcacacugggagguggagcgagccgaauuacaggcucguaucgccuuucugcagggagagagaaagggccaggaaaaccuaaagaaggaucucgucaggcggauuaaaaugcuggaguacgcgcuuaagcaagagcgcgcaaaauaucauaagcugaaguacggcacagaauugaaucagggggaccucaaaaugccuacuuucgagucagaagagacgaaggauaccgaagccccaacagcuccgcagaacagucagcugacuuggaaacaaggaagacagcugcucaggcaguauuuacaagagguugguuacaccgacacaauccuggaugugcggagccagcgcguacgaucccuuuugggccugucuaauucggagcccaacgggucaguggaaaccaagaaucuagagcagauucucaacggaggcgaaagcccuaaacagaagggucaagagaucaagagaaguuccggggacguccuggaaacuuuuaauuuccuugagaacgccgaugacucugaugaggacgaagagaaugauaugauagaaggcaucccagagggaaaagacaagcacaggaugaacaaacauaagauuggcaaugaagggcuggcagcugauuugacagacgaccccgauaccgaggaggcccucaaagaauuugacuuccuggugacggcggaggauggagaaggugccggcgaggcacggagcuccggggacggaacugagugggauaaggacgauuuaucaccuaccgcugaaguuugggacguggaucagggccugaucaguaaacucaaggagcaguauaagaaagaacguaaggguaaaaagggggucaaacgcgccaacagaacaaaacuuuacgacaugauugcugaucugggcgacgacgaguugccacacauccccagcggaauaauuaaucagucuagguccgccucaacucggaugaccgaucacgaaggcgcacgagccgaggaggcugaaccgaucacauuuccuagcgggggagguaagaguuucauuaugggcucugacgaugugcuacuguccguacucgggcugggagaccuugcggaucugaccguuacgaacgacgcagauuacagcuaugacuugcccgccaacaaagaugcuuuucgcaagacuuggaauccaaaauacacacucagaucgcauuucgacggcgugagggcccuggcauuucacccugucgagcccguguuagugaccgccucugaagaucauacucugaagcuauggaaccuccagaaaacagucccagcuaagaaguccgccucacuggacguugagcccaucuauaccuuccgggcacacaucgguccugugcuuaguuuggcgauuagcuccaauggggaacaaugcuuuucuggcggaauagaugcuacgauccagugguggaacaugccaagcccgucaguagaccccuacgacaccuaugagccuaaugugcuggccggcacacucgucgggcacacugaugcaguguggggacuggccuacaguggcauuaaaaaccagcuucuguccuguagcgcugacgguaccguucgcuuguggaauccacaagagaagcuccccugcaucuguacauauaacggggauaaaaagcauggaauaccuacuucuguggacuucauuggcugcgauccagcccacauggucaccucauucaauacagguagugcagugaucuacgaccuggaaaccagccaguccuuaguaauccugucuucgcagguugauagcggccuacaguccaacaaucauauuaacagaguggucucacaccccacucucccggugacgaucacagcucaugaggacaggcacauuaaauuuuucgauaauaagaccgggaagaugauacacaguauggucgcccaucuggacgcggugacuucucuugccguugauccuaacggaaucuacuugaugagcggcucccacgacuguucaauucgucuguggaaucucgauagcaaaaccugcgugcaagaaaucacagcucaucggaagaaacuggacgagucuaucuaugacguagcauuucacuccaguaaggccuacauugcuagcgccggggcagaugcguuagccaaagucuucguguga

SEQ ID NO: 63361 - RNA, 2283 nt, Artificial Sequence
  derived and/or modified sequence opt3 from STRN4__Homo_sapiens__NP_001034966
augauggaggaaagagccgcugcagccguggcggcugccgcaagcuccugcaggccccugggcucuggggccggaccugguccaaccggcgcugcaccggucucagcccccgcuccugggccaggacccgccggcaagggugggggaggcggcgggaguccuggaccaacagcgggucccgagccucucagccuuccaggcauccugcacuucauucagcaugaaugggcacgguuugaggccgaaaaagcucgcugggaggccgagcgagcagaauugcaagcucagguugccuucuuacagggggagcguaagggacaggaaaaccugaaaacugaccuagugagaaggauaaagaugcucgaguacgcgcugaaacaagagcgggccaaguaucacaaacuuaaguuuggcacggaucugaaucagggugaaaagaaagcagacguauccgaacaggugucuaacgggccggucgaaucggugaccuuggaaaauucaccccucguuuggaaggagggacgccagcugcugagacaauaccucgaggaggugggcuauacagauacuaucuuagacaugaggagcaaacggguccgcagucugcuuggccgauccuuggaacugaacggggcuguggagccuucugaaggagccccaagagcucccccugguccagccggccuaagcgggggagagucccuccugguaaagcagauugaggagcagaucaagaggaaugcagccggcaaagaugguaaggagcggcuugggggcucaguucugggacagauucccuucuugcaaaacugugaagacgaggauagugacgaagaugacgagcucgauagcgugcagcauaaaaagcagcgugucaaacugccgucuaaggcuuuagugccugaaauggaggacgaggaugaagaggacgacuccgaagaugcgaucaaugaguuugacuuccugggcucaggggaggauggagaaggugcacccgacccacgcagaugcaccguggauggcagcccucacgagcucgaaaguaggcgggucaaacuucaagggauacuggccgacuugcgagauguugacggacuacccccaaaggugacaggucccccuccaggcaccccgcagccccgcccucaugaggggucuuuuggcuucuccagcgauguauuuaucauggacacuauuggaggcggggaagugucgcugggagaucucgcugaccugacagucaccaacgacaaugaucuuucuugugaccuguccgauucaaaggacgccuucaaaaagacguggaacccaaaauuuacuuugagaagucacuacgaugguaucaggagccucgcauuccaccauucccagucugcccuguuaaccgcuagcgaggacggcacacugaagcuauggaaucuccagaaagccgugacugcaaagaagaacgcggcucuggauguugagcccauucacgccuuucgggcacaucgcgggccugugcuugccgucgcuaugggaucaaauagugaauauugcuacuccggcggugccgacgcauguauccacagcuggaaaauaccagauuugucuauggaccccuaugauggguacgacccgucagugcugagucacguacucgagggccauggagaugcuguuuggggccuggccuucagcccuaccucccaaagacuugcgucuugcucggccgacgggacagugaggauuugggacccaagcuccucaagucccgcuugucugugcaccuucccuacggcaucugaacacggaguccccacuagcguggccuuuacauccaccgagccagcucauaucgucgccucauuccguagcggcgauacuguguuguacgacauggaaguugguucugcacuccugacauuagagucccgggggaguagcggaccuacccagauuaaccaggugguaucucaccccaaucagccacugacgaucaccgcgcaugaugaccgaggcaucagauuucuagauaacaggacagguaagccgguccacuccaugguggcccaccucgacgcuguuacuugucuggccguggauccuaacggcgcauuccuuaugucagggagucaugacugcagcuugcgccuguggucgcucgauaauaaaaccuguguccaagagauuacagcucaccggaagaaacaugaagaggccauacacgcaguggccugccaccccuccaaggcucugaucgcgucugccggagcagacgcuuuagccaagguauuuguguga

SEQ ID NO: 63362 - RNA, 2343 nt, Artificial Sequence
  derived and/or modified sequence opt3 from STRN__Homo_sapiens__NP_003153
auggacgagcaggccggccccgggguguucuuuagcaacaaucacccuggagcugguggcgcaaaggggcugggaccacucgccgaagcggcugccgcaggcgauggugccgcugcagccggggcugccagagcgcaauacucccuuccgggaauccugcauuucuugcagcacgagugggcaagguuugaagucgagcgggcccagugggaaguugagcgcgcugaguuacaggcccaaauugcauuccugcagggcgaacgaaaaggccaggagaaccuaaagaaagaccucgugcguagaauaaagaugcuggaauaugcucuuaaacaggagagggccaaguaccauaagcugaaauaugggaccgaguugaaucaaggagauaugaagcccccuucuuacgacucagaugaagguaacgagacagaaguacagccacagcagaauagucaacucauguggaaacagggccggcagcugcugcgccaauaucuccaggaggugggguacacugacacgaucuuagaugucaagagcaaaagagugagggcgcugcuuggauuuuccucugacguuaccgaucgggaagacgauaagaaccaggacucgguggucaauggcacagaggccgaggugaaggaaacugcaaugauugcuaaaucagaguugaccgauagcgccaguguacuggacaacuucaaguuucuagaauccgcugccgcagacuucucugaugaggacgaagaugacgauguugacggucgcgagaaaagcgugaucgauacauccaccauuguccgaaagaaagcccuccccgacucaggggaggauagagacacuaaggaagcucugaaagaguuugauuuccuugugacaagugaagagggagacaaugaaagcaggucugcgggcgacggcaccgauugggagaaggaggaccagugccugaugccugaagcauggaacguggaucaaggggucaucacgaaguugaaagagcaguauaagaaagaacggaaggguaaaaagggaguuaagcguccaaaucgcuccaaacuccaggacaugcuggccaacuuaagagauguggacgagcugcccucacuccagccuagcguaggcaguccaucuaggccguccagcucgcggcuucccgagcacgaaauaaaucgagcugaugagguggaagcccugacuuuuccuccaucuuccgggaagucauucaucaugggagcagacgaggccuuggaaagugagcuaggccugggugagcucgcugggcugaccgucgccaacgaagcagauagccuuacauacgacauugcgaauaacaaagaugcucugcgcaagacuuggaaccccaaauuuaccuugagaucccauuucgacggcaucagggcccucgcauuccacccuauugagccagugcugaucacagccucugaagaucacaccuuaaagauguggaaucugcaaaagacggcucccgccaaaaagagcacuucacuagacguugagccgauauacacauuucgggcacauaaaggaccugugcucugugucgugaugaguuccaacggcgaacagugcuauagcgggggaaccgacggucugauucagggcuggaauacuacaaaccccaauaucgauccauacgacucuuaugauccuucaguacuucgcgggcccuugcugggacacaccgacgcuguuuggggccucgccuacagugcggcccaucagagacugcuuagcuguuccgcugaugguacgcugagguuguggaacaccacagagguggcaccagcccucucugucuucaaugacacuaaggagcuggggauucccgcuucgguggauuuagucagcuccgacccuucacacaugguggccaguuuuucuaaaggcuauaccagcaucuucaacauggaaacacaacagcguauccugacucuagaguccaauguugauaccacagcaaacucaagcugccagauuaaucgggugauaucucacccaacccucccgaucuccauuacugcgcaugaagaccgacacaucaaguuuuacgauaacaauacgggaaagcugauacauaguaugguagcccaccuugaggcugucaccagcuuggccguggaccccaacggccuguaucucaugucugggucccaugauuguucaauuagacuguggaauuuagaaaguaaaacaugcauccaggaguucacugcacacaggaagaaauuugaggaaagcauccacgacguugcuuuccauccuucgaaguguuacauugccuccgcaggagccgacgcucuggcgaaaguguuugucuga

SEQ ID NO: 63363 - RNA, 1752 nt, Artificial Sequence
  derived and/or modified sequence opt3 from STS__Homo_sapiens__NP_000342
augccccugagaaagaugaaaaucccuuuccuccuucuguuuuucuugugggaggccgaaagccacgcugcauccaggccaaacauuauauuagugauggccgacgaucugggcaucggggacccgggaugcuacgguaauaagaccauucggacacccaacaucgaucgccuagcgucuggcggggucaaacucacucagcaucuggcugccucaccucuuuguacgccaagucgagcagccuuuaugaccggacguuaucccguuagaagcggcauggcuuccuggucuaggacagguguguuccuguuuacugcaucgucagggggauugccuaccgacgagauuacauucgccaagcuccugaaagaucaaggcuacagcaccgcucugaucggcaaguggcaccucgggaugaguugccauuccaagacugacuuuugucaccauccauuacaccacggauucaauuauuuuuacgguauaucucugacaaaccuucgggauugcaaacccggcgaagggagcguauucaccacgggauuuaagcgcuugguguuccugccucuacagaucgucggcgugacucuccugacccuugccgcgcugaauuguuugggucuccugcauguuccauuagggguguuuuucucccuccuguuccuugcagcccugauuuugacacuauuucugggauuccuccacuauuuuagaccgcugaacugcuucaugaugaggaauuacgagaucauucagcagcccaugucauaugacaaccuuacucaacggcugaccgucgaagcugcccaguuuauccagcgcaauacagagaccccuuucuugcucgugcugaguuacuuacauguacacacggcacuguuuagcucuaaagauuucgcuggcaagucccagcacggcguuuacggggacgccguggaggaaauggauuggucagucggacaaauacuaaaccuccuggacgagcuucgauuggcgaaugauacucugauuuauuuuacaagcgaccagggugcccauguggaagaggugaguucuaaaggcgagauccacgggggauccaacggcauuuacaagggugggaaggcaaauaacugggaaggcggaaucagagucccaggcauccucagguggccccggguuauucaggcugggcagaaaauagacgagccuaccagcaauauggauaucuucccaacuguggccaagcuggcuggagcuccccuuccggaagaccguauuaucgauggucgcgaccugaugccuuugcucgagggcaaaucgcaaagaucugaucaugaauuucuguuccacuauuguaacgcauacuuaaacgccguaagguggcauccccaaaauuccacaucaauauggaaggccuuuuucuucaccccaaacuuuaauccuguggggaguaacggaugcuucgcgacgcacgucuguuuuugcuucggcagcuaugugacccaccaugaucccccacugcuauuugacauuuccaaagacccccgggagcgaaauccucucacaccagcaucugagccgcgcuucuacgaaauccugaagguuaugcaggaggccgcugauagacacacucagacccuucccgaagugccugaccaguuuagcuggaacaauuucuuguggaaaccauggcugcagcucuguugccccucaacaggucugaguugccagugugauagggagaagcaagacaagcgguuaucccgcuga

SEQ ID NO: 63364 - RNA, 2118 nt, Artificial Sequence
  derived and/or modified sequence opt3 from STT3A__Homo_sapiens__NP_001265432
augaccaaguucggcuuucugagacucagcuacgagaaacaggacacacuucugaaguuguuaauccuguccauggccgcugugcuaucuuucucaacuaggcucuuugcaguccugcgguucgaaaguguuauucacgaguuugaucccuauuucaacuaccgcacgacccgauuucuugccgaagagggguucuauaaauuucauaauugguucgacgaucgugcgugguacccucugggaagaauaaucgguggcacaauuuauccaggguugaugaucacuagcgcugccauuuaccacgugcuccacuuuuuccauaucaccauagacaucaggaacguaugcguguuucuggcaccgcuguucuccucuuucacaaccauugucacuuaucaucucacaaaggaauuaaaagaugccggagcuggccugcuugcagccgcuaugaucgccgugguucccgguuacauuucgcggucaguggcggggagcuacgacaaugagggaaucgcaauauuuuguauguugcugaccuauuacauguggauuaaggccgucaagacgggcaguaucugcugggcugccaaaugugcacuagcuuauuucuacaugguguccucuuggggcggguauguauuucucauuaaccugaucccucuucacguucugguguugaugcucacuggacgcuucagccacagaaucuacgucgccuauugcaccguguacugucuggguacaauuuuauccaugcaaauaucauuugugggcuuccagccaguccugaguagcgagcauauggcggccuuugggguuuucggacucugccagauccacgcauuuguggauuaccuuaggucuaagcugaauccccagcaauucgaaguauuguuucgguccgugauuagucuagucggcuucgugcugcucacuguuggugcucugcuuaugcugaccgggaaaaucagcccuuggacaggacgcuuuuauaguuugcucgacccaucuuacgccaagaacaauauacccauuaucgcuuccgugagcgagcaucagccuaccacguggucgucuuauuacuucgaucugcaguuacuggucuucauguuuccagugggccuauauuacuguuucuccaaccucucagacgcccgaaucuuuauuaucauguauggcguaacuucaauguacuucagcgcaguuauggugagacugaugcuugucuuggccccggugaugugcauucuguccgggauaggagucucucaggugcucagcacauacaugaaaaaucuggauaucucaaggcccgacaagaagaguaaaaagcaacaggauuccaccuauccuauuaaaaacgaaguugcuagcgguaugauccuugugauggcguuuuuccugaucacuuacacauuucacucuaccuggguaacgucagaggcauauaguagcccauccauugucuugucugcccggggcggggacggaucgcguauaaucuucgacgauuuucgcgaggcuuacuauuggcucagacacaauacccccgaagacgccaaggugaugagcuggugggauuacggcuaucagauuacagcaauggccaacaggacuauccugguugacaauaacaccuggaauaacacacauauuucccgggugggucaggcuauggccucaacugaggaaaaagcauacgagaucaugcgagaauuagaugucaguuacgugcugguaauauucgggggccuaaccggauauucuagcgacgauaucaacaaguuucucuggauggugcgcauuggcggguccacagacaccggaaaacacaucaaggagaaugauuacuauacuccuacgggugaguucagaguugacagggaaggcucaccaguccugcuuaacuguuugauguacaagaugugcuauuaccgguuugggcaaguguauacagaggcgaaaagacccccgggauucgaucgcgugaggaaugcugaaauuggcaacaaggacuucgagcuggacguccucgaagaggccuacaccacugagcauuggcugguucguaucuacaaagugaaggauuuagacaaucggggucugagccgaaccuga

SEQ ID NO: 63365 - RNA, 2481 nt, Artificial Sequence
  derived and/or modified sequence opt3 from STT3B__Homo_sapiens__NP_849193
auggccgagcccagcgcuccugaauccaagcacaaaucuucacugaacaguagcccaugguccggccucauggcacuuggaaauucuagacauggacaccaugguccgggcgcccagugcgcgcacaaggcugccgggggagcagcucccccuaaaccagcucccgcaggccugucggguggguugucacaaccugccggauggcagagcuuacugaguuucaccauccuauuucucgcuuggcuggccggcuucuccucuaggcuuuuugcggugauucgguucgagagcauaauccaugaauuugacccaugguucaacuaccgcuccacacaccaccuggcaucacauggcuuuuaugaguucuugaauugguuugaugaacgagccugguacccccucgggcguauugucggagguacuguuuauccuggccugaugaucacggcugggcugauucacuggauccucaacaccuuaaauauaacagugcauaucagagacguauguguguuccuggccccaacuuuuaguggacuuaccagcauuucuacauucuugcugaccagggagcuauggaaccagggcgcaggucuccuggcugccugcuuuaucgcgauugucccgggguacaucucccggucaguggccgggagcuucgauaaugagggcauagcaauuuucgcccuucaguuuacuuauuaccuguggguuaagagugugaaaacaggcucugucuucuggaccauguguugcuguuuguccuauuuuuacauggugagcgccuggggaggguacguauucaucauuaaccucaucccccugcacguuuuuguguuacugcucaugcaacgcuauucgaagagagucuacaucgcuuauucuacguucuacauugugggucuuauacuguccaugcagaucccuuuugugggcuuccagccaauuaggacuucagaacacauggccgcagccggggucuuugcuuugcuacaggcguaugcauuccugcaauaccuccgggaccgccugaccaagcaggaguuucagacacuuuucuuucugggaguuaguuuggccgcuggcgccguguuccucagcguaaucuaucugacuuacaccgguuacauagcacccugguccgggcgauucuauucuuuaugggauacaggcuacgccaaaauucauaucccuaucauugcuagcgugucagaacaccagccaaccacgugggucuccuuuuucuuugaccugcauauccuagugugcacuuuccccgccggacucugguuuuguauuaagaauauaaacgaugagagaguuuucguggcacuguaugcgaucagugcugucuacuuugccggcgugaugguaaggcuuauguugacacugaccccgguugugugcaugcucagcgcaauugccuucucuaaugucuuugagcacuaucugggggacgauaugaaacgggaaaacccucccguggaggacucaagugaugaagacgauaagcguaaucaaggaaaccuuuacgacaaagcugguaagguccgcaagcaugccacugagcaggagaaaacagaagagggccuggggccaaauaucaagagcaucgugaccauguugaugcucaugcuguuaaugauguucgcaguucacuguacgugggugaccuccaacgcuuauucuucgccuagcguaguccuggccuccuacaaccacgacggaacaagaaauauucuagaugacuuuagggaagcguacuucuggcuccggcagaacacugaugagcaugcccgagugaugucauggugggacuauggcuaccaaauagcugguauggcaaaucgcaccacacugguugauaacaauacuuggaacaauagucacaucgcccuuguggggaaagcuaugucuagcaacgaaaccgccgcauauaagauuaugagaacauuggacgucgauuacgugcugguaaucuuuggcggagugauuggcuauuccggggacgauaucaauaaauuccucuggaugguuaggauagcggagggagaacaucccaaggacauccgggagucagauuacuucaccccacagggugaguuucgcgucgacaaagccggcagccccacucuguuaaacugccugauguauaagaugucuuacuacagauucggggaaaugcagcuugacuuuaggacgccuccaggauucgaucguacacggaaugcugagauuggcaacaaggacaucaaauuuaagcacuuggaagaggccuucaccuccgaacacuggcucgugcgaauuuauaaagugaaggcaccggauaauagagagacucuggaccauaaacccagggucaccaacaucuuuccuaagcagaaguaccuaaguaaaaagacaaccaaacgcaagcgggguuauauuaaaaauaagcugguuuucaagaaagggaagaaaauaagcaagaaaacuguguga

SEQ ID NO: 63366 - RNA, 912 nt, Artificial Sequence
  derived and/or modified sequence opt3 from STUB1__Homo_sapiens__NP_005852
augaagggcaaagaggaaaaggaagggggagccagacugggugcuggcgggggaagccccgaaaaauccccuucugcacaggagcucaaggaacaaggcaacaggcuuuucgugggucggaaauacccagaggccgcggcuugcuaugggcgcgccaucacccgaaauccgcuggucgcaguuuacuauacaaaccgugccuuguguuacuuaaagaugcagcagcacgagcaggcucuggcagacugcagaagggcccuagaacucgauggacaaucagugaaggcucacuuuuuccugggccagugucagcuugagauggaaaguuaugacgaggccauugcgaaucugcagcgggcauacagcuuggccaaagagcaacgccucaacuuuggcgaugacauacccuccgcucugagaaucgccaagaaaaagagguggaacucuauugaggagcggcgcauccaucaggaaucggagcugcauucauaucucagccgauuaauugcagcugaaagagagagggagcuggaagagugccagcggaaucacgaaggggaugaggacgauagucauguacgugcccagcaagcguguaucgaagccaaacacgacaaguacauggcagauauggacgagcuuuucucccagguggaugagaagcgcaaaaagagagacauaccugauuacuugugcggaaaaaucucuuuugaacugaugagggagccauguauuacucccagcgguaucacguaugaccggaaggacauugaggaacaccuacagcgagucggccauuucgauccugugacccgcuccccacucacacaagaacagcugauccccaaucuugcuaugaaagagguuauagacgccuuuauuucagagaacggguggguggaagauuacuga

SEQ ID NO: 63367 - RNA, 864 nt, Artificial Sequence
  derived and/or modified sequence opt3 from STX11__Homo_sapiens__NP_003755
augaaggacagacuggccgagcuccuugaucugagcaaacaguacgaccaacaguuccccgauggcgacgaugaauuugacuccccucacgaggauaucguguucgaaaccgaccauauuuuggagucuuuauauagggauauacgggacauccaggaugaaaaccagcugcuagucgcugacguuaagcgccucgggaaacaaaaugcacgauuucugacaucaaugcguagacuuaguagcauuaagagggauacuaacuccaucgccaaagcgauuaaggcucggggagaggugauccacugcaagcugcgcgccaugaaagaguugucugaagcagccgaggcucagcaugguccacacucggcaguagccagaauaucaagggcucaguacaaugcccucacgcugaccuuccagcgggcgaugcaugacuauaaccaagcagaaaugaagcagcgcgacaauuguaaaauccgaauccagagacagcuggagauuaugggcaaggaggugagcggggaucaaauugaagacauguuugagcagggaaaaugggaugucuucagugaaaaccucuuagccgacgugaagggcgcuagggccgcacugaaugagaucgaaucccggcaccgugagcuuuugcgccuggagucuagaauaagggauguucacgaacuauuucuccagauggcugugcuggucgagaagcaagccgacacacuuaacgugauugaacugaauguacagaaaacuguugauuacaccggucaggcgaaggcccaggugcggaaagcaguccaauaugaggaaaagaacccgugccgaacauuguguugcuucuguugccccugucucaaauga

SEQ ID NO: 63368 - RNA, 978 nt, Artificial Sequence
  derived and/or modified sequence opt3 from STX16__Homo_sapiens__NP_001001433
auggccaccagaaggcugacagacgcuuuccuccuucugcggaacaauagcauccagaaccgccaauuguuagcagaacagguguccucucacauuacuucaaguccccugcauagccgauccauagccgcggagcuagaugagcucgcugacgaucguauggcccuggucucuggcaucucgcuugacccugaagcagccauugggguuacgaagagaccaccgcccaaauggguggauggaguagacgagauccaguacgauguggguaggauuaagcagaaaaugaaggaacuggcuucauugcacgacaaacaucucaaucggccuacccuggaugacagcagugaggaggaacacgcaaucgagauaacaacucaagaaaucacccagcuguuucaucgcugccagagagccguccaggcucucccauccagggcccgggcguguucugagcaagagggccgcuuacuggggaacgugguugcaagccuugcccaggcuuugcaggaacuguccacaucauuccgacacgcccagaguggauaucuaaagagaaugaagaauagggaggaacggagccaacacuuuuucgauaccucugugccccucauggacgauggcgacgacaacacucuguaccaucgugguuuuacagaggaucagcuuguccugguggaacagaauaccuugaugguagaggagcgcgaaagagagauuaggcaaaucguucaguccauuucagaccucaacgaaaucuuccgggaucugggggcaaugauaguggagcagggaacggucuuagaccgaauugauuauaauguggaacagagcugcaucaaaacugaggacggccugaagcaacuccacaaagcugagcaguaccagaagaaaaaccgcaagaugcuugugauucugaucuuguuugucaucauuauaguucuaaucgugguacuggugggcgucaagaguagauga

SEQ ID NO: 63369 - RNA, 909 nt, Artificial Sequence
  derived and/or modified sequence opt3 from STX17__Homo_sapiens__NP_060389
augagcgaggacgaagagaaggugaaacugagaaggcucgaacccgccauccagaaguucauuaaaauagucaucccuaccgaucuugagcggcugcgcaagcaccaaauuaacaucgaaaaauaccagcgaugccguauuugggacaaguugcaugaggagcacaucaaugcuggcagaacaguucagcaguuaagguccaacauacgggaaaucgagaagcugugucuaaaagugcgcaaggaugaccucguacugcuuaaaagaaugauugauccagugaaggaagaggcaucugccgcgacugcugaguuucugcaauugcaucucgaaucagucgaggaacugaaaaagcaguucaaugacgaggaaacgcugcuccagccgcccuuaaccaggaguaugacaguugggggagccuuucacacuaccgaggcagaggccagcucccagucucugacacaaaucuaugcacuuccugaaauuccacaggaucagaacgcugccgagucgugggaaaccuuggaggcugaccugaucgaacuaucacagcucgugacugauuucagccugcuugugaauagucaacaggagaagauagacuccauugccgaucaugucaacucugcggcagugaauguagaggaagguaccaaaaaccugggcaaggccgcuaaauacaaguuggccgcacuccccguugcuggggcccugaucggaggcauggugggugggccuauuggauuacuggcgggcuuuaaagucgccggcaucgcagcugcccucgggggaggugugcuuggcuucacagggggaaagcugauccagcggaaaaagcaaaagaugauggagaaauugacgagcuccugcccagaccuacccucacagacugauaagaaauguaguuga

SEQ ID NO: 63370 - RNA, 1008 nt, Artificial Sequence
  derived and/or modified sequence opt3 from STX18__Homo_sapiens__NP_058626
auggccguggacaucacccuucucuucagagcuagcgucaagacaguuaaaacuaggaacaaggcacuuggcguggccguagggggagguguggauggcucccgggacgagcuguuucgccgaucuccccguccuaaaggggauuucucaaguagagcgagggaagucauuagccacauaggaaaguugcgggacuuuuuacuggagcaucgcaaagauuacaucaaugcuuauucccacacgaugucugaauacggcagaaugaccgacacagagagggaucagauugaccaagaugcccagaucuucaugcggacuugcucggaagcaauucagcagcuacgcaccgaggcccauaaggagauccacucacaacaggugaaggaacaucgaacagcuguucucgacuuuauagaggauuaucugaaaagaguguguaagcuguacagcgaacagagggcaauccgggucaaacgugugguagacaagaaacgccugaguaaguuggagccagagccgaacaccaagacuagagaauccacaucuagcgagaaaguuucccagucacccaguaaggauagcgaagagaauccugccaccgaagagaggccagagaaaauucucgcugaaacgcaacccgagcuggguacuuggggagacgggaagggcgaagacgagcugucuccugaagagauccagauguucgagcaggaaaaccagcggcucauuggcgagaugaacuccuuauuugaugaagugcgacaaaucgaggggcgcgucguggaaauaucaagacugcaggagauuuucaccgagaaagugcuucagcaagaagccgagaucgacagcauucaccaguuggucguuggagcgacagaaaauaucaaggaggguaaugaggauaucagggaagcaauuaaaaacaaugccggcuuucggguguggauacuguucuuucuaguaaugugcaguuucucucuccuguuucuugacugguaugauuccuga

SEQ ID NO: 63371 - RNA, 756 nt, Artificial Sequence
  derived and/or modified sequence opt3 from STX1A__Homo_sapiens__NP_001159375
augaaggacagaacccaggagcugaggacagccaaagauagcgacgaugacgaugacguggcugucacuguugaucgggaccgcuucauggaugaauuuuucgagcaaguggaagagauccgaggcuuuauugacaagauagcagaaaacguagaggaggugaaacguaagcacuccgccauccucgcgucucccaauccugaugaaaagacgaaggaggaacuugaggagcugaugucagacauuaagaaaaccgcuaacaaggucagaaguaaauugaaaagcaucgaacaguccauugagcaggaagagggguuaaauaggucuucggccgaucugcggauccgcaaaacacagcauucaacucuaagcagaaaguucguggaaguuaugagugaguacaacgcaacccaauccgacuauagggagcggugcaagggacgcauacagcgacagcucgaaaucacagguagaaccacuacaucugaggaacuggaggacaugcuugaaagcggcaauccagccauuuuugcuuccgggaucauuauggauucaaguaucagcaaacaggcacugucugagauagagaccaggcacuccgaaauuaucaaguuggagaacucaauucgggaacuccaugacauguucauggauauggccaugcugguggagagccaaacgauguggcguggaccgugucugacuccccgcagaccuaguucuaccagggcucggcgagccggccgcaaauccuga

SEQ ID NO: 63372 - RNA, 867 nt, Artificial Sequence
  derived and/or modified sequence opt3 from STX1B__Homo_sapiens__NP_443106
augaaggacagaacccaggagcugaggagcgccaaagauuccgacgaugaagaggaagugguccacguugaccgggaucauuucauggacgaguuuuucgaacaaguggaggagauccgcggcugcauugaaaagcucucugaggauguagaacaggugaaaaagcagcacucagcuauacuugcagcccccaacccugacgagaaaacaaagcaggagcuggaagauuugacugcggacaucaagaaaacggcuaauaagguccgaaguaaauuaaaggccauugagcaaagcaucgaacaggaggaagggcugaaccguuccucugcagaucuaagaauuaggaaaacccagcauucgacacucucacggaaguuuguggagguuaugacugaguacaaugccacccagagcaaguaucgcgacagauguaaagauaggauccaacggcagcuggaaauaacaggacgcaccacuacaaacgaggaacuugaggacaugcuggaaagugguaaguuggcuaucuucaccgacgauauuaaaauggacucccagaugacgaagcaggcacucaaugagaucgagacucgacacaacgaaauuaucaaacuggagaccucuauaagagaacugcaugauauguuuguggacauggccaugcucgucgagagccaaggcgaaaugauugauaggaucgaguacaauguggagcacuccguagacuauguugaacgggcugugucagauacaaagaaagccgucaaguaccagaguaaggcgcgucgcaaaaagauuaugaucaucauuugcugugugguguuaggggucguucuggcaagcucuauaggaggcacucuugguuuguga

SEQ ID NO: 63373 - RNA, 864 nt, Artificial Sequence
  derived and/or modified sequence opt3 from STX2__Homo_sapiens__NP_001971
augagagacaggcugcccgaucucaccgccugccggaagaacgacgauggcgacacaguggucguuguggagaaagaucacuucauggacgacuuuuuccaucagguagaagagauccgcaauagcauugauaagauaacucaauacguggaagaggucaaaaagaaccacuccaucauucuuucugcuccuaauccagaagggaaaaucaaggaggagcuggaagauuugaacaaggagauuaaaaagacggcaaauaaaauccgagccaaguuaaaagcgauagaacagucauuugaccaggaugagaguggaaaccguaccagcguggaccugagaaucaggcggacacagcauuccguucuaucucgcaaguucguggaggcuauggccgaauauaaugaggcacaaacucucuuuagagaaaggucgaagggucggauucagcgccagcuggagaucaccggccgaacaaccacugaugacgaacuugaggagaugcuggaaucagggaaaccgagcauuuucacaagugacaucauauccgauucucagauuaccagacaagccuugaacgagaucgaaagcaggcacaaggacauuaugaaacucgagacguccauccgggaacugcaugagauguuuauggauauggcuauguucgucgagacucagggagaaaugaucaauaacauugagcguaaugugaugaacgcaaccgacuacguagaacacgccaaggaggaaacuaaaaaggcuauaaaauaucagucaaaggcccgcagaaagcugauguuuaucauuaucuguguuauagugcucuuagucauucugggcaucauccuugcgacaaccuugaguuga

SEQ ID NO: 63374 - RNA, 834 nt, Artificial Sequence
  derived and/or modified sequence opt3 from STX3__Homo_sapiens__NP_001171511
augaaggacagacuggagcagcucaaagccaagcaacuuacccaggaugacgauacagacgcuguggaaaucgcaauugauaacacugccuucauggacgaguuuuucagcgaaauagaggaaacgaggcugaauaucgauaaaauuuccgagcacgucgaggaagcgaagaaauuguacucuaucauuuuaucagcucccaucccugagccaaagaccaaggacgaucuggaacagcuaacaacugagaucaaaaagcgggccaacaauguucgcaacaaacucaagaguauggagaaacauauagaagaggacgaagugcgaagcuccgcagaucugcguauuagaaagucucagcacucgguacuuucaaggaaguuuguggaggucaugaccaaauauaaugaagcccaaguggacuuccgggagcgcagcaagggcagaauccagaggcagcuggagauuacagggaaaaagaccacugaugaagaguuggaagagaugcucgaaaguggaaacccggcuaucuuuacauccgguauaauugacucucagaucagcaaacaagcacuguccgagauugagggccggcauaaggacaucguucgccuggaaucaaguaucaaagagcuccacgauauguucauggacauugccauguuaguggaaaaucagggggagaugcuggauaacauagaacuuaaugucaugcauaccguggaccacguagagaaggcucgagaugagacgaagaaagccguuaaguaccagagccaggcgaggaaaaaguugaucucucugcaaacuggaguggcaacccuagucuuuagauga

SEQ ID NO: 63375 - RNA, 888 nt, Artificial Sequence
  derived and/or modified sequence opt3 from STX4__Homo_sapiens__NP_001259025
augggcaugaccgccagaacaaagagaacucggagcgggucccgcugguggugcacgcgagcucgucacggauggggugcaagaaccaggucuucaaguacaagcccccugggccauccuccacaggugcggacuauccgccaaaccauugucaaacucgggaacaagguucaggagcuugaaaaacaacaggugacaauacuggccaccccguugcccgaggaauccaugaagcaggaguuacagaaucugagagacgaaaucaaacagcuaggaagggagauucggcuccagcugaaggcgaucgagccucaaaaggaagaggcugaugaaaacuacaauucuguaaacacucgcaugcgaaaaacacagcacggcgugcuuucgcagcaguucgucgagcugauuaauaaguguaacucaaugcaaagcgaguauagagagaaaaauguggagaggauccggcgucaguugaagauaaccaacgccgguaugguuagugacgaagaacucgaacagaugcuggauuccgggcaaucugagguguuugucagcaauauccugaaagacacucaggugacgcgccaggcacucaacgagauuuccgccagacauucagaaauccagcaauuagagaggaguauucgggaacugcacgauaucuucaccuuucuugcuacagagguagaaaugcagggagagaugauaaaucgaauugagaagaacaucuugagcucugcagacuacguugaacgcggccaggagcaugugaagacugcccuggaaaaucagaaaaaggcuaggaaaaagaaaguccuaauugccaucugcguguccaucaccgugguccuccuggcgguuauuauaggcgugacaguagugggguga

SEQ ID NO: 63376 - RNA, 966 nt, Artificial Sequence
  derived and/or modified sequence opt3 from STX5__Homo_sapiens__NP_001231595
augaucccccgcaagagguacggcagcaaaaacaccgaccaggggguguaucugggacucuccaagacacaaguccuuucuccugccacugcugguucaaguagcuccgauauugcaccacugccgcccccuguuacguuggugccacccccuccagacaccaugucuugccgggaucgcacacaggaguucuuaucggccuguaaaucacugcagacucgacagaauggcauacaaaccaacaagcccgcgcuacgugcuguaagacagaggagcgaauuuacacucauggccaaacggaucgggaaggaccugaguaauaccuucgcaaaacuugagaagcugacuauuuuggccaagcgcaaaucccucuuugaugacaaggcuguggaaaucgaggaacugacauacauuaucaaacaggauauaaacucucugaauaagcagaucgcacaacuccaggacuucgucagagccaagggaagccaguccggcaggcacuuacagacccauucaaacacgauugugguuagucugcaaagcaaacuugcuucuauguccaaugauuuuaagucaguguuggagguccggacugagaaccugaaacagcagcgcagccgaagagaacaauucaguagggccccugugucugcgcuaccacucgcaccgaaucaccugggugggggagccguaguucuuggcgcugagucccaugccagcaaggacguggcaaucgauaugauggacucgcggaccucucagcagcugcaguugauugaugaacaagacuccuauauccagucacgugcugacacaaugcagaacauagagaguacuauugucgagcucggcagcaucuuucagcaacuggcccacauggugaaagaacaggaggaaaccauucaguccguguuacuguucccccuccuuccugcgcugucuccagggagcacaagaaccugcuga

SEQ ID NO: 63377 - RNA, 465 nt, Artificial Sequence
  derived and/or modified sequence opt3 from STX6__Homo_sapiens__NP_001273139
augaaggaccagaugagcaccuccucugugcaagcccuggcugagaggaaaaacagacaggcacuccuuggcgauucagggagucagaauuggagcacaggaacuacggacaaguacggucggcuggaucgcgaauugcagcgagccaacucccacuucaucgaggaacaacaggcgcagcagcaauuaauugucgagcagcaggacgaacagcuggagcuaguuucuggcucgauaggggugcucaaaaauaugucacaacguaucggaggcgagcuggaggaacaggcuguaaugcuugaagauuuuagccaugagcuggagaguacccaguccagauuggacaacgugaugaagaaacucgccaaggucucucacaugacaagcgauaggcggcaauggugcgcaauugccauccuguucgcugugcugcucguuguguuaauucuguuucuugucuuguga

SEQ ID NO: 63378 - RNA, 711 nt, Artificial Sequence
  derived and/or modified sequence opt3 from STX8__Homo_sapiens__NP_004844
auggcccccgacccuugguucagcaccuacgauuccacaugccagaucgcucaagagauugcagaaaagauacagcagagaaaccaguaugagaggaaaggcgaaaaggccccaaaacugacugugacgauccgggcgcuccuucaaaaucugaaggagaaaauugcuuuguuaaaggaccugcuacuccgcgccgucucuacccaccagaucacacagcuggaaggggaucgacgucagaaccuucuggacgauuugguuacuagagagaggcuccugcuggcaucauuuaagaaugagggagccgaaccggaccucauucggaguagcuuaauguccgaggaagcuaaacgcggugcacccaacccuuggcuguucgaggagccagaagagaccagaggccuuggguuugaugaaaucaggcaacagcagcagaagauaauccaagagcaggacgccggauuggaugcucugucuucgauuaucucacggcagaaacaaaugggccaggaaauugguaaugagcuagacgagcagaacgaaaucauagaugaccucgccaaucugguggagaacacagaugaaaagcugcgcaaugagacccgaagaguaaacaugguggacaggaaaagcgcgaguugugggaugauuauggucauccuuuugcuccugguggcaauuguuguggucgccguguggcccacuaauuga

SEQ ID NO: 63379 - RNA, 1785 nt, Artificial Sequence
  derived and/or modified sequence opt3 from STXBP1__Homo_sapiens__NP_001027392
auggcccccaucggccugaaggcuguggucggggagaaaauuaugcacgacguuauaaagaaagugaagaaaaagggagaauggaagguacucguggucgaucagcuuagcaugagaaugcuguccucuugcuguaaaaugaccgacaucaugacagaggguauuacuaucguggaagauauuaacaagaggcgggagccuuugccaucauuagaagcaguuuaccugaucacgccgagugagaaaagcgugcauucccuaauaucugacuucaaggaucccccuaccgccaaauaucgcgcggcucacgucuuuuucacagacucgugcccagaugcccucuuuaaugagcuggugaagucacgagcagccaagguaaucaaaacucuuaccgaaauuaacaucgcuuuccugcccuacgagagccaaguuuauaguuuggacuccgcagauucuuuucagagcuucuacuccccucauaaggcccagaugaaaaauccaauucucgaacgucuggcugagcagaucgccacacugugugcgacccucaaggaguaucccgcagugagauacaggggcgaauauaaagacaacgccuuacuggcucaacuuauacaggauaaguuggacgccuacaaagcagaugacccuacuaugggggagggaccagacaaggcucggucacagcugcuaauucucgaucgcggcuuugacccgaguagccccguccugcacgaacuuacauuccaggccaugucuuacgaucuguugccuaucgagaaugacguguauaaguacgaaaccuccgguauuggggaggcgagagugaaagagguccuccuggaugaagacgaugacuuauggaucgcccugaggcauaagcacaucgcagagguuucacaagaagugacgcggagccucaaagauuuuaguucuuccaagcgcaugaacacuggagagaaaaccacaaugcgagaccuuagccagaugcugaagaagaugccacaguaucagaaagaauugucgaaguacucuacucaccuacaucuggcugaggauugcaugaaacacuaucaaggcaccguagacaagcucuguagaguggagcaggaccuggccaugggcacagaugcugaaggggagaaaauuaaggaccccaugagggccauagucccuauccuucuggaugcaaauguguccaccuacgacaagauucggaucauauugcucuauauuuuccugaaaaacggaaucacggaagagaauuuaaacaagcugauccagcaugcccaaauuccacccgaagauucagagaucauuacuaauauggcucaccuagguguuccgauagugacagacaguacccuccgucgcagaagcaaaccugagaggaaggaacggaucuccgagcagacuuaccagcugucucgauggacacccauuaucaaagauaucauggaagacaccauugaggauaaacuugacacgaagcacuacccauauauaagcacccgcucaagugcguccuuuagcacaacugcagucucugccagauacggccauuggcacaagaacaaggcuccuggggaguauaggucaggaccccgguugaucauuuucauccugggcggugugagucucaaugaaaugcgcugcgccuacgagguaacccaggcaaacgggaaaugggaaguucugauuggaagcacacauauccuuacuccacaaaagcuguuggauacccucaaaaagcugaauaaaacagacgaggaaauauccucuuga

SEQ ID NO: 63380 - RNA, 1773 nt, Artificial Sequence
  derived and/or modified sequence opt3 from STXBP2__Homo_sapiens__NP_001120868
auggcccccagcggccugaaggcuguggucggggagaaaauccucuccggaguuauuagaucugugaagaaagacggugaauggaagguacuuauaauggaucacccuucaaugaggauccugaguagcugcuguaaaauguccgacauuuuggcagagggcaucaccauuguggaagauaucaacaagcggcgcgagccaauaccgucuuuagaagccaucuaccugcuaucgcccacagagaaggcgcucauuaaagacuuccaggggacuccuacguuuaccuauaaggcugcccauaucuucuuuacagauacuugcccagagccccuguucucagaacuuggacgaagccgucuggcaaaagucgugaagaccuugaaagagauucaccucgccuuucugccuuacgaagcucaaguuuucagucuggacgcaccacauuccacauauaaucucuacugucccuuuagagccgaggagaggacccggcaguuagaagugcuggcucagcagaucgccacucuuugcgcgacauugcaagaguauccugcaauacgcuacagaaagggcccagaagauaccgcccagcuggcucacgccguccuagcaaagcucaacgcuuucaaagccgacacgccgucucugggugaggggcccgaaaagacuaggagccagcuucugauuauggaucgggcggccgacccuguguccccauugcuccaugagcugaccuuucaggcaauggcuuaugauuuacuggacaucgagcaagauacauaccgcuacgaaacuaccggacucucagaggcccgagaaaaagcuguacuucuggacgaggacgaugacuuguggguugaacuaagacacaugcacauugccgaugugaguaagaaagucacagagcugcucaggaccuucugugagagcaagcggcugacgacugacaaagcaaauaucaaggaucuuucucagauccugaagaaaaugccccaguaucagaaggaauugaacaaauacuccacacaucuccaccuggccgacgauugcaugaagcauuuuaaaggcucaguggagaaguuauguagcguggaacaagaccuggcuaugggcagugaugcggagggggaaaagauuaaagacucuaugaagcuaauagucccuguucuccuggaugcagccgugccagcuuaugacaaaauccguguacuuuugcuguacauucuccugcgcaauggaguguccgaggagaaccuugccaagcugauccagcacgcaaauguccaggcccacagcucguugauaagaaaccucgaacaacuggguggcaccgugacuaaucccgggggaucuggcacauccucaagguuagagccgcgggaacgaauggagccuaccuaucagcugagucgcuggacgcccguuauuaaagacgugauggaggaugcugucgaagacagacuagauaggaaccucuggccauucgugagcgacccugcccccaccgcauccucucaggcggcuguaagcgcccgguuuggucauuggcacaagaauaaggcagggaucgaggcccgcgcuggaccaagacugaucguuuacgugaugggcggcgucgccaugucagaaaugagggcagcuuaugaggugacacgugccacugaagggaaaugggagguccuuauuggaaguucccauaucuugacccccacacgguuccuggaugaccucaaggcgcuggauaaaaaguuagaggacauugcccugccuuga

SEQ ID NO: 63381 - RNA, 1662 nt, Artificial Sequence
  derived and/or modified sequence opt3 from STXBP4__Homo_sapiens__NP_848604
augaacaagaauaccagcacaguggucucccccucucugcucgagaaagacccugccuuccagaugaucacuauugcuaaggaaacgggccuugggcugaaaguuuugggagguauaaacagaaaugagggcccauuaguguacauccaagaaauuauccccgggggagauugcuauaaggacggcaggcugaaacccggugaucagcuaguaucagugaacaaggagaguaugauuggggucagcuuugaagaggcaaaguccaucauaaccggagccaaacuccggcuggagucugcgugggaaaucgcuuucauucgccagaagucggacaauauccagccugagaaccuuucauguacaagccugauugaagccaguggcgaguacggcccacaagcauccacuuugucucucuuuagcuccccgccugagauccugauaccaaaaaccucaaguacacccaagaccaauaacgauauucugagcucuugcgaaaucaaaacuggguauaauaagacagugcagauuccuaucaccuccgagaacucaacgguuggacucagcaauacugacguggccagugcuuggaccgaaaacuacgguuuacaggagaagaucucucugaauccauccguccgauucaaagcagaaaaacuugagauggccuugaacuaucugggcauucagccgacaaaggagcaacaccaggcucuacgucaacaggugcaggccgauagcaaggggacuguaucguuuggagacuucguucagguggcgagaaaucucuuuugucugcagcuugaugaagucaacgugggcgcacaugagauaucuaacauccuggacucccaauugcuccccugcgauucaagugaagccgacgagauggaaaggcugaaaugugagcgggaugacgcuuuaaaggaggugaauacccugaaagaaaagcuccuugagagcgacaagcagcgcaaacagcugacagaagaguugcagaacgucaagcaagaagccaaagcaguuguggaggagaccagagcucuaaggucccggauucaccuggccgaagcggcccagcgccaggcacaugguauggagauggauuacgaagagguaauccgacuccuggaggcuaagauaacggaacuuaaagcccagcuggcugacuauucugaucaaaauaaggagagcgugcaggacuugaagaaaagaauuaugguccucgauugccagcugaggaagucagaaauggcccggaaaacuuucgaggcaaguacagaaaaguuacugcacuuuguggaggccauccaggagguuuucuccgacaacagcaccccucuaucuaaucucucagaacgucgcgcugugcuggcgagucaaacuagccuuacaccauuggggagaaacggaagguccauccccgcaacccuggcccucgagucuaaagaacuggucaagucggugcgggcucugcuugauauggacuguuugccuuacggcugggaggaagccuacacggcagauggcauuaaguauuuuaucaaucauguaacccagacaacuagcuggauucacccaguuauguccgugcucaaccugucacgaagugaggagaaugaagaggacugcucucgcgaauuacccaaccagaaaagcuga

SEQ ID NO: 63382 - RNA, 3456 nt, Artificial Sequence
  derived and/or modified sequence opt3 from STXBP5__Homo_sapiens__NP_001121187
augagaaaguucaacaucaggaaagugcuggacggccucaccgccgggagcuccucugcuucacagcaacagcagcagcaacaucccccuggaaaucgggagccagaaauucaggagacacuucagagugaacacuuucagcugugcaagacuguccgccacgguuucccguaccaacccagcgcauuggccuuugauccuguucagaaaauauuagcggugggcacgcagaccggggcucugcgacuauucggacguccaggcguagaguguuauugccagcaugacuccggugccgcagugauccaacuccaguuucugauuaacgaaggggcccuugucucugcucuggcagaugacacauugcaccucuggaaucugagacagaagaggcccgccauccugcauucgcucaaauucugucgggagcgcgugacuuuuugccacuuaccuuuccaaucaaaguggcuguacguuggaaccgagagaggcaacauucacaucgugaaugucgaauccuuuacacuuaguggcuaugugauaauguggaacaaggcuaucgaguuguccucuaaaagccauccagggcccguaguucacauuuccgauaauccuauggacgaaggaaagcugcuaaucgguuucgagucaggcaccgugguccucugggaucugaaaaguaagaaagccgacuacagguauacuuacgaugaggcgauucauagcguggcauggcaccacgaagggaagcaguuuaucuguucucauuccgacggaacacuuaccauauggaacgugcggucaccagccaagccgguccagacgauuacuccccacggcaaacagcugaaggaugguaaaaagccugagccaugcaaacccaucuugaagguugaguucaaaaccacacgcagcggggagccuuuuauuauccucaguggaggccugucuuaugacacugugggccgaagaccauguuuaaccguaaugcaugggaaguccacagcugugcuggaaauggauuacagcaucgucgacuuccucacccuuugcgagacgcccuacccgaaugacuuccaagagccuuaugccgugguugugcuguuggaaaaggaucuaguccugauugaccucgcacagaacggauaccccauauuugagaauccauauccucugucgauccacgaaucucccgugacuuguugcgaguacuucgcugauuguccaguagaccuuauucccgcccuguauuccguuggugcgaggcagaaacggcagggcuacucaaagaaagaauggccuaucaacgggggaaauuggggcuugggugcccaaaguuauccagagauaauuaucacagggcaugcagauggcagcgugaaguuuugggacgcuuccgccaucacccuccagguccuguacaaauuaaagacuucuaagguguucgagaaaagccguaacaaggaugaccgcccgaauacagauauugucgacgaagaucccuacgcuauccagauuauaucauggugcccugagaguagaaugcugugcaucgccggaguguccgcacacguuauuaucuauagguuuagcaaacaggaagugaucaccgagguaauuccaaugcuagaaguccggcuccuguacgagauaaacgacguggagacgcccgaaggcgagcaaccuccaccccuuccgaccccuguugggggaucuaacccacagcccaucccuccccagucacacccaaguacaagcuccucuucgagcgacgguuugcgagauaaugugccuugucugaaggucaaaaacagcccccucaagcagucaccaggcuaucaaacugaacuggugauucagcuuguaugggugggaggggagccgccucagcaaaucaccagucuggccguuaauucuagcuacggcuuggucguguucgguaacugcaaugggauugcuaugguggacuaucuccagaaggcgguccuguuaaaccugggcacaaucgagcuauacggauccaaugaucccuaucgcagagaaccaaggucaccccggaaaagccgccagccuucuggcgcagggcucugugacauauccgagggaacuguugugccagaagauagaugcaagagucccaccagcgguucuuccucaccucauaacagugacgaugagcagaaaaugaauaacuuuaucgaaaaggugaaaacaaagagcaggaaguucucgaaaaugguagccaaugacauugcuaagaugucccguaaacugucucuuccgaccgauuugaagccagaccuggaugucaaagacaacagcuuuucacggagucgauccucuagcgugacuuccaucgauaaggagucaagagaggccauuagcgcacuccacuucugugaaacguuuacaaggaaaaccgacaguucucccuccccuugccuguggguuggcacuaccuuagggacagugcuggucaucgcccuuaauuugccacccggaggcgagcaacgccuccugcagccugugauaguuagcccgucggguaccauucuacggcugaagggggcuauccucagaauggccuuccuggacacuacaggcugucuuauucccccagcauacgaaccuuggagggagcauaacgugcccgaagagaaggaugagaaagaaaaguugaaaaagcgccgaccaguaucagucucuccuaguuccagccaggagaucucugaaaaucaguacgcggugauaugcagcgagaaacaagcuaaggugaucucccugcccacgcagaacugugccuauaagcagaacauuaccgaaacuucauuugucuuacggggagacaucguugcacucaguaauagcauuugccuggccuguuucugcgcuaacggccacaucaugacauucucucuuccaucccugcguccguugcucgauguguacuaucugccucuaaccaauaugagaauagccaggacauuuugcuucacuaacaaugggcaggcacuguaccucguaucacccaccgagauucaacgccugacguauagucaggagaccugugaaaaccuucaggagauguugggagaacuguuuacaccaguggagacucccgaggcuccuaaucggggcuucuuuaaagguuuauucgggggaggcgcccaaagccucgacagagaagaacuguuuggugaauccucuucgggcaaggcgagcaggucacuugcccagcacaucccagggcccggaggcaucgagggggucaaaggagcugcauccggcgugguuggugaacuggcccgagcucgccuagcccucgaugagcgggggcagaagcugggagacuuggaggaaagaaccgcagcgaugcugaguucugccgagagcuucuccaaacaugcucacgaaauuauguuaaaguacaaggauaaaaagugguaucaguuuuga

SEQ ID NO: 63383 - RNA, 3561 nt, Artificial Sequence
  derived and/or modified sequence opt3 from STXBP5L__Homo_sapiens__NP_055795
augaagaaauucaacuuuagaaaggugcuggacggccucaccgccagcucccccgggucuggaucaaguagcgguuccaauucuggcgggggagcuggcucggguucaguccacccugcagggacagccggaguucuuagggaggaaauccaggagacucugacgagcgaauacuuccaaauuugcaaaaccgugcggcauggcuuuccacaccagccgacagcguuggcuuucgaucccguacagaagauauuagccaucggcacucgcaccggggcaauucgaauccugggacguccugguguggacuguuauugccagcaugagaguggcgccgcuguccuacaacuccaguuucugauuaacgaaggggcacuuguguccgccucuagcgaugacacacugcacuuguggaaucucagacagaaaaggccagcuauccugcauucccugaaguucaaccgggagcgcauaaccuacugucaccuccccuuucagucaaagugguuauauguuggaacugagagaggcaauacacacaucgugaacauugaaaguuucauccugagcgguuacgucauuauguggaauaaagccaucgagcuuucuaccaagacgcauccugggccagugguacacuuguccgauucacccagggacgaaggaaaacugcuaauaggcuaugagaacggcacuguuguguuuugggaucucaagagcaaacgggcggagcugcgcgucuacuaugacgaagcaauucauaguaucgauuggcaccacgaggggaagcaauucaugugcucucauuccgacggaagccuuacccuguggaauuugaagucgccuucucgaccauuucagacaacuauuccgcacgguaaaucccagagagaaggcaggaagucagagaguuguaaacccauccucaagguggaauacaaaaccugcaagaacagcgagccuuucaucauuuucuccgggggacugucuuacgauaaagccugucggcguccaaguuuaacaauaaugcauggcaaggcuaucaccgugcuggagauggaccaccccauugucgaauuucucacgcuuugcgagacuccuuauccaaaugaguuccaggagcccuacgccguugugguacuguuggaaaaggaucuaaucguggucgaccugacacaaucaaacuuuccgauauucgagaauccuuaucccauggacauucaugagaguccagugaccuguacugcauacuuugcugauugcccucccgaccucauccugguucuuuauuccaucggugugaaacacaagaaacagggguacagcaacaaggaauggccaauuucuggcggagccuggaaucugggcgcgcagacauaucccgagaucauuauaaccgggcacgccgauggaucaaucaaauucugggacgcaagugcuauuacguugcaaaugcucuacaagcugaagaccagcaaagucuuugaaaagcagaaagugggugagggcaagcagacaugugaaaucguagaggaggauccuuucgccauccagaugauuuacuggugcccagaaucccgcauauuuugcguuucuggggugucggcuuaugucaucauuuacaaauucagcagacaugagaucacuaccgaaauuguguccuuagaggucaggcugcaauaugacguggaggauaucauaacaccggaacccgagacuucaccuccauuucccgaccuaagugcccagcucccuucuagccggucccugucaggaagcaccaacacaguugcaucugaaggcgugaccaaggauuccaucccaugucuuaacguaaagacucgacccguccgcaugccgccugguuaccaggccgaguuggugauucagcugguuuggguggacggggaaccaccccaacagaucacgagucucgcugucagcucugcguauggcauuguggcauucggaaauugcaacggccuggccguaguggauuuuauccagaaaacaguucuucuguccauggggaccauagacuuguacagaucaagugaccucuaucagaggcaaccucggagcccccgcaagaauaaacaguucauugcugauaacuuuuguaugagaggacugucgaauuucuacccagacuuaacuaagaggauccguaccuccuaccagucucugacagagcuaaacgauagcccugucccccucgagcuggaacggugcaaaucaccaaccagugaccacgugaauggucauuguacuuccccgacaucucagagcugcuccucaggcaagcgacuuagcagugccgaugugucuaaggucaacagaugggggccuggaaggcccccauuccgcaaagcacaauccgccgcuuguauggagauuagcuugcccguuacgaccgaagagaaucgggaaaacucguauaauagaucaaggucuaguuccaucagcucuauagacaaggauagcaaagaggccaucacugcacuguacuuuauggacuccuucgcgcgcaagaacgauucaacaauuaguccuugccucuuugugggcaccagccuggguaugguguuaaucauuucucugaaucuuccauuggcugacgagcagcgauucacagaacccguaaugguccucccuuccgggacuuuucugucacuaaaaggcgccgugcugaccuucaguuguauggaucggaugggaggccucaugcagccgccauaugagguuuggcgugaccccaacaauaucgaugaaaacgaaaagagcuggagaaggaaaguggucaugaacuccucuucggcaagccaagaaauaggggaccaccaguacacgauuaucugcucagagaagcaggccaagguguuuucccugccuagucagaccugucuuuauguucacaauaucacagagacuucuuucauuuugcaagcuaacgugguagucaugugcagcuccgccugccuggcauguuuuugcgcuaauggacauaucaugauuaugucauuaccaucucuccgccccaugcuggacgugaacuaccuuccucugaccgauaugcggauagccagaacauucuguuuuacuaaugaaggccaggcguuguaucucgugagcccgaccgagauccagaggcugacguacagucaggaaaugugcgacaaccuacaagauaugcugggugaccucuucacacccauugagaccccagaggcccagaaucgaggguuucugaaaggacuuuucggcgguuccggccagacuuucgaucgcgaagaguuguuuggggaagcuagcgcaggaaaggccucucggucacuggcucagcacaucccuggccccggguccauugagggaaugaaaggcgccgcggguggggucaugggagaauuaacaagagcaaggaucgcccucgacgagcguggccaacgccugggugagcuugaagagaagaccgcuggcaugaugacuagcgccgaagcauucagcaaacaugcucacgagcugaugcuaaaguacaaggauaaaaagugguaucaguuuuga

SEQ ID NO: 63384 - RNA, 633 nt, Artificial Sequence
  derived and/or modified sequence opt3 from STXBP6__Homo_sapiens__NP_001291406
augagcgccaaguccgcuaucucuaaagagauuuucgcaccccuggacgaaagaaugcucggcgccgugcaggucaagaggcggaccaaaaagaaaauaccuuuucuugcgacagggggacaaggugaguaccugacuuauaucugcuugucaguuacgaacaagaagccaacccaggcuaguauuacaaaagugaagcaguucgaaggcagcacuuccuuuguacgccgaucucaguggauguuagagcaacugcgucaggugaaugggaucgauccgaacggagacucggccgaguucgaucuacucuuugaaaaugcauucgaccagugggucgccucaaccgcuagcgagaaauguacauuuuuccagauucugcaccauaccugccaaagauaccuuacugauaggaagcccgaauuuaucaacugucagaguaaaauaaugggcgguaauuccauccugcacucugcagccgacagcgugacauccgcuguucagaaggccucacaggcguugaacgagcggggagaacgccucgggagagcagaggagaagaccgaagaucugaaaaauagugcccaacaguucgcugagacggcccauaagcuggcaaugaaacacaagugcuga

SEQ ID NO: 63385 - RNA, 1269 nt, Artificial Sequence
  derived and/or modified sequence opt3 from STYK1__Homo_sapiens__XP_005253474
augggcaugaccagaaugcugcucgagugcagccuuuccgacaagcugugugugauccaggaaaaacaauacgaggucauuauaguucccacauuguuagugacuaucuuccugauucuacucgggguaauccuguggcuuuuuauuagggaacagcggacgcagcagcaacgcucuggaccucaggguaucgccccagugccgcccccucgagaucugucaugggaggcuggccacgggggaaacgucgcauugccacucaaggaaaccaguguggagaauuuccugggcgccacaacucccgcgcuggcuaaacuccagguuccucgugagcaguuaagcgaagugcuggagcaaauaugcuccgguucuugugggccaaucuuuagagccaacaugaauaccggagaccccucgaagccuaaaucagucauucuuaaggcauugaaggaaccagccggccugcaugaggugcaggauuuccuaggcaggauccaguuucaccaguaucucgggaaacauaagaaccugguacaacuugagggaugcuguacagaaaaacugccguuguacaugguucucgaggacguggcucagggugaucugcugagcuuccuguggaccugccggcgcgacgucaugacuauggauggccuccuuuaugaccugacagaaaaacagguguaccacauugggaagcaaguguugcuagcacuggaguuucuccaggaaaagcaucuguuccacggagaugucgccgcuagaaauauccuuaugcagagugaccugaccgccaaguuguguggccucggucuggcguaugagguuuacacgaggggagcaauauccucuacucagaccauucccuuaaaauggcuggccccugagcggcuacuccugcgcccagcuagcauccgagccgaugugugguccuuugggauucuuuuguaugaaaugguaacacugggcgcacccccuuacccagaggugcccccgacuucaauccucgaacacuuacaaagaaggaagaucaugaaacggccuaguagcugcacccauacaauguacucuauuaugaaguccuguuggcguuggcgcgaggcugacagacccucaccaagggaacuucggcugcgauuggaggccgcgauaaaaaccgccgaugacgaggcaguccuccaggugccugaacugguugugcccgaguuauaugcugccgucgcuggcauccgcguggaaagccuguucuacaacuauaguaugcuauga

SEQ ID NO: 63386 - RNA, 672 nt, Artificial Sequence
  derived and/or modified sequence opt3 from STYX__Homo_sapiens__NP_001124173
auggaggacgugaagcuggaguuccccagccucccucagugcaaagaagaugccgaagaguggaccuacccaaugagaagggaaaugcaagagauccuuccgggccuguuuuuggggcccuauuccucugcuaugaagucaaaauuaccuguccugcagaagcacggaauuacacauauaaucuguauucggcagaacaucgaggcaaauuucauuaaaccaaacuuucagcaacuauuccgcuaccucguucuggacaucgccgauaaucccguggaaaacauaauccgauuuuucccuaugacuaaggaguuuauugacgguagucuucagaugggcgggaagguacuggugcacggaaaugcgggcaucagccguuccgcugccuucgucauugcauauaucauggaaacguuugguaugaaauacagagaugccuucgcuuaugugcaggagaggcgguuuugcauaaacccaaaugcaggguucguucaucaguugcaagaguacgaagccauuuaucucgcuaagcugaccauccagaugaugucuccccugcagauugagcgcucgcucucagugcacagcggaacaacuggcaguuuaaaaagaacccaugaagaggaagacgauuuuggcacaaugcaggucgccaccgcgcaaaacggguga

SEQ ID NO: 63387 - RNA, 384 nt, Artificial Sequence
  derived and/or modified sequence opt3 from SUB1__Homo_sapiens__NP_006704
augcccaagagcaaagagcugguguccucuucaaguagcggcuccgacucugauucggaagucgacaagaaacucaagaggaaaaagcagguugccccugagaagccagugaaaaagcagaaaaccggggaaacaucaagagcucuuagcaguuccaagcaaucuagcuccucacgggaugacaacauguuccagaucggaaaaaugcgcuacguaagugugcgagauuuuaaggguaagguccugauugacauacgugaguauuggauggauccggaaggcgagaugaaacccgggagaaagggaaucagcuugaauccugagcaguggucucaauuaaaagaacagauuuccgacaucgaugacgcagugaggaagcuguga

SEQ ID NO: 63388 - RNA, 1392 nt, Artificial Sequence
  derived and/or modified sequence opt3 from SUCLA2__Homo_sapiens__NP_003841
auggccgcuagcauguucuacggcagacugguggcagucgccacccucaggaaccaccggccccgcacagcgcagcgagcugccgcacaaguucuuggguccucuggacuguuuaauaaccaugguuuacaggugcagcagcaacagcagcguaauuugucacugcacgaguauaugaguauggaacuacuccaggaggccggcguaagcgugccuaagggguacgucgcuaaauccccagacgaagcauaugccaucgcuaagaaacugggaucuaaggaugugguuauuaaagcccaagugcuugcgggcgguagagggaagggaacuuucgagucgggccugaagggcggggucaaaauaguguuuucaccggaagaggcaaaggccguaagcagucagaugaucgguaaaaaguuguucacgaaacagaccggagagaagggcaggauuugcaaccagguucucgugugugaacggaaguacccccgcagagaguauuacuuugcuaucacaauggaaagguccuuccaagggccuguccugauuggaucuagccauggcggugugaauaucgaggacguggccgcagaguccccagaagcuauaaucaaagagcccauugauaucgaagaggggauuaagaaagaacaggcccugcagcucgcgcaaaagaugggauuuccuccaaacaucgucgagucagccgcagagaauaugguuaaauuauauagucuguuccuuaaguacgacgcuacuaugauagaaauuaaccccaugguggaggauagcgacggcgccguauugugcauggaugcuaaaaucaauuuugacucuaacuccgccuaccggcagaagaagauuuucgaucugcaggacuggacccaggaagaugagcgcgacaaagaugcagccaaggcuaaucuaaacuauaucggccucgacgggaauaucggaugucuggugaacggugcgggccuugcaauggccacaauggacauuauaaaacugcacgggggaaccccugcuaacuuuuuggaugucggcgguggggccacugugcaucaaguuacagaagcauucaagcucaucaccucagacaaaaaggugcuggccauuuuagucaauaucuuuggcggaauaaugcgaugcgaugugauugcucagggcaucguaauggccguuaaggaccuggagaucaaaauuccaguggucgugagacuccaggggacgagggucgaugacgcaaaggcgcuuaucgcugauagcggacugaaaauuuuggccugugacgaucuagacgaggcagcccggauggugguuaagcugagugaaauagugacucucgcuaaacaggcccacguagaugucaaguuccaacugccgaucuga

SEQ ID NO: 63389 - RNA, 1041 nt, Artificial Sequence
  derived and/or modified sequence opt3 from SUCLG1__Homo_sapiens__NP_003840
augaccgccacacuggcugcagccgcggacaucgcuacuauggugagcggcuccucugggcucgccgcagccagacuucugucaaggaguuucuuguuaccccagaacgguauucggcacugcagcuacacggcuucccgccaacaucuguaugucgauaagaauaccaaaauaaucugucagggauucacaggcaagcaggggacuuuccacucucagcaagcacuagaguacggaaccaaacucguuggcgguacaaccccugggaagggaggccagacucaucugggccuuccaguguuuaacacaguaaaagaagccaaggagcagaccggggcuacggccucggugauuuaugucccgcccccuuucgcggcagccgcuaucaaugaagccauugaggcagaaaucccacuggugguuugcauaacugagggaaucccccagcaagacauggugcgagucaagcacaaauugcuccgucaggagaagaccagacugauugguccuaacuguccaggcgugaucaaucccggggaaugcaaaauuggaaucaugccuggccauauacacaagaaagguaggauugggaucguaucacggagcggaacacugacuuacgaggcuguucaccagaccacacaggugggccucggccaaaguuuaugugucgggauuggaggugauccauuuaacggcaccgacuucaucgauugccuggaaaucuuucuuaaugacuccgccacggaggggauuauauugaucggagagauuggcgguaacgcggaagagaaugccgcagaauuucugaagcagcauaacucugggccgaauagcaagcccgugguguccuucaucgcuggccuaacugccccuccaggacgcagaaugggccacgcuggggccauaauugcaggagguaaaggcggggccaaggagaaaaucucagcucuccagagugcgggagucguugugagcaugucucccgcacaacugggcacaaccaucuauaaggaauuugagaaaaggaagaugcuuuga

SEQ ID NO: 63390 - RNA, 1323 nt, Artificial Sequence
  derived and/or modified sequence opt3 from SUCLG2__Homo_sapiens__NP_001171070
auggccagccccguggcugcacaggccggcaagcugcucagagcgcuugcucugaggccucgguucuuggccgcagggucccaagccguccaguuaaccucucgccgauggcugaaccuacaggaguaccagaguaaaaagcucaugucagacaauggaguucgugugcaaagauuuuucguagcugauacagcaaacgaagcccuggaggcugccaaaaggcuuaaugcgaaggaaaucgugcugaaagcacagauuuuggccgguggccgggggaagggagucuuuaacagcggccucaaggguggggugcaccugacuaaagacccaaauguugugggacagcuggcuaagcagaugauaggcuauaaccucgccacgaaacaaaccccgaaggagggcgucaaagugaauaagguaaugguugcagaggcuuuagauaucucccgcgaaacauaccuggccauucuuauggacagaucuugcaacgggcccguguuggucggaucgccucaggguggcguggauaucgaggaaguggcggccucaaauccagagcugauuuucaaggaacagaucgacauauuugaggggaucaaagauagccaggcacaaaggauggcugagaaccuaggauucgucggcccccucaagagucaggccgcugaccagauuacuaaacuguauaaucuuuuucugaagaucgaugccacccaaguugaagugaacccuuucggugagacaccagaagggcagguaguguguuuugacgcaaaaauuaauuucgaugacaacgccgaguuucggcagaaggauaucuucgcuauggacgacaaauccgaaaaugagcccauagagaacgaagcggcaaaguacgauuugaaguauauuggacucgacggcaacaucgccugcuuugucaauggcgcugggcuggccauggcaaccugugauauuaucuucuuaaacggagguaaaccugccaauuuccuggaccucggcgggggagugaaggaggcucagguuuaccaagccuuuaaacuucugacugcagauccaaagguggaagcgaucuuggucaacauuuucggcgguauagugaauugcgcuaucauugccaacgggaucacaaaagcaugucgcgagcuagaacugaagguaccgcucguugugcgacuggagggcaccuuuauggagaagaaaggaucuuauaugcauauaaagcaggaaacgggcaauagcaacgagaauauuacugggauccaggaaaacgucgcccaccagaaucuuuccaaaugcgcuaucucaauuuuccuguguuga

SEQ ID NO: 63391 - RNA, 1005 nt, Artificial Sequence
  derived and/or modified sequence opt3 from SUCNR1__Homo_sapiens__NP_149039
augcugggcaucauggccuggaacgcuaccugcaagaauuggcucgcagccgaggcggcucuugaaaaauacuaucugagcauuuucuacgggauagaguuuguggucggaguuuuggguaacacaaucgugguauauggcuacauuuucuccuuaaagaauuggaacucuucaaauaucuaucuguuuaaccuaagugugagcgaccucgccuuccuguguacucuucccaugcugauuagauccuacgcaaaugggaacuggaucuauggagaugucuugugcauaucuaauagguacgugcuccacgccaaccuguacacgucgauccuguuucucaccuucauuucaaucgaccgguauuuaauuaucaaauacccuuuucgcgaacaucugcuucagaagaaagaguucgcuauauugauuagccuggcaaucuggguucuagugacacucgaacugcuuccaauucugccguugaucaaucccgucaucacugauaacggcaccacauguaaugacuuugccaguuccggugauccuaacuauaaucucauuuacucuaugugccugaccuuacugggguuccucauaccacuuuuugugauguguuucuuuuauuacaagaucgcucuguucuugaagcaacgaaaccgucagguagccacugcgcuaccccuggagaaaccucucaaccugguuauuauggcaguggucaucuucagcgugcuuuuuacaccauaucacgugaugagaaaugucaggauagccucccggcugggaucauggaagcaguaccagugcacccaaguugugauuaacaguuucuacaucguaacgcgccccuuggcuuuucucaauagcgugaucaacccugucuucuauuuucuguuaggcgaccauuucagagauaugcugaugaaucagcuaaggcacaacuuuaaaucucucacuuccuucucacggugggcccaugagcugcuuuugagcuuucgcgaaaaguga

SEQ ID NO: 63392 - RNA, 3765 nt, Artificial Sequence
  derived and/or modified sequence opt3 from SUCO__Homo_sapiens__NP_055098
augaagaaacacagaagggcccuggcucucgugagcugccuuuuccuguguuccuuggucugguuacccucuuggcggguuugcuguaaggagucaaguagcgcauccgccucuucguacuauucacaggacgauaacugcgcgcuggaaaaugaggacgugcaauuucagaaaaaggaugaacgcgagggcccuaucaacgcugaaagccuagggaaaaguggauccaaucucccaauuucuccgaaggagcauaagcugaaagacgauagcauaguagacgugcagaacaccgaguccaagaaacuuucacccccugucguggaaacacugccaacuguugauuugcacgaggaaaguagcaaugccguggucgacucugagacgguggagaacaucuccucaagcaguaccucugaaauuacacccaucuccaagcucgaugagauugagaaaagcgguacuaucccuauagcaaagccaucggagaccgaacagucugagacagacugugauguaggcgaggcccuggacgcuuccgcacccaucgaacaaccuucauucguuaguccaccggauagccugguggggcagcauauugagaaugucuccucuagccacggaaagggcaaaaucaccaagucagaauuugagaguaaaguguccgccagcgaacagggugggggagaccccaagucugcucucaacgccucagacaaucugaaaaacgagaguagcgauuacacuaagccuggcgacauugauccaacauccguggcgucucccaaagacccugaggauaucccaaccuucgacgaauggaagaagaaagucauggagguugaaaaggagaaaucgcagagcaugcaugcauccucaaauggcgggagucacgccacgaagaaagugcaaaagaaccgaaauaacuaugcuucuguagaaugcggagccaagauauuagcagcuaaucccgaggccaaaagcacuuccgcgauucuuaucgagaacauggauuuguacaugcugaacccguguucaaccaagauuugguuugugaucgaacuaugcgagccuauccaggucaaacagcucgacauugccaauuaugaacuguucagcucuacacccaaggauuuucuuguguccauaagugaccguuacccaacuaacaaauggaucaagcuggguaccuuccacggcagagaugagaggaauguucagagcuuuccuuuggacgagcaaauguaugcaaaguacgugaaaauguucauuaaguacaucaaagucgaacuccugucucauuuuggguccgagcacuucugucccuuaucacugauacggguguuuggaacaaguaugguagaagaguaugaagagauugcugacagccaguaccauucggagcgccaggaacucuucgaugaggacuaugauuacccacuugacuauaacaccggcgaagauaaguccucuaaaaaucuguuggguagcgccacgaacgcuauccuaaauaugguuaacaucgccgcaaauauucugggggccaagacugaggaccucacagaaggaaacaagucaaucagugagaaugcuaccgcgacugcagcccccaaaaugccugaguccacaccagugucuaccccgguccccagcccugaauacgugacgaccgagguccacacacacgauauggaaccauccacucccgacaccccuaaggagucaccaauugugcaacugguucaggaagaggaggaagaggcuagccccaguacagugacucuucugggcucuggcgaacaggaggaugaguccagcccgugguucgaaucggagacccagauauuuugcucagaauugacaaccaucuguugcauuucuaguuucuccgaguauaucuacaaauggugcagcguaagagucgcccucuacaggcaacggucucgcacugcacugagcaaggggaaagacuauuuagugcuggcccagccuccacuacuccugcccgcugaauccguugaugugucaguccuucagccuuugaguggagagcuggagaacacgaauaucgaacgagaggccgaaacagugguacucggugaccugucuucuuccaugcaucaggaugaccuugugaaccacaccguugacgcagucgagcuggaacccucacauagucaaacuuugagccagucccuccuguuagauauuaccccagagauaaauccucugcccaagaucgaggugucugaaucgguggaguacgaagcgggccacauuccaagcccggucaucccucaggagucauccguugaaauugacaacgagacagagcagaaaagugaaucuuuuagcuccaucgagaagcccucaauaaccuaugaaacuaacaaggugaaugagcuaauggauaacaucauuaaagaggacgugaauagcaugcaaaucuucacaaagcucagcgaaacgauuguaccacccaucaacaccgcuacugucccugauaaugaggacggggaagccaaaaugaacauagcagauacagccaagcagacccugauuagugugguugacuccagcucucuuccagaggugaaagaagaggagcagucacccgaagaugcuuugcugagaggacuccagaggacagccacugacuuuuacgcagagcugcaaaauuccaccgauuuaggcuaugcuaacgguaaucugguccaugggaguaaccagaaggaaagcguguucaugcggcuuaauaaccguaucaaggccuuggagguuaauaugucgcucucuggccgcuaccuggaagaacuaucccagagauauaggaaacaaauggaggaaaugcagaaggcguuuaacaaaacgauugugaagcugcagaauaccagccggaucgccgaggaacaggaccaacgacagacagaggcuauacagcuccugcaggcacaacuuacuaacaugacccaguugguaucaaaccugagugccacagucgcugaauuaaaacgcgaggugucugauagacaguccuaccucgugaucagccugguccuuuguguugugcugggauugaugcucugcaugcagaggugucggaauacuucacaauucgacggcgacuacauuaguaagcugccuaagagcaaccaguauccguccccaaaacgcugcuuuucuagcuacgaugacaugaaucuaaagagaaggaccuccuucccccugaugcguucaaaaucucuccagcugacggggaaggagguagauccuaacgaccuuuauaucguggaaccauugaaauuuagucccgagaagaagaaaaagcgguguaaauacaagauugagaaaaucgaaacaauaaagccugaggaaccgcugcaccccauugccaauggagauaucaaaggucgaaagccauucaccaaccaaagagacuuuucgaauaugggcgaggucuaucacagcuccuacaaggggccucccucugaaggaucaagcgagacuuccagucagucugaagagagcuauuucugcggcaucucagcauguacauccuuaugcaacggucagagucagaaaaccaagacugagaaaagggcgcucaagcgccggagaagcaaagugcaagaucaggggaagcugauuaagacccuuauccagacaaaaucuggcucccugccaucacuacaugacauuauaaagggaaauaaagaaaucacgguuggcaccuucggggugacugccgucagcggacacauuuga

SEQ ID NO: 63393 - RNA, 987 nt, Artificial Sequence
  derived and/or modified sequence opt3 from SUDS3__Homo_sapiens__NP_071936
augagcgccgcuggccugcucgcacccgccccugcgcaggcuggggccccaccggcacccgaguacuauccugaagaggacgaggaacuugaauccgccgaggaugacgagagaucuugcaggggacgggaaucagaugaggacaccgaagaugcuagugagacagaccuggcaaagcacgaugaggaagacuacguggagaugaaagaacaaauguaucaggauaaguuggccagcuuaaaacgccagcugcagcaacuacaggaggguacucuccaggaauaccagaagcgaaugaaaaagcuggaccaacaguauaaggagcguaucagaaacgcugagcuuuuccugcaguuggaaacggagcaggucgaaaggaauuacauuaaagagaagaaagccgcgguuaaggaauuugaggauaaaaagguggagcucaaggaaaaccugauagcagagcuggaagagaaaaagaaaaugaucgaaaaugagaagcucaccauggaguuaacaggcgacuccauggaaguaaaaccaauuaugacucggaagcugcgcagaaggcccaacgauccugugccaauccccgacaaacggcgcaagccugccccagcucaacuuaauuauuugcugaccgacgagcagauuauggaagaucuacgaacacucaacaagcugaaaucuccgaagagacccgccucgccuucaagcccagagcaucuucccgcaaccccugcugagaguccagcccagagguucgaagcgcggaucgaggacgggaaacuguacuacgauaagcguugguaucacaaaucccaagccauauacuuggaaucuaaggacaaucagaagcucagcugugucaucuccucagugggagcaaacgagauuuggguucgcaaaacaagugauagcacuaagaugagaaucuaucugggccaguuacagaggggucuguuugugauucggcgacgcucugcugccuga

SEQ ID NO: 63394 - RNA, 1302 nt, Artificial Sequence
  derived and/or modified sequence opt3 from SUFU__Homo_sapiens__NP_001171604
auggccgagcugagacccagcggcgcuccugggccaaccgcaccgcccgccccuggaccaacagcgcccccugcuuucgccucccucuuuccacccggucuucacgcaaucuacggcgaaugcaggcggcuguauccugaccagccaaacccguugcaagugacugccauugucaaguacugguuagggggacccgauccucuggacuauguuucuauguaccgcaaugugggcucaccaagugcuaacauacccgagcauuggcacuauaucagcuucggucuauccgaucucuacggggacaaucgaguacaugaauuuacgggaaccgauggcccuucuggcuucggguuugagcugacauuccgucuuaaaagagaaacuggagagucggcaccacccaccuggccggccgagcugaugcaggguuuggcuagguauguguuucagucagaaaacacauucuguagcggcgaccacgucaguuggcauuccccucucgauaauucugagagccggauucagcacaugcugcugaccgaagacccccaaaugcagccagugcagacuccuuuugggguugugacauuccuccagaucgucggagugugcaccgaggaguuacacuccgcccaacaguggaacggccaggguauucuggaacuuuugcgcacgguacccaucgcagggggaccauggcugauaacugauaugagaaggggcgagaccaucuuugaaauugacccccaucuacaggagcggguugauaagggcaucgaaacagacgggucaaaucucaguggagugagcgcgaaaugugccugggaugaccugucucgcccuccagaggacgaugaggacucccgaucaauuugcaucgguacucaaccgagaaggcuuagcggcaaggauaccgaacagauacgggagacacugcgucgcggguuggaaauuaacaguaaacccguccucccuccaaucaauccccagagacaaaacggacuggcucacgacagggccccuucucggaaggauuccuuagagagcgacucgucuaccgcaauuaucccacaugaacugauccgaacgcgccagcucgaguccgugcaccuuaaguucaaucaggagucaggcgcucugauucccuugugucuaagagguaggcugcuccacgggcggcauuuuacuuacaaaaguauaacaggcgauauggccaucaccuucgugagcacuggagucgaaggcgcguucgccacagaggaacacccguacgcagcucaugggccuuggcugcagcuuuga

SEQ ID NO: 63395 - RNA, 1416 nt, Artificial Sequence
  derived and/or modified sequence opt3 from SUGCT__Homo_sapiens__NP_001180240
augcccagcgagacccacgccaugcuggcuacacucgcaagaguggccgcgcuuaggcggacuugccuguucuccggccgcgggggaggucgaggcuuguggacggggcguccucagucugacaugaacaauaucaagccauuagaaggagucaaaauucuggaucuaaccagaguucucgcuggcccguuugccacaaugaaccugggugaccuuggggcagaggugauaaagguagaaaggcccggagccggcgaugacacucggaccuggggcccuccauucguggggacagagucaaccuacuaucugagugucaaucgcaacaaaaagagcaucgcugugaauauuaaagaucccaagggaguuaagaucauuaaagaauuggcagccgugugugacgucuuuguggagaacuacguaccugguaagcucuccgcuaugggccugggguaugaggauaucgacgaaauagccccacauaucauuuacugcucuaucacuggauauggccaaacaggucccauuucgcagagagcgggguacgaugcaguugccucagcugugagcggacugaugcacaucaccggcccugagaauggcgacccagucaggccggggguggccaugacggaucucgcaacuggauuauaugcuuacggugccauaauggcgggccugauucagaaauacaagaccgggaaaggacuuuucaucgacuguaacuugcugaguucccagguggccugccuaucucauauugcagcuaauuaucucaucggccaaaaggaagccaagcggugggguacagcucacgggagcaucguccccuaccaggccuuuaaaacuaaggauggcuauauuguugugggagcaggcaacaaucagcaguucgccaccguauguaaaauacuggaccuuccugagcugaucgacaacuccaaguacaaaacaaaucauuugcgcgugcacaaccgaaaggagcucauuaaaauccugucagaaagauuugaggaagaguuaaccaguaaguggcuguaucucuucgaagggagcggagucccauacggucccauaaauaacaugaagaacguguuugcugagccucaaaaugcgguuucuggcuuccagucccuucugcacucauuggcacaugggccauuucuacaucugcagggaagcgccagggugcuccacaacggccuggucauggagauggaacaccccacgguggguaaaauuaguguaccggggccugcuguucgguauucuaaguucaaaauguccgaggcccgucccccaccucuucugggccagcacacuacacauaucuugaaggaagugcuccgcuacgaugacagagcaaucggagagcuguuaagcgccggcgucguggaucaacacgaaacccauuga

SEQ ID NO: 63396 - RNA, 1938 nt, Artificial Sequence
  derived and/or modified sequence opt3 from SUGP1__Homo_sapiens__NP_757386
augagccugaagauggacaacagagauguggccggcaaagcuaauaggugguucggggucgcacccccuaaguccggaaaaaugaacaugaauauccuccaccaggaggaacuuauugcccaaaagaaacgggagauagaagcgaagauggagcagaaggcuaaacagaaccagguugccucuccacaaccgccccauccuggugaaaucaccaaugcacacaacucaaguugcauuagcaauaaguuugccaacgacggcuccuuccugcagcaguuuuugaaauuacagaaggcucaaacaucuacugaugcaccaacgucggcccccucagcuccuccaagcacccccacaccuagugccgggaaacgcucccugcuaaucucucgacguacuggacucggccuggcgagccuuccagguccggugaaguccuacucacaugcaaagcagcugcccguagcccacagaccuaguguguuccagagcccagacgaggaugaggaagaggacuaugaacagugguuggagauuaaagucucucccccugagggggcugaaaccaggaaggugaucgagaaacucgcccgguuuguugcagaaggaggcccagagcuggaaaagguggcuauggaggauuacaaagacaaucccgccuucgcguuucugcaugauaagaacucccgcgaguuccucuauuacaggaaaaaggucgccgaaauaagaaaggaggcacaaaaaucacaggcugccagccagaaggugaguccgccugaagacgaggaaguuaaaaauuuagcugagaagcuggcccgguuuaucgcagauggcgggcccgagguagaaacaauugcccuucaaaacaaucgcgagaaccaggcuuucucuuuucucuaugaaccaaauucccagggauacaaauauuaccgacagaagcuggaggaguucagaaaggcgaaagcaagcucgaccgguucuuuuacugccccugaccccggccuaaagaggaaauccccacccgaagcucucucagggagucugccuccagccacaaccuguccggcaagcuccacgcccgccccuacuaucauuccagcucccgccgcaccuggaaagccagcgucugcugccaccgugaaacggaagcguaagagccgcuggggccccgaggaagauaaagucgagcuuccgccugcagaacuggugcaaagagacguggacgccucaccaagucccuuguccguccaggaucucaagggucugggguacgagaaaggaaagccuguuggcuuagugggcguaacagagcugagcgacgcucagaaaaagcagcucaaggaacaacaggagaugcagcagauguaugauaugaucaugcaacacaaaagggccaugcaggacaugcagcuucugugggaaaaggcagugcagcaacaccagcauggguacgauucugacgaggaagucgauucagaguugggaacuugggagcaccagcuacggcgaauggaaauggacaaaacccgcgagugggcugaacaacugacaaagauggguagaggcaaacauuucauaggggauuucuugcccccagacgagcuggaaaaguuuauggagaccuucaaagcccuuaaggagggaagggaaccugauuauagugaguacaaggaauuuaaacugacgguggagaacauuggcuaucagauguugaugaagauggguuggaaagaaggggagggccucggaagcgagggccaggggaucaagaaccccguuaauaaaggaacuacaaccguggacggugcgggcuucgggauugaccggccagccgaacuguccaaggaggaugacgaauacgaggcuuuucgcaagagaaugauguuagcauauagguuccguccgaacccucugaauaacccccggcgaccauacuacuga

SEQ ID NO: 63397 - RNA, 1098 nt, Artificial Sequence
  derived and/or modified sequence opt3 from SUGT1__Homo_sapiens__NP_001124384
auggccgcugcagccgcgggcaccgcuacaagccagagauucuuucaauccuucucugacgcccugaucgaugaggacccccaggcagcccucgaggaacuuacuaaggcucuggaacagaaaccugaugacgcacaguacuauugccaaagggccuacugucacauuuuguuagggaacuauugcguggcugucgccgaugcgaagaaaucacuggagcuaaauccaaacaauaguacggcaaugcuccggaagggaauaugugaauaccaugagaaaaacuaugccgcugcccuggagaccuuuacagaaggucagaaacuugacaucgagacuggcuuccaccgcguugggcaggcaggacugcaguugcucaccagcuccgauccgcccgcucuggacucucaaucggccggcauuacaggugcggaugccaauuuuucaguguggaucaagcgaugccaggaagcacagaacgggagcgagagugagguauggacccaucaguccaaaauuaaguacgacugguaucaaacugaaucucagguggucaucacacugaugauaaagaaugugcagaagaacgauguuaauguggaguucagcgaaaaagagcucuccgcuuuagucaagcugccuucaggagaagacuacaaccuuaaguuggagcugcuacacccaaucauucccgagcaaaguaccuuuaaagugcucagcacgaagaucgaaauuaaacugaagaaaccugaggccguacguugggaaaaacuugagggccagggcgauguuccaacucccaagcaguucguggcugacgucaagaaucuguacccuucuuccucaccauauaccagaaacugggacaaguuggugggggaaaucaaagaggaggaaaagaaugagaaacucgaaggagaugccgcacugaacagguuauuucagcaaauauacagcgacgguagugaugaggugaagcgggccaugaauaaaucuuucauggaauccggcgggacaguccugagcacuaacuggucggacguuggaaagcgcaagguggagauuaacccgcccgaugacauggaguggaaaaaguauuga

SEQ ID NO: 63398 - RNA, 2616 nt, Artificial Sequence
  derived and/or modified sequence opt3 from SULF1__Homo_sapiens__NP_055985
augaaguacagcugcugugcccuggugcucgcuguccuuggcaccgagcuguugggguccuuaugcucuacaguuagaucacccagguuccggggacgcauccagcaagaacguaaaaacauucgaccuaauauaauccuggugcuaacugacgaucaggacguagagcucgguagucuucaggugaugaacaagacgagaaaaauuauggaacacggcggggcaaccuuuaucaaugccuucgucacaacuccaauguguugcccgagcagguccucuaugcugaccggaaaguaugugcauaaccacaauguuuacacaaacaaugagaacuguucgucacccagcuggcaggcgaugcaugaaccucggaccuuugcuguguaucugaauaacacuggcuaccgcacagccuucuuugguaaauauuugaaugaguacaacgggaguuauauuccacccggauggagagaguggcucggccugaucaaaaauuccagguucuacaacuacaccgucugccggaauggcauaaaggaaaaacacggguuugauuaugcaaaggacuacuucacggaucugaucacuaacgagucuauuaacuauuuuaaaaugagcaagcgcauguacccucaucgaccagugaugaugguaaucucccacgccgcuccccacggaccugaagacucagcaccacaauucaguaaacucuauccgaaugccagccagcauauuacccccucuuacaacuaugcuccuaauauggauaagcacuggaucaugcaguacacagguccaauguuacccauacauauggaguuuacuaacauucugcagagaaagaggcuucaaaccuugauguccguugacgauucaguggagcggcuguacaauaugcuagucgaaacaggcgagcucgaaaacaccuauaucauuuacacggccgaccacggguaucacaucggacaguucggccuggugaaagguaagagcaugccuuacgauuuugacauccgugugccauucuucauucgcgggcccagugucgagccgggaucuauaguuccucagaucgugcuuaauauugaucuggcgcccacuaucuuggacauagcaggccucgacacaccaccugauguagacggcaaauccgugcugaaguuacuggaucccgaaaaaccagggaacagauuuaggaccaauaagaaagccaagauuuggcgggacacuuuccucgucgagcgaggaaaguuucuucgcaaaaaggaggaaagcucgaaaaacauccagcaaucuaaucaucugcccaaguaugagagagugaaagaauugugucagcaggcuagguaccaaacagccugcgagcagccuggucagaaguggcaguguaucgaagauaccuccggcaagcuacggauucacaaaugcaaggggccaucagaccugcucacgguucgccaaaguaccagaaaccuguaugcaaggggauuccaugauaaagacaaggaguguagcugccgugaguccggcuaccgggcuucucgaagccagagaaaaucacagaggcaguuucuucgcaaucaagguacaccgaaguacaagccccgguucgugcacacuagacagaccaggagucuguccgucgaauuugagggggaaaucuaugauauuaacuuggaggaagaggaggaacuccaggugcugcagccucgcaauauagccaaacgacaugacgagggccacaagggaccacgggauuuacaagcgagcucuggcgggaaccguggaagaaugcuggccgacucaaguaacgcaguaggucccccuacaacuguuagggugacccacaaaugcuucauccuaccaaaugacagcauucauugugaacgcgagcucuaccaguccgcucgggccuggaaggaucacaaggcuuauaucgacaaggagaucgaagcccugcaggauaagauuaaaaaccuuagagaggucaggggccauuugaagcgacgcaaacccgaagagugcucuuguucgaagcagagcuacuauaauaaagaaaagggggugaaaaagcaagagaagcugaaaucccaccuccacccguuuaaggaggcagcccaggaagucgacucaaaacugcagcuuuucaaggagaacaaucggagaaggaaaaaggaacguaaggagaaacgccggcaaagaaagggagaagagugcagucugccuggcuugacauguuuuacccaugauaacaaucacuggcagacugcuccauucuggaaccucgguucuuuuugcgcguguacgagcuccaauaacaauacauacuggugccugaggaccgugaacgagacucauaauuucuuauucugugaauuugcaaccggguuccuggaguauuuugacaugaacacagaucccuaccagcuaaccaauacuguucacacaguggaacgaggcauacucaaccagcugcauguacaacuuauggaguugcggucaugccagggauacaaacaguguaacccucgccccaagaaucuggacgucggcaacaaagaugggggaagcuaugaccuccacagaggucagcugugggauggcugggaaggguga

SEQ ID NO: 63399 - RNA, 2613 nt, Artificial Sequence
  derived and/or modified sequence opt3 from SULF2__Homo_sapiens__NP_061325
auggggcccccuagccuggugcucugccuucuguccgccaccgucuucucuuuguuagggggaucaagugcuuuucugagccaccauagacuaaaggguagguuccagcgggaccgccgaaacauccguccaaauauuauacucguucugacagaugaccaagauguggagcuuggcuccaugcagguaaugaacaaaacuagaaggaucauggaacagggcggagcacacuuuauuaaugccuucgugacgaccccgauguguugccccucucggucgucaauccugacaggcaaguacguccauaaccacaauacuuauaccaacaaugagaacuguagcaguccuuccuggcaggcgcaacaugaaucucgcacauuugcuguguacuugaauagcaccgguuauagaacugccuucuuugggaaauaccucaacgaguauaauggauccuacguuccacccggcuggaaggaaugggugggccugcugaaaaacucaagguucuauaauuacacacucugccggaacggggucaaggagaagcacggaagugacuacagcaaagauuauuuaaccgaccugauuacgaaugauucuguguccuuuuuccgcacuucaaagaaaauguacccucaccgaccaguacuuaugguuaucagccaugcagcuccccacgguccugaggacagugccccacaguauucuagauuguuuccgaacgcaucccagcauauaacccccagcuacaacuaugccccuaauccagauaagcacuggaucaugagguacacaggccccaugaaaccuauucacauggaauuuacuaacaugcugcagcggaagcgucuacaaacccucaugucgguggacgauucuauggagacaaucuauaauaugcuggucgaaaccggggagcuugacaacacguacauuguguacacugcugaucauggauaucacaucggccaguuuggucuggugaaggggaaauccaugccauacgaguucgacauacgcguccccuucuauguuagaggaccgaauguggaagccggcuguuugaacccucauauuguacucaauaucgaccuggcgcccacaauuuuagauaucgcaggccuggacaucccagccgauauggacgggaagucaauucucaaacuucuggauaccgagaggccugugaaccgguuucacuugaagaaaaagaugcgagucuggcgcgacaguuuccuaguggaaagaggaaaacugcuccauaagagggauaaugacaagguugaugcucaggaggaaaacuuucugcccaaauaccagcgggugaaggaccuuugccaacgcgccgaguaucagacugcaugugagcagcugggucaaaaauggcagugcgucgaagaugcuacaggcaaguugaaacuccacaaguguaaggggccaaugagacugggaggcagcagggccuuauccaaucuggugcccaaauacuauggucaggggucugaggcgugcaccugugacagcggcgacuacaagcuaucacucgccggacgucggaaaaagcuguucaaaaagaaguacaaagcaaguuauguacgauccagaagcauaaggucuguugcuaucgaaguggauggccgcgucuaccacguggggcuuggagacgccgcucagccucggaacuugacgaagagacauuggccaggugccccggaggaucaagacgauaaagacggcggggauuuuucaggaaccggcggucugcccgacuauagugcagccaauccuauuaaggucacacacaggugcuacauccucgaaaacgauacugugcagugcgaccuggaucuuuauaaaagccugcaggcuuggaaggaccauaaguugcacauagaucacgagauugagacccuccagaauaaaaucaagaaccugcgcgaaguucgagggcaucuuaaaaagaaacggccagaggaaugugacugccacaagaucuccuaccauacacaacacaaaggccgucugaagcauagaggaucuucgcuacaccccuucaggaagggccuccaggagaaagacaagguguggcugcuucgcgaacagaaacggaagaaaaaguugagaaagcugcucaaaaggcugcagaacaaugauacuuguagcaugccuggguuaaccugcuuuacacacgacaaccaacauuggcagaccgcgccauucuggacucugggacccuuuugugcaugcacguccgccaauaacaauacauauugguguaugcgaaccauuaacgagacucacaauuucuuauuuugcgaguucgcuaccgguuucuuggaauacuucgaucucaacacagacccguaccagcugaugaaugccguaaacacccuagaucgcgacguccugaaucagcuccaugugcaacugauggagcuucggucauguaagggcuauaaacagugcaacccuagaacuaggaauauggauuuggggcugaaggacggaggcaguuacgaacaguaucgucaauuccagcgccggaaauggccagagaugaagagacccucuagcaaguccuuaggucagcucugggaggggugggaaggcuga

SEQ ID NO: 63400 - RNA, 888 nt, Artificial Sequence
  derived and/or modified sequence opt3 from SULT1A1__Homo_sapiens__NP_803878
auggagcugauccaggacaccagcagacccccucucgaauacgugaagggcgucccacuuauuaaauauuucgccgaggcucuggggccguugcaauccuuucaggcaaggcccgaugacuuacugauaucuacauacccuaagucaggaacuacguggguuagucagauccuagauaugauuuaucaggguggcgaccucgaaaaaugccaccgggccccaaucuucaugcgcgugcccuuucuggaguucaaggcgccugggauuccaagcggaauggaaacccuuaaagauacacccgcuccucgacuguugaagacucaucucccacuggcccugcucccgcaaaccuuacuggaccagaagguaaaaguggucuacguggcacguaacgccaaggauguugcuguguccuauuaccacuuuuaucauauggcaaaaguccaccccgagccuggcacaugggacucuuuccuugagaaguuuauggugggugaaguaucguacgggucaugguaccagcauguucaggaguggugggaauugagcagaacccacccagugcuguaucuauucuacgaggauaugaaagagaaucccaagagggaaauccaaaagauacucgaguuugucggacggagucugccugaagagacuguggacuucgugguccagcacacauccuuuaaagaaaugaagaaaaacccaaugaccaauuauacgacuguuccccaggaguucauggaucauucuaucagcccguuuaugcgcaagggcauggccggcgacuggaaaaccacauucacuguggcucagaacgagagauucgaugccgacuacgcggaaaagauggcaggguguucccuuucauuuaggagugagcuguga

SEQ ID NO: 63401 - RNA, 888 nt, Artificial Sequence
  derived and/or modified sequence opt3 from SULT1A2__Homo_sapiens__NP_803564
auggagcugauccaggacauuagcagacccccucucgaauacgugaagggcgucccacuuauaaaauauuucgccgaggcucuggggccguugcaauccuuucaggcaaggcccgaugacuuacugaucucuaccuacccuaagucaggaacaacuuggguuagucagauucuagauaugaucuaucaggguggcgaccucgaaaaaugccaccgggccccaauuuucaugcgcgugcccuuucuggaguucaagguaccugggaucccaagcggaauggaaacgcuuaaaaacacccccgcgccucgacuguugaagacacaucucccacuggcucugcucccgcaaacuuuacuggaucagaaggugaaagucguguacguugcccguaaugcaaaggacguggccgucuccuauuaccacuuuuaucauauggcuaaaguguacccccacccuggcaccugggagucuuuccuugagaaguuuauggccggugaaguaucguacgggucaugguaucagcauguucaggaguggugggaauugagcagaacacacccagugcuguaccuauucuaugaggauaugaaagagaaccccaagagggaaauacaaaagauccucgaguuugucggacggagucugccugaagagaccguggaccuuaugguggaacacacuuccuucaaagagaugaagaaaaauccaaugacaaacuacaccacgguccgcagagaguuuauggaucauucuauuagccccuucaugaggaagggcauggcaggcgacuggaaaacuaccuuuacaguugcucagaaugaacgguucgaugccgacuaugcggagaagauggcaggguguucccugucauuccgcagugaauuguga

SEQ ID NO: 63402 - RNA, 888 nt, Artificial Sequence
  derived and/or modified sequence opt3 from SULT1A4__Homo_sapiens__NP_001017390
auggagcugauccaggacaccagcagacccccucucgaauacgugaagggcgucccacuuauuaaauauuucgccgaggcucuggggccguugcaauccuuucaggcaaggcccgaugacuuacugauaaacacauacccuaagucuggaacuacguggguuucacagauccuagauaugauuuaucaggguggcgaccucgaaaaaugcaaucgggccccaaucuacgugcgcguacccuuccuggaggugaacgauccuggggaaccaaguggacuugagacccugaaggacacacccccuccacgauugauuaaaagccaccucccgcuggcgcugcucccccaaacuuuacuggaucagaaggucaaggugguuuauguggcucguaauccuaaagacgucgccguguccuacuaucauuuucacagaauggagaaggcacauccagaacccggcaccugggauucuuuccuugagaaauuuauggccggugaaguaucguacgggucaugguaccagcacguucaggaguggugggaguugagcaggacacauccugugcuguaucuauucuacgaagacaugaaggagaacccaaaacgggaaauccaaaagauacucgaguuugucggacgcagucugcccgaagagaccauggauuucauggugcagcacacuuccuuuaaggagaugaaaaagaauccgaugacaaacuauaccacggugccucaggaacuuauggaccacucuaucagccccuucaugagaaaaggcauggcuggcgauuggaagacuaccuuuacagucgcacagaaugagagguucgacgccgacuacgcugagaaaauggccggguguucccugucauuucggagugaauuguga

SEQ ID NO: 63403 - RNA, 891 nt, Artificial Sequence
  derived and/or modified sequence opt3 from SULT1B1__Homo_sapiens__NP_055280
augcugagccccaaggacauccucagaaaagaucuuaagcuggugcacggcuacccuaugaccugcgccuucgcuuccaacugggagaaaauugaacaguuucauucuaggccagacgauauagucaucgcaacauauccgaagucagggacuacguggguuagugagauuaucgacaugauuuugaaugauggagacaucgaaaaauguaagcgggguuucauaaccgagaaggugcccauguuagaaaugacacugccuggccuacgcacuagcgggaucgagcaacucgagaaaaacccaucuccccgaauuguaaagacccaucugccuacagaucuucugccaaaauccuuuugggaaaauaacugcaagaugaucuacuuggcccguaaugcgaaagacgugucggucucauauuaccacuucgaucucaugaacaaucugcagcccuuuccuggaaccugggaggaauaucuggagaaguuccucacuggcaagguggcuuacgguagcugguuuacacacguuaaaaacugguggaagaaaaaggaggaacauccaauuuuauuccuguauuacgaggacaugaaagaaaauccgaaggaggaaaucaaaaagauaauuagauuucuugagaagaacuugaaugaugagauccuggacaggauuauccaccacaccaguuucgaagugaugaaagauaacccccuagucaauuacacgcaucucccuacuaccgugauggaccacuccaagucuccauuuaugcggaaagggacagccggagacuggaagaacuauuucacuguagcacagaaugagaaauuugaugccaucuacgaaaccgagaugagcaagacagcucugcaguuccgcaccgaaauuuga

SEQ ID NO: 63404 - RNA, 891 nt, Artificial Sequence
  derived and/or modified sequence opt3 from SULT1C2__Homo_sapiens__NP_001047
auggcccugaccagcgaccucggcaagcagaucaaacuuaaggagguggaagggacacuguugcaacccgcuacugucgauaacuggucccagauucagucuuucgaggcaaaaccugacgauuuacugauaugcacguacccaaaggccggaaccacauggauccaggaaauuguugacaugaucgagcaaaauggugauguggaaaaaugucagagagcgauuauccagcacaggcauccguuuauagagugggcucggcccccucagccaucaggcguagagaaggccaaggcaaugcccaguccucgcauccuaaaaacucaccucagcacccaacugcuuccacccuccuucugggaaaacaauugcaaguuucuguauguggcccgaaacgcuaaagacuguauggucucuuacuaucauuuccagcguaugaaucacauguugccugauccagggacaugggaggaauacuuugagaccuucauuaacggaaaggugguuuggggcucgugguuugaccaugugaaagguuggugggagaugaaggauagacaccagauccucuuccuguuuuaugaagacauuaagagggauccgaaacacgagauccggaaggucaugcaguucauggggaaaaagguggacgaaacuguacuggauaaaauaguucaagagacaucauuugaaaagaugaaagagaaucccaugaccaaccgcagcacggugaguaaguccauucucgaccagucuaucagcuccuucaugagaaagggaacugucggcgacuggaaaaaucauuuuaccguggcacagaacgagagguucgaugaaauuuaccggcgcaagauggagggcacaucaaucaauuucugcauggaauuauga

SEQ ID NO: 63405 - RNA, 885 nt, Artificial Sequence
  derived and/or modified sequence opt3 from SULT1E1__Homo_sapiens__NP_005411
augaacagcgagcuggacuacuaugaaaaguucgaggaagugcacggcauccucauguacaaagauuuugucaaguauugggacaauguugaggccuuccaggcuagacccgaugaccuugugauugcaaccuacccuaaauccgggacaacuuggguaucugaaauaguguauaugaucuacaaggagggagaugucgagaaaugcaaggaagacgugauuuuuaacaggaucccauuccuggagugucggaaggaaaauuugaugaacgguguuaaacaauuagaugagaugaacucaccgcgcauugugaagacgcaucugcccccugagcuacucccagccaguuuuugggaaaaagacugcaagaucauauaucugugucgaaaugcgaaagaugucgcugugagcuucuacuacuuuuuccuuaugguagccggccaccccaauccuggguccuuuccagaguucguugaaaaguuuaugcagggacaggugcccuauggcucuugguacaagcaugucaaaucguggugggagaaggguaaaucaccucgugugcuguucuuguuuuaugaagaccucaaggaggauaucagaaaagaggugauuaagcugauccacuuccuggaaaggaaaccaagcgaggaacucgucgaccggauuauccaucacaccaguuuccaggagaugaagaacaauccguccacaaacuacacuaccuuacccgaugaaauaaugaaucaaaagcugucuccuuuuaugcgcaaagggauuacaggagacuggaagaaccacuucaccguugcacuuaaugagaaauuugacaagcauuaugagcagcagaugaaagaaagcacuuugaaguucagaacagagaucuga

SEQ ID NO: 63406 - RNA, 858 nt, Artificial Sequence
  derived and/or modified sequence opt3 from SULT2A1__Homo_sapiens__NP_003158
augagcgacgauuuccugugguuugagggcaucgccuuccccaccaugggguuuagauccgaaacacucaggaaggugcgggacgaguucgucauucgcgaugaagacguuauaauccuuacuuacccuaaaucuggaacgaacuggcuggcugagauuuugugcuuaaugcacucaaagggugaugcaaaauggauccagagugugccaauuugggaacgaagcccguggguagaguccgagaucggcuauaccgcccugucugaaacagagucgccccgucuauuuucaagccaucucccuauacaacuguucccaaaguccuuuuucaguucuaaagcgaaggugaucuaccuuaugagaaaucccagggacguccuggugagcggguacuuuuucuggaagaacaugaaauuuauuaagaaaccuaaguccugggaagaguauuucgagugguuuugucagggaacuguuuuguauggcucaugguucgaucacauccaugguuggaugccaaugcgggaagagaaaaauuuccuccugcugaguuacgaggaacucaagcaggacaccgggcgcacaauugaaaagaucugccaguuuuuaggaaaaacccuggagcccgaggaacuuaacuugauacugaagaauagcucuuuccaauccaugaaagagaacaagaugucaaauuauagccuacucaguguggauuacgucguggacaaagcucagcugcuuagaaagggcguaucuggcgauuggaaaaaccacuuuacuguugcccaggcagaagacuucgauaagcuguuucaggagaagauggccgacuugccuagggaacucuucccaugggaguga

SEQ ID NO: 63407 - RNA, 1053 nt, Artificial Sequence
  derived and/or modified sequence opt3 from SULT2B1__Homo_sapiens__NP_004596
auggccagcccgccuccauuccacucccagaagcugccgggcgaguacuuuagauauaaaggggugcccuucccugucggacucuacucucuugaaucaaucagucuggcugagaacacccaagacguuagggaugacgauauuuuuauaaucacauauccaaagagcgguacuacguggaugauugaaaucauuugcuugaucuuaaaagagggcgaccccuccuggauacggucugugccuaucugggaacgcgcaccauggugugagaccauuguaggggccuucucgcugcccgaucaguacucaccucgacuaaugagcagucaucucccaauccagauuuuuacaaaggcguucuuuuccucuaaagcuaaggugaucuauaugggacguaauccgagagacgucgugguuagccuguaccacuauuccaagauagccggccagcuuaaagaucccgguacuccugaccaauuccugagggauuuucugaagggggaggugcaguucggaucaugguuugaccauauuaaaggcuggcuccggaugaagggcaaagauaacuuccuguuuaucaccuacgaagaguugcagcaggaccuccaagggagugucgaacgcauuugcggauucuuagguagaccacugggcaaggaggcacuugggagcgugguagcccacucuacauucuccgcuaugaaggcaaauaccaugucaaacuacacuuugcugcccccuagccuacucgaucauaggcggggagccuuucugcgcaaaggcguuuguggugacuggaagaaucacuucacaguggcucagagugaggccuuugaccgagcguauagaaaacagaugagggggaugccaaccuuccccugggaugaagacccggaggaagauggaucuccugaccccgagccauccccugaacccgagccaaagcccagccuugagccuaacacgucgcuggaacgggagccacgucccaauucuucccccucaccuaguccaggccaggcaagcgaaacuccccacccucgcccauccuga

SEQ ID NO: 63408 - RNA, 855 nt, Artificial Sequence
  derived and/or modified sequence opt3 from SULT4A1__Homo_sapiens__NP_055166
auggccgagagcgaagcugagacccccuccacaccuggcgaguucgaaucuaaguacuuugaguuccacggggugagacugccaccguuuugcaggggaaaaauggaagagaucgcaaacuuccccguccggccuucagacguuuggauugugacuuauccaaagagugguacgagccuccuucaggaaguaguguaccuggucucccaaggcgccgaucccgacgagauaggguugaugaauaucgaugaacaguuaccugugcuggaguauccacagcccggacuagacauuaucaaagagcucaccucuccucgccugauuaagucgcaucuuccauaccgauuucugccgucagauuugcacaacggcgacagcaaaguuaucuauauggcgcguaaucccaaggaucucguggucaguuacuaucaguuccauagaucccugaggacaaugucuuaccgggguacuuuucaagaguucugucgcagauuuaugaacgacaagcugggguacggaagcugguucgaacacgugcaggaauuuugggagcauaggauggauuccaauguacucuucuuaaaauaugaagacaugcaccgggaucugguuaccaugguggagcagcuugcucgcuuuuugggcgucucaugcgacaaggcccagcuggaggcacuaacagaacacugucaucaacucguggaucagugcuguaacgccgaggcucugccugugggccgagggagagucggacuuuggaaagacauauucaccguuaguaugaaugaaaaguucgaccugguguacaaacagaagauggguaagugcgauuugacuuuugacuucuaucucuga

SEQ ID NO: 63409 - RNA, 1050 nt, Artificial Sequence
  derived and/or modified sequence opt3 from SUMF1__Homo_sapiens__NP_001158146
auggccgcucccgcacugggccucgugugcgggagauguccugagcuuggacuggucuuguuacugcuacuccugagccuucugugcggugccgcgggcucccaggaagcugggaccggagccggcgcagguucuuuggccgggucauguggaugcggcacaccacaaaggccgggcgcucacgggaguagcgcagccgcucaucgguacucccgcgaggccaacgcgcccggaccuguuccaggugaacgacagcucgcacacucuaagauggugcccaucccugccggcguauucacuauggggacggacgauccacagauuaaacaggacggagaggcucccgcccguagagugaccauagaugcauuuuauauggacgcuuacgaagucucgaauacagaguucgagaaguuugugaacucaacuggcuaucugaccgaaguugccgcggccccuugguggcugccagugaaaggugcaaauuggaggcauccggaggggcccgauagcacaauccuccaccggccugaccauccagucuuacacgugaguuggaacgaugcuguagccuacuguaccugggcuggaaagcgccugcccacugaagccgagugggaguauuccugcagaggcggccuucacaauagguuguucccuugggggaacaaacugcaaccaaagggacagcauuacgcaaauauuuggcagggugaauuucccguuacaaacaccggcgaggacggguuccagggaacggccccgguggaugcuuuuccucccaauggcuauggucuauacaacaucgucgggaaugcgugggaauggacuucugacugguggaccgugcaccauagcguggaggaaacacucaacccaaagggcccucccuccggaaaagaucgggucaagaaaggcgggucauacaugugucaccgcaguuauugcuaccgauauagaugugcagccaggagccaaaauacuccagacucuuccgcuucaaaccugggauuccggugcgccgcagaucgucuucccaccauggacuga

SEQ ID NO: 63410 - RNA, 918 nt, Artificial Sequence
  derived and/or modified sequence opt3 from SUMF2__Homo_sapiens__NP_001035934
augagagcccacgcucagaggggccgggggugcacccgccgaagcgcagccgugcugauggcgcgucauggacucccccuucugccuuuguuaucccugcuagucggugcuuggcucaagcugggcaacgggcaagccacaucuaugguucagcuucagggaggcagauuccugauggguacuaauucaccagacaguagggauggggagggaccggugcgggaagcaacgguaaaacccuuugccaucgacauuuucccugugaccaacaaggauuuucgcgacuucgucagagagaaaaaguacaggacagaagcugagauguuuggcuggagcuucguguuugaagauuucguuuccgacgaguugcggaauaaagcaacucagccaaugaagcccgccggcccugggucuggaauacgcgagcgacucgaacacccagugcugcaugucucguggaacgaugcuagagccuauugugcguggagggguaagcggcugcccaccgaggaagagugggaguuugcagcccguggcgggcucaaaggacaaguguacccuuggggcaauugguuccagccaaaccgcacaaauuuauggcaggguaaguuuccgaaaggggacaaggcugaagauggauuccacggcguaucacccguuaacgccuuuccugcacagaauaacuauggccuguacgaccuuuuggggaaugugugggaguggaccgcuagcccauaucaagccgcggaacaggauaugagaguccugaggggagccaguuggaucgacacugcagaugguuccgcuaaccaucgggcccgagugacaacccgcaugggcaauacgcccgacucugcuagcgacaaccuaggguucagaugcgccgcagaugccggaaggccuccaggcgagcucuga

SEQ ID NO: 63411 - RNA, 306 nt, Artificial Sequence
  derived and/or modified sequence opt3 from SUMO1__Homo_sapiens__NP_001005781
augagcgaccaggaggccaagcccuccaccgaagaucugggcgacaaaaaggagggggaauacaucaaacucaaggugauuggacaagauucuucagagauacacuucaaagucaagaugacaacucaucuuaagaaacugaaggaaaguuauugccagagacaggguguuccuaugaacagcuugagguuuuuauucgagggccagcggaucgcugacaaucacacgccaaaagagcuggggauggaagaggaagaugugauugagguauaccaagagcagaccggaggccauuccacaguguga

SEQ ID NO: 63412 - RNA, 216 nt, Artificial Sequence
  derived and/or modified sequence opt3 from SUMO2__Homo_sapiens__NP_001005849
auggccgacgagaagcccaaggaaggcgugaagaccgagaacaaugaucacaucaaccugaaagucgcugggcaggacggaagcguugugcaauucaagauuaaaagacauacaccucucuccaaacuuaugaaggcauacugcgaaaggcagcuggagauggaagaugaggacacuauagauguauuucagcagcaaacggguggcguguauuga

SEQ ID NO: 63413 - RNA, 426 nt, Artificial Sequence
  derived and/or modified sequence opt3 from SUMO3__Homo_sapiens__NP_001273345
augagcgaggaaaagcccaaggagggcgugaagaccgaaaacgaccacaucaaucugaaagucgccgggcaggauggauccguugugcaauucaagauuaaaagacauacaccucucucuaaacuuaugaaggcuuacugcgagaggcagguacggcaccuggcaccaccgcagucauugcccgugugugccuuaguccugugcgugccugguauaccacgcgcgcgagcuagucguggcuggacucagaugcaacuacccgaagggcucagcaugagacagaucagguuucgguucgacggacagccuauuaacgagacggauaccccagcccagcuggagauggaagacgaggauacaaucgacguuuuucaacagcagacuggcggugugcccgaauccucucuugcagggcauucguucuga

SEQ ID NO: 63414 - RNA, 288 nt, Artificial Sequence
  derived and/or modified sequence opt3 from SUMO4__Homo_sapiens__NP_001002255
auggccaacgagaagcccaccgaagaggugaaaacagaaaauaacaaucacaucaaccugaaggucgcuggccaggacgggagcguugugcaauucaaaauuaagagacagacuccucucuccaaacuuaugaaggcauacugcgagccaaggggacugucuguaaagcagauacgguuucgcuucgguggccagccgaucucagggacggauaaacccgcccaauuggaaauggaggacgaggauaccauugacguguuucagcagccuacaggaggcgucuauuga

SEQ ID NO: 63415 - RNA, 2358 nt, Artificial Sequence
  derived and/or modified sequence opt3 from SUN1__Homo_sapiens__NP_001124437
auggacuucagcagacugcacauguacagucccccucagugcgugccagagaacaccggcuauacauacgcccucucuucaaguuauagcuccgaugcucuugacuuugaaacugagcauaagcuggauccggucuucgacucucccaggaugucgcggcgcucauugcgauuagcaacgaccgccuguacacugggggauggagaagcgguuggugcugacagcggcacuuccuccgccgugucucuaaagaaucgugcagccagaaccacaaagcaaaggcggagcaccaacaaauccgcuuuuucaauuaaucacguaagucgccaggugacuagcucuggggucucccauggaggcacagugucacuccaggaugcaguuaccagaaggccuccagugcuggacgagagcuggauucgggaacagacgacugucgaucacuucuggggucuugacgaugacggggaucugaagggaggcaacaaagccgcuauacaaggcaauggggacgugggagccgcggcagccaccgcucauaacgguuuuaguugcucuaauuguuccauguugagcgagcgcaaggacguacucacagcccaccccgcagcuccuggcccaguuucgcgaguguacucuagagauaggaaccagaagugcuauuuccugcugcagauccuccggcguauuggggccgucggacaggcggugucccgcacugccuggucagcauuauggcuggcuguggucgcccccggcaaagcugccagugguguguuuugguggcuugggaucggaugguaccaauucguuaccuugauuagcuggcugaauguauuucuacucacaagaugucugaggaacaucugcaaguuccuugugcuguugauaccucucuuucuguuacuggcaggccucucccuucggggccaggggaauuucuuuucuuuccugccagucuugaacugggccagcaugcaccgaacccagcgcguggacgauccgcaggacguuuucaaacccacgacuucaagacuaaagcaaccucugcagggagauagugaggcuuuuccauggcauuggauguccgguguggaacagcaagucgcgagccucucuggccagugucaccaucacggggagaaucugagggaacuuacaacccuguugcagaaacuccaggcacggguggaccaaauggagggaggcgccgcuggucccucagccaguguacgcgaugcaguugggcagccuccaagagagacugacuucauggccuuucaccaggaacaugaggugaggaugagccaccuggaagauaucuuaggcaagcugcgugagaaguccgaagcuauucagaaagagcuagagcaaacaaagcagaaaaccaucucugccgucggagaacagcuccugcccacgguggagcaucuucaguuggaacuggaccaacucaagucggagcugagcuccuggcggcacgucaaaaccggcugcgaaacaguggaugcaguucaggagcgaguggacguacaggucagagagauggugaaacuucuguucucagaagaccagcaagggggaaguuuggagcagcuccugcagagguuuucuagccaauucguuuccaaaggugauuuacagacuaugcugcgcgaccuacagcuccagauucugcggaacgugacccaucacgucucagugacaaagcaacuuccgacuagcgaagcgguagugucugcuguuuccgaggccggcgcaagugggaucaccgaagcccaggcuagagccauagucaauagcgcauugaagcuguauucucaggauaaaacaggaaugguggacuuugcucucgaguccggcggugggucaauucugaguaccagguguagcgagacuuacgaaacgaagacagccuuaaugucgcuguucggcaucccucuuugguacuuuucccagucuccccgcguggucauucaaccagauaucuauccuggaaacugcugggcguucaaaggcagccagggguacuugguugugcgacucucaaugaugauccaccccgccgcuuuuacccuggagcauauuccaaagacucuaagucccaccggaaacauauccucugcaccuaaagacuucgccguguauggucuggaaaaugaguaccaggaggaaggccagcuccuggggcaauuuacauaugaucaggacggagagagccuucagauguuccaggcuuugaagcggccagaugacaccgccuuccaaaucguagaacugcguaucuuuuccaacuggggccacccggaguacacuuguuuauauagauucaggguccauggugaacccgugaaguga

SEQ ID NO: 63416 - RNA, 2217 nt, Artificial Sequence
  derived and/or modified sequence opt3 from SUN2__Homo_sapiens__NP_001186508
augagcagaaggucccagcggcugacccgcuacucucaaggcgacgaugacgggucaaguagcuccggagguucuucgguggccggcucacagagcacacucuucaaggauaguccccuucgaacucugaaacguaaguccucuaacaugaaaagauugagcccugcuccacaguuagggccguccucagacgcacacacgaguuauuacagcgagucucugguccaugaauccugguuucccccuaggucaagccuagaggaacuccacggagaugccaauuggggcgaggaccugcggguucgcagaaggcgggguaccgggggaagugaaucuucccgcgcgagcggccuugugggccgaaaggcuacagaggauuuccuggggucgucuuccggauauucaagugaggacgauuacguagaagacagcgaggguagaggcuccaaagugacugaaaccgagccagucucuagcuuucccgccggguauucagauguggaccagcaaaguuccagcucuagguugcggucagcaguuagucgugccggaagccuccuguggaugguggcuacauccccuggccgccuguucagacucuuauacuggugggcagguaccacuugguauaggcugacaaccgccgcuucucuuuuggaugucuuugugcugacgcggcgauucucgagccuaaagacuuuucucugguuccugcuuccacuguugcuccugaccugcuuaacauacggggccugguacuuuuaucccuacggacugcagacuuuccauccugcgcucguauccuggugggcagccaaggacucacgcagaccagacgagggcugggaagcuagggauaguucuccgcacuuucaggccgagcagcggguuaugagccgcgugcauucccuugaaagaaggcuggaggcauuggcugccgaguucucaagcaacuggcaaaaagaggcgaugcgucuagagcggcuggaacuccgacagggcgcccccgggcagggagguggcgggggacugucucacgaggacacccuugcacuguuggaaggccucgucuccagaagggaggcugcccugaaggaagauuuucgccgggagacagcugccagaauccaggaggaauuaagugcacugagggccgagcaccaacaggacagcgaagaucuauucaaaaagauugugcgcgcuucucaggaguccgaagcgcgaauacaacagcucaaaucagaguggcagaguaugacccaggagagcuuccaagaaucguccgugaaggagcugcggcgucuugaagaccaguuggcaggucugcagcaggagcucgccgcucuggcccuuaagcaaucuagcgucgcagaggaaguugggcuguugccucagcagauccaggccgugagagaugacguagagucacaauuuccagcuuggauuagucaguuccucgccaggggcggaggcgggcgcgugggacuguuacagcgggaagagaugcaggcacaacugagagaacuagaguccaaaauccucacgcaugucgcggagaugcaggguaagucugcuagggaagccgcagccagccugucccuuacuuugcagaaagagggcgugauugggguuacagaagaacaagugcaccauaucgucaagcaggcucugcagcgauauucagaagaucgcauaggacucgccgacuacgcacuggagagcggcggugcuagugugaucucuacccgguguuccgagacuuaugaaacaaaaaccgccuuacugagccuuuuugggauucccuugugguaccacucgcagucaccuagaguaauccuccaaccagauguucaccccggcaauugcugggcguuccagggaccgcagggcuuugccguggucaggcugucugcucguauucgcccuacggcagugacccuagagcauguccccaaggcccugaguccaaacuccacaaucagcucugcuccuaaagacuucgccauauuuggguucgacgaagaucuccagcaagagggaacucugcuugguaaguuuaccuaugaccaggauggcgaacccauucagacauuccacuuucaggcaccaacuauggcgaccuaccaagugguugaguugcggauccugacaaauugggggcaucccgaguacaccuguauuuauagauucagggugcacggagaaccugcccauuga

SEQ ID NO: 63417 - RNA, 1074 nt, Artificial Sequence
  derived and/or modified sequence opt3 from SUN3__Homo_sapiens__NP_001025190
augagcggcaagaccaaagccagaagggcugcaauguucuuucggcgcugcuccgaggacgccucugggucagcgaguggaaacgcucugcucagcgaagaugagaaucccgacgccaacggugugacacgauccuggaagaucauucuuucuacuaugcugacguugaccuucuuacuggucggccuacucaaucaccaguggcugaaagaaacagauguuccucaaaagucgcgucagcuuuacgcaauaaucgccgaguaugggucaagacuguacaaauaucaggcuagguugcggaugccaaaggaacagcucgagcugcugaagaaagagagccaaaaccucgaaaauaacuuucgccagauuuuauuccugaucgagcagauugacgugcuuaaggcauugcugagagauaugaaagacggaauggauaauaaccauaauuggaacacucacggcgacccgguagaagaucccgaccauaccgaggaggugaguaaucuagucaacuacgugcucaagaaacugagggaagaucagguugagauggccgacuaugcucuuaaguccgccggugcgucuaucauagaagcagggacaagcgaguccuacaagaauaacaaagccaagcuguauuggcacggaaucggcuuuuugaaucaugaaaugccuccagauauuauccuccaacccgacguguacccuggcaaauguugggcuuucccagggucacagggacacacccugauuaaguuagccacuaaaaucauacccacagcagucaccauggagcacauuagugagaaggugagcccuucugguaacaucuccucagcuccaaaagaauuuagcguauacggcauuacgaagaagugcgagggggaagagaucuuccugggacaguuuaucuauaacaaaacuggcaccacaguucagacuuucgaacuccaacaugccgugagugaguaccuucugugugucaaguugaauauauuuucuaacuggggucacccgaaauauaccugccuauaccgguuccgcgugcaugggacacccggaaagcacauuuga

SEQ ID NO: 63418 - RNA, 1638 nt, Artificial Sequence
  derived and/or modified sequence opt3 from SUOX__Homo_sapiens__NP_000447
augcugcuccuucacagagccgugguccugagguugcagcaggcuugccgguuaaagagcauccccucccgcauuuguauacaagcaugcucuaccaacgacucauuccagccucagcgaccaagucugacauuuagcggcgauaauuccucuacucaaggguggcguguuaugggaacgcuacucggucugggcgccgugcuugcguaccaggaccauagauguagggcugcccaggagucgacccacaucuauacaaaagaagagguaucaagccauaccaguccggaaacugggauuugggugacacugggauccgaggucuucgaugugaccgaauuuguugacuugcaccccggcgguccuucuaagcucaugcuggcagccgggggaccacuggagcccuucugggcucucuacgcagugcauaaccagagccacguccgggaguuacuggcccaauauaaaaucggcgaacuuaauccugaggauaagguggcuccaacuguagaaacauccgaccccuacgccgaugacccuguucgccacccagcguugaaagugaacucacagagaccguuuaaugcagagcccccuccagagcugcuaaccgaaaacuauauuacgcccaauccuaucuucuuuacuaggaaccaucucccaguccccaaucuggauccggacaccuaccggcuucacguggugggcgccccugggggacagagucugagcuugucucucgaugaccugcauaacuucccccgcuaugagauaacagucacuuuacagugcgcugguaaucgaagauccgaaaugacccaaguuaaggaggugaagggccuggaauggaggacaggggccaucucaaccgcacggugggcuggagcccgucucugugauguacuugcgcaggccggccaccagcugugcgagacggaggcacacguguguuuugaagguuuggacagcgacccaacugggacagcuuacggagccaguauuccucuagcucgcgccauggaucccgaggcagaaguccugcucgccuacgagaugaacggccaaccacugcccagagaccauggcuucccugugaggguuguggucccaggggugguaggagcucggcacguuaaauggcuuggucgagugucuguccagccggaagaguccuauagccauuggcagcgcagagauuacaagggcuuuucgcccucuguggacugggagaccgucgauuucgacuccgcgccuucaauccaggaacugccagugcaaagugcaauuacugagcccagggauggggaaacaguugagagcggagaagugaccaucaaaggcuaugccugguccggugggggccgggcuguaauacgcgucgacgugucuuuggauggaggccucacguggcagguugccaagcuggacggggaggagcagagaccuaggaaagcaugggccuggcguuuauggcagcugaaggcuccagugcccgccggacaaaaggaacuaaauauugucugcaaagcaguggaugacgguuacaacguacagccggacaccguggcgccuaucuggaaucuccggggcguucugagcaacgcuuggcaccgaguccauguguaugugucaccauga

SEQ ID NO: 63419 - RNA, 2340 nt, Artificial Sequence
  derived and/or modified sequence opt3 from SUPT20H__Homo_sapiens__NP_001014308
augcagcaagcccuggagcucgcucuugacagagcagaauacgugaucgagagcgccaggcagcggcccccuaagcgcaaauaucuguccucuggccgaaagucagucuuccagaaauuguacgauuuauauauugaagagugcgaaaaggagccagagguuaaaaagcugcguagaaacgugaaucuacucgaaaagcugguaaugcaggagacccuuaguugucugguggucaacuuguacccggggaaugaaggauauagccucaugcugagggguaaaaacggcuccgacucugagacaauacggcugcccuacgaggaaggggagcucuuagaauaucuggaugcggaggaacuuccuccaaucuugguggaccugcuagagaagucgcaaguuaauauuuuucacugcggaugugugaucgcugagauucgcgauuacagacagucaagcaacaugaaaagucccggcuaccaguccaggcauauccuccugcggccuacuaugcagacgcuuauaugcgacguccacucuaucaccagcgauaaucauaaguggacacaagaagacaaacuguugcucgagucccagcugauuuuagccacugcagaaccacugugucucgaucccucaaucgccgugaccugcacagcuaaccgccuucuguauaauaagcagaagaugaacacccgaccuaugaaaagauguuucaagagguacagucggagcucuuugaaucgucagcaagaccuaucccacugcccaccgcccccucagcugcgccuccuggauuuucuucagaaaagaaaggagaggaaagcaggucaacauuaugaccugaagauuucaaaagccgggaacuguguagauauguggaagcggagcccaugcaauuuggcuauccccagugaaguugacguggagaaguacgccaaagucgagaagucuauaaaauccgacgauagccagccuacuguguggccagcgcacgacgugaaggaugacuaugucuucgaaugugaggcaggaacacaguaccagaaaaccaagcucacgauucugcaaucguuaggcgauccccuguauuacggcaagauccagccgugcaaagccgacgaagagucugauucccagaugucaccuagucacagcuccacugacgaucauucuaacugguuuauuaucgggagcaagaccgacgcugaacgaguugugaaucaguaccaagagcuaguacagaacgaggccaaaugccccgugaagaugucacacaguuccagcggaucugcaucacucagucaggucagcccagguaaagaaacagaucagacugagaccguguccguucaaucuucggugcugggcaagggggucaagcaucgcccucccccaaucaaacuucccagcuccucaggaaacaguucuagcggcaauuauuucacaccucagcagaccuccucauuuuugaaaagcccaacgccgcccccuucuuccaagccaaguagcauucccagaaagucuuccguggaccugaaccagguaucaaugcucaguccugcugcccugagcccagcgucguccucucaaaggacuacagccacccagguuauggcaaauagcgcuggucuuaacuucauaaauguggucgggucaguguguggagcccaggcucugaugaguggcuccaaccccauguugggcugcaauacuggggccaucacaccggcaggaauuaaccucucuggucuguuaccuagcggcgggcugcuaccaaaugcccuccccuccgcuaugcaagcggcaucacaggccggagucccuuuuggccugaaaaacaccagcagucuucggcccuugaaucugcuccagcugccaggugggucuuuaaucuucaacacgcugcagcaacagcagcagcaacuuucccaguuuaccccucagcagccccaacagccaacaacuuguagcccgcagcaaccuggcgaacagggaucggagcagggcucaaccucucaggagcaggcuuugagugcccaacaggcagccgugauaaaucucacagggguuggauccuucaugcagagccaagcugccgugcugucucagcuagguagcgcagaaaaccgccccgagcagucccugccacagcaaagauuucagcucucaagugcguuccagcagcaacagcagcaaauucagcagcugagguuccuucagcaccaaauggcuauggccgcagccgcugcccagacugcacaguugcaccaucaccgucauaccggcagccagucuaaguccaagaugaaacgggggacacccaccacuccuaaguuuuga

SEQ ID NO: 63420 - RNA, 498 nt, Artificial Sequence
  derived and/or modified sequence opt3 from SUPT3H__Homo_sapiens__NP_001248752
auguucgaggacgaugaaaucgacgaggugaagcaggaaagaauggagagggccgaacggcaaacccgcauuauggauagcgcucaguacgcagaguuuugcgagucccgacagcugucuuucaguaaaaaggccucaaaauuucgugacuggcucgauuguagcuccauggaaauaaagcccaacgucguugcgauggagauccuugcuuaucuggccuacgaaacaguggcacaguugguagacuuagcccugcuagugagacaagauauggucacuaaagcuggcgacccuuucucucacgcaauuucggccacguuuauccaguaucauaauucagcugagagcaccgccgcgugcgggguggaggcacacagugaugccauucagccaugucauaucagggaagcuauacggcgcuacucccacagaaucggaccgcucucucccuucacaaacgccuauaggcggaaugguauggcauuucuggcuugcuga

SEQ ID NO: 63421 - RNA, 354 nt, Artificial Sequence
  derived and/or modified sequence opt3 from SUPT4H1__Homo_sapiens__NP_003159
auggcccuggagaccgugcccaaggaccucagacaccuuagggcuugccuguuguguagcuuagucaaaacaaucgaucaguucgaauacgacggcugcgauaacugugacgcauaucugcaaaugaaggggaaucgggagaugguuuacgauugcacuuccucuucauuugacggaauuauagccaugaugaguccugaagauagcuggguguccaaauggcagcgcguaucuaacuucaagccagguguguaugcggucucggugacgggccgacuaccgcaggggaucguucgugagcucaaaucaagaggaguggcuuacaagagcagggacaccgccauuaagacauga

SEQ ID NO: 63422 - RNA, 1245 nt, Artificial Sequence
  derived and/or modified sequence opt3 from SUPT7L__Homo_sapiens__NP_001269658
augaaccugcagagauacuggggcgagauccccauuagcuccucucaaaccaauaggucaaguuucgaccuccuuccucgggaauuucgccugguggagguccacgauccaccguugcaucagcccagcgccaacaagccuaaaccacccacaauguuagacauaccuuccgaaccaugcucucugacuauccacacgauucagcuaauccagcauaaucgacgucucagaaaccugauugcuaccgcacaagcccagaaucagcagcaaacagaggggguuaagacugaagagucggagccccuuccuucauguccaggaagcccgccccugccugaugacuugcucccacuggauugcaaaaaccccaaugcgccuuuccagaucaggcacagugacccagaauccgauuuuuaucgggguaagggcgagcccgugaccgaacugucuuggcauagcugucgccagcucuuauaccaggcuguagccacaauacuggcacacgccggguucgacugcgcuaacgaguccgugcuugagaccuugacugaugucgcacacgaauauugucugaaauuuacaaagcuacucagauucgccguggacagggaggcucggcugggacaaaccccguuuccugauguuauggaacagguguuccaugaggucggcaucgguucagugcuuagucugcagaaguuuuggcaacaccgcauuaaagacuaccauagcuauauguugcagaucucuaagcagcucuccgaagaguacgagcgaauuguaaaucccgaaaaagccacggaggaugcgaagccaguuaaaaucaaggaagaaccugugucagacauaacuuuccccgucagcgaggagcuggaggcagacuuagccaguggggaucagucucugccaaugggagugcucggcgcucaauccgaaagauuucccagcaaccuugagguggaagccucgccucaggcaucuuccgcugaggucaaugccucaccacuguggaacuuggcgcacguuaagauggaaccgcaggagagugaggaaggcaaugugagcgggcacggaguacuagguuccgacguguucgaggaacccaugucuggcaugagcgaggccgggauuccucagucaccagaugacagugauuccagcuauggaucucauucaaccgacagucugaugggcagcucccccgucuuuaaccaaaggugcaaaaagcggaugcguaaaaucuga

SEQ ID NO: 63423 - RNA, 2361 nt, Artificial Sequence
  derived and/or modified sequence opt3 from SUPV3L1__Homo_sapiens__NP_003162
augagcuucuccagagcccugcucugggcuaggcuucccgcaggccggcaggccgggcaccgcgcggcuaucugcucugcccugcgaccucauuuuggaccauucccggguguguugggccaagucucaguuuuagcaaccgccaguagcuccgcuucugggggaucgaagauucccaacacaucacuguuugugccucuaacuguaaaaccacagggccccagcgcagacggugaugugggggccgagcucacgcguccucuggacaagaaugaagucaaaaaggugcuugauaaauucuacaagagaaaggagauacagaaacugggagcugacuauggcuuggaugccaggcucuuucaccaggcguucaucaguuuucggaacuacauuaugcaaucccauucucuggacguugauauccacauugugcugaaugacaucuguuucggcgcagcccaugcugaugaccucuuuccauucuuuuuacgccacgccaagcagauauuccccguccuggauugcaaagacgaucuuagaaagaucagcgacuugaggauuccuccaaacugguauccggacgcacgggcuaugcagcgcaaaaucauuuuucacuccgggcccaccaauucaggaaagacauaccaugccauccagaaguauuucagugcgaaaagcgguguguacuguggcccucugaagcuacucgcccacgaaauauucgagaaaucuaacgcagcugggguaccaugcgaucugguuacuggagaggaacgagugaccguccaacccaauggcaagcaggccucccaugugucauguacaguggagaugugcagcgucaccacuccuuaugaaguugcugugauugacgagauccagaugauuagagauccagccagggguugggcauggacacgggcccuucugggguugugugcugaagagguacaccucugcggagagcccgcggcaaucgaccuggugauggaauuaauguacaccacgggcgaggaagucgaggugcgugauuacaaacgccugacuccgaucaguguucucgaccacgcccuugaaucucuggauaacuugagaccuggcgacuguauugugugcuuuuccaagaaugauauauauagcgucucgaggcagaucgagauucgggggcuagagucugcugugaucuacggaucccugcccccagguaccaaacucgcccaagcaaagaaguucaacgacccuaaugaucccuguaaaauacugguagccacagacgcuauuggcauggggcuuaaccugucaauccgacgcaucaucuuuuauaguuugauuaagccaagcauuaaugaaaaaggagagagagaacucgagcccauaacuaccucccaggcccugcagaucgcaggcagggcgggucgguucucuagccgcuuuaaggaaggggagguuacaaccaugaaccaugaggacuuaucacugcuaaaagaaauucucaagagaccuguggauccaaucagggcugccggccugcacccgacggcagagcaaaucgaaauguucgccuaccaucuucccgacgcuacuuugaguaaucugauugauauauuugucgacuucucccagguggauggacaguauuuugucugcaacauggacgauuucaaguuuagcgccgagcucauccagcacauuccucugucucuucgugugcgguacguuuucugcacagcaccaaucaacaaaaagcaacccuuuguguguucaagucuguugcaguucgcucgacaguauagcagaaaugaaccucucaccuucgccuggcugaggcgcuacauuaaauggccauuacugcccccgaagaacaucaaagaccuaauggaucucgaggcgguacaugacguccuggaucuuuacuuguggcuguccuaucgguuuauggacauguucccugaugccucucucauaagagaccugcagaaggaguuagacggcaucauucaagauggggugcacaauaucacuaagcugauuaaaaugucggaaacacacaaacuuuugaaccucgagggauuuccaagcgguucccagucaaggcugaguggcacccuaaagucucaggcucgccgaacgcgggggaccaaggcacugggaagcaaagccacagaacccccuucccccgacgcuggcgagcucucacuggccagccgucuuguucagcaagguuugcugacuccagauauguuaaagcagcucgagaaggaauggaugacccagcagacagagcauaauaaagaaaagacugagucugggacccacccuaaaggcacaagaaggaagaaaaaggaacccgacuccgauuga

SEQ ID NO: 63424 - RNA, 903 nt, Artificial Sequence
  derived and/or modified sequence opt3 from SURF1__Homo_sapiens__NP_003163
auggccgcuguggcagcccugcagcucggccuuagagcggcugggcugggaagggcccccgcaagcgccgcuuggcgguccgucuugcgcguuucuccucgaccagguguggcauggcguccgucaagaugcggcaguagcgccgcugaggccuccgcgaccaaggcagaagacgauucuuucuuacaauggguacugcuacucauccccgugacagccuuugggcugggaacuuggcagguccagaggcggaaauggaaacuuaaccugauugcugaguuggaaucgcgcgugcucgccgagccuguuccacugcccgcagacccuauggaacugaagaaucucgaguacagaccagugaaggucaggggcuguuucgaucacucaaaagaguuauauaugaugccccggacgaugguggacccuguacgcgaagcucgagagggugggcugauaagcaguuccacccagucuggagccuacguugugacaccauuucauugcacugaucuuggcgucaccaucuuggugaacagaggcuucgugccgaggaagaaggucaaucccgaaacacggcaaaaagggcagauugagggagagguugaccugaucgguauggugcgucuaaccgaaacucgccagccuuuuguaccagagaacaaucccgaaagaaaccacuggcauuauagggaucucgaggcgauggcccggauuacaggcgcagaaccuaucuucauagacgcuaauuuucagagcaccgugccagggggacccaucggcggucaaacgcgagucacucugcgcaacgagcaccuucaguacauugugaccugguaugggcuguccgccgcuacaucauacuugugguucaagaaauuucucagaggaacuccgggcguuuga

SEQ ID NO: 63425 - RNA, 480 nt, Artificial Sequence
  derived and/or modified sequence opt3 from SURF4__Homo_sapiens__NP_001267718
augggccagaacgaccugauggggaccgccgaggauuucgcugaccaauuucucagagugacaaagcaguaccuuccccacgucgcaaggcugugcuugaucagcacuuucuuagaagaugguauucggaugugguuucagugguccgagcagcgcgacuauauagauacgaccuggaauuguggauaccugcuagccucuucauucguuuuucucaaccugcuuggccaacugacagggugcguguugguacucagucgaaauuucgugcaguaugcguguuuuggacuguucggcaucauugcucugcagacuaucgccuacagcauucucugggacuuaaaauuucugaugcguaaccuugcauugggugggggacugcuacuccugcuugccgaauccagaucugagggcaagucgauguucgcuggcgucccuaccaugagggaaucaagcccaaaacaguaucugccgggguga

SEQ ID NO: 63426 - RNA, 2274 nt, Artificial Sequence
  derived and/or modified sequence opt3 from SUSD1__Homo_sapiens__NP_001269569
augggcagagggcccugggacgccggaccuagcaggcggcugcucccacuucuguuguuacugggucuagcucgcggcgcagccggggcgccgggacccgauggccucgacgugugcgcuaccugccacgagcaugccacaugccagcaacgagaagguaagaaaaucuguauuugcaacuacggguucgucggaaauggccguacucaguguguugauaagaacgagugccaguuuggcgcaacgcuggugugugggaaucacaccuccugccauaacacaccuggagguuucuauuguauaugccuugaaggcuacagagccacuaauaacaauaaaaccuuuaucccaaacgacgggacauucuguaccgauauugacgagugcgaaguaucuggacugugcaggcacggcggucggugugugaauacucaugggucauuugagugcuauuguauggauggauacuugccccgcaacggcccugagccauuccaccccacaaccgacgcuacgaguugcacugaaaucgauuguggcaccccuccagaggucccggacggguauauuaucggaaauuacacaagcucccucgguucucaggugagauaugcaugcagggaaggcuuuuucucgguucccgaggauacugugucaagcuguaccgggcugggaacaugggagaguccuaagcugcacugccaagaaauaaacuguggcaauccacccgagaugcggcaugccauccucgucgguaaccacuccucucgcuuagggggcguggcucgauacguaugccaggaaggauuugagagcccuggcgggaaaauuaccuccguuuguacggaaaagggaacuuggagagagucaacacugaccugcacugagauccuuacaaagauuaaugacgugaguuuguucaacgauaccugcgucagguggcagaucaacagccggcguauaaauccaaaaauuucuuacgugaucuccauuaagggucagcgccuggaccccauggaaucagugagagaggaaacggucaaccuaaccacagacagcaggacuccggagguuugucucgcccuguauccuggcaccaauuacacagugaacaucaguacugcgcccccacggcgaucuaugccugcaguaaucggguuucaaaccgccgaaguggaucuucuggaggacgauggauccuucaauauuagcauauuuaacgagacaugcuugaaacucaaucgcagaucgaggaaggucggcucugaacauauguaucaguucaccgugcugggucagcggugguacuuagcuaacuucucccacgccacuucauuuaauuucacgacacgcgagcagguucccguggucugucuggaccucuauccaaccacugauuacaccgugaacguaacacuucugagaagucccaaaaggcacagcguucaaaucaccauugcaacuccuccagcugugaagcagacaaucuccaauauaucuggguuuaacgaaacgugcuugcguuggcggagcauuaagaccgccgacauggaggaaauguaucuauuccauaucuggggccagcgaugguaccaaaaagaguuugcgcaggagaugacuuucaauaucucaaguuccagcagagauccggaagucugucuggaccucaggcccggaacaaacuacaaugugucucugcgcgcccuuucaagugagcugccugucgugauuagcuugaccacacagaucacugaaccaccccucccugagguugaguuuuucaccgugcaccggggcccacugcccagauuaaggcugcgcaaggcaaaagaaaagaacgggccgauuuccucuuaucagguacuuguccucccucuggcucuacaaucgacguuuagcugcgauuccgagggagccucaaguuucuuuucuaacgcuagcgacgccgaugguuacguggcagccgaauugcuggcuaaagacguuccagacgaugcgauggagauacccaucggcgaccgacucuauuacggggaauauuacaaugcaccucugaagcggggauccgauuauuguauuauccuucguaucaccucagaguggaacaaagugagaaggcauagcugcgccgucugggcucaggugaaggagauucccuguaauugcaacuuccugcgcuugcacauacaucgggccaauucuggcgacacacagaucagacacuccuguugcuguagguggcgaguacucgauugggugccauggcuguuauga

SEQ ID NO: 63427 - RNA, 2469 nt, Artificial Sequence
  derived and/or modified sequence opt3 from SUSD2__Homo_sapiens__NP_062547
augaagcccgcccugcucccuugggcacuucuguuguuagcuaccgcccugggcccagggccgggacccacagcggacgcucaggagagcugcuccaugagauguggugcccuagauggcccuugcucuugucacccaacuugcucagggcucggaacguguugccuggacuucagggauuuuugucuugaaauccugcccuacaguggcagcaugaugggugggaaagacuucgugguccggcauuuuaagauguccucuccuaccgaugcaucgguuauuugccgcuucaaagacucaauacaaacauugggacacguggauagcaguggccagguacauuguguguccccacuccuguaugagucuggccgaauccccuuuacugucagccuggacaacgggcacuccuucccucgugccggaaccuggcucgcugugcauccaaauaagguuucaaugauggaaaagagugaguuagugaacgaaacaagauggcaguacuaugguaccgcaaauacuagcggcaaccugucucuuacauggcacgucaaguccuugccgacccagacgauuacuaucgagcuguggggguacgaggaaaccggaaugcccuauucacaagaguggacagccaaguggagcuaccuauauccucucgcuacucacauuccaaauaguggcucuuuuaccuucacacccaaaccugccccacccuccuaccagagguggcgggugggugcgcugcgcaucauagauagcaagaacuacgcagggcagaaagacguacaggcccuuuggaccaaugaucaugcucuggccuggcacuugucggacgauuuuagagaagacccgguugcaugggcuaggacgcaaugccaggccugggaggagcucgaagaccagcugccuaacuucuuagaggaacugcccgauuguccaugcacucucacacaggcgcgggccgacucuggacgcuuuuucaccgauuauggcugcgacauggagcaaggcuccguguguacuuaccauccuggggcaguccacugcgugcgaucagugcaggcuagucuuagauauggaagcggucagcaauguugcuacacagccgauggcacccagcuguugacggcugacuccucugggggaagcacccccgauaggggccacgacuggggugccccacccuuucggacaccuccacgugucccgucaaugagucauuggcuauaugauguucuguccuucuacuauuguugccucugggcacccgacuguccucgcuacaugcagagaaggccaagcaaugauugccggaacuaccgacccccucgccuggccucugcuuucggggacccacacuuugugacuuucgacggcaccaauuuuacauucaacggaagaggcgaauauguacuucuggaggcggcauugacugaucucagggugcaggcccgggcucaacccgggaccaugucaaauggaacagagacccgcgguacuggccugacggccgucgcagugcaggaagggaacagugacguuguggaggucagauuagccaauaggacaggaggccuggaagugcuacucaaccaggagguacugagcuuuaccgaacaguccuggauggaucuuaaggguauguucuugucuguugcugccggggaccgugugucgaucaugcuggcaagcggcgcgggacucgaggucuccgugcaaggcccguuucugucagucagugugcuucugccugagaaauucuugacucauacccacgggcuccugggaacauuaaacaaugauccaaccgacgauuuuacucugcauucuggucggguucuacccccuggcacaagcccccaggaacucuuccuguuuggggcuaacuggacggugcacaaugccuccucacuuuugaccuacgacagcugguuccugguacacaacuuucucuaucagccaaagcaugauccuacuuucgagccccuguucccaucugaaacaaccuuaaauccgucccuggcacaggaggccgcuaaacuuuguggagacgaucacuuuugcaacuucgacgucgccgcaacaggcaguuugagcacugguaccgcuacgcgaguggcccaucaacuccaccagagaaggaugcagucucugcagccuguuguguccuguggguggcuagcgcccccacccaauggccaaaaagaaggaaaccgcuaccuggccggcucaaccauuuauuuucacugcgauaauggguacagucucgcuggagcagagacaagcacuugccaggccgacggcaccuggucguccccuacaccaaagugucagcccggucggucuuaugcuguccugcuugggaucauuuucggaggcuuggccgugguagcagcgguggcccugguuuacgucuuacucagaaggcgcaaagguaacacucauguguggggcgcucaaccuuga

SEQ ID NO: 63428 - RNA, 873 nt, Artificial Sequence
  derived and/or modified sequence opt3 from SUSD4__Homo_sapiens__NP_001032252
auguaccacggcaugaaccccagcaauggggacggauuccuggagcagcaacagcagcagcaacagccucaguccccacagagacuccuugccgugauccugugguuucaauuggcuuuaugcuucgguccggcacagcugaccggcggguuugaugaccuacaggucugugccgaucccggcauuccugaaaacggauucaggacaccaucuggugggguguuuuucgagggaucaguugcgcgguuucauugccaggacggcuucaagcucaaaggcgcuacuaagcgccugugucuuaaacacuuuaaugggacgcugggauggauacccagugauaacagcaucugcguacaagaagacugucguauuccucagaucgaggaugccgaaauucauaauaagaccuaucgacacggugagaaauugaucauaacaugccaugagggcuucaagaucagauacccagaccuccacaacauggugucccuguguagggaugacgggacuuggaauaaccugcccauuugccagggaugucuccggccuuuagcaucuucgaauggcuaugucaacaucucagaacugcaaaccagcuuuccaguggguacaguuauuaguuaccgcugcuucccgggguuuaaacuugauggauccgccuauuuggagugucugcagaaucuaaucuggucuagcucacccccuagaugccucgcucuggaaggcggcaggccagagcaccuuuuccccgugcuguacuucccucauauacgguuggcagccgcuguccucuauuuuugcccagugcugaaguccagucccaccccggccccuacuuguagcucuacauccaccacgacuucauuauucuga

SEQ ID NO: 63429 - RNA, 912 nt, Artificial Sequence
  derived and/or modified sequence opt3 from SUSD6__Homo_sapiens__NP_055549
augugccacggcagaaucgcccccaagagcaccuccguguucgcugucgcaucuguugggcauggaguguuucugccucucguaauucuuuguacacuguugggugacggcuuagccucagugugcccacugccgcccgagccugaaaacgggggauacauaugucacccaaggcccugccgggauccucuaacugcgggcagugucaucgaguaucucugugcugaagguuacaugcugaaaggggacuauaaguaccuuacgugcaaaaauggagaguggaagccagccauggaaauuagcugucgccugaacgaggauaaagacacccauacauccuugggcgugcccacucucucuaucguugcaucgaccgccucaagcguggcucugauucugcucuuagucgugcuguucguacuuuugcagccuaagcugaagaguuuucaccauucccgacgugaucaaggcguuucuggggaccaggugagcaucauggucgauggaguccagguggcacuaccauccuaugaggaagccguguacgguucaaguggccacugcguuccgcccgcugacccuagagugcagauaguacucagcgaggggucuggaccauccggcaggucagugccccgggaacaacagcugccugaucagggugccuguagcagugcagggggagaggacgaggcgccaggccagucuggccuuugcgaagccugggggucccgcgcuagcgagacagucauggugcaccaagccaccacuucgucuuggguugcaggauccgguaauagacagcuggcucauaaagaaacagccgauucagagaacagugacauccagagcuugcucucccugaccucugaagaguauacggaugacauucccuuacugaaggaggcguga

SEQ ID NO: 63430 - RNA, 1272 nt, Artificial Sequence
  derived and/or modified sequence opt3 from SUV39H1__Homo_sapiens__NP_001269095
auggugggcaugagcagacugaggaacgaccggcucgccgauccacuuaccgggugcuccgucuguugcaagucuucauggaaucagcugcaagacuugugucgcuuagcuaaacugaguugcccugcacuaggaaucagcaagcgaaaccucuacgauuucgagguugaauaucugugugacuacaaaaagauucgugagcaggaauauuaccuugugaaauggagagguuauccagauuccgagucuacaugggaaccgaggcagaaucugaagugcguacggauauugaagcaguuucacaaagaccucgagcgcgagcugcugagaaggcaucaccggucgaagacuccccgccaucucgauccuucauuagccaacuaccuggugcaaaaagcgaagcagagacgagcucuuaggcggugggaacaggaguugaaugccaaacguagccaccugggccgcaucacggucgaaaacgagguggaccuagaugggccacccagagcauucguuuauauuaaugaguacagggugggagaaggcaucacccucaaccaggucgccguggguugugagugccaagacugucugugggcuccuacagggggaugcuguccaggcgcaagucuucauaaguuugccuacaaugaucagggccagguacggcugcgagcuggguugcccauuuaugaaugcaacucccgcugcagauguggauacgacugcccuaauaggguugugcagaaggguauccgguaugaucucuguauauuccgcacugacgacggcagaggguggggagucaggacccuggagaaaauccguaagaacucuuuugugauggaauacgugggcgagauuaucacaagcgaggaagccgagcggcgaggucaaauuuaugauagacagggggcgaccuacuuauucgaccuggauuaugucgaagacguuuacacuguggaugcagccuacuauggaaauaucucccacuuuguaaaccacucaugcgacccaaaucuccagguguacaacgucuucauagauaaccuugacgagaggcugccgcgcauugccuuuuucgcuacacggaccaucagagcaggcgaagaguugacguuugauuauaauaugcaaguggaccccguugauauggagaguacuaggauggacagcaacuucggccuagcugggcugccuggaucucccaaaaagcgcgugcgaauugaauguaaaugcgguaccgaguccugucggaaguaccucuuuuga

SEQ ID NO: 63431 - RNA, 1233 nt, Artificial Sequence
  derived and/or modified sequence opt3 from SUV39H2__Homo_sapiens__NP_001180353
auggccgcugugggcgcagaggccagaggggcguggugcguccccugucugguuucacucgacacccuucaggaacugugcaggaaggagaaauugacauguaaguccaucggaauuacuaaacggaacuuaaauaacuacgaaguggaguaucugugcgauuacaagguagugaaagacauggaauauuaccuagucaaguggaaggguuggccugauucuacgaauaccugggagccacuccaaaaccugaaauguccgcuucuguugcagcaguucucaaaugacaagcacaacuaucucagucaggugaaaaagggcaaagcuauaacacccaaggauaauaacaagacucugaaaccugccaucgcagaguacauuguuaagaaagccaagcaacgcaucgcucugcagcgauggcaggacgaacucaaucguaggaaaaaccauaaggggaugauuuuuguggagaauaccgucgauuuagaaggaccacccagcgacuucuauuacaucaacgaguacaaaccugcaccaggcauaucccuggugaaugaggccacauuugguugcucuuguaccgauugcuucuuucagaaguguugccccgcugaagccgggguacuuuuggcguauaacaagaaucaacagaucaaaauuccuccaggaacuccgaucuacgaguguaacucgagaugccagugcggccccgacuguccuaaccggauuguucagaagggcacacaauauucacugugcaucuuccgcaccagcaaugggagaggauggggugugaaaacgcuagucaagauaaaaaggaugaguuuugugauggaauacgugggcgaggucauuacuuccgaagaggcagagcggcgcgggcaguucuaugauaacaagggaaucaccuaccucuuugaccuggauuaugaaucugacgaguucacaguugacgccgcucgauacggcaaugugagccacuuuguaaaccauuccugugauccaaaucuucagguguucaacgucuuuauugacaaucuggauacuagauugcccaggaucgcccucuucucaacccggacaaucaacgcaggggaggaacugaccuucgacuaccaaaugaaggguaguggagauauuagcucugacuccauagaucacagcccugcuaaaaagcgugugcgcacgguuugcaaauguggcgccgugacuugcagaggcuauuuaaauuga

SEQ ID NO: 63432 - RNA, 1389 nt, Artificial Sequence
  derived and/or modified sequence opt3 from SUV420H2__Homo_sapiens__NP_116090
augggccccgacagagugaccgccagggagcugugcgaaaacgaugaccucgcuacaagccuuguccuggauccuuacuugggguuccggacucacaagaugaauguuuccccagugccgcccuuacgccgacagcaacaucugcguucugcacuagagacguuucucagacagagggaccuggaagccgcguaucgggcucuuacccugggagguuggacagcccgcuacuuccagucaagaggcccuaggcaggaggcagccuugaaaacucacguauaucgguaccuccgcgcuuuucugccagaaaguggguucaccauccugcccuguacacgauauagcauggagaccaacggagcaaagauuguguccacuagagccuggaaaaagaaugagaaacucgaauuacuggucggcugcauagcugagcuuagggaagccgaugaggguuugcugcgggcgggggagaacgacuuuucuaucauguacucgacacguaagcgcucagcacaacuauggcucggaccugccgcuuucauuaaucaugauuguaagccaaacugcaaauuugugcccgccgacggcaaugcagcuuguguuaaggugcugagagauaucgaaccuggcgacgaggugaccugcuucuauggggaaggauuuuucggugagaaaaacgaacacugugagugccauacgugugagaggaagggcgaaggggccuuucggacucgaccacgcgagccggcgcuucccccuagaccacuggauaaauaccaguugagggaaaccaagcggcgccuccagcagggacuggacagcggcaguagacaagguuuacuggggcccagggccugcguccacccuuccccacuccgucgggaucccuucugugcagcuugccagccgcuucgacugccugccugcucugcuagacccgacacaagcccauuguggcuacaguggcugccucagccccaaccaaggguacgcccccggaagagaaggcgcccucgaccacggcgugccccgguucucuccacucaccaugcagccagagugucacugcacagguggggaggcuguggcccccauugccgccuuagaggggaggcucuggucgcguugggacagccuccacacgcacggugggcuccccagcaagacuggcacugggccaggcgauacggucucccuuauguggugcgcgucgaucugcggagauuagccccagcacccccggccaccccugcuccagccggcacacccgggccuauucugauccccaaacaggcacuagcguuugcuccauucaguccucccaagaggcuccgucugguugugagccauggaucuauagaccuugauguaggcggugaagaguuguga

SEQ ID NO: 63433 - RNA, 2220 nt, Artificial Sequence
  derived and/or modified sequence opt3 from SUZ12__Homo_sapiens__NP_056170
auggcuccccagaagcacggcgggggagguggcgggggaagcggcccuuccgccgguucugggggaggcggcuucgggggaucagcagccguggcggcugccaccgcaagugguggcaaaagcgggggaggcuccugcggugggggaggcucuuacucggccucaagcaguuccucugcugcagccgcugccggcgcggcaguccugccaguuaagaaaccgaagauggagcaugugcaagccgaccacgaacucuuucuucaggcuuucgagaaacccacacagaucuauagauuucugaggacucggaacuugauugccccuauauucuuacaucgcacgcugaccuacaugagccaccgaaauucccguacaaacaucaagagaaagacuuuuaaaguagaugacaugcuaucaaagguggagaaaaugaagggggagcaggaaagucauagccucucugcacaucugcaacuuaccuucacaggauuuuuccacaaaaaugauaagccaucccccaacucagagaaugagcagaacagcgucacccuggaaguguugcucguuaaggugugucacaaaaagaggaaagacgucaguugcccuauucgccaggugccaacugguaagaaacagguaccccugaauccugaucugaaccaaacaaagccaggcaauuuuccgucucucgcuguuuccagcaacgaguucgaacccucuaauucgcacauggugaaauccuauucauuacuguuucgggucaccagaccugggaggcgggaguucaacggaaugaucaauggcgagacgaacgaaaauauugacgugaacgaggaacuuccagcccgccgaaagagaaacagggaggauggugaaaagacuuuuguggcgcagaugaccgucuucgacaaaaaucggcguuugcagcugcuagauggggaguacgagguugccaugcaggaaauggaggaaugucccaucaguaagaaacgcgcaacaugggagacuauacucgacggcaagagacugccuccauucgaaaccuuuagccaaggacccacacuucaguucacccugagguggacgggcgagacuaacgauaaauccacagcuccgaucgccaagccuuuggcuacccgaaauucugagagccuccaucaggaaaacaagcccgggucagugaaaccaacucaaacaauugccguaaaggagagucugaccacggacuuacagacccggaaagaaaaggauacaccuaaugagaaccgccagaaacugagaaucuuuuaucaguuccucuacaauaacaauacuaggcaacagaccgaagcacgggacgaccuucacugccccugguguacacugaacugccgcaaguuguauucccuacugaagcaccucaaacugugucauagcagauuuauuuucaauuacguguaccacccaaagggagccaggaucgaugucucuauaaacgagugcuaugacgguucauacgcuggcaauccccaggauauucaucgucagccuggguuugcguucagucggaacggaccagugaaacgaacuccgaucacccacauucuuguuuguagacccaagaggacaaaagcaagcauguccgaguuucuggaaucugaggacggcgaaguggagcaacagcgcaccuauucgagcggucauaaucgguuguacuuccacuccgauacuugccucccucugagaccacaggagauggaagucgacucagaggaugaaaaggaccccgagugguuaagggaaaagacgaucacacagaucgaggaguuuagugaugugaacgaaggggagaaagaaguaaugaagcuguggaaccuacacguuaugaaacauggcuucauugccgacaaucaaaugaaccacgcuuguaugcucuuuguggagaauuauggacagaagauaaucaaaaagaaccugugccgcaauuucaugcuucauuuggucucuaugcacgauuucaaccugauuagcaucauguccauagacaaagccgugaccaagcuccgagaaaugcagcagaagcuggagaaaggcgagucagcaagcccugccaaugaagagauuacugaagaacaaaacgggaccgcuaauggauuuucugaaaucaacuccaaggagaaagcccuugagacagacagugucagcggugugucuaagcaguccaaaaagcagaagcuguga

SEQ ID NO: 63434 - RNA, 2052 nt, Artificial Sequence
  derived and/or modified sequence opt3 from SV2B__Homo_sapiens__NP_055663
auggacgauuacaaguaucaggacaacuacggcggguaugcccccagcgauggauacuauagagguaaugaguccaacccugaagaggacgcucaaucugaugugaccgaaggccacgacgaggaagaugagaucuacgagggggaauaucagggcauuccacauccggacgaugucaaagcaaagcaggccaaaauggcgcccucaaggauggacagucugcggggacagacagaucucauggcugagcgccuugaagacgaggagcaacuggcccaccaguacgaaacuauaauggaugagugcggucaugggcgauuccaguggaucuuguuuuucguuuuaggacuggcacuaauggccgacggcguggaaguauuuguggucagcuucgcucucccuuccgcagagaaggacaugugucugucuucgagcaaaaagggcaugcuugggaugauuguguaccugggaaugauggccggugcuuuuaucuugggcgggcucgccgauaagcugggacguaaaagaguucugucaaugagucucgcggugaaugcauccuucgccucuuuaagcuccuuuguccagggcuauggugcuuuccuguuuugcaggcuuauuucagggaucggaauaggcggcgccuugccaaucguguucgcauacuuuagugaauuucugagccgggagaagcgcggggagcaccuaucuuggcucggaauuuucuggaugacggguggccuguaugcuuccgccauggcguggucaaucauuccccauuacggguggggauucagcaugggcaccaacuaucacuuccacaguuggagaguauuuguuaucgugugugcccuuccuugcacagucucuaugguggcacugaaauucaugccagaaucccccagguuuuugcucgagauggguaagcaugacgaagcauggaugauacugaaacaagugcacgauacuaauaugcgggccaaggggaccccugagaaggucuucacaguuagcaacauuaaaaccccaaagcagauggacgaauuuaucgagauucagucgucuacuggcacaugguaccagcgcugguuagugcgauucaaaaccaucuuuaagcaaguaugggauaaugcucuguauugugugaugggaccguacagaaugaacacgcucauccuugccgucgugugguucgcaauggccuuuuccuacuauggccugacuguuugguuccccgacaugauuagguacuuucaggaugaggaauauaaaucaaagaugaaaguguucuuuggggagcaugucuacggagcuaccauaaauuucacaauggaaaaccagauccaccaacacgguaaguuggugaaugacaaguucacucggauguauuuuaaacauguacuauucgaggauaccuuuuucgacgaaugcuacuuugaggauguuacaaguaccgacacguauuucaagaacuguacuauugagagcacaaucuuuuacaauaccgaccuguacgaacacaaauucauaaacugccguuuuauuaauuccacuuuccucgagcagaaggaaggcugucauauggaucuggagcaggacaacgauuuucuuaucuaucuggugucuuucuuggggagccucucaguccugccuggaaacaucauuagugcguuacugauggaccgcaucggcagacuaaaaaugauugguggguccaugcucauaagcgcagugugcugcuuuuuccuguucuuuggcaauucugagucagccaugaucggauggcagugucuuuucugcggcacaaguauugcugccuggaacgcauuggaugucaucaccguggaacuguacccaacgaaucaaagggccaccgcuuuugggauccucaacggacuguguaaguucggugccauucuuggcaauacaauauuugcuagcuucguugggaucacuaaggugguacccauucuguuggcggcugccucccucgucggaggcggucugaucgcauuacggcugccugagacccgagaacaggugcuaauguga

SEQ ID NO: 63435 - RNA, 2031 nt, Artificial Sequence
  derived and/or modified sequence opt3 from SV2C__Homo_sapiens__NP_001284645
auggaggacagcuacaaggauagaaccucccugaugaaaggcgccaaggacaucgcuagggaagugaaaaagcagacagucaaaaagguuaaccaagcaguggaucgggcccaggacgaguauacucagcgcucuuacucacgauuccaggaugaagaggacgaugacgauuauuaccccgcgggggaaacguauaauggagaggcuaacgacgaugaggguaguagcgaagccaccgagggccacgacgaagaugacgagauuuacgagggggaauaucaaggaauaccuuccaugaaucaggcaaaggacucuaucguaucggugggccagccaaaaggugaugaguacaaggaccguagagaacucgagucagaaaggcgggccgaugaggaggaacuugcucagcaauacgagcugauuauccaggaaugcgggcauggacgcuuucagugggcauuguucuuugucuuaggcauggcccugauggcugacggcguggagguuuucguggucggguuugugcuaccgagcgccgaaacagaucucuguauucccaacaguggauccgguuggcugggcucuaucguauaucuugggaugaugguuggagcguucuuuuggggcggucuggcagacaaaguggggagaaagcagagcuugcucauaugcauguccgucaauggauucuuugccuuccugucaaguuuugugcaaggcuacggcuucuuucuguucuguaggcucuuaagcggguucggaaucgguggcgcuauuccuacuguguuuucuuauuucgccgagguccuggcacgggagaaacgcggggaacaccuuuccugguugugcauguuuuggaugaucggaggcauuuacgcuucagccauggcgugggccaucauaccacauuaugguuggagcuucaguauggggucugcauaccaguuucacuccuggcgaguuuucgugauuguaugugcucugcccugcgugagcucggucguggcccuaaccuuuaugccugagucuccaagauuccuccuggaaguuggcaagcaugaugaggcuuggaugauccuuaagcugauucacgacacaaacaugagggcccggggacagcccgaaaaaguguuuaccgucaauaagaucaaaacuccuaagcaaaucgaugaguugauugagauagaauccgacacaggcaccugguaucgucgcuguuucgugagaaucaggacggagcucuacgggauuuggcugacuuuuaugcggugcuucaacuacccaguacgagauaauaccaucaaauuaacaauaguuugguuuacucugucauucggauauuacggucucagugugugguucccggacgucauuaagccccuucagagcgacgaauaugcacuguugacccgcaacguggagagagauaaauacgccaauuuuacaaucaacuucaccauggagaaucagauccacacgggcauggaauaugacaacgggagguuuauuggagucaaguucaaguccgugacuuuuaaagauucuguuuucaagagcuguacauuugaggacgugaccucaguaaauacuuacuucaaaaacugcacauuuaucgauaccgucuucgacaacacggauuuugaaccuuauaaguucauugacagugaguuuaaaaauuguuccuucuuccauaacaagaccggcugccagauaacauuugaugacgauuacagcgcuuacuggaucuauuucgugaauuuucuagguacucuggcgguucucccagggaacauugugucugcacugcuuauggaccggaucggccgccugaccauguugggaggcucaaugguccucagugggaucagcugcuucuuucugugguucggaacauccgaaucuaugaugauugguauguuaugucuguacaauggccuaacuauaucggccuggaacagccucgaugugguaaccguggagcuguaucccacagacagaaggcgucggguucuuccuugcuguccaggguga

SEQ ID NO: 63436 - RNA, 10716 nt, Artificial Sequence
  derived and/or modified sequence opt3 from SVEP1__Homo_sapiens__NP_699197
auguggcccaggcuggccuucugcuguuggggccucgcucuugugagcgggugggcaaccuuucagcaaauguccccuucuaggaacuucucauuucggcuguucccagaaacagccccgggcgcgcccgguaguaucccugcuccacccgccccuggcgacgaagcagccgggucccgcgucgaacgauuggggcaggcuuuucguagaaggguucgguuacugcgcgaacuauccgaaagacucgaacugguguuccuuguagaugacucuucgucagugggcgaggucaauuuuaggagcgagcugauguucgugcggaaguugcucagugauuuuccaguugugcccacugcaacgcgcgucgccauugugaccuucuccucuaaaaacuacguaguuccucgaguggacuacauaagcacaagaagggcucggcagcacaagugcgcccugcugcuccaggaaaucccagcgauuuccuaccguggugggggaacuuauaccaaaggcgcauuucaacaggccgcucagaucuuacugcaugcccgcgaaaauucaacaaaggucguguuccuuauuaccgauggcuacaguaacgggggagacccgagacccaucgcagcuagcuugagggauucugguguggaaauauuuacuuucggcaucuggcaggggaauauucgggagcugaacgacauggccuccacaccuaaagaggaacacuguuaucuacuccauucauucgaggaauuugaggcgcuggcccgacgcgcacuucacgaagaucugccaagcggaaguuucauccaagacgauaugguccauugcucuuacuugugugacgagggcaaggauugcugugacagaauggguuccugcaagugugggacccacacgggacacuuugagugcauuugugaaaaaggcuauuacggcaaggggcuccaguacgagugcacugcuugccccagcggaaccuauaaaccugaagguucgccaggcgggaucucuuccuguauacccugcccggacgagaaucauacaucaccucccggaaguacuagcccagaagauuguguuugcagggagggcuaccgggccuccggucagaccugugagcuggugcacugcccugcuuuaaagcccccagaaaacggguauuucauucagaauacauguaacaaucauuuuaacgccgcaugcggcguacgcugucaccccggauucgaccuggugggcucuagcaucauucucugccuuccuaaugggcuguggucaggaagugaguccuacuguagagucaggaccugcccacacuugcgucaaccgaaacauggucacaucagcugcucuacgcgggaaaugcuauauaagacuacaugucugguggccugcgaugagggcuaccgacucgaagggucagacaagcugaccugucagggaaacagucagugggauggccccgagccuagaugcguugagaggcauuguagcacuuuucaaaugccaaaagacgugaucauuuccccacacaauugcgguaagcagccugcuaaauucgggacaauauguuaugucucuugccgccagggcuuuauccuuucgggagugaaggaaaugcugcgguguaccacgagcggcaaauggaacguagggguucaggcggcagugugcaaggaugucgaggccccacaaauuaacugucccaaagacaucgaagcuaagaccuuggagcagcaggauuccgccaaugugacauggcagauaccgacugcaaaggacaacucaggagagaaagucagugugcauguucacccugccuucaccccacccuaccucuuuccuauuggugauguggcuaucguauacacagccacugaccugucuggcaaucaagcaagcugcaucuuccacauuaaggucaucgacgcggaacccccagugauugauuggugcagauccccucccccaguucaggugucagagaaaguccaugcugccagcugggacgaaccgcaguuuucugauaacuccggggcagaguuagugauaaccaggagucacacacagggagaccuguucccucaaggcgaaaccaucguacaguauacugccacggaucccagcgguaauaaccgcacaugugacauucauaucgugaucaaggggucuccaugcgagauucccuucaccccuguuaauggcgauuuuauauguacuccagacaacaccggagucaauugcacacuaaccugucucgagggcuacgauuucacugaaggguccacagacaaauauuacugcgcuuaugaggauggaguguggaagcccacguacaccacugaauggccugacugugccaagaaacgauuugcaaaccacggcuucaagucauuugagauguucuauaaagcugcccggugcgaugacacagaccugaugaagaaauuuagugaagcguucgagaccacacuugguaagauggugccgagcuuuuguucggaugccgaggacaucgauugccguuuggaagagaaucugacuaagaaauacugucucgaauacaacuaugacuacgagaauggguucgcuauuggaccaggcgguuggggcgcagccaacagacuggauuauuccuacgacgauuuucuugacaccguccaggaaacggcuaccucuaucgggaaugccaagagcucaaggauuaaacgcagugcaccccuguccgauuauaagaucaaauugauauucaacaucacagcgucuguuccucucccagacgagcggaacgauacucuggagugggaaaaucagcaaagauuacugcagacccuagagacaauuacuaacaagcucaagaggacccugaauaaagaccccauguacagcuuucagcuugccuccgaaaucuugauugcugauucaaacagccuggagacgaagaaagccaguccuuucugccgaccgggaucugugcuccgcggccggaugugcgugaauuguccccuggggacauauuacaacuuagagcacuuuaccugcgaauccuguagaaucggaagcuaccaagacgaggaaggccagcuggagugcaaacuuuguccaucggguauguauacugaauacauacauucaaggaauauuucugacugcaaagcacaguguaagcaggggacauauaguuacuccggauuggagaccugcgagagcuguccucucggcacuuaucaacccaaauuugguucucguagcugccuguccuguccagaaaacaccucaacaguaaagcgcggcgcugucaauaucagugccugcggggugccuugccccgagggaaaguucagccggucuggccuaaugccaugucacccgugcccuagagauuacuaucagcccaacgcagggaaagccuuuugucuggcuugcccauucuacggaacgacccccuuugcgggcuccaggucaauuacugaauguaguagcuucuccucuacauuuucggccgcagaggaaagcguugugccuccagcuucacucggucauaucaagaaacgacacgagauauccagucaggucuuccaugagugcuuuuucaaucccugucacaacucugggaccugccagcaacugggacggggcuacgugugucuuugcccuuuggguuauacaggccugaagugugaaacugacaucgaugagugcagcccguuaccaugccucaauaacgggguuuguaaagaccuggugggagaauuuauuugcgagugucccuccggcuacaccgggcagcgcugcgaagagaauaucaacgaguguucaucuagcccuugccuuaacaagggaauuuguguagauggcgucgccgguuauagaugcacgugugugaagggguucgugggacugcacugcgaaacagaggucaaugaaugucagaguaaccccugcuugaauaacgccguuugugaggaccaggugggcggcuuccucugcaaaugcccaccuggguuucugggaaccaggugugguaagaauguagaugagugccuaucccaacccuguaaaaacggcgcuacuugcaaggacggggcaaauagcuuccggugucugugcgccgcgggauuuaccggcucucauugugaacucaacaucaaugagugccagucaaacccaugucgaaaucaggcuacaugcguggaugaacugaacuccuacaguuguaaaugccaaccugguuucagcgggaagagaugcgagacugaacagucgaccggauuuaaucuugacuucgaggucucuggcauauauggcuacgugauguuggaugggaugcugccguccuuacacgcccucacauguacguuuuggaugaaguccucagacgacaugaacuauggaacccccauuaguuacgcaguugauaaugguucugacaacacucugcuucugacagauuacaacggcugggugcuauaugucaaugggcgcgagaaaaucaccaacugcccauccgugaaugacggaagguggcaucacaucgccauuacuuggacaagcgcuaacggcaucuggaagguuuacauugaugguaaacucucagacgggggagcaggccugagugugggcuugccuauacccgggggaggugcccuggucuuaggccaggaacaggauaagaaaggggagggauucagcccagcggaauccuuuguaggcucuaucagccaacucaaucugugggacuaugugcuuuccccucagcagguuaagucacuggcuaccucuugucccgaggaauugaguaaggguaacgugcucgccuggccggauuuccugucggggauugucggaaaagugaagaucgacagcaaauccauauucugcucugauuguccacgucuaggcggcucaguaccucaucugcggacggcaagcgaggaccuuaagcccggguccaaagugaaucucuucugcgauccaggauuucagcuggucgguaaccccguucaauacuguuugaaucagggccaguggacucagccucugccgcacugcgagagaaucaguuguggggugcccccaccuuuagaaaacggauuccacucugccgacgacuucuaugcuggcagcaccgugacauaccaaugcaauaacgguuauuaccuccugggggauucaaggauguuuuguaccgacaauggauccuggaacggcgucagucccagcugccuugauguggacgagugcgccguuggcucugauuguuccgaacaugcaucaugccugaauguagacgggagcuacauauguucgugcgugccuccauauacuggagaugguaagaacugugcugagcccaucaaaugcaaggccccuggcaauccagaaaacgggcacucuaguggagagauuuacacagucggcgcggaggugaccuucuccugucaggaagguuaucaguugauggggguuacaaagaucacuugccucgagagcggcgaauggaaccaucugauucccuacuguaaagccgugucaugcggaaagccggcaaucccugagaauggcuguauagaggaacuagcuuuuaccuucggguccaaagucacguaucgcugcaacaagggauacacacuggccggugacaaagagucuagcugccuugcuaauaguuccuggagccacucuccacccgugugugaaccuguaaagugcucaaguccagagaacauuaauaacggcaaguauauccucuccgggcugaccuacuugagcacugcaucuuacucgugugauaccggauauucauuacagggccccagcaucauugaaugcacagccuccgguauaugggaccgagccccgccugcuugucaccuggucuuuugcggggagcccccagcgaucaaagaugcagugauuacuggcaauaacuucaccuuuagaaauacgguuacauacaccuguaaggagggauauacucucgccggccuggacacaaucgaaugccuugcugaugggaaauggagucggucugaccaacagugucuggccgugagcugcgacgagccucccauugucgaucaugcauccccagaaaccgcccacagguuguucggagacaucgcuuuuuacuauuguucagaugguuacagucuagcggacaacucucagcugcucugcaaugcccaaggcaagugggugcccccugaggggcaggauaugccacgcugcauagcacauuucugugaaaaaccgcccagcguuuccuauucaauccuggagagcgugucuaaggcuaaguuugccgcaggauccgucgugaguuucaaaugcauggagggcuuuguacuuaacacuagcgccaagauugaauguaugcguggugggcaguggaauccuucgccaauguccauccagugcauucccgugagauguggcgagccuccaucuaucaugaacggauacgcuucaggcagcaauuacaguuucggggccaugguugcguauuccugcaacaaaggauucuacauaaagggcgagaagaagucuacaugugaggcaaccggucaauggagcucacccauuccuacgugccacccggucuccuguggggaaccacccaagguggagaacggauuuuuagagcauacuaccggccggaucuucgaaagugaggugagguaucagugcaauccugguuacaaaagcgucggcucucccguauuugugugucaggccaaccgccacuggcacucagaauccccacugaugugcguuccucucgacugcgggaagcccccaccgauccagaauggauucaugaaaggcgagaacuuugagguggggagcaagguccaauucuuuuguaaugaaggauaugaguuggugggcgauucuaguuggacaugccagaaaucggguaaguggaacaagaaauccaauccuaaguguaugcccgcuaaaugcccagaacccccucugcucgagaaccagcugguucuuaaggaacugaccacagaggugggggucgugacuuucagcuguaaagagggacauguauugcagggcccaucagugcuaaagugccugcccucucaacaguggaaugacagcuuuccuguuuguaaaauuguccucugcaccccgccacccuuaaucuccuucggugugccuauaccaaguucagcccugcacuuuggcucuacggugaaguacagcugugucgggggauucuuucuucgaggcaacuccacaacucugugccagcccgaugggaccuggaguagcccucuccccgaauguguuccaguggagugcccgcaaccugaagagauucccaauggaaucauugacguacagggcuuggcuuaucuguccacagcacucuauaccugcaagccagguuucgaacugguggggaacacuaccacacuuuguggagagaauggccauuggcuaggcgggaaaccuacgugcaaggccaucgagugucugaaacccaaggaaauauugaacggaaaauucucuuacacugauuuacacuauggucagaccgucacauacucaugcaauagaggcuuucggcuggaggggccaagcgcucucaccugucuggaaacuggagacugggacguggaugccccuucgugcaacgcaauucacugugacagcccccagccgaucgagaacggcuucguugaaggugcggauuauaguuacggggccaucauuaucuauucuugcuuuccaggauuccaaguggcuggccaugccaugcagacaugugaggagagcggcuggucauccucuauuccuaccugcaugcccauagacugugggcuuccaccccacaucgauuuuggagacugcacgaagcugaaggaugaccaggguuacuucgaacaggaggaugacaugauggaagucccuuauguaacuccgcauccacccuaccaccucggcgcaguggcuaaaacaugggagaauaccaaggagaguccugccacccauagcuccaacuuuuuguacgggacuaugguuucauauacaugcaaucccggauacgaacugcuaggcaacccagugcugauuugucaagaggaugguaccuggaaugggagcgcaccuucuugcaucaguaucgaaugugaccuccccacagccccagagaacggauuccuuagguuuacugaaacguccaugggcagcgcuguccaguauucaugcaaaccuggccacauucuggcggggucugauuuacgcuugugucuggagaauagaaagugguccggagccucgccgaggugcgaggcaauaagcuguaaaaagcccaacccagugaugaaugguaguaucaagggcucuaacuacaccuaucucuccacacuguacuaugaaugcgacccuggguacguccuuaauggaacugagcggcguaccugucaggacgauaaaaacugggacgaagaugagcccauuugcaucccaguggacuguagcucaccucccguuagugcuaauggccaggugcgcggugaugaauacacauuccaaaaggagauugaguauaccugcaacgaaggguuucugcucgagggagcccgauccagaguaugcuuggccaauggcagcuggucuggcgcaacuccggacugugugccagucaggugcgcuacgccuccccagcuggccaacgggguuaccgaaggauuagauuacgguuucaugaaagaggugacauuucacugucaugaaggcuauauccuacacggggcgccaaagcugacuugccagucagacggaaacugggaugcugagauaccccucuguaaaccugucaauugcggacccccagaggaccuugcccaugguuucccuaacggguucagcuuuauccacggaggccacauucaguaccaauguuucccgggcuauaagcugcauggaaauuccucucggcgcugcuugaguaacggaucguggagcgguuccucacccucuugucugccaugcagauguagcaccccugugaucgaauacggcacaguaaaugggaccgauuuugacugcggaaaggcagccaggauucagugcuucaaaggcuuuaagcuccugggucuuagugagaucacuugugaagcugacgggcagugguccucaggauucccccacugcgagcauacaucuuguggcagccucccaaugauaccuaacgcauuuauuuccgagacgaguagcuggaaagaaaaugugaucaccuauucuugccggucaggcuacguuauucaaggguccagcgaucugaucuguacugagaagggaguguggagucagcccuacccggucugcgaaccuuugucuugugguuccccacccucgguggccaacgcggucgcuacaggcgaggcccacaccuaugaaagcgaggugaaacugcgaugcuuagagggguacaccauggacacagauacugacacguucaccugucagaaggauggaagaugguuuccugaacgcauaucaugcucccccaaaaaguguccccuaccugagaauaucacacauauucugguucacggcgacgauuucucuguaaacagacaggugagugucagcugcgcagaagguuauacuuuugagggggugaauaucucaguuugccaacucgacggcaccugggaaccacccuucuccgaugagagcuguucuccggugaguugcggaaagccugagucccccgaacacggcuuugucguggggagcaaauacacauucgagucaaccauuaucuaucagugugaaccaggauacgagcuugaagguaaccgggagcguguaugccaggagaauagacaguggucuggcgggguggccauauguaaggaaacuaggugcgagacgccccuggaguucuugaacggaaaagcugacauugagaaucgcacaaccggcccuaacguugucuauucguguaaccgggguuacagccuggaggggccauccgaagcccauugcacugagaauggcaccuggagucaccccgugccucucuguaagccaaacccgugccccgugccuuuugucaucccagaaaaugcacugcuuucugagaaagaguucuacguugaucaaaacgugucaaucaagugucgagagggauuuuuacugcagggccaugggauuaucacaugcaaucccgacgagacuuggacccagacaagcgcuaagugcgagaaaauuuccuguggaccuccagcccacguagagaacgcgauugccagaggugugcauuaucaguacggcgauaugaucacguauaguugcuacucuggguauaugcucgaaggauucuugaggagcgucugucuggagaauggcaccuggacuucacccccgauuugccgcgcagugugucgguuuccuugccaaaacgguggcaucugucagagaccaaaugcuugcagcugucccgaaggguggaugggacgucuaugcgaggagccuauauguauccugcccugccucaacggcgggagguguguugccccauaccagugcgacugcccgccuggauggacaggcagccggugucacaccgcagugugccaaucucccugucuuaauggugggaagugcguccgcccaaaccgaugucacugccuguccaguuggacuggacauaauuguucaagaaaaaggcggacaggcuucuga

SEQ ID NO: 63437 - RNA, 5367 nt, Artificial Sequence
  derived and/or modified sequence opt3 from SVIL__Homo_sapiens__NP_003165
augaagagaaaagagaggaucgcccggcgccuggaaggcauugagaacgacacccagcccauacuccuucaaagcugcacagggcuggugacucaccgauuguuagaagaggauacgccucguuacaugagagcuuccgacccagcaucuccgcauaucggaaggucaaaugaagaggaggaaaccagugauagcucccuggagaagcagacacggucuaaauauuguacugaaaccucggguguccacggcgacucacccuacgggagcggaacaauggauacccauagucuagaguccaaggccgagcgcauugcgagauauaaagcugaaaggcggcgccagcucgccgagaaguacggccugacucuugacccugaagcagauucugaguaucugagccgauacacaaaguccagaaaagaaccagacgccguugagaagaggggugggaaaucagauaagcaggaggaaaguagccgggacgcuucuuccuuguaucccggaaccgagacgaugggccuccguacuugcgcaggcgaaucaaaagauuacgcccugcacgugggggacggaagcagugauccugagguacugcucaacaucgaaaaucaacgcagaggucaggaguuaucugcuaccaggcaggcccaugaccuguccccagcggcagagagcucgucuacauucuccuuuucaggccgggacaguagcuucacugaagugccccgauccccuaagcacgcccacucuagcucacuucagcaagcugccagucgcuccccaagcuuuggggauccgcaguugucucccgaggcaagaccuagguguaccucacauagugaaacaccaaccgucgacgaugaggaaaagguggacgagcgggcuaaacugagcguugccgcgaagcgccuacucuucagagagauggaaaaauccuuugaugagcagaacgugcccaagaggcguucucggaauacggccgucgaacagcgacugagaaggcuucaagaccgcucgcugacucagccuauuacaaccgaggaggugguaaucgcagcuacuuugcaggccagcgcucaccaaaaagcccucgcaaaggaucagacaaacgaaggaaaagagcuggccgaacagggcgagccagacuccucaaccuuaagucuggcugaaaagcucgcgcuuuucaauaagcugucucagcccguuagcaaagcaauauccacgcggaacagaaucgauaccaggcaacgccgaaugaaugcccgguaccagacacagccggugacuuugggugaggucgagcaggugcaaucagggaagcuaauuccuuuuagccccgcugugaacaccucugucuccacaguugccaguacuguggcaccaauguaugccggagaccugcguaccaaaccuccccucgaucauaaugcuagcgccacagacuacaaguucucuuccucaaucgaaaacagugacagcccaguaagaucgauucugaaaucccaggcauggcagccccuuguggagggcucugaaaauaagggcaugcugagggaguauggggaaaccgagagcaagcgcgcguugacuggacgggauucagguauggagaaauacggcaguuuugaagaggcugaagccuccuauccuauccucaacagagcaagggagggggacucucacaaggaaagcaaauacgccgucccacgacgcggaucccuggagcgggcuaauccgcccauaacgcacuuaggcgaugagccuaaggaauucucaauggccaaaaugaacgcacaggguaaccuggaccuaagagauaggcucccauuugaggaaaagguggagguugagaaugugaugaagcguaaauucagccugcgcgcugccgaauuuggggagcccacaagugaacaaaccggcacugcggccggaaagaccauugcucagacaaccgcaccugucucuuggaaaccacaggacuccagcgagcagccccaagaaaagcuuugcaaaaacccgugugccauguucgcugccggcgagaucaagacuccuacaggggagggauugcuggauucgccaucaaagacgaugucuauuaaagaacggcucgcacugcuuaagaaaaguggugaggaagacuggagaaauaggcugucccgacggcaggagggcgggaaggcgcccgccagcucuuugcauacccaggaagcuggacgcagccucaucaaaaagagagugacugaguccagggagucacaaaugacaaucgaagagcggaaacagcugauuaccguacgagaagaggccuggaagacaagaggccgcggugcagcuaacgauaguacucaguucaccguugccgggaggauggugaagaaaggcuuagcaagcccuacggccauaacccccgucgcuucuccaaucugcggaaagacacguggcacuaccccuguguccaaaccccuggaagacauugaggcgcggccagauaugcagcuagagucagaccucaagcuggauagacuugaaacauuuuugaggcgccugaauaacaaagucgggggaaugcacgagacugugcucaccguuacggguaagagugugaaggaaguaaugaaaccggacgacgaugagacauucgccaaguuuuaucgaagcgucgacuacaauaugccuagaucccccguggagauggaugaagacuucgauguuaucuuugacccauacgcacccaaacugaccucuucgguggcugagcauaagcgggccgucaggccuaaacgccgugugcaagccagcaagaacccauuaaagaugcuggcugcaagagaagaucuuuugcaggaguauacugaacagcggcucaauguagccuucauggagucaaaaaggaugaagguggagaaaauguccaguaacucuaauuuuagcgaaguuacacuggcgggccuagcuuccaaggagaacuucucaaaugucucucugcgcagcgugaaccucaccgaacagaauaguaacaacuccgccgugcccuacaaacgacugaugcuuuugcaaauaaaggggagacggcacguccagacuaggcugguugagccucgcgcaagcgccuuaaauucuggagacuguuuucuccugcuuucaccgcauugcuguuuccugugggugggcgaauuugcuaacgugauugagaaggcaaaagccuccgaguuggcgacccucauccagacaaagagagaacuggguugcagggcuacguauauccagaccauugaggaagggaucaauacucacacacacgccgcaaaagauuucuggaagcuacugggcggacaaaccaguuaccagagcgccggcgacccaaaagaggaugaacucuaugaggcugccauuauagagacaaacuguaucuaccggcugauggacgauaagcuuguacccgacgacgauuauugggggaaaauuccuaagugcucguugcugcagccaaaggaagucuuaguguuugacuucggaucugagguuuacguguggcauggcaaagaagucacucucgcacaacguaagaucgcuuuccagcuggccaaacaccuuuggaaugguaccuuugauuacgagaacugcgacaucaauccccuggauccuggggaguguaacccgcuaauuccccgcaagggacagggccgaccagacugggcgauauucgguagacucacggaacauaaugagacaauccuguuuaaagaaaaguucuuggauuggaccgagcugaagagguccaacgaaaaaaauccuggcgaguuagcccagcacaaggaggacccccggacugaugugaaagcauaugacguuacccgcauggugagcaugccacaaacaacugcugggaccauucucgauggaguaaacgucggcagaggguacggacugguggaaggccacgacaggcggcaguuugagaucacaucagugagugucgacguuuggcauauucuugaauucgauuauucucgacugccuaagcaguccaucggucaguuucacgagggggacgccuacgugguaaaauggaaguucauggugagcacggcugucggaucaagacaaaagggcgaacauagugugcgcgcagccgguaaagagaagugcguuuauuuuuucuggcagggcaggcacagcaccguguccgagaaagggacuucugccuugaugacagucgaacucgaugaggaacggggagcucaggugcagguucugcaaggcaaggagcccccauguuuucuacagugcuuccaggggggaauggugguccauagcggccguagagaagaggaggaagagaauguacaguccgaauggaggcuguacugugugcgcggugagguuccgguggaggggaaccuucucgaagucgcgugccacuguucaucucugcggagucgaaccucgauggugguauugaaugugaacaaagcacugauauauuuauggcacggaugcaaggcccaagcucauacuaaggaggucggcagaacagccgcaaacaaaaucaaggaacaguguccucucgaggccggucugcacagcuccucuaaaguuaccauucaugaaugcgacgagggcucagagccccuuggguuuugggaugcucugggaaggcgcgaccggaaggcguacgauuguauguugcaggacccaggcagcuucaauuucgcccccagacucuuuauccuguccaguucuagcggggauuucgcagcuacggaauuuguguacccugcccgugcaccaucaguggucuccaguaugcccuuccuacaagaggaccuguauagcgccccucagccggcucuuuuucucguggauaaccaccaugaaguuuaccuguggcagggaugguggccaauugagaauaaaaucacuggcucugccaggauacggugggcguccgaccgcaagucagcaauggaaaccguauugcaguauugcaaggguaaaaacuuaaagaaacccgccccuaagagcuaccugauucacgcugggcucgagccccugacauucaccaauauguuuccaucgugggagcaccgagaagauaucgccgagauuacugaaauggacacagaggugucuaaccaaaucacccuugucgaagacgugcuggcuaaauugugcaagacaauauauccucuagcagaucugcucgccagaccccugccagagggaguugacccucuuaaauuagagaucuaccugacugaugaagacuucgaguuugcucucgauaugaccagggacgaauauaaugccuugccggcauggaagcaggugaaccugaagaaagcgaagggccucuucuga

SEQ ID NO: 63438 - RNA, 234 nt, Artificial Sequence
  derived and/or modified sequence opt3 from SVIP__Homo_sapiens__NP_683691
augggccugugcuuccccuguccuggggagagcgccccaccgacccccgaccucgaagagaagagagcuaaacuugcagaagccgcggagaggcggcagaaggaagcugccucccgcggaauccuggaugugcaaucuguccaggagaaacgaaagaaaaaggagaagauugaaaaacagauagcaacaucagguccuccacccgagggcggguugcguuggacuguuaguuga

SEQ ID NO: 63439 - RNA, 1647 nt, Artificial Sequence
  derived and/or modified sequence opt3 from SVOP__Homo_sapiens__NP_061181
auggaggaagaccuguuccagcucagacaacuucccguggucaaguuuaggcggaccggcgagagcgcccgcuccgaagaugacacagcuucuggggagcacgaaguucagaucgagggagugcauguaggucuggaggcaguggaauuggaugacggcgccgcggucccuaaagaguucgcuaacccaacugaugacacguuuaugguggaagaugccguugaggcaauuggguucggaaaguuucaguggaaauuaucagugcugaccggccuagccuggauggcugacgcaauggagaugaugauacucaguauccuggccccgcagcuucacugcgaauggcgacugcccagcuggcaagucgcuuugcucacauccgugguauucguugguaugaugucuucgucaacucugugggggaauauuagcgaucaguacggacguaagaccggccugaaaaucagugugcucuggacauuauauuacggcauucuguccgccuuugcgccugucuauucuuggauccuuguguugagagggcuggugggauucgguauaggcggggucccacagagcguuacccuauacgcagaguuucuccccaugaaggccagggcuaaguguauccugcuuauugaaguguucugggccaucggaacuguauuugaggugguccuggcaguguucguuaugccuuccuugggcuggcgguggcuccugauuuuaucagcugugccacugcuccuuuuugccguccugugcuucugguugcccgaaagugcgcgcuaugacgugcuaagcgguaaccaggagaaagccaucgcaacacugaagagaauagcuaccgagaauggggccccuaugccacucggaaaacugauuaucucuaggcaagaagaucggggcaagaugcgcgaccuuuucacgccgcauuuucgauggacuacccuguugcucugguucauuugguuuuccaacgcuuucucauacuauggccugguauuacugacaacugagcuauuucaggccggggauguuuguggaaucagcaguaggaaaaaggcaguggaagccaagugcucucucgcuugugaguaccuguccgaagaggacuacauggaccuuuuguggaccacacugagcgaguuccccgguguccucgugacccuguggaucauugauagacuuggccggaaaaagacgauggcgcugugcuuugucauauucucguuuuguucuuugcuccuguucaucugcguggggcguaauguuuuaacucugcuacucuuuauugcacgcgccuucaucuccggaggcuuucaggcugccuauguguacacaccugaaguauauccaaccgcaacuagagcccugggucuugggacauguucaggcauggcuagggucggagccuugauaacccccuucauugcacaggugaugcuggagaguagcguuuaccucacgcuggcgguguauuccggcugcuguuuacuggcugcccuugcaucuugcuucuugccuaucgaaaccaaagggcggggacuccaagagagcucacaccgagaauggggucaggagauggucggccgcgggaugcauggagccggcgugacaagaaguaacuccgguagccaggaguga

SEQ ID NO: 63440 - RNA, 1758 nt, Artificial Sequence
  derived and/or modified sequence opt3 from SWAP70__Homo_sapiens__NP_055870
augggcagccugaaggaggaacuccuuaaagccaucuggcacgcuuucaccgcacuggaccaggaucauuccgggaaggugucuaaaucacaauugaaggucuuaagucacaaccugugcacaguucuaaaagugccccaugacccuguagcccucgaggaacacuuuagagaugacgaugagggaccagugagcaaucaggguuacaugccguaucugaacagguucauucuugaaaagguccaggacaauuuugauaagauagaguucaaccggauguguuggacucugugcgugaaaaagaauuugacgaaaaacccccuccugaucaccgaggaagacgcguuuaagauuuggguuaucuucaauuuucuguccgaggauaaauacccucucauuaucgugucugaagagauagaguauuuacugaagaaacuuacagaagcuaugggcgggggauggcagcaagagcaguucgaacauuacaaaaucaacuuugacgauucgaagaauggcuugucagccugggagcugauugaacuaaucgguaacgggcaguucagcaaaggaauggaccgccagacugucaguauggcaauuaaugagguguuuaacgagcucauccuggauguacuuaagcaaggcuauaugaugaaaaagggccaccgacguaaaaauuggaccgaaagaugguucguucugaagccaaacauaauuuccuacuaugugucugaggacuugaaggacaaaaagggggauauccuccuggacgaaaauuguugcgucgagagcuuacccgauaaagacggaaagaaaugucuguuucucgugaagugcuucgauaagacauucgaaauuuccgccucagacaaaaagaaaaagcaggaguggauccaggcuauccacaguaccauucaucuucugaaauuggguagcccuccaccccacaaggaggcaaggcagcggcgcaaggaacuaagaaagaagcaacuggccgagcaggaggaacucgaaaggcagaugaaagagcugcaagcugccaacgagucuaagcagcaggaacuugaggcggugcggaaaaagcuggaagaggcagccucccgcgcugccgaggaagagaagaaacgauugcagacucaagucgaacuccaggcaagauuuucaacagagcuggaaagggagaaguuaauacggcagcagauggaggaacaaguugcucagaaaagcagugagcuggaacaguaccuacagcgugugcgcgagcucgaagauauguaccugaaacuucaagaggccuuggaggacgaaagacaggcgaggcaggaugaggaaaccguacggaaacugcaggcccgacuccuggaggaagagucuuccaagcgcgcagagcuugaaaaauggcaucuggagcaacagcaggcuauccaaacgacugaagccgagaagcaggaguuggaaaaccagagagugcucaaggagcaggcucugcaagaagccauggagcaguuagaacagcuggagcuagagaggaaacaggcacucgaacaauaugaggaagucaagaaaaagcuggagauggccaccaauaaaacaaagagcuggaaggacaaaguggcucaccacgaaggccuuauucgguugaucgagccugggucgaagaacccacaucugauaacuaauuggggaccggcggcauucaccgaggccgaacucgaggaacgcgagaaaaacuggaaggaaaagaagacaaccgaguga

SEQ ID NO: 63441 - RNA, 2703 nt, Artificial Sequence
  derived and/or modified sequence opt3 from SWT1__Homo_sapiens__NP_060143
augagcuccaaggagucuugcggcaaaaaggaaaccucacagagaaaagacacaacuacgaguagccccaacuucggggagaaggauaaaaaggaaaggaagaccccugccuccucuacaucgucaagcaguauccgguccgugucuagcgagaaacgcaagcugaaauccgaccacacugauguccucuacuauaauauuaagcgacgucaaggacuuaaaagacugucaguugaaauagacaccuugaggcggcgcccaaagaucgguaguagcucucagagaccgauuaaguuaaaagaggcuuccuacucaaacgauaaucagaucauucugcagagccccaguucuaacggcacaaagaaagacauccauaaguguguggauuuuaaaccuaaggacauaaaacuaaccaaugcaggguccaagcucgaucacggaaucaagagccugucgucuccaaaaauugccuccgacguaaagcccaaagcggagggccaagcgucagaaaacaaguggagucaucuucuggugcagagggagaaaaugaaggaauugaagaaaggucggaauagcaaguuccgcgauaacuccgagaaaugcguccucgagaaguggaaacgaaaucaguuuucucaggacuauaacagcaauaagaucauuaaggaaccucuggggucaagaaggcagaaaaucaguuucaagauaccaauuaaaucccgggauacucugcaaaagcucguggaggaaaacguuuuuaauaucgacagcaacaauucuaaaacaaagcaggaggaacgugaguacuuagagucaagucaggugagccugaacgucacccgccaaaagacggaacaccuuuuguccgacuucacuuauaaaagaaccgugcaugaguggaagaggaaacaccacuacgaucaucaggaaucuaacgacucgcacagccgggagaaucugacacaguccuuugaagcccccuguugcucaguaaguucugagagcauucaagaugcagaccaggagaugcagaucguugaggaacuacaugccgcucgagugggaaaguccgucgaucucccuggcgaacugaugucaauggagaucgaccuugaagaugacgugcacaguucuuccgcaaacaauacuagcgaucgcaaacuguugauugugauagacaccaacauccucaugaaucaccugaaguucgucagaauuuuaaaaacaaccgagguuccaggcuuugauaagcuggugcucaucauaccguggguagugaugcaggagcuugacaggaugaaggaagggaaacuguugaagcgggcccaacauaaagcuauucccgccguccacuucaucaacgacagccuaaagaaucaggaucgcaaacuguggggacagucuauccagcucgcgucccaaaagcauuauggucugucagacgagaacaaugaugacagagugcuuaaguguugccugcagcaccaggaauuguuuccuuguaguuucguuauucucugcacggaugacaggaaccugcguaauaaaggcuuaaucagcggggugaagucgcuguccaaagaggagcuaucugcagaacuccugcaucuuagcuugaacacugaugucugucaccagccaugcauucccaagcaacagcugaaagccgagacaaccccucucaaggaaucauacaaggaggaaaguacuaauuccggacugucuauacuucuggagagcaucguguccgacuuggagaaaucacucggcacaggucugagcaguauuuuagaaaccgagaugaagaucgcuuuugggaaccuguggauggaaauccuauaccucaaaccacccuggacgcugcuucacuugcugcaguguuucaagaaacauuggcucgccguauucggacugguuauggagaagaauuuacugcuuaccauugaaucuuuguauaagaaccuccggaaagcaaacaaggcuguggauuuuacaacugucaaauuccugcuacaggacucccgaagccugcuccacgccuuuucgaccagaucaaauuacgauggcauacugccgcaaacauucgcucaggugaacaaucuuuugcagacuuuugccgaggucaagaccaaacugaagccuaacucuagugagaauacagugaccaaaaagcaagaaggcacuuccuuaaagaacagccauaaucaggagaucacgguuuucucuagcucccaccucccccagccaucaaggcaccaggaaauuuggaguauccuggagagcguguggauuacaaucuaucaaaacucuaccgacguauuucagcgccuuggguccaauucagcacugacuaccaguaacauagcuagcuucgaagaggccuuuaucugcuugcagaaacucauggcugccguccgggauauucuggagggaauccagaggauucuagcaccuaauuccaacuaccaagacguggaaacacuguauaauuuccucaucaaguacgagguuaacaaaaaugugaaguuuaccgcccaggaaauauaugacugcgucucucagacugaguacagagagaaacugacaauugguugucgccagcuuguggaaauggaguacacgaugcaacagugcaacgcuucgguauauauggaagcgaagaaccgaggcuggugugaggauauguugaauuaccggaucuga

SEQ ID NO: 63442 - RNA, 1989 nt, Artificial Sequence
  derived and/or modified sequence opt3 from SYBU__Homo_sapiens__NP_001093213
augggcccccugagagagagcaaggaacacagggugcagcaucacgacaaagagaucucccggucucgcauuccucgacucauacuucguccacauaugccgcaacagcagcacaaggucucacccgccagugaaagcccuuucuccgaggaagagucuagagaguuuaacccaucgucaagcgggaggagugcucggaccguuuccucuaauagcuucugcuccgaugacacaggaugucccucaagucagagcgugucuccuguaaaaacuccauccgaugcagguaacucacccaucggcuuuugcccugggagcgacgaaggauucacgcgcaagaaauguaccauuggcauggugggugaggggaguauccaaucuuccagauacaagaaggaaagcaaaucgggacuggucaagccaggcucugaggccgauuuuuccucaaguagcuccacaggcucuauuagcgcgccggaggugcauaugucaacugcugggaguaaaagguccucuagcucacggaaucgcggaccccacggucgaaguaacggcgccagcucccacaagccugggucuucgccaagcucccccagagaaaaagacuuguuaucaaugcugugcaggaaucagcuaaguccuguuaacauccauccaucuuaugcacccagcuccccgucaagcucuaauuccggaaguuacaagggcagcgauuguucuccuauaaugcggcguuccggucgcuauaugucaugcggggagaaccacggagugagacccccaaauccugaacaguaccucacaccccugcagcaaaaggaggucaccgugaggcaucuuaaaaccaagcugaaagaaagugagcggcgauugcacgagcgcgaaagcgagaucguagaacucaagucgcagcuggccagaaugagggaggacuggauugaagaggagugucaccggguugaagcucagcuggcacucaaagaggcccgcaaggaaaucaaacaguuaaagcaagugauugagacuaugagauccucucuggcugauaaggacaaaggcauccagaaguauuucgucgauauaaacauucagaauaaaaaguuggaaagccuucugcaaucaauggagauggcccauaguggcucccuaagggacgagcucugccuggauuuuccaugugacucucccgaaaagagccuuacacugaacccuccauuggacaccauggcggaugggcucucccuggaggaacaggugacgggagagggugcagaccgugaguuacuggugggcgauucaaucgccaauagcacugaccucuucgaugaaauugucaccgcuacaacuaccgagaguggggaccuugaacugguucacucuacaccgggagccaacguguuggagcuacugcccaucguaaugggccaggaagaggguuccguggucguggagcgggcaguucagaccgauguggucccuuacagcccagcuaucucggaacucauucaaucagugcugcagaaacuucaggaccccugcccuucuagucuggccuccccagaugagagcgaacccgacucuauggagagcuuuccggaauccuugucagcgcucguaguugaucugacgccucgaaauccaaacagugccauauuacugagccccguggagacuccuuaugcaaacgucgacgcugaggugcaugccaauagacuaaugagggaacucgacuucgcugccugugucgaggaacgccuggauggggugaucccccuugcacggggcggaguugugagacaguacuggucuuccucauuuuugguagaccugcucgccgucgcugcgccagugguuccuacagugcugugggcauucaguacccaaaggggcgggacugaucccgucuacaacauuggagcccuucugcgcgguugcugcgugguagcuuugcacagccuccgacggacagccuuucguaucaagaccuga

SEQ ID NO: 63443 - RNA, 957 nt, Artificial Sequence
  derived and/or modified sequence opt3 from SYCE1__Homo_sapiens__NP_001137235
auggccggcagaagccugaccuccaaggcugagcccacagcaggggccguggacagggcggaaaaagcuggaggucaggauacuucuucacaaaagaucgaggaccucauggaaaugguccagaaacuucagaagguuggcagucuggagccucggguggaaguauugauuaaccgcauaaaugaggugcagcaagccaaaaagaaggcaaacaaagauuuaggggaggcccgaacgaucugcgaagcucugcagaaggagcuagacagccuccacggagaaaaaguccaucugaaggagauucuuuccaaaaagcaggagacccugcguaucuugagacuccacugucaggaaaaggagucugaagcacauaggaaacacacaaugcugcaagagugcaaggaacggauuucggcccugaaucuccagaucgaggaggagaaaaacaagcagcgccaguuaagacuggcuuucgaagaacaacuugaggauuugaugggccagcauaaagaccugugggauuuucacaugccagaaaggcuagccaaggagauaugugcgcucgacucaagcaaagagcagcugcuuaaggaagagaagcuggugaaagcaacuuuggaagauguuaagcaccaacucugcagucuguguggugccgaggggccguccaccuuagacgaaggacuguuccuccggucucaggaggcugccgcaacagugcagcuuuuucaggaggaacaucgcaaagcugaggaacuguuggccgcggccgcacaacgacaccagcagcuacagcaaaagugccagcagcagcaacagaaaagacagaggcugaaggaggagcucgaaaagcauggcaugcagguccccgcucaagcccagagcacccaggaggaagaggcuggcccuggggauguggccccacggcccggacguccuguaacuuggugguccuga

SEQ ID NO: 63444 - RNA, 729 nt, Artificial Sequence
  derived and/or modified sequence opt3 from SYCE1L__Homo_sapiens__NP_001123451
auggccggcaagcugaaaccccucaacguggaggcuccugaagcaaccgaggaagccgaggggcaggcuaagagccuuaaaacagaagaccuguuggcgauggucaucaaguuacaaaaagagggaucccuggagccacagauugaagaucuaauaucuagaaucaaugaccuccagcaggccaagaagaaaucaagugaggaacugagggagacucacagccuuugggaggcacugcaucgggaauuggauucccucaacggugagaagguucaccuggaagaggugcugggcaaaaagcaagaagcccuccgcauuuuacagaugcauugccaggagaaagagucugaagcucagcgacuggacguacgugggcaacuugaggauuugaugggacagcacaaggaccugugggaguuccauaugcuagaacagagacucgcaagggaaauccgggcccuggagcgcucgaaggagcagcuucugucagaaagaagguuggugcgggcuaaacuccgcgaggucgaacgaagacugcacagcccgcccgagguggaaggcgccauggcgguuaaugaugguuuaaaggcagagcuggagauuuuuggggaacaagugaggagugccccugaggucggagcuggcgaaggcgaggccgggccagagcucccccgggcacgugacgaagaggauccugaaccacccguggcugccccugacgcgcuuuga

SEQ ID NO: 63445 - RNA, 4593 nt, Artificial Sequence
  derived and/or modified sequence opt3 from SYCP2__Homo_sapiens__NP_055073
augcccaucagaccugaccugcagcaacucgagaagugcauugaugacgcccuuaggaaaaacgauuucaagccacugaaaaccuuguuacagauagacaucugugaagaugugaagauuaaaugcagcaagcaguuuuuccacaaggucgacaaucugaucugucgggagcuaaacaaagaagauauucauaauguuuccgcuauccucgugucuguaggccgcugcgggaagaacauaucagugcugggacaggcaggucuucugacaaugaucaaacaaggcuugauucagaagauggucgccugguuugagaaaaguaaggacaucauucagagccagggaaauuccaaggaugaagcggugcucaacaugaucgaggaccugguugaucugcucuuagugauacacgacgucucugaugaggggaaaaagcaagugguagaaucguucguuccgcgaauuuguucacuggugaucgacagccgugucaauauuugcauccagcaggagaucauuaaaaagaugaacgcuaugcuugacaaaaugccccaggaugccagaaagauauugaguaaucaagaaaugcugauccuaauguccucuaugggcgagaggauucucgacgcuggugauuacgaccuucagguggggaucguggaggcccuuugucggaugacuacggaaaaacagcgccaagagcuggcucaucagugguuuagcauggauuucauagcaaaggccuuuaagagaauuaaagacuccgaguucgaaaccgauugcaggaucuuuuugaaccucgucaauggaaugcugggcgacaagcggcgcguuuucacauuuccuuguuuaucagcuuuccuggauaaauaugaacuccagaucccaagugacgagaagcuggaggaauuuuggauugauuucaaccugggcagccagacuuugucuuucuacaucgccggggacaaugacgaucaccaaugggaggcggugaccguacccgaagagaaagugcagauuuauuccauagaaguccgagagucaaagaagcuacugacaaucauucucaaaaacaccgugaagaucagcaaaagagagggaaaggaacugcuucuguacuuugacgcaaguuuggagaucacuaauguuacacagaaaauuuucggugccaccaagcauagggaaucuauacggaagcagggcaucuccguggcuaaaacgagccuccacauucuguuugaugccucggggucucaaaucuuagucccugagucccagauuucaccagugggagaggaacugguaagucuaaaggagaaaagcaagucccccaaagaauuugcaaagccuucuaaguauaucaaaaacagcgacaagggcaaccguaauaacucacagcucgagaaaacuaccccaaguaagcgcaaaauguccgaagcuagcaugauaguuucuggugccgauagauacacaaugaggucaccggugcuguucaguaauacuagcauucccccucggcgacgcagaaucaagccaccccuucagaugaccuccucugcggagaaaccuucggucagccaaacauccgagaacaggguggacaaugccgcaucauugaagagucggucuagcgaagggcgccacagaagggauaacaucgacaagcauauuaaaaccgcuaagugcgucgagaauacggaaaacaaaaauguggaguucccaaaccagaauuuuuccgaacugcaggauguuauccccgacucacaggccgcugagaagcgugaucacacuauacucccgggagugcuggacaacauuuguggcaauaaaauccauagcaagugggccugcuggacaccuguaaccaacauugagcuuugcaauaaccaacgggcaucuacuuccaguggcgauacacugaaccaggacaucgucauaaauaagaaauugaccaagcagaaaucuagcuccucaaucagugaccacaacagcgaagggacgggaaaggugaaauauaagaaggagcaaaccgaucacauuaaaaucgacaaggccgaaguugagguguguaaaaagcauaaucagcagcagaaccaccccaaauacucgggucaaaagaauacagaaaacgcuaagcaguccgauuggccagucgagucugagacuaccuucaaaagcgugcuccugaauaagacaauugaagagucauuaaucuaccgaaagaaguauauacugaguaaagacguaaacacugcgaccugcgauaagaauccuuccgcaucuaaaaacgugcagagccauagaaaggccgaaaaggagcuaacauccgaacucaauucaugggacagcaaacagaagaaaaugagggagaagaguaaaggcaaggaguuuaccaacguugcugaaucucugauuucccaaaucaauaagcgcuacaaaacuaaggaugacaucaaaagcacgcggaaacuuaaagagucguugauuaacucaggguucucuaauaagcccgucgugcagcugaguaaggaaaaagugcagaagaaauccuauagaaagcucaaaacaaccuuugucaacguuacuagcgaguguccagugaacgauguguacaauuucaaccugaauggagccgacgaucccaucauuaaguuaggcauacaggaguuucaagcaaccgccaaggaagcaugcgccgacaggucuauccgccugguagguccucgaaaccacgaugagcuuaaaagcuccgucaagacaaaagacaagaaaauuaucaccaaucaucagaagaagaacuuguucucagacacugaaacagaguaucggugugaugacaguaaaacggauauuagcuggcuccgugaaccaaagucuaaaccgcagcugaucgacuacuccagaaauaagaacgugaaaaaucacaagucagggaaaaguaggagcucccuagagaagggccaacccucuucgaagaugaccccuagcaaaaacauaacuaagaaaauggauaagacaaucccagagggacgcauucggcugcccagaaaagcaaccaagacaaagaaaaauuauaaggaccucucaaacuccgaaagugagugcgaacaggaguucucucacagcuuuaaagaaaauaucccuguuaaggaggagaacauucauuccaggaugaaaacugugaagcugccaaagaaacagcagaaggucuucugugcggaaaccgagaaagaacuuucaaagcaauggaaaaauucuagcuugcugaaggaugcuauccgagacaacugcuuagaucucaguccccgcucccugagcggcucuccgucauccauagaggugacgcgguguauugaaaagaucaccgagaaagacuuuacacaggauuacgacugcaucacuaagaguauuagcccuuacccaaaaaccucgucucuugagucccugaacagcaauucagggguuggagguacaauaaagagucccaaaaacaaugaaaagaacuucuugugugccucugaguccugcagcccuauccccagaccacucuuucugccuaggcacacucccaccaaaucaaauacgauugugaaccguaagaagaucaguagccuaguacugacacaggaaacccaaaauuccaacucuuauagcgacgucuccucauacucuagugaggagcgcuucauggaaauugagucgccacauaucaaugaaaacuauauacagagcaaacgggaggaaucccaccucgcaucuucacugagcaaguccagugagggcagagagaaaacuugguuugauaugccgugcgacgccacacacgugucugggccuacccagcaucuuagcaggaagcgaaucuacauugaagauaauuugucaaacuccaaugagguggaaauggaggaaaaaggagagcggcgcgcuaaccuguuacccaagaagcucuguaaaaucgaggacgccgaucaccauauucacaagaugagugaaagcgucucuucccugucaacuaaugacuucagcaucccaugggagaccuggcagaacgaauuugcaggcauagagaugacauaugaaacguacgagagacuuaauucggaguucaaaaggcggaacaacauucgacauaagaugcugucuuauuuuaccacucagaguuggaaaacagcucaacagcaccuaagaaccaugaaucaccagucccaggauagccgcaucaagaagcucgacaaauuccaauuuaucauuaucgaggaacuggaaaacuucgagaaggauucacaguccuugaaagaccuggagaaggaauuuguugauuucugggagaaaauauuccagaaguuuucugccuaccaaaagagcgaacagcagagguuacaucuccugaaaacaagucuugcgaaguccguguucugcaauacugacagcgaggaaaccguauuuacgucugagaugugucugaugaaagaggauaugaagguguugcaggaccgucuccugaaagacaugcuagaagaggaacugcuuaacguccggagagagcucaugucaguguucaugagucacgaaaggaaugccaacguuuga

SEQ ID NO: 63446 - RNA, 2439 nt, Artificial Sequence
  derived and/or modified sequence opt3 from SYCP2L__Homo_sapiens__NP_001035364
augcaggccaagaacaaagacgcucugcaacccaucaaggaggauagaaccggcaaagcacaggacgaugccuucuggcuccagagccuuauuacagacgcguuucacgauaagggguuccagaaaauaaaggaauacuuucaacagaaggagucccauuucccucagaaauauaauaggcuguuguuauaccggcuggaccgcucuaucaacaaggaacuagauaaaaaugaguuucagucagugagucuccugcuuaagugcauucaacgauuccuggucgacggauugaaagaagaugagccacuccugauccgucagggucugauuccgaagcucguuagcugguuugagagaacuacgggcaucuuaaccuccgaagggcuggcuucugacacaucgcuuauaugugugaucgaggauuucuuugacacugccuugauuaucucaaggagcaguuccgaaggaaagauucagaugcuggauucuuuccuacucagccugggcuuucuuguaaccgagaaaacagugaaccaccuguugcagcaagagggucucaagaccuucaauugcauccugcaugcagucccccgggaggaacgcaaaaaguuuccuuuauccgaagggaugugucaccugaugaaagaccucgccagaacucuucugacagugggagacuaugaucagcagguugcuauaucagaggcauugugcaggcuaaccauuaagaaaagucgggacgaacuggugcauaagugguucgaugacgaggucaucgccgaggcuuucaaggaaauuaaagaucgcgaguuugaaacggacagccgaagauuccucaaccaccugaauaacaggcuuggcgaucaacggcguguguacucuuuuccauguaucgccgcguucgcagacgagcacgaaaugcgcaagcccgccgaugagaaacuggagaaguuuuggaucgacuucaauuugggcucccagucaguaacuuuuuauauugauaacgcugaaaauacccucugggacagcguuacacugccuaaagaggccgugaugaacuucaguauaacugaaaccgagaagaucaagauuuuuaucauauacuugaaaaagccaaugauuaucucuuauaaagaagucaugaagaucgagauucauuucgaccugcaguuuaauaucucccaggugagcauucaagcacuaggggaggauaaacagaugcuccccgaccagacaaagauaucgucugaacuguucuccaagucagauaaagaggacagagaaaguccuagcggacuugagagggagaccgaacaggcugaggaauccacgaacaugguggaguuuaugucugccgaagaugaccggugcuugaucacucugcaccucaaugaucaaagcgagccaccggucauuggugagcccgcgucagacagucaucugcagccuguuccacccuucggcgugccugauuucccacagcagcccaagucccacuaccgaaaacaccuuuuuagcgaaucuaaccaagacucaaguacaagcgagcuguccuggaccucuaaccagaagaaaaagucguuaaagagcuacuccucacgcaaaaagacuagaacaaggaguaaucuccggauccugccgguauucccucccucuagcggguccggacaugaaaaagaucaggccaaguuacugucaccaagcgagaaagaaaucccugagcagaacaauaccacgucucccaagaccuccgagcaaaaauuucaggacaguuucgcauuucuaacagcugaagauagcgcccagaagacugagcuccaagacccacacucucuguccgaacuuucaaguuugaagcauagcgaggacgaagagaaacccaagauugugaaccaggagucgcugaccgaauccacaucucucaaacacaagcugcgcaauuuagaggauaaagacauaccugaaggcagcuucgcuaagucacagcagaguagacuggaggaggaagucgccccagguuccccguuuucuaucacugaggaaagggagcuucccgaagggauuagcaccuccucauuggaggugguuccugagaaccucaauggaagcgcaauccugccaacauucgaaaacuuuaccaagaaacguaagcggaaauaugagcuacgauacagaaagaggcccuucaauagugaaaacgccaaaaaggcuccugauugucugauuaagcuccugaaucaaaugcagcuuuuucgcuugaacaaacuggagcgguuccagaauuuagugcuccaggaacugucuucccuuaagcaagacauccaggcgcuggagcauuuggagaaagaaguccucgaguuuuggggcaagcagagcgcagaucugcagucguucugcgaccuacaagugcugagauucaacucaacucagacgucuuga

SEQ ID NO: 63447 - RNA, 711 nt, Artificial Sequence
  derived and/or modified sequence opt3 from SYCP3__Homo_sapiens__NP_001171420
auggugagcuccggcaagaaauacucuagaaagucagggaaacccagugucgaggaccaguucaccagggccuaugauuuugaaacagaggacaagaaagaucuuagcggauccgaagaggacguuaucgaagguaagacugcugugauugagaagcggcgcaaaaagcgaucuucggcaggcguaguggaggauaugggaggggaaguccaaaacaugcucgagggcguggguguugacauaaauaaagcccuucuggcgaagcguaaaagauuggaaauguacacgaaggcuucauuaaagaccagcaaccagaaaaucgagcacguguggaagacacagcaggaucaaaggcagaaacugaaucaggaguauagucagcaauuccuaacucucuuucagcagugggaccuggauaugcagaaggccgaagaacaagaagagaaaauucuuaacauguuccggcagcagcaaaagauccugcagcagucccgcauuguccagucucaaagauugaaaaccaucaagcagcucuacgaacaguuuauaaagagcauggaggagcuggagaaaaaucaugacaaccugcucacaggggcacagaaugaguucaagaaagaaauggccauguuacaaaagaaaaucaugauggagacccagcagcaggaaauugcuuccgugaggaagucacugcaaaguaugcuguuuuga

SEQ ID NO: 63448 - RNA, 1908 nt, Artificial Sequence
  derived and/or modified sequence opt3 from SYK__Homo_sapiens__XP_011517248
auggccagcuccggcauggcugacucugcaaaccaccuacccuucuuuuucgggaauaucaccagagaggaagccgaggauuaccucgugcagggagguaugucagacggccuuuaucuguugaggcaaagucggaacuacuuagggggauuugcgcugagcgucgcucauggccgcaaggcccaccauuauacaauugaacgagagcuaaaugguacuuacgcaauagccgggggacguacgcacgcuuccccugcagaucucugccauuaucacucucaggaaucggacggccugguuugucuucugaaaaagccauucaacagaccgcagggcgugcagcccaaaaccgggccuuuugaggauuugaaggagaaucucaucagggaauacguaaaacaaacauggaaccugcagggacaggcccuggagcaggcuauuaucucacaaaagccacagcucgaaaaguuaauugccacuaccgcgcacgagaaaaugcccugguuccaugguaagaucagccgggaggaaagugagcagauagugcugaucggcuccaaaacaaaugggaaguuucuuauucgcgcaagagacaacaauggaucuuaugccuugugccugcuacacgaaggcaaaguccuccauuacaggaucgauaaggacaagaccgguaaacugagcauuccugaggggaagaaauucgauacucuuuggcagcugguggaacacuacuccuauaaggcugacggauugcuccggguucugacagugccaugucagaaaaucggcacccaaggcaacgucaauuuugggggacgcccccaguuaccugguucacacccagccacguggagugcaggcgggauaauuagccgaaucaagucuuacuccuucccgaaacccggacauagaaagucaagcccugcucaaggcaacaggcaggagaguacugugucuuuuaauccauaugagcccgaacuggccccuugggcggccgauaaggguccacagcgggaggcacuccccauggacaccgaaguauacgaguccccguaugcugauccugaagagauucgucccaaagagguuuaccuugaccgcaagcuguugacacuagaagacaaagagcuggggagcggcaacuucggaacugugaagaaaggcuauuaccagaugaagaaggucgugaaaaccguggccgucaagauccucaaaaaugaagcuaacgauccagcccugaaggacgagcuucuggcagaagccaacguuaugcaacaguuggauaauccuuacaucgugagaaugauugggauaugcgaggcugagucguggaugcucguaauggaaauggcggagcugggacccuuaaacaaauaucugcagcagaauaggcacgugaaggacaagaacaucauugaacugguccaucaagugucuauggguaugaaauaccucgaggaguccaauuuuguucaccgggaucuggcagcccgaaacgugcuuuuggucacacagcauuaugcuaagaucucagacuucggccugaguaaagcccuccgcgcagaugaaaauuacuauaaggcccagacccacgggaaauggccagugaagugguacgcucccgaguguauaaacuauuacaaguucagcuccaaaucugacguauggagcuuuggaguucugaugugggaagccuucucauacggccagaagccuuauagagguaugaaagggagugaggugacggcaaugcuugaaaagggcgagaggaugggaugcccagcgggcuguccgcgggagauguacgaucugaugaauuugugcuggacuuaugacgucgaaaaccgccccggguuugcugccguggagcucagacugaggaauuacuauuacgaugucgugaacuga

SEQ ID NO: 63449 - RNA, 3825 nt, Artificial Sequence
  derived and/or modified sequence opt3 from SYMPK__Homo_sapiens__XP_011525656
auggccagcggcuccggggacucugugaccagaaggucagucgcuagucaguucuuuacacaagaggaaggacccgguaucgauggcaugacuacgagcgagcggguuguggaccugcucaaccaggcagcccuuauuaccaaugauuccaagauaacaguacugaaacaggugcaggaauugaucauuaacaaggacccuacuuuacuggauaauuuccuagacgagaucauugcguuucaagcugauaaaucuaucgaaguccgcaaguucgugauaggguuuaucgaggaggccugcaaacgagacauugaacuccugcuuaagcugaucgcaaacuugaauaugcuccugcgugaugagaacguuaauguggucaagaaagccauucugaccaugacacagcucuacaagguggcuuuacaguggaugguaaaaucgagaguuaucucagaacugcaggaggcauguugggacauggugagcgccauggcuggagauauaauucuuuugcuggacagugauaacgacggcaucaggacccacgccauuaaguucgucgagggucuaaucgugacucucuccccacggauggcggacucugaaaucccgcgcagacaagagcaugauauuagccuggacaggauaccccgggaucacccuuauauccaguacaaugugcuuugggaagaggggaaagcagcccuggaacaguugcucaaguuuaugguccauccagcuauuuccucaaucaaccugacaaccgccuuaggaagucuggcaaauauagcucgccagcgacccauguucaugagcgagguuauucaagccuaugagacgcuccacgcgaaccuuccuccaacucuggccaagucucagguguccucaguaagaaagaauuugaagcuacaucugcucagcgugcugaaacaccccgcaagucuugaauuucaggcucaaaucaccacacuguuggucgaccucggcacuccucaggccgagaucgcuaggaacaugccaucuuccaaggauacccggaaacguccgcgcgacgauagcgacucgacacugaagaaaaugaaguuagaacccaaucugggcgaggaugacgaagauaaggaccuagagccugggccaucuggaaccuccaaagccucagcacagauuaguggucagagcgacacggauaucacugccgaguuccuccaaccccugcuuacaccugacaacguggcuaacuugguucugauuuccaugguguaccucccagaagcgaugcccgcaucuuuucaggccauauauaccccggucgagagcgcuggcacugaagcccagaucaagcaccuggcaagacuuauggccacacagaugaccgcugccgggcugggaccuggcguggagcaaacgaaacagugcaaggaggaacccaaagaggaaaagguaguuaagaccgagucaguguugauuaaaaggcggcucagugcacagggucaggcgaucuccgucguggggagccugucuucaaugaguccauuagaagaggaggcuccucaagccaagcgacgccccgaaccaaucauucccgucacacagccuagacuggcaggagccggcggcaggaaaaagauauuccggcuaagcgaugugcucaaaccacugacugacgcucagguugaggccaugaaguuaggggcagugaagcgcaucuugagagcugaaaaagccguagcguguuccggagccgcucaggucaggauuaagauccuggcaucucucgugacccaauuuaauucgggucugaaagccgagguucuuagcuucauucuggaagaugugcgugcucggcuugacuuggccuucgcauggcucuaccaggaguauaacgcguaccuggccgcuggcgccuccgggucacuagauaaguacgaggacugccugauccgacuccugaguggacuucaggaaaaaccggaucaaaaggacggcauauuuacaaaggucguguuggaggcaccccugaucacugaaucugcuuuagagguagugagaaaauauugugaagaugagagcaggaccuaccucgguauguccacacugcgcgaccuuauuuucaagcggccuucaagacaguuucaguaucugcauguuuugcucgaucugagcucucacgagaaagacaaggucaggucccaggcccuacuguucaucaaacgcauguacgaaaaggagcaacuccgagaauauguggagaaauuugcacugaauuaccuucaguugcuggugcauccaaaucccccuagugucuuauucggggccgacaaggauaccgaaguugcugcgccauggacugaggagacggugaagcagugccucuaucuguaccuugcccugcuaccccagaaccacaaacucauucacgaacuggcagcuguguacacagaggccaucgccgacauaaagcggaccguauugcgugucauugaacaaccgaucagaggcaugggaaugaacagcccugagcuguuacuccugguggagaauuguccaaaaggcgcugaaacucuuguuaccaggugccugcauucuuugacagauaaggugcccccuucccccgagcucgucaaacgcgugcgggaccuguaucacaagagacuaccagauguuagguuucugauuccugugcuuaacgggcucgaaaagaaagagguaauccaggcacugcccaaguugauaaaacugaauccaaucgucgugaaggaaguguucaaccgauuacucggaacccagcauggugagggcaauucagcccugaguccgcuuaacccuggggagcuguugauugcgcuccacaauaucgacagcgucaaaugugauaugaagucgauuaucaaggcuacuaaccugugcuuugccgaacgcaauguuuacacauccgaggugcuagcaguagugaugcagcaacugauggaacagucuccccuuccaaugcuccugaugcggacggucauacagagcuugaccauguaucccagauuaggaggcuucgugaugaacauucugucaaggcucaucaugaaacaaguuuggaaguacccuaaagugugggaggguuuuaucaaguguugccagcguacuaaaccacagaguuuccaggucauucugcaacuucccccucagcagcugggggccguguuugacaagugcccggaauugcgcgagccacuacuggcucauguucgguccuucacaccccaccagcaagcacacaucccuaacucuauuaugaccauacucgaggccagcggcaagcaggaaccagaggcgaaagaagcucccgccggaccucuggaggaagaugaccuugagccguuaacacuggcacccgccccagcuccuagacccccacaggaucucaucggcuugaggcuggcccaggagaaggcacucaaacgacaacuggaagaggaacagaaacuuaaaccugggggagugggugcucccuccucaagcaguccaucuccguccccuagcgcccggcccggcccacccccuucggaggaggcgauggacuuccgcgaagaggggccagaaugugagacucccggaauuuuuaucucaauggaugacgacucuggccugaccgaagccgcauugcuagauaguucccuggaggguccucucccgaaggagacggcugccgggggcuuaacccugaaagaagagagaagcccacagacacuugcucccgucggagaagacgcaaugaagacuccuucucccgccgccgaggaugcuagggaaccagaggcgaagggcaauagcuga

SEQ ID NO: 63450 - RNA, 2118 nt, Artificial Sequence
  derived and/or modified sequence opt3 from SYN1__Homo_sapiens__NP_008881
augaacuaccugagaaggcggcucagcgacuccaauuucauggccaaccuucccaauggcuauaugaccgaucugcagcgcccucaaccaccgcccccuccacccggggcucacucuccuggagcaacaccaggucccggcacugccacggcggagcgaucaagugggguggcuccugccgcaagcccagccgcuccgucccccggaucuucgggcggugggggauuuuucagcucauugaguaacgcagucaagcagaccacagccgcugccgcggcaacuuuuuccgaacagguuggcggcgggucuggaggugccggccgugggggagcugccagcagaguguuacugguaaucgacgagccucauaccgauugggcaaaauacuucaagggcaaaaagauucacggugaaauagacaucaaaguggagcaggcugaauuuuccgaucuaaaucucgucgcccaugcgaacgggggauucucaguggacauggagguucugaggaauggcgugaaggucgugcggagucuuaagccagauuuuguacugauucgccaacacgccuucagcauggcaagaaacggcgacuauaggucuuugguuaucgggcuccaguacgcuggcauucccuccgucaauucacugcauagcguguauaacuuuugcgauaaaccuuggguguucgcccagauggugcggcugcacaagaaacucgguacagaggaauuuccauuaaucgaccagaccuucuaccccaaucacaaggagaugcugaguucuacuacauauccggucguugugaaaaugggccaugcucacuccgggaugggaaagguaaagguggauaaccaacaugacuuucaggauauagccagcgucguggcacuuaccaaaacguacgccacugcugaaccuuucaucgacgcgaaguacgacguucgcgugcagaaaauuggccagaauuauaaggcauacaugcgaaccucggucucugguaacuggaaaacaaauacuggguccgccauguuggagcaaaucgcuaugucagauagauauaagcuguggguggacaccuguagugagauuuucggcggacuagauaucugcgccguagaagcacuccacggcaaagacgggagggaucacauaauugagguugugggaagcuccaugccccugaucggugaccaucaggaugaagacaagcagcuuauugucgagcugguggucaacaagauggcccaagccuugccacggcagcgucagcgcgaugccucuccuggcagagggagccacggacagacacccucaccaggcgcacucccccuggguaggcaaaccagucagcagccugcggggccaccggcucagcaacggcccccuccacagggcggacccccucagccaggccccgggccgcagcgacaaggaccuccauuacagcagcgcccaccuccccagggucaacagcaucuguccggccucgggcccccugccggaagcccccuuccacagagacugccgucuccuacgucagcaccccaacagccagccagucaggcugcucccccuacucagggccaagguaggcagagccggccaguggcagggggccccggagcuccuccggccgcgcgcccacccgccuccccuucuccacagagacaggcuggacccccucaagcaacaaggcagaccucgguuagcgggccggcucccccaaaggccuccggagccccucccggcggucagcagcgucaagggccaccucagaaacccccaggaccggcaggcccuacucggcaggcgucacaagccggucccgugccacgaacagggcccccuaccacgcagcagccaagacccaguggcccuggaccggcuggcaggccaaaaccccaguuggcccaaaagccuucucaggacguacccccuccagcaaccgcugccgcagggggacccccacacccucagcuaaacaaaagccagucccugacaaaugccuuuaaccucccggaacccgcuccaccucgccccucacugagccaagaugaggucaaggcggagacuauccggucucuuagaaaguccuucgccagucuguuuagcgacuga

SEQ ID NO: 63451 - RNA, 1437 nt, Artificial Sequence
  derived and/or modified sequence opt3 from SYN2__Homo_sapiens__NP_003169
augaugaacuuccugagaaggcggcucagcgacuccucuuuuaucgccaaucuucccaacggcuacaugaccgaucugcagcgcccugagccacaacagccgcccccuccacccccuccagggcccggagcugcaucagccagugcggcuccuccaacagccagcccgggucccgaacgacguccuccacccgcauccgccccugcuccacagcccgcaccgacuccuucugugggcucgucauucuuuagcaguuugucccaggccgucaagcaaacggcugccucugcgggguuaguugacgcacccgccccagcuccugccgcagcuagaaaagccaaggugcugcuaguaguggaugagccccacgcggacugggccaaaugcuucaggggaaagaaaguccucggcgauuaugacauuaagguggaacaggcagaguuuagcgaacugaaucuuguugcucaugccgaugguaccuacgcuguggacaugcagguccugcggaacgggacaaaggugguacgcuccuucagaccagauuuuguuuugauaaggcagcacgccuucggaauggcagagaaugaggacuuucggcaucucaucauuggcaugcaauaugccggccugcccucaaucaacagucuggaaagcauuuacaauuucugugauaaaccuuggguguuugcucagcucgucgcgaucuauaagacuuuagggggagagaaauucccacugauagaacagaccuacuauccgaaccacaaggagaugcuuacauugcccaccuuuccugugguggucaaaaucggucaugcacacucuggcauggggaagguuaagguggagaaucacuacgacuuccaggauauugccuccguaguggcucugacucaaacauacgccaccgcagaaccauucaucgacucaaaauaugacauucgcguccagaagaucggaaacaauuacaaagccuauaugcgaacgagcauaaguggcaacuggaagacuaauaccgguucugcuaugcuagagcagauugccauguccgauagauacaaacucuggguggacacaugcagcgaaauguuugggggacuggauaucugugcaguuaaggcggugcauggcaaagacggcaaggauuauauuuucgaggucauggacugcucgaugccccuuaucggggaacaccaaguggaggauaggcagcugaucacugaguugguaauuucuaagaugaaccagcuccugucccggaccccugcuuuaucaccacagcguccccugacaacccaacagccgcagaguggaacgcucaaagacccugauagcuccaagacuccaccccagcgcccucccccacaagguugucuucaguacauacuggacugcaauggcaucgccguugggccuaaacaggugcaggcaucuuga

SEQ ID NO: 63452 - RNA, 1335 nt, Artificial Sequence
  derived and/or modified sequence opt3 from SYN3__Homo_sapiens__NP_598344
augaacuuccugagaaggcggcucagcgacuccucuuuuauggccaaucuucccaacggcuacaugaccgaucugcagcgcccugacucaaguacaagcuccccagcuucuccggcaauggagcgacgucacccccaaccuuuggccgcgucguucucaagcccagggaguuccuuauuuucuagccuguccucagcuaugaagcaggcaccccaggccacuagcggacuaauggaaccuccaggucccagcacgccuaucgugcagagaccaaggauucuccuggucauagaugacgcccauaccgauuggucuaaauauuuccacggcaagaaaguuaauggggagaucgaaauucggguggagcaagcugaauuuuccgagcuuaaccuggcagccuacguaacaggaggcugcaugguggacaugcaggucgugcgcaaugguacuaagguugugucaagaaguuucaaaccggauuuuaucuuggucaggcagcaugcuuauaguauggcccucggggaggacuaccggucucuggugauuggacugcaguauggcggccuccccgcgguaaacuccuuauacagcguuuauaauuucuguucgaagccuuggguguuuucucaacugaucaagauauuccacucccuugggccagaaaaauuucccuuggucgagcagaccuucuuuccuaaccauaagccaauggugacagcaccccacuucccgguggucguuaaacugggacacgcccaugcugguaugggcaagaucaaaguggaaaaucagcuagauuuccaggacauuaccucaguaguggccauggcaaagacuuacgcuacaaccgaggccuuuaucgauaguaaguacgacauucgcauccagaaaauagggagcaacuauaaggcguacaugcgaacguccauuucuggaaauuggaaagccaacacuggcagcgcaaugcucgagcaagucgcuaugaccgaaagauauaggcuguggguggauucaugcagugagauguucggugggcuugacaucugugccguuaaggcugugcacuccaaagacggacgggauuacauuaucgaagucauggacagcucuaugccucugaucggcgagcauguggaagaggaucgucaguugauggccgaccucguaguuucaaagaugagucaacugcccaugccaggcgggacagcaccuagccccuuacgcccaugggcuccccagauuaaauccgccaagucuccuggacaggcgcagcuggguccacaacucggccagccgcagcccagaccuccaccccaggcaaaucuuucgccuuga

SEQ ID NO: 63453 - RNA, 1584 nt, Artificial Sequence
  derived and/or modified sequence opt3 from SYNCRIP__Homo_sapiens__NP_001153146
auggccaccgagcacgugaacggcaaugggacagaagaacccauggacacuacgagcgcugucauccauuccgaaaacuuccagacccugcucgaugcaggacuuccucaaaagguugccgagaaacuggacgaaauuuacguggcggguuugguagcucacucugauuuagacgagagagccauagaggcacugaaggaauuuaaugaggauggcgcccuagcugugcuccagcaguucaaagacucagaucugagucauguccagaacaagagcgcauuucuuugcggggugaugaaaacauauaggcaacgggaaaagcagggaacuaagguugccgacuccucuaaaggcccagaugaggcuaagaucaaagcccuguuggagcgcaccgguuacacacucgacgugaccacugggcagcgaaaguauggaggcccgcccccugauucggucuacucaggccagcaaccaagcguggggacagaaauuuucguaggaaaaaucccccgugaccuguuugaggaugaacugguuccucucuucgagaaggcggguccaauuugggacuuaagacugaugauggacccccuuaccggcuugaauaggggguaugcauuugugacguucuguacuaaggaagccgcucaggaggccgucaaacuguacaacaaucacgagauccggaguggaaagcauauaggcgugugcaucuccguggcaaacaaucgccuauuugucgguucuauuccuaaaagcaagaccaaagaacagauccucgaggaguucuccaagguuacagaggggcugacugaugugauucuuuaucaccagccagacgauaaaaagaagaacagaggauuuuguuuccuggaauacgaggaccacaaaaccgcugcccaaguaaagguguuguuugucaggaaucucgcgaacacagugaccgaggaaauccuggagaaagccuucucacaguucggcaaguuagaacggguuaaaaagcugaaggauuacgcauuuauacauuucgacgagcgcgauggcgcugugaaagccauggaagagaugaaugggaaggaccucgagggagaaaacauugagaucgucuuugcuaaaccgcccgaucagaagcgaaaagaaagaaaggcccaaaggcaggcagccaagaaucagauguaugacgauuacuauuacuaugguccuccacacaugcccccuccaacgcggggccgugggcgcggaggcagagguggguacggcuaucccccggacuacuacggauaugaggacuacuaugauuacuauggcuacgacuaucauaacuacaggggaggguacgaggauccuuauuacgguuaugaagacuuccaggugggcgcucgggggcgaggaggccgcggugcgagaggggcagcccccaguaggggccggggagcugccccaccucgcggcagagcaggguacagccaaaggggaggucccggcucugcccgugggguacggggagcucgaggcggugcccagcagcagagagggaggggccaaggaaaaggcguugaggcagggccagaucuucugcaguga

SEQ ID NO: 63454 - RNA, 777 nt, Artificial Sequence
  derived and/or modified sequence opt3 from SYNDIG1__Homo_sapiens__NP_079169
auggacggcaucauugagcagaaaagcaugcuggugcacuccaaaauaucugaugccgggaagagaaacggacucaucaauaccaggaaccuuauggcugaaucacgggacggucuggucaguguuuaccccgcaccucaauaucagagccaucgcgugggcgccuccacaguaccagcgucuuuggauucgucacgaagcgagccgaugcagcaguuacuggaccccaauacucuacaacagaguguggaaucccguuacagaccuaacauuauccucuauucugaggggguccugaggagcuggggagauggcguggcugccgacugcugugaaacgaccuucauugaggaucgguccccaacaaaagacucacuugaguaccccgaugguaaguuuaucgaccugagugcagaugacauaaaaauccacacuuugagcuaugauguugaagaggaagaggaguuccaggaacucgagucugacuacuccucagacaccgaaagcgaggauaauuuucugaugaugccuccacgcgaccaucuggggcucaguguguucucuauguuaugcuguuuuuggccccugggaauugccgcuuucuaucuuucccacgaaacaaacaaggcagucgccaagggcgauuugcaucaggcuagcaccucgucuagaagggcccuguuucuagcggugcucuccaucacuauuggcacagggguauacguuggaguggcagucgcccugaucgcuuaccuuucaaagaauaaccaccuguga

SEQ ID NO: 63455 - RNA, 26250 nt, Artificial Sequence
  derived and/or modified sequence opt3 from SYNE1__Homo_sapiens__NP_149062
auggccaccagcagaggcgcuuccaggugcccccgggacaucgcaaacgugaugcagcgccugcaagaugagcaggaaauuguccagaagcgaacauucacuaaauggauaaauucucaccucgccaagcguaaaccuccaaugguuguggacgaucuuuuugaggacaugaaggaugggguaaaacuguuggcguuacuggaagugcuaucaggacagaagcucccgugugagcaagguagaaggaugaagcggauccaugcugucgccaacauuggcacggcacugaaauuccuugaagggcgcaagaguaugcacagaggaagccccaucaaacuggugaauauuaacuccaccgacaucgccgauggcaggccuucuauaguuuugggucucauguggacaaucauucuguacuuucagaucgaggagcugacuucgaaucucccacaguuacagucacugagcaguuccgcuucuagcguggacuccauugucucaagugaaacccccagcccuccaucuaagcggaaagugacaaccaagauccaagggaacgcaaagaaagcccuuuugaaguggguacaguauacugcuggaaaacagacaggcauagagguuaaggauuucggcaaauccuggcgcucagggguggccuuucauagcgucauucacgcgauccgacccgaacugguggaccuagagaccgugaagggaagaaguaauagggagaaccucgaagaugcauucacgauugccgagacugaacuggguaucccucggcuucuggacccagaggaugucgacguugacaaaccggaugaaaagucuaucaugaccuacguggcucaguuuuugaagcauuaucccgacauucacaaugccuccacagauggccaagaggacgaugagauacucccuggguucccaagcuuugcaaacucgguacagaauuucaaacgugaagaccgcgugaucuuuaaggagaugaaagucuggauugaacaguucgagagagaucugacuagggcucaaaugguggaaucuaacuuacaggacaaguaccaguccuuuaaacacuuccggguucaguaugagaugaagcgaaagcaaaucgagcaucugauacagccccuccaccgcgauggaaaacuuucacuggaccaggccuuggugaagcagaguugggauagagucaccagcaggcuauucgacuggcauauucaacuggacaaaucccucccugcgccacugggcacaaucggugccuggcuuuaccgggcagaaguggcucugcgcgaggaaaucaccguacagcagguucacgaggaaacggccaauacuauucagagaaaguuggagcaacacaaagaucuccugcagaacacagacgcucauaagagggccuuucacgagaucuaucguacccggucugugaaugggauucccgucccgccugaucaguuagaagacauggcagagcgauuccauuuugugagcucaacuagugaacugcaccuaaugaagauggaguuccucgagcugaaauacagacuuuugucccugcucguccuggccgaaagcaagcuuaaaucuuggauaaucaaguacggaaggcgcgagucaguggaacagcuguugcaaaacuauguuaguuuuauugagaacagcaaauucuuugaacaguacgaggugacauaucagauccucaagcaaaccgcugagauguacguaaaggcggauggcuccgucgaagaggcagaaaaugugaugaaauucaugaacgagacgaccgcccaguggcggaaucugucuguugaagugagaucggucaggagcauguuagaggaggugaucuccaacugggaccgcuauggcaauacaguagcuucacugcaggccuggcuagaagaugcagagaagaugcucaaccagagugaaaaugccaaaaaggacuuuuuccgaaaccugccccauuggauucaacagcacacugcuaugaaugaugccgggaacuuucuuauagagaccugcgacgaaauggugucucgggauuugaaacagcagcugcuccuguuaaauggacguuggagagagcuguucauggagguuaagcaauacgcacaggcggacgaaauggauaggaugaaaaaggaguauacagacugugucgugacucuuagcgcuuuugccaccgaagcacacaagaaauuguccgagccacucgaggugucauucaugaacgucaagcugcuaauccaggaccuggaagauauugagcagcgcguuccugugauggacgcccaauacaaaaucauuacaaagaccgcucaucucaucacuaaagaaagcccccaggaggaagguaaggagauguucgccacgaugucuaagcugaaagagcagcuuacaaaggugaaagaaugcuacuccccauugcuguaugagagucaacaguuacucauaccccuggaagagcuugaaaagcagaugaccagcuuuuacgauucucugggcaaaaucaaugagauuaucacuguauuggagcgggaagcacaguccucagcucucuucaagcaaaagcaccaggagcugcuagccugucaggaaaacugcaaaaagacccugacacucauugagaaagggagucagagcguccaaaaguuugugacccugucgaauguucuuaaacauuucgaccagacuagauugcagaggcagaucgcggauauacacguggccuuucaauccauggucaagaagacaggagacuggaaaaagcacguggaaacgaacucucgacugaugaaaaaguucgaggagagccgcgcugaauuagagaaaguucuccggauugcacaggaaggccuggaggagaagggugauccugaagagcuucugagaaggcauaccgaauuuuucucacagcuagaccagcgugugcucaacgccuuucugaaagcuugugaugaguugacugacauccugccagaacaagagcagcagggguuacaagaggccguacgcaagcuccacaagcaguggaaagaucugcagggcgaagcaccguaucaucuucugcacuugaagauugacgucgagaaaaaucgguuccucgcgaguguggaagagugcagaacagaacuggauagggagaccaagcuaaugccccaggagggauccgaaaaaaucauaaaggagcaucgaguguuuuucucugacaagggcccucaccaccugugugaaaaacggcuucaacucaucgaggaacugugcgucaaguugccaguucgcgaccccgugagagauacaccugggacuugucauguaacccugaaagaguuaagggccgcuauugacagcacguaccggaagcucauggaggauccagacaaauggaaggauuauaccucccgauuuucagaauucagcaguuggaucucuacaaacgagacucagcugaagggaauuaaaggugaagccaucgacaccgcaaaucacggcgaggugaagagagcugucgaggaaauacgcaacggggugacaaaaaggggagagacucuuuccuggcugaagagccguuugaaaguucucaccgaagugucgucagagaaugaagcccagaagcagggcgaugagcuggcaaagcuaucuaguuccuucaaagcccuggucacgcuucucagcgagguggaaaagaugcugucuaacuuuggugacugcguucaauacaaagagauugugaagaauagcuuggaagaguuaaucuccgggucaaaagaaguccaggagcaggcugagaagauccuggauacagaaaaccucuucgaggcgcagcaacugcuucugcaucaccagcagaagaccaaacggauuagugccaagaaaagagacguacaacagcagaucgcacaggcucaacagggcgaaggaggcuugcccgauagggggcaugaggaacuacgcaagcuggagagcacucucgacggacuggagcgaucuagagaacggcaggagaggcgcauucaggugacacuucguaaaugggaaagauuugagaccaauaaggagacuguugugcgguauuuauuccaaaccgguuccucacacgaaagguuucugaguuucagcucccucgagucuuugucgagcgaacuggagcagacaaaagaauuuucaaagcgcacggaguccauagccguccaggccgagaaccucgugaaggaagcuagugagaucccgcugggcccucagaauaaacaacuucugcagcagcaggcaaagucuauuaaagaacaaguaaagaaauuggaggacacccuagaagaggauaucaagacuauggagauggugaagacaaaaugggaccacuucgggagcaacuuugaaacccuguccgucuggauuacagagaaggaaaaagagcucaaugccuuagaaacuucaucuagcgcgauggauaugcagaucagucagauaaagguuaccauccaagagauugaguccaaacugagcucuaucgugggacuugaagaggaagcucagucauucgcccaguuugugacgacaggcgaguccgcacgaauuaaggccaagcugacccagaucagacgguacggugaggaacucagggagcaugcucaaugcuuggaagggacuauacugggccaccucagucagcagcagaaauucgaggaaaaccugcgcaagauucaacagagcgucucggaguucgaggacaaacuugcagugccaaucaagaucuguucuuccgccaccgaaacauacaaaguucuacaggagcauauggaucugugccaggcguuggaaagcuuaucaagugcuauuacugccuuuucugcauccgccagaaagguagugaauagggacagcuguguccaagaggcugccgcacugcagcagcaauaugaagauauacuccggcgugcuaaggagcgccagaccgcccuggagaaccuucuggcgcacuggcagcgacucgaaaaagaguugucaaguuuccugacauggcuagaaagaggagaggccaaggcaagcucccccgaaauggacaucucugcugauagggugaaaguugagggcgagcugcagcucauucaagcccuucagaacgaaguggucagccaggcuuccuuuuacucaaagcuguuacaguugaaagagucucuguucaguguggcaucgaaggacgauguaaaaaugaugaagcuccaccuggaacaacuugacgagcgguggcgcgaucugccucagaucauuaauaagagaaucaacuuucuccagagcgucguggccgagcaucagcaauucgacgaauugcuguuauccuuuucuguuuggauaaaacuauuccugucagagcuccagacgaccagcgaaaucuccauuauggaccaccagguggcccuuacuaggcauaaggaucacgcugcggaggucgaaaguaaaaagggggagcugcaaucuuugcagggacaucuggcaaaacucggcagccugggucgggccgaggaccuucaccuccugcaggggaaggcugaagauugcuuucaguuguucgaggaagccucacaagugguugagcgaagacagcuggcauuaucccaccuagccgaauuucugcagagucaugcuagccucucuggaauccuucgccagcugaggcaaacaguggaggcgaccaauuccaugaacaagaaugagucagacuugauugaaaaagaucugaacgacgcccuccagaaugcaaaggcucuggagagcgccgcagucucgcuugauggcaucuuaucuaaagcccaguaucaccugaagauagguaguuccgaacagcggacuagcugucgugcuacagccgaccaacucugcggcgagguggaaagaauucagaacuugcuggggaccaaacagucagaggcggaugcacuagccguacugaagaaggcuuuccaggaccaaaaagaggaacuccuuaaguccaucgaggauaucgaagagaggacggacaaagagcgccugaaggaacccacucggcaggccuugcagcaacgacugagaguguuuaaucagcucgaggaugaacugaacucucaugagcacgaauuauguuggcuuaaagacaaggcuaagcagauugcacagaaagacguugccuucgcuccagaggucgauagggagaucaaucgccuggaagugaccugggacgauacaaagcggcucauacacgagaaccaaggacagugcuguggccuaauugaccugaugagagaauaccagaauuugaaaagcgccgugaguaagguccuggagaacgcauccagcguaaucgugacccguacuacaauuaaagaucaggaagaccucaagugggcguucucuaaacaugagaccgccaagaauaagaugaacuauaaacaaaaggaucuugacaacuuuacaucaaaagggaagcaccuguugagugagcugaaaaagauccauuccagcgauuucucucucguuaagacugacauggaaucgaccguggauaaaugguuagacgucucagagaagcuggaagagaauauggacaggcuucgggugagccuguccauaugggaugacguucuaaguacgcgcgaugaaauugagggauggucuaacaauugcgugccucagauggcugagaacaucagcaaucucgacaaccaccugcgagccgaagaguugcugaaagaauuugaguccgaggucaagaauaaagcacucagacuugaagagcugcauucaaaggugaacgauuuaaaggaacugacaaaaaauuuggagacccccccagaccuccaguucaucgaagcugaucugaugcagaagcuagagcacgccaaagagauuacugaaguagcaaagggcacccuuaaagacuuuacagcccaaaguacucagguggagaaguucaucaacgauauuaccacgugguuuacaaagguugaagagucucugaugaauugugcucagaacgaaaccugcgaggcgcucaaaaaggucaaagacauacaaaaggagcugcagagccagcaguccaauaucucaagcacucaagaaaacuugaauucucugugcaggaaauaccacuccgccgagcucgaaagucuuggucgggcaaugacagggcugauuaagaagcaugaggcugugagccaguuauguucgaaaacccaggccucccugcaggaaucuuuggagaagcacuucucagagagcaugcaagaauuucaggagugguuccucggagccaaagcagcugccaaggaaaguuccgaucgcacuggcgacucuaaagugcuggaggcgaagcuacaugaucuucagaacauccuggacagcgucucagacggucaguccaaacucgaugcuguuacacaagagggccagacccuguaugcccacuugaguaagcagaucgugagcucuauucaggaacaaauaacgaaggcaaaugaggaauuucaggccuucuuaaaacagugccugaaggacaaacaagcucuccaggauugugcaucagagcuuggguccuuugaagaccagcacagaaagcugaaccuauggauccaugagauggaggaaagguucaacacugagaaucugggagaaagcaaacagcacauuccggagaagaagaacgaaguacauaaaguggagauguuccucggcgaguugcuggccgcgcgagaaucucuugauaagcugagucaacgggggcagcucuuaucggaggaaggacacggcgcuggucaggaggggcgucugugcucccaguugcugaccagccaucaaaaucuccuuagaaugacaaaagaaaagcugcgcucaugucaggucgcccuacaggagcacgaggcacuggaagaggcccuccagucuaugugguuuugggugaaagcuauccaagacagguuggccugcgcagaaagcacccugggauccaaggauacacuugagaagcggcugagucagauucaggacaucuuacucaugaaaggcgagggugaaguuaagcugaacauggcuauaggcaaaggggagcaagccuugagaucaucuaauaaggaaggacagcgcgugauccagacucagcuggagacccucaaagaagucugggcggauauuaugagcuccaguguacacgcccaaagcacgcuugaguccgugaucucucaguggaacgacuacguugagaggaagaaucagcuggaacaguggauggagucaguggaucaaaagauugaacauccucuacagccccagccaggccugaaagagaaguucguccucuuggaccaccugcagagcaucuuaucggaagcagaggaccauacacgagcucuucaccggcugauagccaaauccagagagcucuacgaaaagacugaggaugaaaguuuuaaagacaccgcacaagaggaacugaagacacaguucaacgauauuaugaccguggcuaaagagaagaugaggaaggucgaggaaaucgugaaagaccauuugauguaucuggaugccguucacgaguuuacugacuggcuccacucugccaaggaagagcuucaucgcuggagcgauaugucaggggacuccucugcgacccagaaaaagcugaguaaaauuaaggagcuaaucgauagccgugaaauaggagcuucccggcugucaagaguggagagcuuagcacccgaaguaaagcaaaauacaacggccucuggcugugagcucaugcacacugaaaugcaggcucugagggccgacuggaaacagugggaggauaguguguuccagacccaauccugcuuggagaaccuugucagccagauggcacugucagaacaggaguuuucuggucagguugcccaacucgaacaggcucuggagcaguucuccgcguugcugaagacaugggcccagcaacuaacccuccuugaagggaaaaauacugacgaggagaucguggaauguuggcauaagggacaggagauucuggaugcauuacagaaagcugaaccucgcacagaggaccugaagucgcagcucaacgaacugugccgauuuagccgggacuugaguaccuacucuggcaaggucuccggccuuaucaaagaguauaauugucugugccuccaagccagcaaggggugccagaacaaagagcagauucugcaacagagauucaggaaggcauuucgcgauuuccagcaguggcuagugaaugccaaaaucacgacugcuaaguguuuugacauaccacaaaacauuucagaaguaaguacauccuugcagaagauccaggaguuccugagcgaaucugagaacggacagcacaaacucaauaugaugcuuucaaagggugagcuguuaagcacccugcucaccaaagaaaaggccaaaggcauccaagcgaaggugacugcagccaaagaggauuggaagaacuuccacuccaaucugcaucagaaggaaucugcuuuggagaaccuuaaaauucagaugaaggacuuugaaguuagugccgagcccauccaggauuggcugucgaaaacagagaagauggugcacgaaagcuccaauagacucuacgaccugccugcaaaacggagggagcaacagaagcuacagucagucuuagaagagauacauugcuaugaaccgcaacugaaccguuugaaggagaaagcucagcagcucugggaggggcaggccgcuucuaagagcuuccgacaccgcgugagucaacuguccucacaguaccuugcccugucuaaucucaccaaagaaaaggucagcagacuggaucggauuguggcagagcauaaccaguuuuccuugggaaucaaagaacuucaggacuggaugacagaugcgauucacaugcuggacaguuauugucacccaacuagcgauaagucuguucuagacucaaggacgcucaagcuggaggccuuacuguccguaaaacaagaaaaggagauccagaugaaaaugauagugacccgcggcgagagcgucuugcagaauacaagucccgaagguaucccuacuauucagcaacagcuccagucugugaaggauaugugggcuucccugcuuucggccgggaucagaugcaaaagccagcuggagggagcacucucaaaguggaccuccuaccaagacggcguucggcaguucucuggcuggauggacaguauggaagcuaacuugaaugagagcgagaggcagcaugccgaacugcgagauaagacaaccaugcuugggaaagcaaagcuguuaaacgaggaagugcuaucauacuccagccuccuggagacuauugaagucaaaggagccgguaugacggagcacuaugugacccaacuggaguugcaggaccuccaggaacguuacagagcgauccaggagcgcgcuaaggaagccguaacaaaaucugagaagcuggugcggcuucaucaagaauaucagagggaucugaaggcauuugagguuugguuaggccaggagcaggaaaaacucgaccaauacaguguccuggagggggaugcccacacucacgaaaccacauugagagaccuucaggagcugcaggugcauugugcugaaggacaggcccuacucaauuccgugcugcacacccgcgaggaugucauuccaagcggcaucccccaagcagaggaccgggcucuggaaucauugaggcaggauuggcaggccuaucaacaucgacucucugagacuagaacacaguucaacaauguugugaacaagcugcggcuuauggaacagaaauuucagcaaguagacgaguggcugaagacggcggaggaaaaaaaguggcacgaggaagugaccgcuuacagggaugaggucgaagaggugggugcccgcgcacaggagauauuagacgaaucgcauguuaacagccguauggggugccaggccacucagcucacauccagauaucaagcucugcuauugcaggugcuggagcagauuaaauuccuugaagaggaaauccagagucucgaggagucugaaucaagccuguccaguuacucugacugguacggaagcacccacaagaauuuuaagaacgucgcaaccaaaaucgauaagguggacacaguaaugaugggcaaaaagcugaaaacuuuggagguucuucucaaggauauggaaaagggccacucccuguuaaaaucagcccgagagaagggggaaagggcggugaaauaucuggaggagggagaagccgagcggcuacgcaaggaaauucaugaccacauggagcaacucaaagagcugacgagcaccgucagaaaggaacauaugacauuggagaagggucugcaccuugcuaaagaauucucugauaaguguaaagcacucacucaguggauagccgaguaccaggaaauccugcaugugccugaggagccgaagauggaauuauaugagaaaaaggcucagcuguccaaguacaaaaguuugcaacagaccgugcucucacacgaacccagcgucaagucgguuagggagaaaggcgaagcccugcuugagcuggugcaggacguaacacuaaaggauaaaauugaccaacuccaguccgauuaucaggaccugugcucuaucgggaaggcaaugauggaggaaauugcuggauuugaggaucgguugaauaaccugcagaugaaaggcgacacccuuaucggucaaugugccgaucaccuccaggcgaagcugaagcagaaugugcaugcccacuuacaggggacuaaagacaguuacagcgcaauaugcucaacggcucaacgcauguaucagucccuggaacaugaguugcagaagcacgucucuagacaggacacacuccaacagugucaggccuggcugagcgcagugcaaccagaucuugaaccuaguccccagccaccucugucccgagccgaggcuaucaaacagguuaagcacuucagggcccuacaggagcaagcgcggaccuaccucgaccuguugugcagcaugugcgaucugucuaacgcuucagugaaaacuaccgcaaaggacauucagcagacagaacagacuaucgagcaaaagcuuguccaggcccagaauuuaacccagggaugggaagagauuaaacaucugaaguccgagcucuggaucuaccugcaagaugcugaccagcagcuacaaaacaugaaacgucgccacagcgaauuggagcugaauauagcccagaacauggugagucagguaaaggauuuuguuaaaaagcuccagucuaagcaagcaucagugaauacaauuaucgaaaaagucaacaagcuuacgaaaaaggaggaaucccccgagcauaaagagaucaaucaccugaacgaccaguggcucgaucuguguagacagagcaauaacuuaugcuugcagagggaagaggaccugcaacggaccagagauuaucaugacuguaugaacgugguugaaguguuccuugagaaguucacuacagaaugggauaaucuggcccgcucggacgcugagucuaccgcgguccaccucgaggcccugaagaaacuagcacuugcccugcaggaacgaaaguacgcuauugaggaccucaaagaucagaagcagaaaaugauagaacacuugaaccuggacgauaaggaguuagugaaagaacaaacuagucaucuggagcagaggugguuucagcucgaggaccuuaucaagcggaagauucagguauccgugacaaaucuggaagaguugaacgucguucaaagcagauuccaggaacugauggagugggcagaggaacagcaaccaaauaucgccgaggcucucaaacagucaccgccucccgauauggcccagaaccuacugauggaccaccuugcgauuugcucugaacuggaggcaaagcagaugcucuugaaaagccugaucaaggaugccgaccgugugauggcugauuuaggccugaaugaacgccaagucauacagaaagcccucuccgacgcacagagucaugugaacugucuuucagaucugguaggccagaggcggaaguauuugaauaaggcucugagcgagaaaacccaauuucucauggccguguuccaggcgacgucccagauccagcaacacgagagaaagauuauguuucgagaacacaucugccuacugccagacgacguuucuaaacaggugaagaccuguaaaagugcccaggcuagcuuaaagacauaccaaaacgaggucacugggcugugggcacagggaagggaacucaugaaggaggugaccgaacaggagaaauccgagguucuugguaaguugcaggaacugcaaucagucuaugauucugugcugcagaaaugcucgcaucgccuccaggagcuugaaaagaaucuggugagccggaaacacuucaaggaggacuuugauaaggccugucauugguugaaacaggcugacauuguaacauuccccgagaucaaccugaugaaugaauccagugagcuccacacucaacuagcaaaguaccagaacauucuggaacagucuccugaguaugaaaauuuacuucugacccuccagagaacaggccaaaccauauugccaagccugaacgaggucgaucauucauaccuguccgagaaacucaacgcccuucccaggcaguuuaaugugaucguugcucuggccaaggacaaauucuacaaggugcaggaagcaauuuuggcccgcaaggaguaugcgagccuaaucgaacugacuacgcagucucucagugaguuagaagcucaauuucugcguauguccaaagucccuacagaucuugccguggaggaggcacugucacuccaggacgggugccgggccaucuuggaugaaguugcuggacugggcgaggccguggacgaacugaaccagaagaaagaggguuucagaagcaccgggcaaccguggcagccagauaagaugcuccaccuaguaacucuguaccaccgacuuaaaaggcagaccgaacagcgcgucucuuugcuggaggacacaacgucggcauaucaagagcaugaaaagaugugucagcagcucgagcggcaguuaaaauccgugaaggaagagcaaaguaaggugaaugaggaaacccugcccgcugaggaaaaacuuaagauguaccacagccuggccggaucacuccaggauucuggcauuguuuugaaaagagucacuauacaucuggaggaccuagcgccucaccuggacccccucgcauaugaaaaggccaggcaccagauccaguccuggcaaggcgaguuaaaacugcuuacaagcgcuauuggggagaccgugacugaaugcgagagucgcaugguacagucaaucgauuuucagacagaaauguccagaagccuggacugguugcggcgagugaaggccgagcucucuggaccagucuaccuggaucuuaaccugcaagacauucaggaagagaucaggaagauacagauccaucaggaggaagugcaaaguagccuccguauuaugaaugcuuugucccacaaagagaaggaaaaauucaccaaggcaaaagagcugaucucugccgauuuagaacauucacuggcggagcucagcgagcuagacggugauauucaggaagcccugagaacacggcaggcuacucuuaccgagaucuauucccagugccaacgcuacuaccagguuuuccaggcagccaacgacugguuggaagaugcucaggagcugcuccaacuggccggcaaugggcuugacguggagucggcagaagagaaccugaagucucacauggaauuuuucaguacggaggaucaguuucauagcaaucucgaagaguugcacucacuggucgccaccuuagacccucuaauaaagcccacaggaaaagaggaucuggaacagaagguggcuucccucgagcugaggucucaacgaaugagcagagacuccggcgcgcagguugaccuuuugcagcgguguacugcccaguggcacgauuaucaaaaagcacgcgaagaggugauugaacugaugaacgacaccgagaagaaacucagugaguucucacuguuaaagacaagcucuucccaugaagcugaggaaaagcugagugagcacaaagcccuuguaagcgucgugaauucauuucaugaaaagaucguugcacucgaggagaaagccucucagcuggaaaagacugguaacgaugcuuccaaagcgaccuugucgaggagcaugacgacaguguggcagagauggacccggcuacgugccgucgcacaggaccaagagaagauucuggaagaugcuguggacgaguggacuggguucaauaacaaaguaaagaaggccacagagaugaucgaucagcuccaggacaaacugccaggcaguuccgccgaaaaggcuucuaaagcagagcuuuugacccugcucgaauaccacgauacuuuugugcuggaguuagaacagcaacagucagcccugggaaugcuucgccagcagacccucagcaugcuacaagacggcgcugcgccuacaccgggggaggagcccccacugaugcaggaaauaacggccaugcaggauaggugcuugaauaugcaagagaaggucaaaaccaacggaaagcugguuaagcaggaacucaaagaccgagagaugguggaaacucagaucaacuccgugaaguguuggguccaggagacaaaagaguaucuggguaauccuaccauugaaaucgacgcacaacuugaggaauugcagauucugcucacugaggccacaaaccauagacagaauaucgaaaagauggcugaggagcagaaagaaaaguacuuaggccuguauaccauacuacccucugagcugagccuucaacucgcagaaguggcccuggauuugaagauucgggaccagauccaggauaaaaucaaggagguugagcagaguaaagcuacgucacaagaacuguccaggcagauucagaagcucgccaaagaccugacaaccauccuuacuaaguuaaaggcaaaaaccgauaacguagugcaagcgaagacagaccagaaaguccugggggaggaauuggauggaugcaauagcaagcucauggagcuggacgccgcugugcagaaauuccuagaacagaacggccaacuggguaagccacuugccaaaaagauagggaagcucacugagcugcaccagcagaccauucgccaggcagagaauagauugucuaaacugaaccaagcugccagucaccucgaagaguacaaugaaauguuagagcugauccuuaaguggauugaaaaagcgaagguucuggcccauggcacaaucgcuuggaacuccgcaagccaguugcgggagcaguauauacuccaccagacgcugcuagaggaaucaaaagagaucgauucggaacuggaggccaugacugaaaagcuucaauaccucaccucuguguacuguacagagaagaugagccagcaggucgcugagcugggaagggaaaccgaggaauugcgccagaugauuaaaauccgacugcaaaauuuacaggacgcagccaaggauaugaaaaaguuugaggccgagcucaaaaagcugcaggcugcacuugaacaagcccaggcgacucugacauccccugaggugggcagacuaagucucaaggaacaguugucacaucgucagcaccugcugucugagauggaaagccuuaaacccaagguacaagcugugcagcucugccaguccgcccugcggauuccggaggacgucguugcaaguuuaccauugugucacgccgcucugaggcuccaggaggaagccagccgccugcaacauaccgcaauccagcagugcaacauuaugcaggcugccgugguccaauaugagcaguacgaacaggagaugaaacaccuucaacagcuaaucgaaggggcgcauagagagauagaggauaagccuguggcaacgucuaauauccaggaacugcaggcccaaauuucccggcacgaggaacucgcucagaaaaucaagggauaucaggagcagauugccucauugaacagcaaguguaaaaugcugacuaugaaggcuaaacaugcaaccauguuacugacaguuaccgaaguggagggucuugccgagggcacugaagaccucgacggggagcuguugcccacaccaucggcgcaccccuccguagugaugaugaccgccggaaggugccacacacugcucucuccugucacugaagagaguggcgaggaagguaccaauucagagauaagcuccccgcccgcuugucgaucuccaagcccuguggcaaacacggaugccaguguuaaccaagacaucgcuuacuaucaggcccugucagcagaaagacuucagacagaugccgcuaagauucaucccuccaccagcgcgucucaggaguucuacgaaccugggcuagagccauccgccacugcaaaacugggcgaccuccaacgcaguugggagaccuugaagaaugucaucagcgaaaagcagcggacacuguaugaggcuuuagaaaggcagcagaaauaccaagauucacugcagucuauuuccacuaagauggaggccaucgaacuuaaacucagcgagucgcccgagccuggacguaguccagaaucucagauggcagagcaccaagcccugauggacgaaauauugaugcugcaggaugagaucaacgaacuccagucaucccuagcugaggagcuggugagcgaaucuugcgaggcggaccccgccgaacagcuugcacugcaaagcacguuaaccgugcucgcugagagaauguccacaauucgcaugaaggccaguggcaaaaggcagcuguuggaggaaaagcugaaugaucagcuugaggaacagcggcaagagcaggcccuccagcgauacagaugcgaagcugacgagcuggauucaugguugcugagcaccaaagcaacucuagacacagcccucuccccgccuaaggagccaauggauauggaagcgcagcugauggacugucaaaacaugcuuguagagaucgaacagaaggucguggcuuuaucugagcugaguguucauaaugaaaaccuccuguuggaggggaaagcccacaccaaggacgaggcagaacagcuggccggaaaacuucgcaggcucaagggcucacugcuagagcugcaacgggcuuugcacgauaaacaguuaaauaugcaggguacugcacaggaaaaggaggaaagcgacguggaucugacagccacccaaucccccgggguccaggaguggcucgcucaggccagaacgacuuggacccagcaacgucagucuucgcuucagcagcaaaaggagcuggaacaggagcucgcggaacagaaaagccuguugcgcuccguggcaaguaggggagaggagauucugauccaacauucagccgcugaaacaucuggcgacgccggugagaagccugauguucuuagccaggaacucggcauggagggggaaaaauccagugcagaggaccagaugcggaugaagugggagucucugcaccaggaauuuagcaccaaacaaaagcuauuacagaacgugcuggagcaggaacaggagcaagucuuguauucacgaccaaauagacugcucuccggagugccccuuuacaagggcgauguaccgacucaggacaaaagcgcugugacaucucugcucgaugggcugaaccaggccuucgaagagguuucaagucaguccggaggcgcgaagaggcaaagcauacauuuggagcagaaacuguaugacggugucucggccaccucuacguggcuugaugacguggaagagcgccuauuuguggcaacagcucugcucccugaagagacugaaaccugcuuauucaaucaggagauucuggccaaggacaucaaagagauguccgaagagauggauaagaacaagaauuuguucagccaggcuuuucccgaaaacggggacaaucgggaugucaucgaggacacacucggaugucugcuuggcagacugucacuccuggauaguguugugaaccaacgaugccaccagaugaaagagagguugcagcaaauuuuaaacuuccagaaugaccugaagguacuauuuaccucucuugcagauaacaaauacauaauccugcagaagcucgccaauguguucgaacagccagucgccgagcaaauugaagcuauccagcaggcagaggacggucugaaagaauuugaugccggcauuaucgaguugaagcggcgcggggacaaacuccagguggagcaaccuuccaugcaggaacugagcaagcuucaggauauguaugacgagcugaugaugauaaucggaucaagacguaguggcuuaaaccagaaucucacucugaagucccaauacgaaagggcguugcaggaucuggcugaccuacuugagacggggcaggaaaaaauggccggagaccaaaagauuaucguuagcucuaaagaggagauucagcagcugcucgauaagcauaaagaauauuuccagggccuggagucgcacaugaucuugaccgaaacacucuuucggaagauaauuagcuucgcagugcaaaaggagacucaguuucacaccgaacugauggcccaggcuuccgccguccuuaaaagagcacauaagcgcgguguagagcuggaguacaucuuagaaacauggucacaccucgacgaggaucagcaagaacugucuaggcagcuagaggugguugagaguagcauucccuccgugggguuggucgaagagaacgaagaccgacugaucgaucggaucacccuuuaccagcaucugaaaucuucacucaaugaguaucagccaaagcuguaccaaguguuggacgauggaaaaagacuccugauuagcauaaguuguuccgacuuagaaucucagcuuaaccagcugggcgagugcuggcuaagcaauacuaacaagauguccaaggagcugcaccgccucgaaacaaucuugaaacauuggaccagguaucagucagagagugcugaucugauucacuggcuucaaagcgccaaggaccgucuggaauucuggacgcagcagucugugacugucccccaagagcucgaaaugguuagagaucaccugaaugcguuuuuagaguucuccaaagagguggacgcacagucgagcuugaagucaaguguacuguccacaggcaaccagcuccuucggcugaaaaagguggacaccgccacucuacgcucugaacugagcaggaucgauucacaguggaccgaccucuugacaaauauuccugcuguccaagagaagcugcaucagcuucagauggauaaacugccaucccgacacgccaucucugaaguuaugagcuggauaagucucauggagaacgugauccagaaggacgaagauaauauuaaaaacuccaucggguacaaggcaauucaugaguauuuacaaaaauacaagggauucaaaauagacaucaauuguaagcagcugaccguggauuuugucaaccagagcguauugcagauuucuucacaagacguggagaguaagagauccgauaaaacggacuucgcugaacagcugggugccaugaacaagagcuggcagauccuccaaggccuuguuacagagaaaauccagcugcuagaagggcugcucgagucuuggucggaguaugaaaauaacgugcagugcuugaagacuugguuugagacccaggaaaaacggcugaagcaacagcaccgcauuggagaucaggcgucaguccagaaugcccuuaaggacugucaagaucuggaggaccucauaaaagcuaaggaaaaagagguggagaagaucgaacagaacggcuuagcacugauucagaauaaaaaggaggacguuagcuccaucgugaugaguacacuaagggaacugggucagacuugggccaaccucgaucacauggucgggcaauugaagauucugcuuaaaucuguacuggaccaguggagcucccauaagguggcuuucgauaaaaucaauucauaccucauggaggccagauacaguuuaagccgguuucgucuguugaccggaucucuugaagcaguccaggugcaaguugacaaccugcagaaucuccaggaugaccuggagaagcaggagcgaucccuacaaaaauucggcagcauaacaaaccagcugcucaaggaaugccacccgcccgugaccgagacuuugacgaauacccugaaggaagucaacaugagguggaauaaccuuuuagaggaaaucgccgagcagcugcagucaucuaaagcucuccugcaauuguggcagcgcuauaaggauuacuccaaacagugugcgaguacagugcagcaacaggaggacagaacuaaugaacuucugaaggccgcaaccaacaaagauauugcugacgaugagguagccacauggauccaggacugcaacgaucuccugaagggccuagggaccgugaaagacagccuguuuuuccuccaugaauugggagagcagcuuaagcaacagguugacgcaucggccgcuuccgcgauucagucugaucaacugucauuaagccagcaccugugugcccucgagcaggcacugugcaagcagcaaacuaguuugcaggcuggugugcuugacuaugaaacauuugccaaaucccuggaggcccucgaagcauggaucgucgaggcugaagagauacuacagggccaggauccuucucauagcucagaccugaguacgauucaagagcggauggaagaguuaaaggggcagaugcugaaauucuccagcauggccccagaucucgacagguugaaugaacugggauaccgccuuccccugaacgauaaggagaucaaaagaaugcagaaucucaaccggcacuggucucugauuuccucacagaccacugaacgauuuagcaaguugcaaaguuuccuucugcagcaccagacauuucucgagaagugcgagaccuggauggaauuccuagugcaaaccgagcagaaacuggcgguugaaaucucuggcaauuaucagcauuuacuggagcagcaaagggcucacgaacucuuccaggccgagauguuuucgagacagcagauauugcauuccaucauuaucgacggucaacgccugcuugagcaggggcaggucgaugaccgugaugaauucaaccugaagcucacucugcuaagcaaucaguggcaaggagugauucggagggcacagcagagacgcggcaucauagacucacagauucggcaauggcagcgauacagggagauggccgaaaaauugagaaaguggcugguagaggugucuuaucuuccuaugaguggccucgggagcgucccaaucccccugcagcaagcucgcacauuauuugacgaggugcaguucaaagaaaagguuuuucugcggcagcagggauccuacauccucacgguggaggcagguaagcaauugcugcuuucagccgauagcggcgcugaagccgcgcugcaggcagagcucgccgaaauucaggagaaauggaaguccgcuucuaugaggcuagaggaacagaaaaagaaacuggccuucuuauugaaggacugggagaagugugaaaaagggaucgcagauagucuggagaagcuucguaccuuuaaaaagaaacucagccaaucccugccugaccaccacgaagagcugcaugcugagcagaugagaugcaaggaacucgagaacgccgucggaucuuggacagaugacuugacucagcugucacuucugaaggauacccucucggcguacauuagcgccgacgauauaaguauccuaaaugaacgaguggagcuguuacagcgccaaugggaagaguugugucaccagcugucccuucggaggcagcaaauuggcgagagacucaacgaaugggcaguauucucugagaaaaauaaggaacugugcgaguggcugacacagauggagagcaaaguuucacagaacggugacauccucauugaagagaugaucgaaaagcuuaaaaaggauuaucaggaggaaauagcuaucgcccaagagaauaaaauucagcugcagcagaugggggagcgguuggcuaaggcaucccaugaaaguaaggccucugagaucgaauacaaauuaggaaaggugaacgaccgcuggcaacaccugcuagaucucauugccgcuagggucaaaaagcugaaagagacucuuguggcagugcagcagcuggacaagaauaugagcuccuugagaaccuggcucgcccauaucgaaucagagcuggcgaagccgauaguuuaugacagcuguaacucugaggaaauucagcgaaaacugaacgagcaacaggaacuccagcgugauaucgagaagcacaguacgggcgucgcuuccguguuaaaucugugcgaaguacuuuugcacgacugugaugccugcgcaacagacgccgagugugauagcauccaacaggcuacccggaaccuggacaggcgcuggagaaauauuugcgcaaugucgauggagaggcggcuaaaaauagaagagacuuggagacucuggcagaaguuucuggaugacuacucucgcuucgaagauuggcuuaaaucauccgagcgaaccgccgcguuuccaagcaguucuggcgugaucuauacagucgcuaaggaggaacugaagaaauucgaggccuuucagaggcaagugcaugaauguuugacucagcucgagcugauuaacaagcaguaccggagauuagcacgcgaaaaucguaccgacuccgccugcagccugaaacagaugguucacgaggggaaccaaaggugggauaaucuccagaagcgggugacaucaauccuuagacgacugaaacauuucauuggacagcgcgaggaauucgagacggcuagggacaguaucuuggucuggcuaaccgaaauggaucugcagcucacuaacauagagcacuuuuccgaaugcgacgugcaagccaagaucaagcagcugaaagcauuccagcaggagauuagccuuaaucauaacaagaucgagcaaauuaucgcucagggugaacagcugauagagaaaucugaacccuuggacgccgcgauuaucgaggaagagcucgaugagcugcggagauacugucaagaaguauuuggccgcguugagagguaucacaagaaauuaauccgucugccucuacccgacgaugaacacgaccucucagauagagagcuggagcuugaagacagcgccgcuuuguccgaucugcauuggcacgaccggagugcagauucucuccugucgccacagccuagcuccaaucuuucacugucuuuggcccagccccuccgaagugagcgcagcgggagggacacaccagcuuccguggauucaauuccgcuggaaugggaccaugacuacgauuuaucuagagaccuggagagcgccaugucccgggcacuaccuagugaagaugaggagggacaggacgauaaggacuucuaucucaggggcgcggucggucugagcgaugugaugauccccgaaucuccagaggccuacguuaaacuuaccgaaaacgcuauuaagaauacuuccggggaccacucagcauuggagagccaaauacgccagcugggaaaggcccucgaugacaguagauuucagauccagcaaacagaaaacauuauccggucgaaaacccccacgggcccugagcuggauaccucuuauaagggcuacaugaaauuacugggggagugcuccagcucaauugacagugugaagcgacuugaacacaaauugaaggaggaagaggaaucccucccaggauucgucaaucugcauucuacagagacucagaccgcuggugugaucgaucguugggagcuacugcaggcccaggcacucagcaaggaacugaggaugaaacaaaaccuucagaaguggcagcaauuuaacucagacuugaauuccauaugggccuggcugggcgacacagaggaagaguuagagcagcuccagcgccuggaacuuagcacugauauccagaccauugagcugcaaaucaaaaaguugaaagaacuccagaaggcuguagaccacagaaaggcgauuauacugucuaucaaccuauguagucccgaguucacacaggccgauuccaaagaaagccgggaccugcaggauaggcucucacaaaugaaugggagaugggaccgagugugcucucugcuugaggaguggcgcggauugcugcaggaugcauuaaugcagugucagggcuuucaugaaaugucgcacggucuccugcuuaugcuggagaacauugaccggaggaagaaugaaaucgucccuaucgauaguaaccuagacgcugagauucuccaagaucaucacaaacagcugaugcagauaaagcacgaauugcuggagagccaguuaagaguugccucccuccaagacaugucuugccagcugcuugugaaugccgaggggacggauugucuggaagcaaaagagaaggugcaugucaucggaaaccgcuugaagcuccugcuaaaagaagugucacggcacauuaaggagcuggaaaaacuucucgacguuagcuccagucagcaagaccugucuagcugguccucagcugaugaguuggacaccagcggcaguguaucuccgacuuccggccguucgacaccaaauaggcagaagacccccagagggaaaugcagccugucacagccuggaccauccgugucuaguccccauagccgauccacuaaggguggcucagauucuagcuuaagugagccugggcccggacgguccggccgcgguuuccucuuuaggguccugagagccgcgcuuccacugcaguugcuccugcuacugcuuaucgggcucgcuugucuggugccgaugagcgaagaggacuauucuugcgccuugucaaacaauuucgcacgguccuuucacccuauguuacgcuacaccaacggccccccaccucuguga

SEQ ID NO: 63456 - RNA, 20658 nt, Artificial Sequence
  derived and/or modified sequence opt3 from SYNE2__Homo_sapiens__NP_055995
auggccagcucccccgagcugccuaccgaagacgagcagggcucuugggggaucgaugaccuccacauuucacuucaggcugaacaggaggauacucagaagaaagcauucacuugcuggauaaacagucagcuggccagacacacgagcccauccgugaucucugacuuguuuaccgauauuaagaaagggcacgucuuacuggacuuacucgaaguucugucgggucagcagcuuccgagagauaagggcucaaauacuuuccagugucggaucaacauugagcaugcgcugacauuuuugcgcaaucgaagcaucaaacucauaaacauccacgugaccgacauuaucgaugggaaucccaguauuauccugggacugauauggacuauuauccuccauuuccacauugagaaguuagcucagacccuguccugcaacuacaaucaaccuucucuugacgaugugagcguggucgacuccucaccagccaguagucccccugcaaagaaauguucuaaggugcaggcccguuggcagauguccgcuagaaaagcauugcuguuaugggcccaggaacaaugcgcuacuuaugagucaguuaacgugacagauuuuaagagcaguuggaggaauggcauggccuuccucgcgaucauccacgcacugcggccagaccuuauugacaugaaaucugucaagcaucgcuccaacaaggauaaucugagagaagccuuuaggauagcugagcaggaguugaaaaucccccggcuccuggaaccugaggacguggauguaguugacccagaugaaaagagcauuaugaccuacguggcccaguucuuacaauauucgaaagacgcaccggguacgggggaggaagcucagggaaaggucaaagaugccaugggcuggcugacucuccagaaggagaaacuucagaagcuguugaaggacucugagaacgauaccuacuuuaaaaaguauaauucccugcugucauucauggaaaguuuuaacgaggagaagaaaaguuuccucgacgugcuguccaucaaacgcgaucuugacgagcuggacaaggaucacuugcaacuccgagaagcgugggacggccuggaucaucagauaaaugccuggaagauuaaauuaaacuacgcacugcccccuccacugcaccagacagaggcuuggcuccaggagguggaggaacugauggacgaagaucuuucugccagccaagaccacucacaggcugucacuuugauccaggagaagaugacccuguuuaaaagucucauggauagauucgaacaucacuccaacauccugcuuacauucgagaauaaggacgagaaccaucugcccuugguuccuccaaauaaacucgaagagaugaagaggcggauuaacaauauccuggaaaagaaauuuauuuuacugcuagaguuccacuauuacaagugucucgugcuggggcuuguagaugaggugaaaagcaaguuggacauauggaacaucaaauacggaucucgugaaucagucgagcugcuccuggaagauuggcauaaguuuauugaggaaaaggaguucuuagcccgccuggacaccaguuuucagaaaugcggugagaucuauaagaaucuugcaggcgaaugucaaaacaucaauaaacaguacaugaugguaaagagcgauguuugcauguauaggaagaauauuuacaaugugaaguccacguugcagaaaguccucgccuguugggcuacuuauguggagaaccugaggcuacugcgggcgugcuucgaagagacaaagaaggaagagauaaaagagguacccuuugaaacccucgcacaguggaaucuggagcacgccacucuuaacgaagcugggaauuucuugguugaggugucuaacgacgucgugggaucgagcaucuccaaggaacugcgacgcuuaaacaaaagauggaggaagcucgucucaaaaacacaacuggagaugaaucuuccgcugaugauuaagaagcaggaccagccuaccuuugauaacaguggcaauaucuugucuaaagaggaaaaggccacgguggaguucagcaccgacauguccguugaacuccccgagaacuacaaucaaaacauuaaagcgggugaaaagcacgaaaaagagaaugaagaguuuacagggcagcugaagguggccaaggauguagaaaaacuaaucggacaggucgagauaugggaggcugaagccaagucagugcuggaccaggaugacguugauacuagcauggaggaaucucucaaacaucugaucgcaaagggcuccauguucgacgagcuuauggcgcggagugaagauauguugcaaauggacauucagaacaucagcucucaggaguccuuucagcacgugcugaccacaggcuuacaagcuaaaauucaggaggccaaggaaaagguccagaucaaugugguaaaacucauagcagcccugaagaaccuuacugaugugucaccagaccuggauauucgccuaaaaauggaggaaagucagaaggagcucgaaagcuauaugaugagagcucaacagcuguuggggcagagggagucgccuggagagcugaucuccaaacauaaggaagccuuaauuaucucuaauaccaaaagccucgcaaaguaccugaaggcuguugaggaacuuaaaaacaaugucacagaggacauaaagaugucacuggaggagaaaagccgugacgugugugccaagugggaguccuugcaccacgaacucucucuguacgugcaacagcuaaaaaucgauauugagaaggguaagcugagcgacaacauccuuaaacucgaaaagcagauuaauaaagagaagaaacugauccggcgaggcagaaccaagggguugauaaaggagcaugaagcgugcuucuccgaggaaggaugccuguaucaguuaaaccaccauauggagguccucagggaacugugugaggagcuucccucacagaaaagccagcaggaaguuaagcgccuguugaaagauuacgagcagaagauugaacggcuccugaaaugcgccagugagauccacaugacucuacaaccaacggcuggcgguacaucuaagaacgaagggaccaucacuaccuccgagaauagaggcggagacccccauagcgaggcaccuuucgccaagucggauaaccagccaucaacagaaaaagcuauggagccgaccaugaaguuuucucuggccagugugcuuaggccccuccaggaagaguccauuauggagaaagacuauagcgcaucuaucaauagccuguuggaacgcuacgauacuuaucgagacauuuuagagcaccaccuacaaaacaauaaguuccggauaacauccgauuuuucaagugaagaggaccguaguucuuccugucuccaagcgaaacugacggaucuucaggugaucaagaacgaaaccgacgccagauggaaggaguucgagauuaucucacugaaauuggaaaaucauguaaacgacauuaagaaaccuuuugucaucaaggagagggauacucuaaaagaacgcgagcgggaacugcagaugacacucaauaccagaauggagagucuggagacagcucuuagguuagugcugccaguugaaaaggccagccucuugcugugcggcuccgaccucccccugcacaaaauggcaauacagggguuccaucuuaucgaugcugaccgaauuuaccaacaucugcgcaacauccaggauucuauugccaagcagaucgagauauguaaucgguuggaagaaccuggaaacuuugugcuaaaggaacugcauccauucgaccuccacgcaaugcaaaauauuaucuuaaaauauaagacucaguuugaggguaugaaccacagaguccagaggucggaggauacccugaaagcccuugaagacuuccuggcuagccuccguacggcgaaguugucagccgagcccgugaccgaucuguccgcaagugacacacagguugcucaagaaaauacucucaccgugaaaaacaaggagggcgagauccaucugaugaaggauaaagccaagcaccuugacaaaugccuaaagaugcuggauaugucuuuuaaagacgccgaacgcggggacgauacaagcugugagaacuuguuagacgcuuucuccauuaagcugucagaaacucauggauacggcguacaggaggaauuuaccgaggagaauaagcuccuggaagcaugcauauucaaaaacaaugagcuucugaagaacauccaggauguccagucucaaauuagcaaaaucggucucaaggacccgacggugccugccgugaaacaccggaagaagaguuugauuagacuggauaaaguccuagacgaauacgaggaagagaagaggcaucugcaggagauggcaaauucccucccacacuucaaagaugggcgagaaaagacaguuaaccagcagugucaaaauaccgugguacuuugggagaacacuaaagcucuggugacagaaugcuuagagcaguguggccgggucuuggaacugcucaagcaguaucaaaauuuuaaaagcauccugaccacucuuauacagaaggaggagucugugaucucacugcaggccuccuacaugggaaaggaaaaccucaaaaagcgcauugcagagaucgaaauuguuaaagaggaguucaaugaacacuuggagguggucgacaagaucaaccaggugugcaaaaaucugcaauuuuauuuaaacaagaugaagaccuucgaagaacccccuuuugaaaaagaggccaauauaauuguugauagauggcuagacaucaacgagaagacagaagauuacuaugagaaucugggcagggcucucgcacuuugggacaaacuguucaacuugaagaacgugaucgaugaauggacggagaaagcccugcagaagauggaacuccaucagcugaccgaggaggaccgggaacgacuuaaggaggaacuccagguccacgagcagaaaacuagcgaauuuagcagacgcguagcggagauucaauuccuguugcagucgucugagaucccccuggaauuacaggugauggaguccagcauacuaaauaagauggaacauguucaaaaaugccugacaggggagucaaacugucacgcucucaguggaucuaccgccgagcuuagggaagaccuggaucaggcaaagacacagauugguaugacugaguccuugcugaaagcccucagcccaucagacagucuggaaaucuuuaccaaacuugaggaaauucagcaacagaucuuacagcaaaagcacagcaugauacugcucgagaaucagauuggcugcuugacgccugagcuguccgaacucaaaaagcaguacgagucugugagcgaucuguucaacacuaaaaaguccguccuccaggaccauuuuucaaaacuucugaaugaucaauguaagaacuucaaugacugguucucuaacaucaaagugaauuugaaggaaugcuuugagaguucggaaaccaagaaaagcguagagcagaagcugcagaaacucuccgauuuccugacuuuagaggggcguaacucuaagaucaaacagguggacucaguccuuaagcacguuaagaaacaucugcccaaggcucacgugaaagaacucauuagcuggcuagugggacaagaguuugaacuggagaagauggaauccaucugucaggcccgggcaaaagaguuggaggauagucugcagcagcuccuuagacugcaagacgaucacaggaauuugcgcaaguggcugaccaaccaggaagagaaguggaaaggcauggaagaaccaggugagaagacagaacucuucugccaggcuuuagcccgaaaaagagagcaauuugaaucugucgcgcagcugaauaacagccuuaaggaguauggguucacugaagaggaggaaauuauaauggaggccaccugucugauggaccgguaccagacacuacucaggcagcugucagaaaucgaggaagaggacaaauugcugccgacggaggaucaauccuuuaaugaccucgcacaugaugugauucacuggaucaaggaaaucaaggagagucuuaugguucugaacagcucugaaggcaaaaugccuuuagaggaacgcauucagaagauaaaagagaucauucuguugaagcccgagggagacgcucguaucgaaaccauuaugaaacaggccgaguccucagaagcuccacucguacagaagacucugacagauaucagcaaccaaugggacaauacccuacaucuugcaucgacuuaccugucucaccaggagaagcuccuguuggagggcgaaaaauaucugcagaguaaggaggaucucagacuuaugcugauagaacuaaagaagaaacaggaggccggguucgcccugcaacauggauugcaggaaaagaaagcucagcucaagaucuacaagaaauuucugaagaaagcgcaagaccuaacaucccuucugaaggagcucaaaagccagggcaacuaucuguuggagugcaccaagaaucccucauucuccgaagaaccuugguuagaaauuaagcaucugcacgagucucuccuucagcagcugcaagauagcgugcagaaccuagacggucauguccgggaacacgauaguuaccagguguguguuacggaccugaauacuacccucgauaacuuuuccaaagaguucgugagcuuuucugacaagccagucgaccagaucgcaguggaggaaaaauugcaaaagcugcaggagcuugaaaauaggcugucacuccaggaugggacacuaaagaaaauucuggccuuggcuaagaguguaaaacagaacaccuccagcgucggacaaaagaucauaaaagacgauauuaagucucugcagugcaaacagaaggaccucgagaaucgccuugccucggcaaagcaggaaauggaguguugccugaacucaauccuaaaaagcaagcgauccacugagaaaaagggcaaauucacacugcccgguagagaaaagcaagccaccagugaugugcaggagucuacacaggaaagcgcugcgguugagaaacucgaggaagacugggagauuaauaaggauuccgccguggaaauggcaaugucaaagcaauugagucugaacgcucaggagucuaugaaaaauacugaagacgagcggaaggucaacgagcuucagaaucagccucuggaauuagauaccaugcucaggaacgagcaacuggaagagaucgaaaaauuguauacgcagcuggaggccaagaaagcagccauaaagccgcucgagcagacagaaugccuuaacaagaccgagacuggcgcucuggugcuacauaauaucggguacagcgcccagcaccuggacaaccucuugcaagcgcugauuacccugaaaaagaauaaagaaucccaguauuguguucuucgcgauuuccaggaguaccuggcagccguggaaucaagcaugaaggcucuccugacagacaaagagucuuugaaggucggaccacuggacuccgugacuuaccucgauaagaucaaaaaguuuauugccaguaucgagaaagaaaaggacagccuuggcaaccugaaaauaaagugggagaaucuaucgaaccacguaaccgauauggacaagaaacuguuagaaucccagauuaagcaacucgagcaugggugggaacaaguggaacagcaaauccagaaaaaguauucucagcagguugucgaguacgaugaguucacgacacugaugaauaaagugcaagacaccgagaucucauugcagcagcagcaacagcaccuucagcugagacucaagagccccgaagagagggcuggaaaccagaguaugauugcacugacuacagauuugcaagccaccaaacauggcuuuuccgugcugaagggucaggcugagcuacagaugaagcggaucuggggagaaaaagagaagaaaaaucucgaagacggaauaaacaaucuuaagaaacagugggagacucuggaaccuuuacaccuggaggccgagaaccaaauuaagaagugcgauauccguaauaaaaugaaggaaacaauucucugggcgaaaaaccuguugggcgagcuuaauccaucuaucccccugcucccugacgauauacugagccagauccgcaaguguaaagucacccaugacgguauucuagcacgacagcaaucaguagaauccuuggccgaggaagugaaggauaagguuccgagucugacgacuuaugagggcagcgaccucaacaacacccuugaggaccugagaaaucaguaccagauguuagugcugaaaucuacacagaggucacaacagcucgaguucaagcuggaggaacgguccaacuuuuucgcuaucauucgcaaauuucaguugaugguccaggagagcgagacccuuaucauucccagaguggaaacagccgcaacugaggcugaacugaagcaccaccauguuacccucgaggccucucaaaaagaacugcaggagaucgauagugggauaucgacgcaccuacaggaguuaacaaauauuuaugaagaacugaacguguucgaaagguuguuucucgaggaccagcugaagaaucuuaagauccggacuaaccgaauccaaagauucauucagaauaccugcaacgaagucgagcauaaaauaaaguuuugucgccaguuccacgagaaaacauccgcacugcaagaagaggccgauagcauccagaggaaugaacuccuguugaaccaggaggugaauaagggaguaaaagaagagauuuacaaccuuaaggaccggcugaccgcuaucaagugcuguauucuacaggugcucaaacugaagaaaguuuuugauuauaucggcuuaaauugggacuucucacaacuggaucaguugcagacucaggucuucgagaaggaaaaagagcucgaagagaagauaaaacaacuggacaccuuugaggaagaacacgggaaguaccaggcgcuucugucuaagaugcgugccaucgaucuccagauuaaaaagaugacagaagugguguugaaagcaccagacagcuccccugagaguagaaggcugaacgcucagauccuuucacaacgcauugaaaaggccaaaugccugugugaugagaucauaaagaaguuaaaugagaacaaaacguucgacgauucuuuuaaggaaaaagagauucuacagaucaagcucaacgccgaagagaaugacaaacuguacaagguccugcagaacaugguuuuggaacucagccccaaggagcuggacgagaaaaauugccaagauaaacuugaaacuucccugcacguguuaaaccagaucaaaagucagcuccagcaaccacuguugauuaaucuugagauaaagcacauccagaacgaaaaagacaauugugaggcauuccaggaacagguaugggcugagaugugcagcauuaaggccgugaccgcgaucgagaagcaacgggaagagaacuccucugaggcuucagaugucgagacaaaacugcgagaguuugaagaccuacagaugcagcucaauaccagcauugaucugagaacuaacgugcugaaugacgccuaugagaacuugacaagguacaaggaagcaguuacccgcgccguggagucgaucacgucccucgaagcuauaaucauuccuuaucgggucgauguaggaaaucccgaggagagucuggaaaugccacuuagaaaacaggaggaacuggagucuacuguggcacauauccaagacuuaacagaaaagcucggcaugauuagcucaccggaggccaaacugcagcuacaguacaccuugcaggagcugguuuccaagaacucugcgaugaaagaggcuuucaaggcccaagagaccgaagcagagcguuaucuugaaaauuacaagugcuauaggaaaauggaggaggauaucuacacuaaccucaguaagauggaaacagugcugggucagagcauguccucacugccuuugagcuaccgggaggcccuugaacgccucgagcagucuaaagcucuggucaguaacuuaauuuccaccaaggaggaacugaugaaacuacgacaaauacucagacuguugaggcugcgguguacagagaaugacgggaucugccuucucaagauugugagcgcccugugggaaaagugguuaucacuguuggaggcagcuaaagaaugggagauguggugugaggaacucaagcaggaguggaaauuugucucugaagagaucgaacgcgaggccaucauucuggauaaccuucaggaggaacugcccgagauauccaagacuaaagaagcggccacgaccgaggaacuaucggagcuccuggacugcuugugucaguauggagagaauguggaaaagcaacagcugcuucucacacuguuacugcagagaaucaggagcauucagaacguuccagagaguucuggcgcaguggaaacuguacccgcuuuccaagagaucaccuccaugaaggagcgaugcaauaaauugcuccagaaggugcagaaaaacaaggaacugguccagacagagauucaagaacggcacagcuuuaccaaagagaucauagcccuuaagaauuucuuucagcagacuacgaccucauuccaaaacauggcauuucaggaccauccugaaaagagugagcaguucgaggaacugcaguccauccucaaaaaggguaaauuaacauucgagaauauuauggaaaagcugcguaucaaauacagcgagauguauacuauuguuccagcugaaaucgagucucaaguggaggaauguagaaaggccuuggaggauauagacgagaaaauuucaaacgagguccuaaagagcucccccucuuacgccaugcgcaggaagaucgaagagauuaauaacggccuucacaauguggagaaaauguuacagcagaagaguaaaaacaucgaaaaggcgcaggagauacagaaaaagaugugggaugaacuggaccucuggcacucgaagcugaaugagcuagauagcgagguacaggacaucguggaacaggauccugggcaggcucaagaguggauggacaacuugaugauuccguuucagcaguaucagcaaguuucccagcgggcagaaugcagaaccucacagcugaacaaagccacagugaagauggaggaauacucugaucuccuuaaaagcaccgaggcuuggaucgagaauacaagccaucugcucgccaacccagcagacuaugauucccugcgcacauuaucacaccaugccucuacgguccaaauggcuuuggaagacagcgagcagaagcacaaucugcuucauuccauuuucauggaucuggaagaccucaguaucauauuugagaccgacgaacugacucagagcauucaggagcuaucuaaccaagugacagcgcuucagcagaaaaucauggagucacugccccagauccaaaggauggccgaugacgucguggcaauugaauccgagguuaagagcauggaaaagcgaguaaguaaaaucaagaccauacucuugucuaaagagauuuucgauuuuuccccugaagaacaccugaagcacggagaggugaucuuagaaaauauucggcccaugaaaaagaccaucgcugagauagucucguaccagguggaacugagacucccacagacaggcaugaagccucuucccguuuuccagaggacuaaccaacuguugcaggacaucaaacugcucgagaaugugacgcaggagcaaaacgaacuacugaaggucgugauuaaacagaccaaugagugggaugaagagaucgaaaaccuuaagcagauucugaauaacuacagcgcccaguuuucacucgagcauauguccccagaccaagcagauaaauugccucagcugcagggggagaucgaacgcauggagaagcagauuuuaucucugaaucaacguaaggaagaccuccuuguagaucugaaagccacaguguugaaccugcaccagcaucucaagcaggagcaggaaggaguugagcgggacagacuaccggcugucacaagugaggaaggcgguguggccgagagggaugcgagcgaacgcaaacugaaucgacgggggucaauguccuauuuagcagccguggaggaggaagucgaggaaagcucuguuaagagugacaacggagaugagaaagcugaacccuccccacaaagcuggucaucucuguggaagcacgacaaagacauggaggaggauagagccucgagcuccaguggcaccaucgugcaggaagcauacggcaagauaucuacaucagacaacagcauggcucagauccucaccccugauucccuuaauacugagcaggggcccgaauguaguuugaggccaaaccaaacggaggaaggaacaaccccucccauugaggccgacacucuggauucuagcgacgcucaggguggccuggagccgcgcguagaaaagaccagaccagagccuacagaagugcuccacgccugcaaaacucaggucgcagagcuugaacugugguugcaacaggcgaauguggccguugagcccgagacccugaacgcugauaugcaacaggugcucgaacaacagcuagucgggugucaggccaugcugacagagaucgaacauaagguggcauucuuacuugagacgugcaaagaccagggacugggcgauaauggugcuacccaacacgaggccgaagcacucuccuugaagcugaaaacuguaaagugcaaccuggagaagguucagaugaugcuccaggaaaaacauucagaggaccagcacccaacaauucuuaagaaaagcucugaacccgagcaucaagaggcccugcagccugugaauuuguccgaacuagagaguauagucaccgaacggccgcaguuuucaaggcaaaaggauuuccagcagcagcaagugcuggagcucaaacccauggaacagaaggacuuuaucaaguucauugaguuuaacgcgaaaaagauguggccacaguauugucagcacgacaaugauacuacacaagagagcucggcuuccaaccaggccucuaguccugaaaaugacgugcccgauagcaucuuaucaccucaggggcagaacggagacaaauggcaauaccugcaccaugagcuuuccucuaagauuaaacugccacucccccaguuggucgaaccucagguuagcaccaauaugggcauccugccaagugugacgauguauaacuuccguuaccccaccacagaggaacugaagacuuauaccacacaacucgaggaucuacgacaggaggcauccaaucugcagacucaggaaaacaugaccgaggaagccuacauaaaucuugacaagaaauuguucgagcuguuucucacauuaagccaaugccugucuucaguagaggaaaugcuugagaugccgcgccuguacagagaagauggcuccgggcaacaggugcacuaugagacccucgcuuuggaacugaagaaacuauaccuggcccucagcgacaagaaaggagauuuacugaaggcaaugacuuggccuggugagaacacgaaccuucuguuggaguguuucgacaaucuccaggucugccuggaacauacacaagcugccgcggugugucggaguaaaucucuuaaggcuggccuggauuauaacaggucauaccagaaugagaucaagcgccucuaucaccaguugauuaaauccaagaccagccugcagcaaucguuaaacgaaaucucugggcagaguguugccgagcagcugcagaaagcagacgccuacacuguggaacucgagaaugcugaguccagagucgcaaagcuacgggaugaaggagagaggcugcaucuuccauaugccuugcugcaagaaguguacaaacucgaggacguacuggacagcauguggggcaugcuucgagcgcguuacaccgaacugucaucucccuuuguuacagagagccagcaggaugcccucuugcaagguaugguggagcuggucaagauugggaaggaaaaauuagcucacggacaccuaaagcagacgaaauccaagguggcacugcaggcccagaucgagaaccauaaaguuuucuuucaaaagcucguggcugacaugcugcuuauacaggccuauagugcaaagauuuugccuucacugcuccagaauagagaaaccuucugggcugagcaggucacugaggugaaaauccuggaagaaaagagccgccaaugcggcaugaaauuacagucccugcuucagaagugggaagaguuugaugaaaacuacgccucucucgagaaagaccuggagaucuugauuaguacacuaccaagcguaucccugguggaagagaccgaggaacggcucgucgaaaggauaucauucuaucagcaaaucaagagaaauauuggcgggaagcacgcgcgccuguaccagacucuuaacgagggaaaacaguugguugccucugugucgugucccgagcuggaaggucaaaucgcaaagcucgaggaacaguggcugagcuuaaauaaaaagauugaucaugagcugcaccggcuucaggcucuccuaaaacaccuguuguccuauaacagggacagugaucagcugacaaaguggcucgaaucuagccaacauacccugaauuacuggaaagagcagucacuuaacgucucccaggacuuggauacaauccgaagcaauauaaacaacuuuuucgaguuuucuaaggaaguggacgagaagaguucccugaaaacugccguaaucucaauuggcaaucagcucuuacaccugaaggaaaccgauacggcaacccuaagagccagccuggcucaauucgagcagaaauggacaaugcuuaucacucagcucccggacauucaggagaagcugcaucaauugcagauggaaaaacugccuucucggaaggccaucaccgagaugauaucguggaugaacaauguggaacaccagacauccgaugaggacaguguucauagccccucaucugcgucccaggugaagcaccuccugcaaaaacacaaggaauuuaggauggagauggacuauaaacaguggauugucgauuucgugaaccagagccuuuuacaacugaguacuugcgacguugagucaaagcgcuacgaacguaccgaguucgcugaacauuugggggagaugaauagacaguggcaccgaguccauggaaugcucaacaggaaaauccagcaccuggaacagcuacuggaguccauuacggagagcgaaaauaagauccaaauccuuaacaauuggcucgaggcacaggaggaacggcugaagacauugcagaaaccagaaucugugauuagugugcagaagcugcucuuagauugucaagacauagagaaccagcuggccaucaaaagcaaggcucuugaugagcugaaacaguccuacuugacccucgaaucuggcgccguaccucugcuagaggacacugcaucacgcauugaugaacuguuucagaagagaagcuccguccuuacacaagugaaucagcucaagaccucgaugcagucuguucugcaagaguggaaaaucuaugaccaguuguacgaugaggugaacaugaugacuauuagguucugguauugcauggaacacaguaagcccgucgugcugagcuuagagacccuccggugucagguugaaaaucugcagucacuucaagacgaggccgaauccucugaggguagcugggagaaacugcaggaagugaucgggaagcuaaaaggacucugcccauccguagcugagauaaucgaagagaagugccagaacacacauaagcgcuggacgcaggucaaucaagcgauugccgaucaguugcagaaagcacagagucugcugcaacuuuggaaggccuacucaaacgcucacggcgaagcagccgcuagacucaaacagcaggaggccaaguuucaacagcuggcgaacaucagcaugucuggcaauaacuuagcagagauuuugcccccugcccugcaggacauaaaagaacuccagcaugacgugcaaaagaccaaagaggcuuuccugcagaacuccagugugcuugaucgacuaccacagccggccgaaagcucaacucacaugcugcuccccgggccuuugcauucucugcagagggcagcuuauuuagagaagaugcugcuuguuaaggccaacgaauuugaguucguccucucccaauuuaaagacuucggagugcggcuggagucguugaagggucugaucaugcacgaagaggaaaaucucgaucgucugcaccagcaggagaaagagaacccagacagcuuucuuaaucauguacuagcgcugacagcccagagucccgauauugaacaccucaacgagguguccuugaagcugccuuuaucugacgucgcugugaaaacccugcaaaauaugaaccgccaguggaucagagcaacugccacagcucuugaaagguguucagagcuccagggcaucgggcugaaugaaaaguucuuguacugcugugagaaguggauucagcugcucgagaaaauagaagaggcacuaaagguugauguggccaacagccugccagaacuucuggagcaacagaaaaccuauaagauguuagaagcugaggucuccaucaaucagacgauugccgacucuuacgugacacaaagccuccagcuguuggauaccacugagaucgaaaaccggcccgaguuuauuaccgaguucaguaaacugacagacagauggcagaaugcaguucagggagugcgccaacgaaagggcgauguagacggucuugucaggcaguggcaggauuuuacuaccucaguggagaaccucuuccgguuccugacagacacgucccauuugcugagcgccguuaaggggcaggaaagauuuucucuauaccaaacucguagucucauccacgagcugaaaaacaaggagauacacuuccagcgcaggcggaccacaugcgcgcuuaccuuagaagcuggagagaaacugcuccugacuacagacuugaagaccaaagaauccgugggcagacgaaucagccagcugcaggauucauggaaggacauggagccucaacuugccgagaugauuaagcaguuucagucgacggucgaaacuugggaucaaugugagaaaaagaucaaagaacucaagucuaggcuacaggugcuaaaagcacagagcgaggacccgcugccagaauugcaugaggauuuacacaaugagaaggaacugauuaaagagcucgaacagucccuugccaguuggacccaaaaccugaaggagcuccagacaaugaaggcugaccugacccgccauguauugguggaagaugucaugguucugaaagagcagaucgagcaccuucaucggcagugggaagaccucugccugagaguggccauaaggaagcaagagauugaagaucgccuaaauacuuggguggucuucaacgagaaaaauaaggaauuaugugcauggcuggugcagauggagaacaaaguuuugcagacagcugacaucucaauugaggaaaugaucgagaagcugcagaaggauugcauggaagagauaaaucucuuuucugagaacaaacuucaacugaagcagaugggcgaccagcucaucaaagccagcaauaagucccgugcggcagaaauugaugacaaacugaacaagaucaaugaccgguggcagcacuuguucgauguaauugggaguagagugaagaaacugaaggagaccuuugccuucauccaacagcuugacaaaaacaugagcaaucuacgaacauggcuggcuaggauagaaucugagcucuccaagcccgucguguaugauguuugugacgaucaggaaauucaaaaacgcuuagccgagcagcaggaccugcagcgggauaucgagcaacacucagcuggaguggaaagcgucuuuaacaucugcgacguguugcuccaugauucggacgcaugugccaaugagacugaaugcgauuccauucagcagaccacgagaucucuggacaggcgcuggagaaacaucugugcgaugaguauggagcggcgaaugaagauugaagagacauggaggcuuuggcagaaguuccuggacgauuacucacguuuugaggacuggcucaaaagcgccgaaagaaccgcugcaugcccuaacuccucugagguacuguauacuagcgccaaggaagaguugaaacgguucgaggcuuuccaacgccagauacacgagagguuaacccagcuggagcuaaucaauaagcaguaccgaagacuugcccgggaaaaccgcacagauacugcaaguaggcugaaacaaauggugcaugaggguaaucagagaugggacaaccuccagcggcgugucacggccguucugcgcagguugcgacacuuuaccaaucaaagagaagaguucgagggcacacgggaaucaauucucguguggcugaccgagauggaucuucagcugacuaacgucgaacauuuuuccgagagcgacgcugaugacaagaugaggcaguuaaauggguuccagcaagaaaucacacucaacaccaauaaaauugaucagcugaucguguuuggagagcaguugauacagaagucugagccccuggacgcgguucuaaucgaagaugagcuugaggaacugcaccgcuauugccaagaaguguucggcagaguaucccgguuucacaggcgccucacaaguuguacaccaggucuggaggacgagaaggaagccagcgagaacgaaaccgauauggaggacccucgagaaauucagacggacucauggagaaaacguggggagucugaggaacccuccagcccacagucguugugccaucucguggcaccgggccacgagcggaguggaugugaaacuccugucucuguggauucaaucccccuggagugggaccauaccggcgauguugggggauccagcucucacgaggaagacgaggaagguccauacuauagcgcucuuuccggcaagaguauuucagaugggcacagcuggcauguccccgacuccccuucuugcccagagcaccauuacaaacagauggaaggagauaggaaugugcccccugugccgccagccaguucaacacccuacaagccuccauauggcaaacuguuacuacccccugguaccgacgggggcaaggagggaccccgcguacugaacggcaauccacaacaggaggaugggggacuagcagguaucacugaacagcagagcggcgccuucgacagaugggagaugauacaagcucaggaauugcacaacaagcugaaaauuaagcagaaucuucaacagcugaacuccgauaucucugcgaucacaaccuggcucaaaaagacggaggccgaacuggagauguugaaaauggcaaagccgccuucggacauucaggagauagaacuccgggucaagaggcugcaggagaucuuaaaggcuuuugacacauacaaggcccuugugguuagcgugaacgucuccaguaaagaguuccugcaaacugagucacccgaaucuaccgagcuacagagccgacugagacagcucuccuugcugugggaggccgcucagggggcaguggauaguuggcgcggaggccuucggcaaucucugaugcagugucaggacuuucaucagcucagccaaaaucuguuauuguggcuggccucagcuaagaacaggcgucagaaagcgcacguuacagauccaaaggccgacccuagagcacuccuugaaugccgcagggagcugaugcagcuagaaaaggagcugguggagcggcaaccccaggucgauaugcuccaggaaauuuccaauagcuugcugaucaaaggucacggggaggacuguauugaagccgaggaaaaggugcauguaaucgagaagaaacuuaaacagcugcgagagcaagugucucaggaucucauggcuuuacagggcacccagaacccagcaucaccucugcccaguuucgacgaaguugauuccggagaccaaccgccagccacuagcgucccugcucccagagccaaacaguuucgcgcagugaggacgaccgagggcgaagaggaaacagagucgcgggugccagggucuacuagaccccagcguuccuucuugagccgcgucguuagggcggcccugccucuccagcuucugcuacugcucuugcugcuucuggcuugccucuuaccgucaagugaggaagauuauucuuguacccaagccaauaacuucgcacgguccuuuuacccaaugcugcgauauacaaauggacccccucccaccuga

SEQ ID NO: 63457 - RNA, 1215 nt, Artificial Sequence
  derived and/or modified sequence opt3 from SYNE4__Homo_sapiens__NP_001034965
auggcccugagccucccccuuggcccuagacugggguccgagccauugaaccacccgcccggagcuccuagggaagcagacaucguggguugcaccgucuguccagccucuggcgaggaaucaacaagucccgagcaggcgcaaacuuuagggcaggauagccugggaccuccagaacauuuccagggcgguccccgggggaaugagccugcugcccacccaccgcgcugguccacgcccucuucguacgaggacccugcaggaggcaagcauugcgaacacccaauuucaggccuagagguucucgaagccgagcagaacagccugcaucuuugucuguuggggcucggacgacgucugcaagaucuggagcagggucucggccacugggcuuuagcacagagugggauggugcagcugcaagcccuucagguagacuugagaggagcugccgaaaggguggaggcgcugcuagcauuuggcgaaggucucgcccagcgguccgagccccgcgcuugggccgcacuggaacagauacuuagagcucugggggccuauagggauucuaucuuccggcgcuuguggcaacuccaggcgcagcuggucagcuacuccuuaguguuugaggaggccaauacccuggaccaagaucucgaaguugagggagacucagauuggccuggcccaggcgggguguggggacccugggcaccgaguagccuuccuacaucuacugaacuggagugggaccccgcuggugauauuggcggguugggaccacuaggccagaaaaccgcccgaacacugggugucccuugcgaacucugugggcagagaggcccccagggaaggggccaagggcuggaggaggcugacaccucccacucacggcaggauaugcuugaaagcggacugggucaucagaagcguuuggcccgccaccagagacauagucuccugaggaaaccacaagacaagaaacggcaggcaucuccccacuuacaggacgugcgacuggagggcaacccuggggccccagauccggcuucccgccagccccuaacuuuccuccugaucuuguuucuucuguuccuccugcuuguaggagcgauguuucuguugccugcaagcggcgguccaugcuguucgcacgccaggauucccagaacaccuuaucucguucugucuuacgugaauggguuaccacccgucuga

SEQ ID NO: 63458 - RNA, 4032 nt, Artificial Sequence
  derived and/or modified sequence opt3 from SYNGAP1__Homo_sapiens__NP_006763
augagcagauccagggccucuauccaccggggcucaauucccgcuaugaguuacgcaccuuuccgcgacgugcgagggccaagcaugcaucguacccaguauguccacuccccguacgauagacccggauggaacccuagguuuugcauaaucucugguaaucaacugcucaugcuugacgaggaugaaauucauccacuguugauccgggaccgcagaucggagucaagcaggaacaaguuacugcggcgcacaguuagugugcccguagaaggccgaccucacggggagcaugaauaucaccuaggaagauccaggcggaaaucugugccaggcgguaagcaguacagcauggagggggcccccgcggcuccuuuccguccaucccagggauuucucucacgcagacugaaaaguagcauuaagaggacuaaaucucagccgaaacuugaucggacguccucauuccgacaaauccugccccgcuuuagaagcgccgaccacgauagggcacgguugaugcagaguuucaaggagucucauucccacgaaagccuccugucgccuucuuccgccgcugaggcacuggaacucaauuuagacgaggauucaauaaucaaaccaguccauaguagcauucugggccaggaguuuuguuucgaagugaccacauccucuggcacuaagugcuuugccugucgcagcgcugccgagagagacaaauggaucgaaaaccuucagagggcgguuaagcccaauaaagauaacucacgucggguggacaaugucuugaagcuguggauuaucgaggcacgagaacuaccuccaaagaaaagauauuacugcgagcucugucuggaugacaugcuuuaugccaggaccacaaguaagccccgcuccgcuagcggggacaccguguucuggggagagcacuuugaguucaacaaucugccggccguacgggcauugagacuccaccuguacagggauucugacaaaaagcgcaaaaaggauaaagcugguuacguuggcuuagugacugucccuguggccacacuggcggggcgacauuuuaccgaacaaugguaucccgugacgcucccaacuggaucaggcgguagugggggaaugggcagcggcgggggagguggcuccgggggaggcucuggugggaagggcaagggaggcugcccugccguccggcuuaaagcacguuaccagaccaugucgauacugcccauggaauuguauaaggaguucgcugaauacguuacaaaccacuauagaaugcuaugugccgugcuggagccagcucucaauguaaaagggaaggaggaaguggccagcgcacugguccauauucuucaguccacuggaaaagccaaggacuuccugucagauauggcuaugagugagguggacagguuuauggaacgcgagcacuugaucuuccgggaaaacacccucgcgacaaaggcaauugaggaguacaugagacugaucggucagaaauauuuaaaggaugccaucggcgaauuuauuagggcucuguacgagucugaagagaauugcgagguugaccccauaaaauguaccgccagcucccuagcagaacaucaagccaaccuccgaaugugcugugagcuggcucuuugcaagguggucaauucacacugcguguucccucgcgaauugaaagagguauuugccagcuggcggcugagaugugcagaaagggggcgugaggauaucgcggaccgccucauuucugcuucccuguuccuucgguuucugugcccagccaucaugaguccgagcuuguucggacucaugcaggaguaccccgaugaacagacgucuagaacucugacauuaauagcaaagguuauucaaaaccuggccaacuuuuccaaguucaccucaaaagaggacuuucuaggcuucaugaaugaauuucucgagcuggaaugggguaguaugcagcaguuccuuuaugagaucagcaacuuggacacucugacaaauucguccucuuucgagggguacaucgaucucggcagggaacugagcaccuuacacgcucugcuuugggagguguugccucagcucucaaaggaagcccugcuaaaacugggaccacucccccgacugcuuaacgacauuaguacggcauugcggaauccuaacauccaacgccagccauccagacagucugagaggccccggccgcagccugucgugcugcgaggcccaagcgcugaaaugcaaggguauaugaugagagauuuaaauuccucaauugaccuccagagcuuuauggcccgcggacugaacaguucuauggauauggcgaggcuucccuccccuaccaaggagaaacccccaccucccccaccggguggcgggaaggaccuguucuacgucagccguccucccuuggcccggucgucaccagcuuauuguacaucuaguuccgauauaacugagcccgaacagaagaugcucagcgugaauaaaucuguuagcaugcuggaccuacagggagauggcccuggugggagacugaacuccucaagugugagcaaucucgcagccguaggcgaccugcuucauucuucccaggcuucauugaccgccgcacugggauuaaggccagcgcccgccggccgccucagucaagggagcggauccucuaucacagcugccggcaugcgacugucgcagaugggugucacuaccgauggggugccugcacagcaacuucggauuccgcugagcuuucagaacccacuauuccacauggcugccgacggacccggcccuccagguggccaugggggaggcgggggacacgggcccccuucaucccaccaucaccaucaccaucaccaccaucacagagguggggagccgcccggagauacauuugcaccauuccauggcuacaguaagucugaagaccucagcuccgguguuccuaaacccccagccgcuucaauccugcacucucauagcuauagugacgaguuuggcccuuccgggaccgauuucacuaggcgccaguugagccugcaagacaauuuacagcacaugcucucucccccacagaucacgauuggaccgcagcguccugcgcccucaggcccagggggaggcuccggugggggaaguggcgguggcgggggaggccaacccccuccacugcagagaggcaagagccagcagcuuacagugucggccgcacaaaaaccccggccuucuuccggaaaccuguugcagagcccggagccaucauacggccccgcuaggccucgccagcagagucucucuaaggaagguuccauagggggaagcggcggcucagggggagguggcgggggaggccugaaacccaguaucaccaagcaacacagccagacuccauccacccuaaauccuacaaugcccgccucugagcgaaccgucgccugggugagcaacaugccacaucuguccgcugauauugaaucagcacacaucgagagagaagaguacaaacuuaaggaguauucuaagaguauggacgaaucgcggcucgauaggguaaaagaguacgaagaggaaauucauagccugaaggagcgcuugcacauguccaacagaaaacuggaggaauaugagaggcgguuacucucucaggaggaacaaacuucaaagauccugaugcaguaccaggcccgucuugaacagagcgagaagcgccugcgacaacagcaggcggagaaagacucccagauaaagaguaucauugguagauugaugcucguggaagaggaacugaggcgggaucacccugcuauggccgagccgcuacccgagccaaagaagcgccugcuugacgcacaagaaagacagcucccuccccuggggccaacaaauccuaggguuacguuggccccaccguggaacggauuagcucccccugcacccccacccccuccgcggcugcagaucaccgagaauggcgaauuucgaaacacugccgaucauuga

SEQ ID NO: 63459 - RNA, 702 nt, Artificial Sequence
  derived and/or modified sequence opt3 from SYNGR1__Homo_sapiens__NP_004702
auggagggcggggccuacggagcugguaaggcaggcggggccuucgaccccuauacccuggugagacagccucacacaauccucagggucguuagcuggcuguuuuccauugugguauucggaucuauagugaacgaaggcuaccuuaauucagcgagugagggugaagaguuuugcaucuauaaccggaauccaaacgcuuguagcuacggggucgccgugggaguuuuggcauucuuaacuugccugcuauaucucgcccuggauguguacuuuccgcaaauuuccucugucaaagaccgcaagaaagcugugcuuucggauaucggcguaucagcauucugggccuuucugugguucguuggcuuuuguuauuuggcuaaucaguggcaagugagcaagcccaaagacaacccucucaaugaagggacggaugccgcgcgagcagccauugcuuucuccuuuuucaguaucuuuaccugggccggacaggcaguccuggcuuuccagcguuaccagauaggugccgacucugcgcuguucagccaggauuacauggacccaucccaggauucaaguaugcccuaugccccuuacguggagccaacaggccccgacccugcagggaugggaggcacuuaucaacagccagcuaacaccuuugauacagagccgcaggguuaccagagccaaggguauuga

SEQ ID NO: 63460 - RNA, 675 nt, Artificial Sequence
  derived and/or modified sequence opt3 from SYNGR2__Homo_sapiens__NP_004701
auggagagcggcgccuacggggcugcaaaggccggagguuccuucgaccugagaagguuucucacccagccccaaguggucgcgcgggcuguuugccuuguguucgcccugaucguauuuucuuguauuuauggcgaaggguacucaaacgcacacgagaguaaacagauguauugcguguucaaucgcaacgaagaugccugucgauacggaagcgcuauaggcgucuuggcauuuuuagccuccgcuuucuuucuggugguugacgccuauuucccucagaucucuaaugcgacagaucguaaguaccuagugauuggugaccuccuguuuucggcacuuuggacuuuccugugguuugucggguucugcuuuuugacgaaccagugggccgugaccaauccaaaagauguacucguuggagcugacucagugagagccgcaaucacauucagcuucuuuaguauuuucuccuggggcguccuggcuucucuggccuaucaaagguacaaggcgggcguggaugacuuuauccagaacuacguggauccgacucccgacccuaauaccgccuaugcaagcuacccaggggcuuccgucgauaacuaucagcagcccccuuucacacaaaaugccgagaccacugaaggauaccagccacccccuguuuauuga

SEQ ID NO: 63461 - RNA, 3888 nt, Artificial Sequence
  derived and/or modified sequence opt3 from SYNJ1__Homo_sapiens__NP_001153774
auggccuucagcaagggcuuuagaaucuaccacaaacuggaucccccuccauucucccucauuguggagaccaggcauaaggaagagugccuuauguuugaaucuggggcugucgcaguucugucaagugccgagaaagaagcgauaaagggaaccuauagcaaaguguuggacgcuuacgguuuacugggcguacuacggcucaaccugggggacacuaugcuucacuaucugguguuggucacgggauguauguccgugggcaagauccaggagucugagguuuuccgcgugaccucgacagaauuuauuucacuccgaaucgauagcagugacgaggaucguauuuccgaagucagaaaggugcucaauucugguaacuucuacuuugccuggagcgcauccgggaucucacuggaccugaguuuaaaugcccauaggagcaugcaagagcagacuaccgauaaccgguucuuuuggaaucagucucugcaccuucauuugaaacacuauggaguaaacugcgacgauuggcugcuacgccucauguguggcggcguugagauaagaacaaucuacgcugcacacaagcaggccaaggcuugccugauuuccaggcuuucaugugaacgggccgggacccgcuucaaugugcgaggaacuaacgacgauggucaugucgcgaauuuuguggagacagaacaaguggucuaucuggacgauagcguuaguucuuucauccagauuagaggcuccgugccguuguuuugggagcagcccgggcuccagguaggaagccacagggugcggaugucgcguggcuucgaagcaaacgccccugcuuucgaccgccauuuuagaacccugaagaauuuauacgguaaacaaaucauagucaaccugcucgggucuaaggagggagagcacaugcuuuccaaggccuuccagucacaccugaaagcaagugaacaugcugccgacauucagauggugaauuuugauuaccaccagaugguuaagggcggcaaagcggagaaguugcauagcgugcuaaaaccacaaguccagaaguuccuggacuauggguuuuucuacuuuaacggauccgaagugcagaggugccaaucugguacgguacggacuaauugucucgauugccuggaccgaaccaacagcguucaggccuuccuuggccuggagauguuggcaaaacagcucgaagcucugggguuagccgagaagccccagcuggugacacgcuuucaagaggucuucagaucaauguggagugugaacggagauuccaucagcaagauuuaugcuggcacuggugcccuagaagggaaagcaaagcucaaagacggcgccaggucugucacccggacaauccagaauaacuuuuucgauucaaguaagcaggaggcuaucgacgugcugcuuuugggaaauacccugaacagcgaucucgcggacaaagcacgcgcccugcuuacgacuggcucccugagaguuucugaacagacauugcaaucggcuagcuccaaggugcucaagucaaugugugagaauuuuuacaaauauaguaagccuaaaaagauuaggguaugcgucgggaccuggaacgugaauggagguaaacaguuccguucuauagccuucaagaaccagacucugacagauugguuacuggacgcaccaaagcuagccggcauccaggaauuucaagacaaacggagcaagcccaccgauauuuucgcuaucggguuugaggagaugguugaacucaaugccggaaacauaguguccgcaucaacgaccaaucagaaacugugggcggucgagcuucagaagacaauuagccgagacaacaaauacguguugcuggcuucugaacagcucguaggcgugugucuguucguuuuuaucagaccucaacacgccccauucaucagggaugucgcaguggacacugugaagaccgguaugggcggcgccacaggaaauaagggcgcugucgccauucgcauguuauuucauacuaccucccugugcuucguuugcagucacuuugcagcugggcagagccaggugaaagagcggaacgaggauuucaucgaaauugccagaaaacuuucuuuuccgaugggaaggauguuguucucccacgacuauguguuuugguguggugauuucaauuaccgcauagaccuccccaacgaggaaguaaaagagcugauccgacaacagaacugggauucacuaauugcgggcgaccagcugaucaaucagaagaacgccgggcaagucuuccggggauuucucgaaggcaaagugacauucgcuccuaccuacaaguaugaucuguuuagugacgauuacgacacuagcgagaaaugccguacgccagcauggacagacagaguucuuuggaggcgccggaaguggcccuucgauagaucggccgaggacuuggaucuguuaaaugcuuccuuucaggacgaaucuaagauccucuauaccuggacuccugguacccugcuucauuacgggagggccgagcugaaaacaagcgaucaccgaccaguggucgcauugauugacauagauaucuucgaaguggaggcggaggaacgccagaacauuuauaaggagguuaucgccgugcaggggcccccggacggaaccguacucgucucaauuaaaaguucccugccugaaaauaacuuuuucgaugacgcucuaaucgaugagcugcuccaacaguuugccucuuucggcgaagugauacugauccgguuuguggaggacaagaugugggucacuuuccuugaagggagcuccgcauugaauguucugucauuaaacggaaaagagcuccugaauagaacaauuacgaucgcucuuaagagccccgauuggauuaagaaccuggaggaagagaugagucuagagaaaaucucuauagcccucccauccagcaccucgucaacucuguugggcgaagacgcagagguggccgcugacuucgauauggaaggugacguagaugacuacucugcggagguggaggaacuguuaccucagcaucuccagcccaguuccagcucugggcugggaacaagcccauccucaagucccaggaccagcccuugucaaucuccaacaauuuccgaaggcccgguccccucacuuccuauccguccaagucgcgcccccagccggacuccugguccacccuccgcacagucuucgccgauugaugcucagccugccaccccacugccccaaaaggacccugcccagcccuuggagccaaaaagaccucccccaccgaggccuguggcucccccaacgcgacccgcaccuccacagcggcccccuccgccaagcggcgcccgcucacccgcgccuaccagaaaggaguuuggggcuccaaaaucccccggaacaacuaggaaggauaauaucggccggagucagccuucuccgcaagccgggcucgcaggacccggcccagccgguuauagcaccgcucgaccuacaauacccccaagagcagggguuaucuccgccccucagucacacgcgcgcgcuucugccggaaggcugacucccgaaagccagaguaagaccuccgagacgagcaaaggcucuacauuccuaccagaaccgcugaagccucaggcagccuuucccccacaaucaucccuucccccuccagcucagcgucuccaggagccccuggugccugucgccgcaccgaugccacagagugguccccaaccuaacuuggaaacacccccacagccucccccacggagcagaucgucucacucccugccuagcgaggcuucaagucagccgcagcaagagcagcccucuggcuga

SEQ ID NO: 63462 - RNA, 438 nt, Artificial Sequence
  derived and/or modified sequence opt3 from SYNJ2BP__Homo_sapiens__NP_060843
augaacggcagaguggacuaccuggucaccgaggaagagaucaaucucacaagggggcccagcggacuugguuucaacauuguuggcgggacugaucagcaauauguguccaaugacucuggaauauacguaucacggaucaaggaaaacggcgccgcugcacuggauggucgcuugcaggagggggacaaaauuuuaagugugaauggacaggaucugaagaaccuacuccaccaggacgccgucgaucuguuucgaaaugcgggcuaugcugugagccuucguguucaacauagacugcaagugcagaacggcccuaucgggcacaggggagaaggugacccauccggcauuccgaucuucauggucuuggugcccguauuugcccucacgaugguugcagccugggcuuucaugcgguaccgccagcagcuguga

SEQ ID NO: 63463 - RNA, 3780 nt, Artificial Sequence
  derived and/or modified sequence opt3 from SYNJ2__Homo_sapiens__NP_001171559
augaucuacauggacgauggcgugagcuccuucguccagauuagagggucuguuccccuguuuugggagcagccuggacuccagguggguucacaccaucuuaggcugcaccggggcuuggaagccaacgcuccagcauucgaccgccauaugguauuacugaaggagcaguaugggcagcaaguggucgugaaucuacucggaagucgaggcggugaagagguucugaaccgugccuuuaaaaagcugcuuugggcgagcugccacgcuggggauaccccgaugauaaauuucgacuuucaucaguucgccaaaggaggcaaguuggaaaaacucgagacacugcugagaccccagcucaaguuacacugggaggauuuugacguguucacuaagggcgaaaacgucuccccuagguuucagaaagggacgcugcggaugaauugucuugauugcuuggaccgcaccaacacagugcaaucuuucaucgcacuggagguacuacaccuccagcugaagacucuuggacugucgucaaaaccaauuguugauagauuuguggagagcuucaaggccauguggaguuugaauggucauucccucucuaaagucuuuaccggcagcagggcucuggaagggaaggcaaaggugggaaaauuaaaggacggcgcccgguccaugucacgcacaauccagaguaacuucuucgauggugugaaacaggaggcuauuaagcugcuccuugucggggacguuuacggagaagagguggccgauaaaggcggcaugcuguuggacagcaccgcgcuacugguaacuccccgaauccucaaggcaaugacagaaagacaaucugaguuuaccaauuucaaaaggauacggaucgccauggggacguggaacgugaauggagguaagcaguuucguuccaacguccugcgcacugcugaacuuaccgacuggcuguuggauucaccucagcucagcggcgccacagacagucaagaugacucuuccccagcagauauuuucgcugugggguuugaggagaugguugaacugagcgccggaaauaucgugaacgcgucgacuaccaauaagaaaauguggggcgagcaguuacagaaggccauuucuagaucccacagguauauccugcuaacaucagcacagcucgucggugugugucuguacauauucguacggcccuaucauguuccuuuuauucgagacguggcuaucgauaccgucaaaacggggaugggcggaaaggccggcaacaaaggggcugugggcauucgcuuccaauuucacaguacuagcuucugcuuuaucuguucccaccuuacagccggucagucucaggucaaggaaagaaacgaggacuacaaggaaaucacccagaaauugugcuucccaaugggcaggaauguguuuagccaugauuauguuuucugguguggggacuucaacuaccggauugaucugacuuacgaggagguguuuuauuucguaaagcgccaagacuggaaaaagcuccuggaauuugaccagcuucagcugcagaaaucaaguggaaagauauucaaggauuuucacgagggcgcaaucaauuucgguccgacauacaaauaugacgucggguccgccgcuuacgauaccagcgacaagugcagaacgcccgcguggaccgauaggguguugugguggcguaaaaagcauccuuuugacaaaacagcaggcgaacucaaccuguuagauucugaccuggauguugacacuaaggugcggcacaccuggucaccaggagcccuacaauauuacggccgagcugagcuccaggccagugaucauagacccguccuggcaauuguggaaguagaggugcaggagguugacgucggggccagggaacgcguguuccaggaggugagcuccuuucaaggaccucuugaugcuacagucguugugaauuugcagucuccaacucuggaagagaagaacgaguuccccgaagaccuccggaccgagcugaugcagacauuagguucguauggcaccaucgugcugguaagaauaaaucaagggcagaugcuugucacuuuugccgacagccacuccgcauugucagugcucgauguugacggaaugaaagugaagggcagggcggucaaaauucgcccgaagacgaaagauuggcugaagggucuacgagaagagaucauccggaaacgugacaguauggcuccugugucucccacagccaacagcugucugcucgaagagaauuucgauuuuaccucccuggacuacgagucagaaggggauauucuugaggacgaugaagacuacuugguugaugaguucaaccagccaggcgugagcgacucugaacugggaggcgaugacuuauccgacguaccugggcccacugcacucgccccacccaguaagagcccugcucugaccaagaaaaagcagcacccaacauauaaagaugacgccgaucuugucgagcugaagagagaguuggaagcagugggagaguucaggcaucgcucuccgucccggucacucagugugcccaauagaccuaggccaccccaaccuccacagcgacccccgccuccaaccggccugauggucaaaaagagcgcuucggacgccuccaucucuagcgguacucacgggcaguacucaauucuacagacagcgcgccugcuccccggagccccucaacagcccccaaaggcucggacgggcauaaguaaaccuuauaacguuaagcagaucaaaaccacuaaugcacaggaagccgaggcugccauuagaugccugcuugaagcaagggguggcgcguccgaggaggccuugucugcuguggcaccccgugaucuggaagccagcuccgagccagaaccgacaccuggggcugccaagcccgagaccccacaagcacccccuuuacucccacgccggcccccuccgagaguaccagccaucaaaaagcccacacugaggcgaacuggaaagccucuuucaccagaggaacaguuugagcagcaaaccgugcauuucacgaucggacccccugaaaccagcgucgaggcuccgcccgugguuacagcgccacgggugccucccgucccaaaaccucgcacuuuucagcccgggaaggccgcagaaagaccaagucacaggaaaccggcuucugacgaggccccucccggagccggcgcuuccgugccacccccucuggaggcaccaccccuaguuccuaaggugccgccacggcgaaagaaaagcgcccccgcggcuuuccaccuccagguccugcagucgaacucacaauugcugcaggguuuaaccuacaauucuagugauuccccuagcgggcaucccccagccgcaggaacaguauuuccucagggcgacuuccucucuacuagcuccgccaccucacccgauagugacgguacgaaggcuaugaaaccagaagcagccccucugcuuggcgauuaucaggacccguuuuggaaccuguugcaccaucccaagcuccugaacaauacauggcuaagcaaaucuuccgacccacuggauucagggaccagaaguccuaagcgcgaccccauugauccagugagcgcgggagcuuccgccgcaaaagccgagcuuccucccgaccacgaacauaagacucucggccacuggguuacaauaucugaucaagagaaaaggaccgcucugcaaguguucgacccguuggccaagacuuga

SEQ ID NO: 63464 - RNA, 3762 nt, Artificial Sequence
  derived and/or modified sequence opt3 from SYNM__Homo_sapiens__NP_056101
augcugagcuggagacuccagaccggccccgagaaggccgaacuucaagagcugaacgcuagguuguacgacuaugugugccggguccgcgaauuagagcgagaaaaucugcuacucgaggaggaacugcgugggagaaggggacgggagggucuuugggcagaaggccaggcccgcugugcggaggaggcuagaucccugaggcagcaguuggaugaacucucuugggccacagcacuggccgagggggaacgggacgcucugcgccgagagcucagagaauuacaaaggcuggaugcagaggagcgggccgcucguggacgccuugacgccgaauugggcgcgcagcagagagagcugcaggaagcacuaggugccagggcugcccucgaggcacugcuugggcggcugcaagcugaacgacgcggauuggaugccgcgcacgagagagacguuagggagcuccgggcccgcgcagcuucacugacuaugcauuucagagccagggcuacgggcccugccgcaccaccgccccguuuacgggaagugcacgauaguuacgcccugcucguagcugagagcuggcgagaaaccgugcagcuuuaugaggacgaagucagagagcuggaggaagcguugaggcgcggccaggagucccggcuacaggcagaagaggagacaagacugugcgcccaagaagcugaggcccucaggcgcgaagcacuggggcuugagcagcugcgagcccgguuggaagaugcucuccugcguaugagagaggaguacggaauccaggccgaagagaggcaacgcgugauugacuguuuagaagaugagaaagcaacucugacccuagcgauggcugacuggcuccgggauuaucaggaccugcuucagguuaagacagguuugucucuggaaguggccaccuacagagcacuccuggagggcgagucgaacccugaaauagucaucugggccgagcauguggaaaauaugccaucagaguuuaggaacaaaagcuaucacuacacugacagucuucugcagcgagaaaaugagcgcaacuuguucucccggcaaaaggcuccccucgccucuuuuaaucauagcuccgcacuguacucaaacuuaagugggcacagaggaagccagacaggcaccucuauugguggggaugcuaggcguggauuccugggcuccggcuauucaagcagugccacgacucagcaggaaaauucuuacgggaaagcgguauccagccaaaccaacguucgcacauuuucgccuacuuauggacuacuccggaauaccgaagcccaggugaagacauucccagacagacccaaggcuggugauaccagggaggucccuguguacaucggcgaagacucuacgauugcacgagaguccuaucgggaucgcagagacaaaguggccgcuggggccucagagaguacuaggagcaacgaacggacagucauccugggaaagaaaaccgagguuaaggcaacucgagaacaggagagaaaucgcccagaaacaauaaggaccaaaccggaggagaagauguuugauuccaaggaaaaagcgucugaggaacguaaccuucggugggaggaauugacgaagcuggacaaagaggccagacagagggagagccaacagaugaaggaaaaagcuaaggagaaagauucacccaaggaaaagagugugcgcgagcgagaaguaccuaucucccucgaggugagccaggacagacgggccgaggucucuccaaaaggccugcagacccccgugaaggaugcuggugggggcacaggaagggaagcagaggcccgcgaauuacguuucagacugggcacuucagacgcaaccgggagucuucaaggagacagcaugacagagacuguugccgagaauauugugaccuccaucuugaaacaguuuacacagucuccugaaaccgaggcuucggcggauagcuucccagacacuaaggucacguacguggaucggaaagaacuccccggugagaggaagacaaagaccgaaauuguaguugaguccaaacugacugaggacguggaugucucagacgaagccggccuagauuaucugcucaguaaggacaucaaagagguggggcugaagggaaaaucugcagaacaaaugauaggcgauauuaucaaccuugguuugaaggggcgcgagggccgagcuaaggucgugaacguugaaauuguggaggagccgguaagcuacgucuccggagaaaaaccugaggaauuuucagugcccuucaagguugaggaaguggaggacgucagcccaggcccuugggggcuggugaaagaggaagagggauacggugaaucugauguaaccuuuuccgugaaucagcacagacggacaaagcagccccaggagaacaccacucauguugaggaagucacagaggccggcgacagugaaggggagcaaagcuauuucgugucuacgccagaugaacaccccggaggccaugacagggacgaugguuccguguacgggcagauccacaucgaggaggaaucaaccauucgcuauaguuggcaggacgagauaguccagggcacuagaaggcggacacaaaaagauggagccguuggcgaaaagguggugaagccuuuagacguaccagcuccgagccucgagggggaucugggaucgacccacuggaaagaacaggcacguuccggcgaguuccaugccgagcccacagucaucgaaaaggagauuaaaaucccucacgaauuucauacuucuaugaaggguauaagcucaaaagagccacgccagcagcuuguggaaguuauugggcaacuggaggagaccuugcccgaacgaaugagagaggaacucagugcgcugacgagggagggacagggcgguccuggcuccgugucugucgacgugaagaaaguucagggggcuggaggcagcuccgugacccuaguagccgaggucaaugugucacaaacaguggaugcagaccggcuggaucucgaggagcugagcaaggacgaagccagugagauggaaaaggcugucgagucuguugugcgcgagucccuuagcagacagaggucgccagcacccgggucaccggaugaagagggaggcgccgaagcgccugcugccgguauccgguuccgaagaugggcaacucgcgaguuguacaucccaucuggggaaagugagguagccggaggcgcuucccacagcucuggucagaggacaccccagggcccugugagcgccaccgucgagguguccucacccacuggguuugcacaaagucagguucuggaagacgugagccaggcugcccggcauauuaaauuaggaccaucugaggucuggcguaccgaaagaauguccuaugagggcccuacggcggaagugguugagauggaugugucaaacgucgaggccaucaggagucgcacacaggaagcaggggcucucggaguaagcgaccggggcuccuggcgagacgccgauucuagaaaugaccaagcuguggguguuucguucaaggcaagcgccggggagggagaucaggcccacagggaacagggcaaagagcaggcuauguuugacaagaaagugcaacugcagcgcauggucgaucagcggucagugauuuccgacgagaagaagguagcgcuucuguaccuagauaacgaagaggaagagaaugacggucacugguucuga

SEQ ID NO: 63465 - RNA, 3282 nt, Artificial Sequence
  derived and/or modified sequence opt3 from SYNPO2__Homo_sapiens__NP_001122405
augggcaccggggacuucaucugcauuagcaugacaggaggugcccccuggggcuuuagacugcaagggggaaaggagcaaaaacagccucuccagguggcuaagauaaggaaccaguccaaagcaucuggcucaggucuuugugaaggggaugaggucguuaguaucaauggaaacccaugcgccgaccugacuuacccggaagugauuaaguugauggagagcaucacggauuccuuacaaaugcugauuaaacggcccucuucgggcaucucagaagcgcuaauaagcgagaaugagaacaagaaucucgaacaccugacccauggcggguauguagagaguacaacucuucagauccgcccugcuaccaagacacaguguaccgaguucuuucuggccccagugaaaacugagguccccuuggcagagaaccagcgauccggaccugacugcgccgguucucucaaggaagagacaggcccaagcuaccaacgugcuccccagaugccugauucccagagagggaggguggcagaagaacugauucugcgggaaaaaguugaggccgugcagccaggaccggucguggagcuccaauuaucacugagucaggaacgccacaagggcgcuagcgguccccuuguagccuugccuggggcggagaaaucuaaguccccagaccccgauccuaaucugucacaugacagaaucguucacauuaacagcaucccaaccaaugaaaaggcagaucccuuccuaaggaguucuaaaauaauucagaucuccagcggacgggagcuccgcgugauucaagaaucggaggccggcgacgcuggccugccgcgagucgaggugauccuugauuguucugacagacagaagacggaagggugcaggcugcaggccggaaaagaguguguggauuccccugucgaagguggccagucagaggcacccccaaguuugguuagcuuugcuguguccucugaagggacugagcaaggagaggacccucggagcgaaaaggaccauucacguccccacaaacaccgcgccagacaugcgaggcuccggcgaagugagucccugagcgaaaagcagguaaaagaggccaagucuaagugcaaaucaaucgcauuacugcucaccgaugcuccaaaccccaauaguaagggcgugcuuauguucaaaaagcgcagaaggcgggcccgcaaauauacacuggucagcuacgguacuggggaguuggaaagagaggcugacgaagaggaagagggcgauaaggaggacaccugugaaguggccuuucuaggagcauccgagucugaaguugaugaggaacugcucucggacguggaugacaacacacaggucgugaauuucgauugggacagcggccugguagauauugagaagaaacuuaaccgcggggacaagauggagaugcugccugacaccacgggaaaaggugccuugauguuugcuaagcgucgggaacgaauggaucagauaacugcgcaaaaagaggaagacaagguuggcgggacaccauccagagagcaggaugcagcccagaccgacggacucaggacuacaaccucauaucagcgcaaggaagaggagagugugcggacgcaaucuagcgucuccaaaucauacaucgaagugagccacggccugggucaugucccgcagcagaauggguucucuggcaccuccgagacagcuaacauucagagaauggugcccaugaacaggacugccaagccuuuuccaggaaguguuaaucaacccgcaaccccuuucagcccaacacgcaacaugacuucucccaucgccgauuuuccggcuccuccacccuauuccgccgugaccccucccccagacgcauucucacgaggcguaaguagcccuauagcggggcccgcucagccaccgccuuggccccagccagcccccuggucgcaaccugcauucuacgauuccucugaacggauugccagccgugacgagagaaucucagucccagcuaaaaggacaggaaucuuacaggaggccaagcgccggaguaccacuaaacccauguuuacguucaaggaaccuaagguguccccgaauccagagcugcuaucucuccugcagaacagcgaagguaaaagaggcacaggggcaggaggcgauuccggucccgaggaagacuaccuuucauugggggcugaggccugcaauuuuaugcagagcaguucugcgaagcagaaaaccccuccacccguugccccuaagccggcugugaaauccagcucgucacagcccgucacuccagugucuccuguauggagucccggcguggcaccaacccagccucccgccuucccaacauccaacccgagcaagggaaccguugucucuagcauuaaaaucgcucagccuuccuaucccccagccaggcccgcaucaacucugaauguggcgggcccuuuuaaggggccacaagccgcuguggccagucagaacuacacacccaagccuacggucagcaccccgacuguuaaugcagugcagccaggagcugugggccccucuaacgagcucccugguauguccgggcgaggagcccagcuguucgcaaaacgccaaucacggauggaaaaguauguagucgauagugacacagugcaggcccacgcugcgagagcccagagccccaccccaucccuuccugcaucuuggaaauacucgagcaauguuagggcucccccaccuguggccuauaacccgauucacucacccuccuacccacuggccgcuuugaagagucaaccuucugcagcccagcccagcaaaaugggcaagaagaaagguaagaaaccacucaaugcgcuggaugucaugaagcaucagccuuaucaguuaaacgcuucccuguuuacauuccaacccccggacgccaaagacggccuaccacagaagucaucugugaagguuaauagcgcacucgccaugaaacaggcucugccuccccguccagugaacgcagccagucccacuaacguacaggcguccagcgucuacucugugccugcuuacaccucaccgcccuccuuuuucgccgaggcaaguagcccagugucggccucuccuguccccguugggauaccuacguccccaaagcaagaaagcgcuucaaguucuuauuuuguggcccccaggccuaaauucuccgcaaagaaaagcggaguaaccauccagguguggaagccaucagucguggaggaauga

SEQ ID NO: 63466 - RNA, 2058 nt, Artificial Sequence
  derived and/or modified sequence opt3 from SYNPO__Homo_sapiens__NP_001103444
auggagggcuacagcgaagaggccucccugcucagacaccuugaaaagguggcuucugaggaagaggaggucccccugguuguguauuugaaagaaaacgcagccuuacugaccgcgaaugggcuacaucucucacagaacagggaggcucaacagaguagcccugccccaccgcccgcagaaguacacuccccugccgcugacgugaaucagaaccuggcaucuccaucggccacacuuacuacgcccaccucaaauagcagucauaacccuccagcuacagaugucaaucagaaucccccugccacugugguuccacaaucccugccguugucuagcauccagcagaacuccucagaggcgcagcuccccaguaacggaaccgguccugcaagcaagccaucuacacugugcgccgacggccaaccccaggcuccugccgaggaagugcgguguuccacccugcucauugauaaagucucaacuccagcaacaaccacgagcacuuucagucgcgaggcuaccuuaauacccucuucccgaccgccugccagcgacuuuaugucgucuucccugcuuaucgauauucagcccaauacauuggugguaucagcggaccaggaaaugagugggcgugccgcagcuacuaccccaacaaagguuuacagcgaggugcacuucacccuggccaaaccucccuccgucgugaacagaacggcuaggccauuuggaauccaagcccccggcgguacuucucagauggaacggagcccuaugcuagagcgcagacauuucggggagaaggcaccagccccgcagcccccuucacucccagauaggaguccccggccucaacgccacauuaugucccgaagcccaaugguggaaagaaggaugaugggacagcggucucccgcuucagagcgucgcccgcugggcaauuuuacagcgccuccaaccuauacugaaacacuuaguaccgcaccccuggccagcugggucagauccccucccucuuacucgguuuuguauccaagcuccgacccuaagucaagucaccucaaaggccaggcugugcccgccucuaagacggggauccuggaggaaagcauggcaaggcggggaucccgaaaaucaauguucaccuuuguagagaagccaaaagugacaccgaacccugauuuacuggaccucguccagacugccgaugagaagcgcagacaaagggaccagggugaagugggcguugaggaggaacccuucgcucuuggggccgaagcaagcaauuuucagcaggagccagcgccccgggaucgcgcuucuccugccgcagccgaggaaguggucccagagugggcuuccugccugaagagucccagaauacaagccaaaccuaagccgaaaccaaaccagaacuugagcgaagcaucuggaaagggcgcugagcuauacgccaggcgucagucccggauggagaaauaugugaucgaaucaaguagccauacccccgagcuggcgcgauguccuucgccaacaaugucccuccccucuagcuggaaguacccuacuaaugccccgggugcuuucagaguagcaucaaggagucccgcccgcaccccuccagcuucccuguaccacggguaucuucccgaaaacggaguucugcggccagagccuacaaaacagcccccauaccaauugagaccgucucucuuugugcugagcccuauuaaggaacccgccaaggucuccccaagggcagcgucacccgccaaaccuagcaguuuagaccuggugccaaaucuacccaagggcgcucucccuccgucuccagcccugccccgcccuucccgaagcucgcccggccuuuauaccucaccagggcaggacucuuugcagccuacugcagucagucccccauacggaggugauaucuccccugugagcccgucucgggcuuggagcccccgugccaaacaggcaccaagaccuuccuucucaacgaggaacgccggcauugaggcucaaguuuggaagcccaguuuuugcuucaaauga

SEQ ID NO: 63467 - RNA, 858 nt, Artificial Sequence
  derived and/or modified sequence opt3 from SYNPR__Homo_sapiens__NP_001123475
auggaccccgugagccagcuggccuccgcuggcaccuucagaguccucaaggagccucuugcauuucugagggccuuggaauuacuguucgcgaucuuugcuuucgccacaugcgggggauacucugguggccuacggcucucaguugauugugugaacaaaacugagaguaaucugagcauugacauagcauuugccuauccauuccgccuucaccaaguaacguuugaagugccgaccugcgaggggaaggaacgacagaaacuggcuuugaucggagauuccucuucgucagcagaguucuuugucacaguggccguuuucgcuuuucucuacagccuggccgcgacuguggucuauauuuucuuucagaacaaguaccgugagaauaacagaggcccccugaucgacuucauugugaccguaguuuucaguuuucucugguuaguggguuccucugcaugggccaaagggcugagcgaugucaagguggcuacagacccuaaggaagugcuuuugcugauguccgccuguaaacagccaucaaauaagugcauggcaauccauagucccgucaugagcucucuaaacaccuccguuguguucggauuucucaauuucauacugugggcuggcaacaucugguuuguauucaaagagacuggcuggcacucaagcgggcaaagguaucuuagugauccuauggaaaagcauucuuccagcuacaaucagggagguuauaaccaggacucguacgggucuuccucaggcuacagucagcaagccagccugggaccaacauccgaugaguuuggccagcagcccaccgguccuacgucuuucacuaaucagauuuga

SEQ ID NO: 63468 - RNA, 942 nt, Artificial Sequence
  derived and/or modified sequence opt3 from SYP__Homo_sapiens__NP_003170
augcugcuccuugccgacauggauguggucaaccagcugguugcuggcgggcaauucagagugguaaaggagcccuugggauuugugaaagucuuacaguggguguucgcaaucuuugccuucgcgaccugcgguagcuacuccggcgaacugcagcuaucuguugacugugcuaauaagacagagucagaucucaguauugaaguggaguuugaauauccuuucaggcugcaccaggucuacuuugacgccccaacuugccgcgggggaacgaccaaaguguuccuuguaggcgauuauagcuccucugcagaguuuuucguuacaguggccgucuuugcuuuccuguacucgaugggugcauuggccacuuauauauuucuccaaaacaaguaccgggagaauaacaaagggccgaugcuggacuuccuggcuaccgccguguucgcguuuauguggcucgugucaagcagugcaugggccaagggauuauccgaugucaagauggcuacagaccccgaaaauaucauuaaagagaugccuguuugucgacagaccggcaacacuugcaaggaacugcgugauccagugacaucuggccuuaauaccagcguaguguucggguuuuugaaccugguccuaugggugggaaaucucugguucguuuuuaaagagacggguugggccgcacccuuccugagagcuccuccaggcgcccccgagaagcagccugcgccaggggacgccuauggagaugcaggcuacggucaggggccgggaggcuacggcccccaagacuccuaugggccucagggagguuaccagccagauuauggccagcccgcugggucaggaggcagugguuacgggccucaaggcgacuauggacagcagggcuacgggccacaaggagcccccacuagcuuuucuaaccagauguga

SEQ ID NO: 63469 - RNA, 780 nt, Artificial Sequence
  derived and/or modified sequence opt3 from SYPL1__Homo_sapiens__NP_006745
auggcccccaacaucuaccuggugagacagaggauuagccggcucggccaacgcauguccggguuccagauaaaucuuaacccucugaaggagccauugggauuuaucaaagucuuagaauggauugcuucuaucuucgcauuugcgaccugcgguggcuucaaggggcagacagagauucagguuaauuguccgcccgccgugacugaaaacaaaacgguaaccgcuacauuuggauauccuuuccgacugaaugaggccucauuucaaccacccccuggcgugaacaucugcgacgucaauuggaaggauuacgugcuaauaggugacuauaguagcuccgcacaguucuacguuacuuuugccguguucgucuuucucuauuguaucgcugcacugcuucuguacgugggguauaccucuuuguaccucgauucgcguaaacugccaaugauugacuucguaguuacacugguggccaccuuucucugguuagucucaacuagcgcuugggccaaggcgcugacagauaucaagauugcaaccggacacaacaucauagacgaacuucccccuugcaaaaagaaagccguguuguguuacuucggcagugugacguccaugggcucucugaaugucagcguuauuuucggguuucuaaacaugauccucuggggagguaaugcuugguucguguauaaggagacuucccugcauucaccaaguaacaccagcgccccgcacucucagggcgggauucccccuccaacaggaaucuga

SEQ ID NO: 63470 - RNA, 831 nt, Artificial Sequence
  derived and/or modified sequence opt3 from SYPL2__Homo_sapiens__XP_011539585
augagcuccaccgagucugccggcagaacagcugacaagucacccaggcagcaaguggaucggcugcucgucgggcuucgcuggcgacgucuggaggaaccuuugggauucaucaaaguuuuacaguggcuguuugcaauuuucgccuuugguaguugcggcagcuacuccggggaaacuggagcgauggugagauguaacaaugaggcuaaggacguaucuucgauaaucguggccuucggcuauccauuuaggcuacaccggauucaguacgaaaugccgcucugcgaugaggagucaagcaguaaaacgaugcaucugaugggugacuucuccgcacccgccgaauuuuucgucacccuugggaucuuuucuuucuuuuauacaauggcugcacuggugauuuacuugcgcuuccacaaccucuauacugagaauaagagauuuccucugguugauuucugugugaccgucagcuucacauuuuucuggcugguggccgcugccgcguggggaaaaggccucaccgacguaaagggcgcaacuaggccauccucauuaacagccgcuaugaguguuugccauggggaagaggccguguguagcgcaggagcuacccccucuaugggucuggccaacaucuccguccuuuuuggcuucauaaacuuuuucuugugggcggggaauugcugguuuguguucaaggagacgccuuggcacggacagggccaaggucaggaucaggaccaggaucaagaccaggggcagggaccaucacaggaaagcgccgcagagcaaggcgcuguggaaaaacagauccaucacgucuga

SEQ ID NO: 63471 - RNA, 1296 nt, Artificial Sequence
  derived and/or modified sequence opt3 from SYT11__Homo_sapiens__NP_689493
auggccgagaucaccaacauuagacccagcuucgacguguccccugucguugcuggccugauaggggcaucugugcucguagugugcgucucagugacaguuuuuguguggaguuguugccaccagcaagccgaaaagaaacagaagaauccaccguacaaauucauccauaugcuuaagggaauuagcaucuaucccgagacucuguccaacaaaaagaagauuaucaaagucaggcgggauaaggacgguccuggccgcgaagggggacgacguaauuuguuaguggaugcggcugaggccggccugcuaucuagagacaaagauccaaggggucccucgucagggagcuguauagaccagcucccuaucaagauggauuacggagaggaacugcggaguccaauuacgucccuuacccccggcgagucuaaaacaacuagcccuuccucaccagaagaggacguaaugcugggcaguuugaccuuuagcguugauuauaacuucccgaagaaggcacucguggucacaauccaggaagcccacgggcugcccgugauggacgaucaaacccagggaucugacccuuacauuaaaaugacuauccugccagauaagcgccauagagugaaaacaaggguccuccggaagaccuuagaccccguuuuugacgagacguucacuuuuuaugguauaccuuacucccagcugcaggaucuuguguugcacuuccugguacuaucauuugaccgcuucagccgagaugacgugauuggcgaggucauggugccacucgcugggguugaucccaguaccggaaaagugcaacugacaagagacaucauuaagaggaauauccagaaaugcaucucucggggcgaacuucaggucucccugagcuaucagccgguggcacaacguaugacuguaguuguguugaaggcccgccaucucccuaagauggauauuaccggucugucggggaaccccuacgucaaagugaaugucuacuauggaagaaagaggauagcuaaaaagaaaacacacgugaagaaguguaccuuaaacccaaucuuuaaugagucuuucauuuacgacaucccuacggaucugcuccccgacauauccauugaauuucuuguuaucgauuucgaccggacuaccaaaaacgaggugguaggccgacugaucuugggcgcccacucagucacagcgaguggggcagaacauuggcgcgaggugugcgagagcccaagaaagcccguugccaaauggcacucccuaucugaauauuga

SEQ ID NO: 63472 - RNA, 1266 nt, Artificial Sequence
  derived and/or modified sequence opt3 from SYT12__Homo_sapiens__NP_001171351
auggccguggacgucgcugaguaccaccugagcguuaucaagucucccccuggcugggaaguggggguauaugcagccggagcgcucgcacuucuggguauugccgcagugucuuuguggaaauuauggaccucaggcaguuucccaagcccgucccccuuuccuaacuacgauuauagauaccugcagcaaaaguauggggagucuugcgccgaagcuagggagaaacgggucccagcauggaaugcccagcgcgcuucgacacgaggacccccuucacguaagggcagccuaaguauagaagacacuuucgaguccaucucugagcucgguccacuggaacuuauggggagagagcuggauuuggcccccuacggaacgcucaggaaaagccaguccgcggacucacugaacaguauuagcucuguguccaauaccuuuggccaggauuucacacugggccaaguugaagugucaauggaguaugacacugcaagccauacccucaacgucgccgugaugcaggggaaggauuuacuggagcgggaagaggcuaguuuugaaucuuguuucaugcgcguaucccuuuugccugacgagcagaucguuggaauuagcagaauccagaggaaugccuacucgauauuuuucgaugaaaaguuuucuaucccacuggacccgacagcacuagaggagaaaucccuccgguucucaguguuugguauugaugaagacgagcgcaacgucaguaccggcgugguggaacugaaacuuagcguccuggauuugccccuccaaccuuucuccggguggcuguacuuacaggaccagaauaaggcugccgacgcgguuggagagauccugcucucucuuagcuaucugccaacugccgaacgauugacagugguaguggucaaggcuaaaaaccuaauuuggaccaaugauaagacgacugcugaccccuuugugaagguuuaccugcuccaggauggcagaaaaaugucaaagaaaaagaccgccgugaaaagggacgauccuaacccagucuucaaugaggcuaugaucuucagugugcccgccauaguacugcaagaccuuucccugcggguuacaguggcagagagcuccucagauggucguggggacaacgucggacacgugauuaucggcccgagugccagcggcauggggacuacccauuggaaucagauguuggcuacacuccgcagaccugucuccauguggcacgcggugaggcggaacuga

SEQ ID NO: 63473 - RNA, 1281 nt, Artificial Sequence
  derived and/or modified sequence opt3 from SYT13__Homo_sapiens__NP_065877
auggugcugagcguccccguuaucgcccucggcgcuacccuugggacagcaacuuccauucuggccuugugcggagugacguguuuaugcagacacaugcauccuaagaaaggucugcuaccaagggaccaggauccggaccucgagaaggcgaaacccucucugcuuggcucagcucaacaguucaacguaaagaaaaguaccgaaccugugcagccacgggcccuguugaaguuucccgauauauacgggccucgcccagcagucacagcccccgaggugaucaauuaugcugacuacagccuccgauccacugaagaaccuaccgcaccagccucuccgcagcccccuaacgauucgcgucugaagagacaaguuacagaggagcuguucauucucccacagaauggaguggucgaggacguguguguaauggaaaccuggaaccccgagaaagcugccucauggaaucaggcgccuaaguuacacuauugccuggauuacgacugucagaaagcagaacuuuuuguuacuagguuggaggccgugacaagcaaccaugauggcgguugcgacuguuauguccaagggaguguggcuaaucggaccggauccguggaggcccagacggcacugaagaaacgccagcuacacacuaccugggaagagggccucguccugccacuugcugaagaggaacugcccacagccacuuugacccucacacugagaaccugcgauagguucucucggcauagcguugcgggcgaguuacgccuggggcucgacggaacguccgugccgcuuggugccgcacaguggggcgagcugaagacuucagcuaaggaaccuagugccggggcuggagagguauugcuaagcaucucuuaccugcccgccgcaaaccgacuccuggugguccuuauuaaagccaagaaucugcacuccaaccaaucaaaagaauugcucggcaaggaugugagcguuaaagugacacugaagcaccaggcuagaaaauuaaagaagaaacagaccaagagggcgaaacauaagaucaauccagucuggaacgagaugauaauguuugaacugccugacgaccuacuccaagcaaguucuguggagcuggagguacuuggucaggaugacuccgggcagagcugugccuugggacacugcucgcugggccuccauacuucuggcuccgaacggucacacugggaggaaaugcugaaaaauccccgucgccagaucgcuauguggcaccaacuucaucuguga

SEQ ID NO: 63474 - RNA, 1860 nt, Artificial Sequence
  derived and/or modified sequence opt3 from SYT14__Homo_sapiens__NP_001139733
auggcuagcgcuuccuggagacugaagguggagagggaacccgucgaguacaugaaccucucuguucuugaaaagaucggcuauuucucaguggcacggcuggaguacagugggaccauuuuggcccacugcaauuuucgcuuacugggaagcaacgacuccucugcgucggcuucacagguaacagguacuacggugagcccugaagccgucggcuuccuaagugcaguggggguuuuuauaauccucaugcugcuucuguucuuguauauuaauaagaaauuuuguuucgagaacgugggaggcuuuccagaucucgguuccgaguacucuacccgaaagaauagccaagacaaaaucuauaacuccuacauggauaaggacgaacaugggucaaguagcgagucugaagaugaggcccugggaaaguaucacgaggcucugucccguacacauaauucaagacucccguuagcagacagcaggcagcggaacuacgccugggaaacucgccagaaauacaguccccugucugcugaguaugauggcuacuccagcgaagccucgauugacgagggcaauugcauccagagaaugaggcggaccccuccacuugaugaauugcaacccccuccauaucaggacgauucugggagcccccaccugucauguacaccuagugagauaggagacagcaagugcgaguucucccauuguucuaacagcccacgcugcucauacaauaaauguccgagugaagguuccaccggccacgagaucgaauccuuucacaacaagggguaugaggaagauguccccucugacucaacugcggugcuaaguccugaggacaugagcgcacagggauccucuucgcagcucccaaaacccuucgauccugagccagaagccaaguacggcacacuggacguaaccuuugauuaugacagccaagagcagaaacuucugguuacggugacugcugucaccgauauucccacauacaaucgaacuggugggaacuccuggcaagugcauuuggugcuccugccgaucaaaaagcagagagccaaaaccucaauucagaggggaccuugccccgucuucacagaaaccuuuaaguucaaucacguugagagugaaaugaucggcaacuacgcagugcgguuccguuuauauggcguacaucgcaugaaaaaggagaaaauagugggggagaagaucuuuuaccugacgaagcucaaccuucagggaaaaaugucucugccagucauuuuggaaccuagcuauaaucacuccgguugugacucacagaugagcgugucugagauguccugcagugaaagcacuucuuccugucaaucacuagagcacggcaguguucccgagauucugaucgggcuccuguacaacgcuacaaccggaagacuuagcgccgaagugaucaagggcucgcauuucaaaaaucuggcggccaacaggccacccaaugguuuguuuugcugccucaagcaccugauugggggccaggucuauauaauccgggauacuuacgugaaauuaacacugcuaaacuccaugggacaggagaugucuaaguguaagaccagcauucgacgcggccagccuaauccaguauauaaagaaacguucguuuuucaaguggcacucuuccagcugucagacgucacccuuaucuugaguguguacaacaagagauccaugaaaaggaaggagaugauaggguggauuucucugggacucaauagcuccggugaagaggagcugaaccauuggacagaaaugaaagagucaaagggccagcaggucugccgguggcacgcccuucuggaaagcuga

SEQ ID NO: 63475 - RNA, 1260 nt, Artificial Sequence
  derived and/or modified sequence opt3 from SYT1__Homo_sapiens__NP_001278830
auggugagcgagucccaccaugaagcccuggcugcacccccugucaccacaguugccacugugcucccaucuaacgcgacggagccggcuucacccggcgaagggaaggaggacgccuucaguaaacuuaaggaaaaauuuaugaaugagcugcacaagaucccuuugccacccugggcauuaauugccauagcuaucguagcagugcugcuaguccugaccugcuguuucugcauuuguaaaaagugccucuuuaagaaaaagaacaaaaagaaaggaaaggagaaggguggcaaaaaugccaucaacaugaaggaugugaaagaccuugggaagacaaugaaagaucaggacgaugacgcugaaacuggacugaccgauggcgaggaaaaggaggagccuaaagaagaggaaaaguuggguaagcuccaauacagccuggacuaugauuuccagaauaaccagcugcucguugggauuauccaggccgcggaguuaccagcacuggacaugggaggcacauccgaucccuacgugaaagucuuucuuuugccugacaagaaaaagaaauucgaaaccaaggugcauagaaagacucugaauccaguauuuaacgagcaauucacauuuaaaguuccguauucugagcuaggcgggaagacccucgugauggccgucuacgauuucgacagguuuucgaaacacgacauaaucggagaguucaaggugcccaugaauacgguggauuuuggucaugucacugaggaauggcgggaccugcagucagcugagaaagaagaacaggagaaacuuggcgauauuuguuucagccugcgcuauguuccuaccgccgggaaguugacagugguaauccucgaagcaaagaaccugaagaaaauggacgugggaggcuuaagugauccauacgucaagauucaccugaugcagaaugguaaacgacucaagaagaaaaagacuaccaucaaaaagaacacacuuaaucccuauuacaacgaguccuucucuuuugaagugccuuucgagcaaauacagaaaguucagguggucgugaccguacuggacuacgauaagauugggaaaaaugacgcuaucggaaagguuuuugugggcuauaacagcacgggcgccgaauugcgucacugguccgauaugcuagcgaacccaagaaggcccauugcccaguggcauacucugcaagucgaggaggaaguggacgcaaugcucgcugucaagaaauga

SEQ ID NO: 63476 - RNA, 1278 nt, Artificial Sequence
  derived and/or modified sequence opt3 from SYT4__Homo_sapiens__NP_065834
auggcccccaucaccacaagcagagaggaguucgacgaaauuccuacuguggucggcauauuuuccgcuuucgggcugguuuuuacggugucucucuucgcauggaucugcugucagaggaagucaaguaaaagcaacaagaccccaccguacaaauuuguacacgugcuuaagggagucgauauuuaucccgaaaaucugaacuccaaaaagaaguucggugccgacgauaaaaaugaggugaagaacaaaccugcgguuccaaagaacucuuugcauuuagaccuggaaaaacgggaucuaaauggcaauuuucccaagacaaaccucaagccugggucgccaucagaccuggagaaugcuacucccaaacuuuuccuggagggagaaaaggagagcgugaguccugaauccuugaaaucuagcaccucccucacaucagaggagaagcaagaaaaacugggcacccuguuuuucagucucgaguacaacuuugaacgcaaggccuucgucgugaauaucaaagaggcacgagguuuaccagccauggaugaacagagcaugacuucugacccguauauuaagaugacaauccugcccgagaagaaacacaagguaaaaacccguguucuuagaaagacguuggauccugcuuuugacgagacuuucaccuucuacgggauaccauauacacagauccaggaacuggcacuacauuuuacuauucucuccuucgauagguuuucacgggacgauaucauuggagaggugcugaucccccuuagcggcauagaacugagugagggcaaaauguugaugaaccgcgaaauuaucaagagaaaugucaggaagucuuccgggcggggagagcuccugauuagcuuaugcuaccaaucgaccacaaacacccugacgguggugguccucaaagcccgccaccuuccuaagucugacguuuccggucugucagacccauaugugaaaguaaauuuguaccaugcuaagaaacgaaucaguaagaagaaaacucacgugaagaaauguacacccaacgccgucuucaacgagcuauuuguguucgauaucccgugcgaaggccuggaggacauuagcguugaauuucucgugcuggauuccgagagagggucuaggaaugaagucauaggacagcuugugcugggcgcggcagccgaggguaccgggggagagcacuggaaggaaaucugugacuacccucggcgucagauugcuaaauggcauguauugugcgauggcuga

SEQ ID NO: 63477 - RNA, 900 nt, Artificial Sequence
  derived and/or modified sequence opt3 from SYT6__Homo_sapiens__XP_011539054
augcccuggagaaacaaggaggccagcuccccuucuucagcuaauccaccgcuggaagcacuccagagucccagcuucaggggcaacauggccgacaaacuuaaggauccuuccacccugggguuuuuggaggcggcugugaaaaucucucacacaucgccagacauucccgccgaaguccaaaugucaguuaaggagcauauaaugcggcacacucgcuuacagcgacagacgaccgaaccugcaagcaguacacgucauacuuccuucaaaagacaucugccaaggcagaugcacgugucuagcguagauuacggaaaugagcuacccccugccgcugagcaaccaaccuccaucggucggauuaagccggaacucuauaagcagaaaucaguggacggcgaggaugcaaagagugaagccacaaaaagcugcgggaagaucaacuuuucucugcgcuacgacuaugagaccgagacucuuauugucagaauccugaaggcuuucgauuugcccgccaaagacuuuuguggauccucagauccuuacgugaagauauaucuccugccagacaggaaaugcaagcugcagacacggguucaccgcaaaacccucaaucccacguucgaugaaaacuuucacuucccugugccauacgaggaauuagcggaccgaaagcugcaucuuagcgucuuugauuucgacagauuuaguaggcacgacaugaucggcgaggugauuuuggauaaucuguucgaagcaucugaccuaucccgggagacuagcaucuggaaagauauucaguaugccaccucgcucgacuggggucuguguucuacacuucugcccggggauccgucccaacagcguuugcaucucgacacuggaccucacucauga

SEQ ID NO: 63478 - RNA, 1476 nt, Artificial Sequence
  derived and/or modified sequence opt3 from SYT9__Homo_sapiens__NP_783860
augcccggcgccagagacgcucugugccaccaggcacuccaacuucuggccgaguugugugcgaggggagcuuuagaacaugauagcugccaggacuucaucuaccaccuucgggaucgcgcccgaccucgucuaagagacccagauauuuccgugucucuccugacccuugucguuacagcauguggacuggccuuguuuggugugucacucuucguaaguuggaagcugugcugggugccguggagggagcggggccugcccagcggguccaaagacaacaaucaggaaccucucaacuauauggauacugagacgaaugaacaggagaacucugaggacuuuuuagauccacccaccccuuguccagacucgucaaugaagauaagccauacaagucccgauaucccucuguccacucaaaccgggauucaggaaaauugcgcucacggcguccgcgugcagagacagguuacagagccaaccucuagcgcaaggcauaacuccauccggcgccaacuuaauuugucaaacccggacuucaauauucagcagcugcagaaacaagaacagcuaacugguaucgggcgaauaaagcccgagcucuacaaacagagaagucuggauaacgacgacggaaggcggagcaauucuaaggccuguggcaagcugaacuuuauccugaaauaugauugcgacuuggagcaacucauugugaagauccacaaagcugucaaucugccugccaaggauuucuccggcacaucagacccauacgugaaaauuuauuuacugcccgaucguaagaccaagcaccagacgaaaguacaucgcaagacucucaacccuguuuuugacgaaguguuccuuuuuccaguccccuacaaugaucuggaggcgagaaaauugcacuucagcguguaugacuuugauagguucagucggcaugaccuaaucggacagguggucguugaucacuuucuggaccucgcagacuucccgcgagaauguauacuguggaaggauauugaguacgugaccaacgacaacguagaucuuggggaacugauguucucuuugugcuaccucccuacagccggucgccugacuaucaccauuaucaaagcuagaaauuuaaaggccauggacaucacaggcgcauccgaucccuaugugaaagucagccugaugugugacgggaggcggcuaaagaagcgcaaaaccucgacgaagagaaacacucucaauccaguguacaacgaggcuauuguuuuugaugugccucccgagaauauagaccagauccaccugucuauugccgucauggauuaugacagggugggacauaacgaaaucauaggcguaugccaaguugguaaugaggcggaacgucuugggcgggaucacugguccgagauguugucauacccacgaaaacccauugcccauuggcacagucugguggaaaagagauga

SEQ ID NO: 63479 - RNA, 954 nt, Artificial Sequence
  derived and/or modified sequence opt3 from SYTL1__Homo_sapiens__XP_011540618
augagaccccugaggcggggcagcgggcgccuccgacuucagauccugcguagaaggccucggccacgcaagauuuuggccaaagagaccaacagauccgugccgaggcgguuaacacgcucuuggucaccccgaagaggagaaaguaggagccgggguccuuccaagccaucuuacgucaaaucguaucugcuacccgacaagcaaucaaaacguaagacugcuguuaagaaacgcaaucucaacccuguguucaaugagacgcugagauacagcguaccacaggcagaacuucagggcagggugcugaguuuguccgucuggcaccgggagucucucgggcgaaacauauuucugggagaaguggagguuccccuggauaccugggacuggggcagcgagccuacauggcucccauuacagccgcgcgugcccccuuccccagaugaccugcccucaagaggucuuuuggcccugagucuaaaguaugucccugcggggagcgaaggagcuggccucccacccucuggcgagcugcauuucugggugaaagaagccagggaucuucugccguugcgggcagggucccucgacacuuacguacaaugcuuuguucugccugaugacucacaggccagccgccagagaaccagggugguccgucggaguuuaucucccguguucaaucacacaaugguguaugauggauuugguccagcugaccugcgacaggcaugugccgagcucucccuuugggaucauggcgcucuggccaacagacaacuagggggaaccagguugagccugggcacugguucgucuuacgggcuccaggucccuuggauggacuccacacccgaggaaaagcagcuguggcaggcgcuucuggagcaaccaugcgaauggguugauggauugcucccccugcgcaccaauuuagcaccucggacguga

SEQ ID NO: 63480 - RNA, 2805 nt, Artificial Sequence
  derived and/or modified sequence opt3 from SYTL2__Homo_sapiens__NP_001156423
augaucgaccugagcuuccucaccgaggaagaacaggaagccauuaugaaggugcuucaaagagaugcugcacugaaaagggccgaggaggagcggguccgccacuugcccgagaagauaaaagacgaucagcaguuaaagaacauguccggccagugguuuuacgaagcgaaagcuaagcgacaucgugacaagauccacggggccgauauuaucagagcaucuaugaggaaaaagcggccucaaauugccgcugagcagucaaaagaccgcgaaaauggagcaaaggagaguuggguuaacaaugugaacaaagaugccuuccugccaccggagcuagcugguguaguggaggaacccgaagaggacgccgcgccugcaagcccauccucuucggucgugaaucccgccucaagcguuaucgauaugagucaggaaaacacaagaaagccuaauguguccccagagaagaggaaaaaccccuuuaauucuagcaagcucccugagggccauuccucacagcaaacuaaaaacgaacagaguaagaaugggcggacgggacuguuccagaccagcaaagaggacgaacuuucugaguccaaggaaaaaucaacagucgcugauacuagcauacagaagcuggagaagaguaaacaaaccuugccaggccucucuaacgguucccagaucaaggccccgauucccaaagcacgcaagaugaucuauaaaagcacagaccugaauaaggaugacaaccagucguuuccucgacaaagaaccgacucucugaaggcuaggggagccccacgggggauucucaaacguaauuccucaaguagcuccacugauucugagacauuacgcuacaaccacaacuucgaacccaagagcaaaaucgugucaccuggccugaccauacaugagagaauuagugaaaaggagcacucccuugaagacaauagcucuccaaacucauuggagccccugaaacacguaagguuuagugcgguuaaggaugagcuaccgcagagcccuggccucauccaugggcgggaagugggagaguucuccguccuggaaucugaccgacuuaagaaugguauggaggaugccggcgacacggaggaauuucagucggaucccaaaccaagccaguaucgcaagccuucccuguuccaccaaucaacuucgucucccuacgugagcaaauccgagacccaucagccaaugacaucagggagcuuucccauuaacggauugcacucucacuccgaagugcucacugcaagaccucagaguauggagaauagcccaaccaucaacgaaccgaaggacaaaucuuccgagcugacaagguuagagucaguccugccccggaguccugcugaugaacucagccauugcguugagccagaacccagucaggugccuggcgguuccucucgcgacagacaacaggggagcgaggaggaaccaucacccguacuuaagacccuggagaggagugccgcucguaagaugccguccaaaucuuuggaagauaucagcuccgacucaagcaaucaggccaagguggacaaccagccugaggagcuaguccggagugcagaagaugugucuacgguuccaacucaacccgacaauccuuucucccaccccgauaaacugaagcgaaugagcaaaucggugccagccuuucuccaggacgaaucagaugacagagagacagauaccgcuucugagaguuccuaucagcugagcaggcauaagaaaucuccuagcucccuuacuaaccugucaaguagcucuggaaugacauccuugucaagugucagcggcuccgugaugucuguauacucgggcgacuucgggaaucucgaaguuaagggaaacauucaguucgcgauagaguauguggaaagccugaaggaguuacacgucuuuguggcacaauguaaagaucuggccgcugccgacgucaagaaacagcgcucagaucccuacgugaaggcauaccuacucccagacaaagguaagaugggcaagaaaaagacccugguugugaaaaagacgcuuaauccgguauauaacgagaucuugcgguacaaaauugaaaagcagauccugaagacccaaaaacucaaucuguccauauggcauagagauacauucaagaggaacaguuuucuuggggaggucgaacuggacuuggagacuugggacugggauaacaaacagaauaagcagcuccgcugguauccucugaaacgaaagaccgcccccguggcuuuagaagccgagaaccggggagagaugaagcuggcacuacaguacguuccagaacccgugccuggcaaaaagcucccaacaacuggugagguccacauuugggugaaagaaugccuggaccuucccuugcugcgugggucucaccucaauagcuucguaaaguguaccauccugccugauacauccagaaaaucaaggcaaaagacccgcgcggugggcaaaacuacgaacccgaucuuuaaucauacaaugguuuaugacggauuccggccagaggauuuaauggaggcuugcgucgaacugaccgugugggaccacuacaaacuuacuaaccaguuuuugggcgggcucagaauuggauucgguaccggcaagucuuaugggacagagguggauuggauggacagcaccagugaagaggucgcccugugggaaaagaugguuaauucccccaacacuuggaucgaggcaacacuaccucugaggaugcuccugauugccaagauaagcaaauga

SEQ ID NO: 63481 - RNA, 2259 nt, Artificial Sequence
  derived and/or modified sequence opt3 from SYTL5__Homo_sapiens__NP_001156806
augagcaagaacuccgaguucaucaaucugucuuuucuccuugaccacgaaaaagagaugauucugggcguguugaagagagaugaauacuuaaagaaggucgaggacaaaaggauacggaagcugaagaacgaacuacucgaggccaaacgccgaucagggaagacccagcaagaggcuagucguguuugcgugcauugucacagaaaucugggacuuaucuucgauaggggugaccccugccaggcauguagccugcggguaugccgcgaauguagaguggccggcccuaacggguccuggaaaugcacagucugugauaagauugcgcaguugaggaucauuacuggagagugguuuuucgaagagaaagcuaagcgguuuaaacaggugaauguucucggcacggacgugguccgccaaucuauccugcgaagaucgccaggugccgaggaagugcagucacaggagcagaccaggcaagaugcagagaaaagcgacacaaguccgguagccgggaagaaggcuucccaugauggacccaagcggaaaggcuuccugcucucuaaguuucguagcgcaacucgcggcgagauaaucaccccuaaaacagacaccgggagauccuauucauuagaucuggacggacagcacuucaggagucuuaagagcccacccgguucugaucggggcuccacugggucaagcgacuugaacgaccaggaaccuggaccacgaacacccaagaguucucgcuccaauggcguuaccccugguacgcagagcucgccagccccgucuacuagaaccgugacauccgucauuucaagggaguacggguuugagaacaguauggaucuggcugccaucgaaggaacuagccaagagcuaaccaaaucccaucggcgcaauacaucuggcacccccagcauugcggugucaggcacgagucucuccagcgaccagucuagaucagaacuggaucuuagugagagcuucacugaagacuccgaggauacagugucuaucaggucgaaaagcgucccuggggcacuggacaaagauuccuuggaggaaaccgaggaaucaauagacgcccucguuaguucucagcugagcacuaacacacaccguuuagcuuccggacugucaaccagcucucaagccgguuccgaucggaaguggacguaucucaaugugccagacgcagauagugacaccacaagccuuaacucuaugauguccguauacucagagacuggcgacuaugggaaugugaaagucaguggagaaauucuguugcacaucagcuacugcuauaagaccggcggucuauacauuuuugugaagaacugucgaaaucuggcuaucggggaugagaaaaagcagagaacagacgccuacguuaaaucguaucuccugcccgauaaguccaggaacaacaaacgcaagacuaagauccggaccggcacaaauccugaguucaacgaaacccuuaaauacacuauuucucauacgcagcuggagacaagaaccuugcagcucagcguguggcacuaugacagguuuggacgcaauucauuccugggcgaagucgagauaccauucgauaguuggaacuuugagaaucccacugacgaaugguucguguuacaaccgaagguagaguuugcgccugauaucgggcugcaguacaaaggagaacuaaccguugugcuccgauauauucccccagaggaaaaccugaugcuuccucccgagcaguugcaggguaauaagacauucaaaaagggcaagaaaaaggaguccccagucaucucugggggaauacuggaaguguuuauuaaagaggccaagaaccucaccgcagucaaaagcggcgguacuuccgacucauucgugaagggguaccugcuucccgaugacagcaaagcuacaaagcauaagacgcugguuaucaaaaagagugugaauccucaauggaaccacaccuuuauguucucuggcauccacccacaggauauuaaaaauguaugcuuggaacucacuaucugggacaaggaggccuuuuccagcaacauuuuccugggaggcguccgguuaaauucggggucaggagugucucaugguaaaaacguugauuggauggacagucagggcgaagaacagcgucuguggcaaaagauggcuaauaacccggggacacccuuugagggagugcuaaugcucagauccagcaugggcaaguguaggcuguga

SEQ ID NO: 63482 - RNA, 1851 nt, Artificial Sequence
  derived and/or modified sequence opt3 from SYVN1__Homo_sapiens__NP_115807
auguucagaaccgccgugaugauggcugcaagccuggcccucacaggcgcggucguugcucacgccuacuaucuuaagcaucaguuuuaccccacugugguauaucugacgaaauccucuccuucaauggcaguguuguacauccaagccuucgucuuaguguuucugcuagggaagguuaugggaaaaguguucuuuggucagcucagggcugcagagauggaacaucugcuugagcggaguugguaugccgucaccgaaacaugccuggcuuucacuguguuucgcgacgauuucagcccacgauuuguagccuuguucacccuccugcuguuucucaaguguuuccacugguuagcggaggaccguguugauuuuauggaaagauccccgaacauuucuuggcuguuccacugcaggauagugucgcuuauguucuugcugggcauccuagacuuucucuucgucucacaugcauaccacagcauucugacacgcggggccagugugcagcuuguguuuggauucgaguaugcuauccugaugaccauggucuugacuauuuuuaucaaauacguucuccacuccguggaucugcagucugagaaucccugggacaacaaggccguauacauguuauauacagaacuguucaccggcuuuauaaaggugcuccuuuacauggcauucaugacgaucaugauuaaaguccauacuuuuccucuguucgcuauccggccaauguauuuggccaugagacaauuuaagaaagcggugaccgaugccauuaugagcaggcgggcaauccgcaauaugaacacacuauaccccgacgcuacuccugaggaacugcaggccauggauaauguuuguauaauuugccgagaggagauggugaccggugcuaagagacucccauguaaccacaucuuccauacauccugccugaggucaugguuucagcggcagcaaaccugucccacgugccguauggacguccuucgcgccagucugccugcacagagcccaccgcccccugaaccagccgaucaggggcccccuccagcuccccacccgccucccuugcucccacagccucccaauuucccacaaggacuguuacccccuuucccaccgggcauguuuccccuguggccuccaaugggccccuucccuccagugcccccgccuccaucuuccggggaggcgguagcacccccuucaacuagcgccgcucuaaguagacccucuggagccgcaacaaccacugccgcugguacauccgccaccgcagcgagcgcuacggccucgggcccagggucuggauccgcaccugaagccggccccgcuccagguuuuccguucccucccccauggauggggaugccccucccuccacccuuugccuucccuccgaugccaguucccccugcaggauuugcuggccugaccccagaggaacuuagggccuuggagggccacgagcggcagcaucuggaagcgcgacuccagucacugcgcaacauucacacacuucuggacgccgcuauguugcaaaucaaucaguaucucacugugcuggcaaguuuagggcccccuagaccggccaccagcgucaacuccacagaggaaacugcuaccacaguggucgccgcagcgucuagcaccucaauccccaguuccgaggccacuacgccaacaccuggagcuucucccccagccccugaaauggagaggcccccagcaccggagagcguggguaccgaagagaugccugaagauggcgagcccgacgcugccgaacugcggcgcagaaggcuacagaaacucgagucaccaguugcacauuga

SEQ ID NO: 63483 - RNA, 1020 nt, Artificial Sequence
  derived and/or modified sequence opt3 from TAAR1__Homo_sapiens__NP_612200
augaugcccuucugccacaacaucauuaauauaagcugugugaagaacaauugguccaacgacgucagagccucucuguacucacucaugguucuuaucauucugaccacauuggugggcaauuuaaucguaauugugaguaucagccauuuuaaacagcugcacacuccuacgaacuggcuaauacauuccauggcuaccgucgauuuccuccuggggugccuugugaugccauauucuaugguuaggucggcagagcacuguugguacuuuggagaaguguucugcaagauccauacaucaacugacauuaugcugagcagugccuccaucuuucacuugucuuucauuagcaucgaucgguauuacgcggucugugacccgcuccgcuauaaagcuaagaugaauauacuggugauuugcguaaugaucuuuauuuccuggucaguucccgccguguucgcauuugguaugaucuuccuggagcucaacuuuaaaggcgccgaagagaucuacuauaagcacguccauugucgagggggaugcaguguguucuuuagcaagauuucuggcguguuaaccuucaugacauccuucuacauaccugguucaaucaugcugugugucuacuaucguauuuaccuuaucgcuaaagaacaagcaagauugauaagcgaugccaaucagaagcugcagauugggcuagagaugaaaaacggaaucagucagucuaaggagaggaaagcuguuaagacccucggcaucgugaugggcguauuucugauuugcugguguccauucuuuaucugcacugugauggaccccuuccuucacuauauuauaccuccaacacugaaugaugucuugaucugguuuggguaccucaacuccaccuucaaucccaugguguaugccuuuuucuacccuugguuucggaaggcgcugaaaaugauguuauucggaaagauuuuucaaaaagacagcucgcgcugcaagcuguuccucgaacuuucuuccuga

SEQ ID NO: 63484 - RNA, 1056 nt, Artificial Sequence
  derived and/or modified sequence opt3 from TAAR2__Homo_sapiens__NP_001028252
auggccgugagcuccgagcagcacgaacugucucauuucaagagaacccaaacuaaaaaggagaaauuuaacugcucagaauacggcaauaggaguugucccgagaacgaacggagccucgggguccgcguugcuauguauuccuucauggcaggaucuaucuuuauuacaauauucgguaaucuugccaugaucauuucgaucucauacuuuaagcagcugcacacgccuaccaacuucuugauuuuaagcauggcgaucacagacuuucugcuaggcuucacuauaaugccauauaguaugauccgauccguggagaauugcugguacuuugggcucaccuucuguaaaauuuauuacucuuuugaucugaugcuuagcaucacauccauuuuccaucugugcucaguagcuaucgaccguuuuuaugccauauguuacccguugcucuacaguaccaagauuacuauccccgugauuaagagacugcugcucuuaugcuggagcgucccuggagcauucgccuucggcgugguguuuucugaggcuuaugcagaugguaucgaaggguacgacauccugguugccuguuccucaagcugcccagucauguucaacaaacuuuggggaacaaccuuguuuauggcuggcuucuuuacgcccggcaguaugaugguggggauuuauggaaagauauucgccguaucuaggaaacacgcgcaugcaaucaauaaccugcgggagaaucagaacaaucagguuaagaaagauaagaaggccgcuaaaacucuagguauugugaucggcgucuuucuccuguguugguucccuugcuuuuucaccauacuucuggacccauuuuugaacuucuccacacccguggugcucuuugaugcccugacuugguucggguacuucaauagcaccuguaacccuuuaauuuauggauuuuucuacccaugguuucgcagagcacugaaguauauccuccuuggcaaaaucuucucgucuugcuuucacaauacaauucugugcaugcaaaaggaauccgaguga

SEQ ID NO: 63485 - RNA, 1014 nt, Artificial Sequence
  derived and/or modified sequence opt3 from TAAR5__Homo_sapiens__NP_003958
augagagccguguucauccagggcgcugaggaacaccccgcagccuuuugcuaccaagucaacgggagcuguccuaggaccguucauacacuggguauucagcucgugauauaucuugcgugcgcugccggaaugcugaucauuguauugggcaauguguucgucgcauuugccguguccuacuucaaggcuuuacacacuccaacgaacuuucugcuacucucucuggcacuugccgacauguuccugggguugcucguucugccgcugucaaccauccggaguguggagagcuguugguuuuucggagauuuucucugccgcuuacauacauaucuggacacucuuuucuguuugaccuccauuuuucaccugugcuucaucucuauagaucgacauugugcuaucugcgacccccuacucuacccuucgaaauuuacaguccguguggcccugagauauauucuugcgggcugggguguaccagcagccuacaccucacuguucuuguauacugauguuguggaaacaaggcucagccaguggcuggaggaaaugcccugugucgggaguugccaguuacugcucaauaaguucuggggauggcuuaacuuuccucuguucuuugugccauguuugaucaugauuucccuauacgugaaaaucuucgucguugcuacccggcaagcccagcagauaacgacucugucuaagagccucgcaggcgcugccaaacacgagcgcaaggcggccaagacccugggcauugcaguggggaucuaccuucugugcugguugcccuuuacaauugacacuaugguagauucccuccugcacuucaucaccccuccauuaguguuugacaucuucauuugguuugcuuauuucaauucagccugcaacccgauaaucuacgucuuuaguuaucagugguucagaaaagcucugaagcuaacacucagccaaaaaguguuuucuccccagaccaggacgguugaucuguaccaggaguga

SEQ ID NO: 63486 - RNA, 1038 nt, Artificial Sequence
  derived and/or modified sequence opt3 from TAAR6__Homo_sapiens__NP_778237
augagcuccaacucuucacugcucguggccguccagcuuugcuacgcuaauguuaacggcaguugugugaagauccccuucagcccuggguccagaguaauucuguauauaguguuuggauucggugcagucuuggccguguuuggcaauuuacugguuaugaucucuauucuacacuucaaacaacuccauucgccaaccaacuuucugguggcgucacuugcuugcgccgacuuccuggucggggugacaguaaugccguuuagcaugguuaggacuguggagaguuguugguacuucggacgguccuuuugcacguuccacaccuguugcgaugucgcauuuuguuauucuagcuuguuccaucucugcuuuaucuccauugaccgcuacaucgccgugacagauccccugguguauccuacuaaguucaccgucucaguuaguggcauauguaucagcgugucuuggauucugccacucauguacuccggugcuguauucuauacagggguguacgacgauggauuagaggaacugucagacgcacuuaauugcaucggcggcugucagaccgucgugaaccagaauuggguuuugacugauuuucugagcuucuuuauucccacauucaucaugauaauucuauacgggaacaucuuucucguggcccgacgucaggcuaaaaagauugaaaauaccggaaguaaaacggagucuuccagcgaaucguauaaggccagagucgcgaggcgggagcgcaaggcagccaaaacucugggugugaccguaguugcuuucaugaucucuuggcuuccuuacuccaucgacucacugauugaugccuuuaugggcuucauaacaccagcaugcaucuaugagauuugcuguuggugcgcuuacuauaacagugccaugaaucccuugaucuacgcgcucuuuuauccuugguucagaaaggccauaaaagugauugucacugggcaagugcugaagaacagcuccgcaaccaugaauuuauuuucugaacacaucuga

SEQ ID NO: 63487 - RNA, 1515 nt, Artificial Sequence
  derived and/or modified sequence opt3 from TAB1__Homo_sapiens__NP_006107
auggccgcucagagaaggagccugcuccaauccgagcagcagcccucuuggaccgacgaucuuccucugugccacuugucaggcguggggagugcaagcaaccgguccuacucugccgacggaaaggguacagaaucgcauccaccggaggauucaugguuaaaauuccgcagcgaaaauaacuguuuucuguauggcgucuucaauggguacgacggaaaccgaguuacuaauuuuguggcgcagcgucuaagugcugagcuccugcuuggccaacugaacgccgaacacgcagaggccgauguaagaaggguguugcuccaggcuuucgacgucguggagcgguccuuucuggaaucuaucgaugacgcacuggccgagaaggcuagccuccagucccaguuacccgaagguguuccucaacaucagcugccaccccaguaucagaaaauucuugagcgcuugaagacgcuggagagagaaauaucagggggagccauggcgguggucgcagugcuacucaauaacaaacuguacguagccaauguuggcaccaacagggcccuucugugcaagaguacaguggauggcuugcaagucacucagcucaauguggaccacaccacagagaacgaagaugagcuguuccgguuaagccagcuggggcucgacgcuggaaagaucaaacaaguggguauuaucuguggccaggaaucuacccgccgaauuggggauuauaaggucaaauacggauauacugacaucgaccuucuguccgcagcuaagucaaaaccuauaaucgccgagccagagauucauggcgcgcagcccuuggaugguguuacaggguuucuagugcugaugagcgaaggacucuacaaggcccuggaggcagcucacggcccuggccaggccaaucaagaaaucgcugccaugauugacaccgaguucgcaaagcagacgagucuugaugccguagcucaggcgguggucgacagagugaaaaggauccacucugauacuuuugcauccgggggagaacgggcccguuucugcccacgccaugaggacaugacccuguugguuagaaacuuugguuacccgcucggcgagaugagccagcccacaccuucgccagcucccgccgcagggggaaggguguauccugucucugugccauacuccucagcccaaaguacuagcaagaccuccguaacacugucuuuaguuaugcccagccagggccagauggugaauggugcucacucagccaguacccuggaugaagcaacgccgacucuaacaaaccaguccccuacccucacucugcaaagcacaaacacccauacgcagucuucaaguagcuccucugacgggggccuuuuccggucgcgacccgcgcacagcuugccaccuggagaggauggccgcgucgaacccuauguggacuuugcugaguucuacagacugugguccgucgaucacggggaacagucagugguuaccgccccauga

SEQ ID NO: 63488 - RNA, 1986 nt, Artificial Sequence
  derived and/or modified sequence opt3 from TAB2__Homo_sapiens__NP_001278964
augcagaacaauaacaaucuggacgccugcugugcugugcucagccaagaguccaccagauaccuuuauggcgaaggggaucugaacuucucugacgauucaggaaucagugguuugaggaaucacaugacaagccuuaaccuggaccuacagucccagaauauuuaccaucacggccgggaggggucucgcaugaacggaucgcgaacucucacgcauucaauaagcgauggccagcugcaaggugggcagaguaauuccgaacuuuuucagcaggagccccaaaccgccccugcacaggucccacagggauucaacguuuuuggcaugucuagcuccucaggcgcgaguaauagcgcuccgcaccugggguuccauuugggaucuaaggguacauccucacucagccagcaaacuccccguuuuaacccuaucauggugacccuggccccaaauauucagacaggcagaaacacccccacuucacugcacauccacgggguaccuccacccgugcucaauucuccucagggaaacuccauuuauaucaggccauacauaacaaccccgggcgguacgacucggcaaacccagcagcauagcgggugggucucgcaguucaaccccaugaauccucaacagguguaucagccaucucagcccggaccuuggacaacuugcccagcauccaaccccuuaucacacaccaguagccaacagccgaaucagcagggccaucaaacaucccacguuuacaugccuaucucuagccccaccacgucacagccaccuacuauucacaguuccggcagcucucagucaagugcccauagccaguauaacauccaaaauauuuccacagggccccgcaaaaaccagaucgaaauaaagcuggagccaccccagagaaauaacucuucgaaacuuaggagcuccggaccucggaccucaaguacuucuagcuccgugaauagucaaacauugaaccgcaaucagccaaccgucuacauugcugcaagcccgcccaacacggacgagcugaugucucgaucccagccuaagguguacaucagugccaaugcugccaccggugaugaacagguaaugagaaaccaaccaacacuauuuauuagcacuaauucuggcgcguccgcagccucaaggaacaugagugggcagguuagcaugggacccgcuuucauccaccaucacccuccaaaaucgcgggccaucggcaacaauuccgcaaccucuccccguguggucgugacacagccgaacacuaaguauaccuuuaagauuacagugagcccuaauaaaccacccgcugucucaccugguguugugagucccaccuucgagcucacuaaccugcuuaaucauccagaccacuacguagaaacggagaacauacagcaccugacagauccuaccuuggcccauguggaccgcaucuccgagacuagaaagcucucuauggggagcgaugacgcggccuauacccaagcacuguuaguccaccagaaagcuaggauggaacggcugcagcgagagcucgaaauucagaagaaaaaguuagauaagcugaaauccgaggugaaugaaauggagaacaauuugacacgcagaaggcuaaagcggucaaacagcaucagucaaauacccucucuggaggaaaugcagcagcuccgcuccuguaauagacaacugcagauugacaucgacugccuuaccaaagagaucgaucuguuucaggccaggggcccacauuucaacccgagcgcuauucacaauuuuuacgacaacaucggauucguuggcccugugcccccaaagcccaaagaucagcguucgauuauaaagacuccuaaaacacaagacacggaagaugacgagggggcccaguggaauuguaccgcaugcacuuucuugaaccacccagcccucauccggugugaacagugcgagaugccccgacauuuuuga

SEQ ID NO: 63489 - RNA, 2139 nt, Artificial Sequence
  derived and/or modified sequence opt3 from TAB3__Homo_sapiens__XP_005274539
auggcccagagcuccccucaacuggacauccaggugcuccacgaucuuagacagagguuccccgagauuccagaaggcgucguuucucagugcaugcugcaaaacaauaacaauuuggaggcuuguugccgggcauuaucacaggaaaguagcaaguaccuguauauggaguaccauuccccggacgauaaccgcaugaaucgaaaccgucuacuccacauaaaucuggggauccauucucccucgucauaucacccuggagacggugcccagcuuaacggcgggagaacccuggugcauagcaguuccgauggacacauugacccacagcacgcggcuggcaaacaauugaucugucucguacaggaaccccauucugccccugcaguggucgccgcuacaccaaauuacaaccccuuuuucaugaaugagcagaacaggagcgcagccacuccuccaucccagccgccccaacagccuucaaguaugcagacggguaugaauccaagcgcuaugcaagggcccucuccuccacccccgccucccuccuauaugcacauuccacgguacucaaccaacccuaucacagugacuguuagccagaaucugcccaguggacagaccgugccacgcgcccugcagauacucccccaaaucccuucuaacuuauauggcuccccaggcagcauuuacaucagacagacaucgcagucuuccucagggaggcagaccccgcaaaguacucccuggcagagcuccccucagggaccagucccccauuacucucagcggccucugccaguguauccccaccaacagaacuaccagccgagccaguauucaccuaagcaacagcagauuccacaaagugcguaccacucucccccucccagccagugcccaucuccuuuuucaaguccccagcaucagguacaaccaagccagcuuggucacaucuucaugccgccuucccccucuacaaccccaccccauccuuaucagcagggcccacccucguaccaaaaacaggggagccacuccguugcauauuugccuuacacggccucaagucugucuaagggaagcaugaaaaagauagagauuacuguggaaccgucccagcgcccaggcaccgcuaucaaucgaucacccagcccuauuucuaaccagccaucccccagaaaucaacauagucuauacacagccacuaccccuccgagcuccucccccucaagggguaucaguagccagccaaagccucccuuuucggucaacccaguguauaucacauacacccagccuacggggcccuccuguacuccaucuccgagcccucgggugauucccaauccaacaaccgucuucaaaauaacuguuggacgugcaacaaccgagaaccuccugaaucuuguggaucaagaggaacgcucagcugcccccgagccuauccagccaauuaguguaauccccggcuccggcggggaaaagggaucucacaaauaucagagaagcuccucaagcgguagugacgauuacgcguauacgcaggcccuguugcuccaccaaagggcacggauggagcgacuggcuaagcaguuaaaacuggaaaaggaggaacucgagcgccuuaagucugaggugaacggcauggaacaugaccugaugcagagaagguugcggcgcgucuccugcaccacagccauaccuacuccggaggaaaugaccagacuaaggagcaugaaucgucagcugcaaauuaacguggauuguacacucaaagagguugaccugcuucagucgcgggggaauuuugauccaaaggcuaugaacaauuucuacgacaacaucgaacccggaccuguggugcccccaaaaccuucaaagaaagacucuagugaucccugcacuaucgagcgaaaggccagaaggauuuccgucaccagcaaaguacaggcagacauccacgauacacaggccgcugcggcagacgagcaucgcaccggcucuacucaaagcccacggacgcagccuagagaugaagacuaugagggugccccguggaauugugauuccugcacauuucugaaccaccccgcuuugaacaggugugaacagugcgagaugccacgcuacaccuga

SEQ ID NO: 63490 - RNA, 390 nt, Artificial Sequence
  derived and/or modified sequence opt3 from TAC1__Homo_sapiens__NP_003173
augaagauccugguggcccucgcugucuucuuucuuguuagcacccagcuguucgcagaggaaauuggcgccaacgacgauuugaauuacugguccgacugguaugauucugaccaaauaaaagaggaauuacccgagccuuuugaacaucugcuacagagaaucgcgaggcggccaaagccgcagcaguucuuugggcucaugggaaaacgcgaugcugacucaaguauugagaagcaaguggcccugcuuaaagcacuguacggucacggccagaucagccacaagcgacauaagacagauuccuucguaggguugaugggaaaacgugcccucaacucuguggcuuaugagagaucggcaaugcagaauuacgaaaggcggcgcuga

SEQ ID NO: 63491 - RNA, 312 nt, Artificial Sequence
  derived and/or modified sequence opt3 from TAC3__Homo_sapiens__NP_001171525
augagaaucaugcuccuguucaccgccauucuugcuuuuagccuggcacaguccuucggcgccgugugcaaggagccccaagaagaggucguuccugggggagguaggucuaaacgggacccagauuuguaccaguuacugcagcgccuauuuaagucacacaguagccucgaaggccugcuuaaagcgcugucccaggcuucuacagacccgaaggagucgacuucacccgaaaaacauagcccuacggaugugaaccaagagaauguaccaaguuucgggauauugaaguaucccccucgagccgaguga

SEQ ID NO: 63492 - RNA, 291 nt, Artificial Sequence
  derived and/or modified sequence opt3 from TAC4__Homo_sapiens__NP_001070971
augcugcccugccucgcccuucuguuguuaauggagcugagcguguguaccgucgcuggcgacgggggagaggaacagacacuauccacugaagcagagacgugggaaggugccggcccuucuauccaacuccagcugcaggagguuaagaccgggaaagcgucacaguucuuuggacuuaugggcaagagagugggugcuuaccaacuggagcacacauuccagggguugcucggaaaaaggagucuguuuacugaaggccgggaggaugaagcccagggcagcgaguga

SEQ ID NO: 63493 - RNA, 1188 nt, Artificial Sequence
  derived and/or modified sequence opt3 from TACC1__Homo_sapiens__NP_001116296
auggccuucagccccuggcagauccuguccccugugcaaugggcuaaguggaccuggucugcagucagaggcggggccgcgggagaggacgaagcugguggcccagagggggauccggaagaggaagacucacaggccgagacaaaaagucucagcuuuagguccggaugcaagguuaaaaagcacgagacucagucucuugcacuggaugccuguucgcgggacgaaggcgcugugauuucacagauaagcgauaucaguaaccgcgacggucaugcaacggaugaggaaaaauuggccuccaccucuugcgggcaaaagagcgcuggagccgagguaaagggcgagcccgaagaggacuuagaauacuucgaguguuccaaugugccugucucaacaauuaaccacgcguuuaguagcucugaagcaggcaucgagaaagagacuugccagaagauggaagaggauggguccaccgugcugggacuacucgaaucaagcgccgagaaagcuccaguuagugugucuugugguggcgaaagcccccuggacgggauuugccuuuccgagucggauaagacagccguccugaccuugauccgagaggaaauaaucacuaaagagauugaagcaaaugaguggaagaagaaauaugaagagacacgucaggaggugcucgaaaugagaaagaucguagcugaguacgagaaaaccauugcccagaugaucgaggacgagcaaaggacgucuaugacuucccagaagucauuccagcagcugaccauggaaaaagagcaagcgcuggccgaucucaacaguguugaacggagcuuauccgaccuguuucgcagauaugagaaucuuaagggaguguuggaaggcuucaaaaagaacgaggaggcacugaagaaaugugcucaggacuaccuagccagggucaagcaggaagaacaacgguaucaggcucucaaaauacaugccgaagagaagcuggauaaagcaaaugaagagauugcccaggugcgcacaaaggcuaaggcggagucugcagcccuucacgcuggucugcgaaaagaacagaugaagguggagagcuuggaaagagcccuccaacagaaaaaccaggagaucgaggaacugacuaagauuugcgacgaguuaaucgcaaaacuggggaagaccgauuga

SEQ ID NO: 63494 - RNA, 8481 nt, Artificial Sequence
  derived and/or modified sequence opt3 from TACC2__Homo_sapiens__NP_001278805
augggcaacgaaaauucaaccuccgacaaccagcgaacucugucugcccaaacucccaggucagcucagccuccagggaauagucagaacaucaagcggaaacagcaagauacgccgggaagccccgaccaccgcgaugcauccucuauugguucggugggccuagggggauucugcaccgccucagaaagcagugcgucccuugacccuugucuggucucuccagagguuacugaaccccgaaaggauccucagggcgcucgugguccagaggggagcuuguuacccuccccuccaccgucacaggaaagggagcaccccaguagcucuaugccuuuugccgagugcccacccgaaggaugucuggcauccccugccgcugcaccagaggacggcccccagacucaaucaccgaggcgggaaccugcccccaaugcuccaggcgauauagccgcggcauucccugccgagcgcgacagcaguacccccuaccaggagaucgcugccgugccaucugcagggagagaaaggcagcccaaagaggaaggacagaaguccagcuuuucguucucuuccgguauugaucaaucaccuggcaugaguccaguaccgcuacgggagcccaugaaagcuccucucugcggggaaggagaccagccaggcgguuuugagagccaggagaaggaagccgcagggggauucccuccugccgagucccgccaaggcguggcaucuguccaggugacaccagaagcucccgccgcugcccagcagggcaccgagagcucagcaguucuggaaaagaguccgcuuaaaccuauggccccaaucccccaagauccugcuccccgagcguccgacagagagagggggcagggagaggcaccaccucaguaucugacugaugacuuggaauuucuccgggccugucaucugccacguagcaacucuggugcugccccagaggcagaagugaaugccgcuucacaggagaguugccaacagccggucggcgccuaccugccucaugcagaacuccccuggggguuaccaagccccgcgcuggugccugaggcuggaggcuccgguaaggaggcccuugacaccauugauguacaggggcacccacagaccggcaugcgcggaacgaaacccaaccaaguugugugugucgcagccggcgggcagccugaaggagguuugccggugucuccagagcccucgcugcuaacuccuaccgaagaggcucauccagccagcucccucgcaucauuccccgcugcccagaucccuauagcgguggaggaaccgggcaguucuagcagagaguccgucucaaaggccgggaugcccguuagcgcugacgcagccaaagaagugguagaugcuggacuggugggccuugagaggcaggucucugaccuggguuccaagggggaacacccagagggcgauccuggagaggugcccgccccaaguccucaagaacggggcgagcacuugaauacagaacagagccaugagguucagcccggggugccaccgccuccccucccaaaggaacaaucucacgagguccagcccggagcaccuccacccccucugccgaaagcgccauccgagucagcccgaggucccccuggccccacugacggggcuaaggugcaugaagauaguaccagcccagccguagcaaaagagggaucgcgcuccccuggcgacucucccggugggaaggaagaggcuccagaaccuccggauggcggagaccccggcaacuuacagggggaggauagccaggccuuuucaaguaaaagagacccagagguuggaaaggacgaacuguccaaaccuucuagcgaugcagaguccagggaccaccccucaagccacagugcccaaccaccucggaagggcggugcugggcauacagauggaccccacucucagaccgcggaagccgacgcauccggccucccgcauaaacuuggugaggaggauccagugcugccucccgucccagacggcgcuggggaacccacggugccugagggagccaucugggaaggcagcggguugcagccgaaaugccccgauacucuacagucgcgcgagggacugggcagaauggaaucauuccucacacuggagucugagaagagugacuuuccaccuacccccgucgccgaaguggcuccuaaagcacaagagggugaauccacucuugagauuaggaagauggggagcugugauggagaaggccuguugacaucuccagaccagccccgugguccugccugcgaugcgagccggcaggaguuccacgcuggcguuccacaucccccgcagggggagaaucucgccgcagaccugggauuaaccgcccugauccuagaucaagaccagcagggcauuccuuccuguccaggggaaggauggauccgaggcgcugcaucagaguggccccuccugaguagcgaaaaacaccuucaaccuucucaggcccagccagagacguccauauuugacguguugaaggaacaggcgcaacccccggagaacgguaaggagaccucaccuagucaccccggguucaaagaucagggagcugacagcucccagauucauguaccagucgaaccucaggaggauaauaaccugcccacacacggcggucaagaacaggcccucggcucugagcugcagucgcagcuuccaaaggggacucugagcgacacccccacaucauccccuacugauauggugugggagaguucuuugaccgaagagagcgaacucuccgcaccaacaagacaaaaacugccggccuuaggagagaagaggcccgaaggcgcuugcggggacggacagucaucucgcguuagcccuccagccgcagaugugcugaaagacuucagucuagcuggcaauuuuucccggaaggagaccugcuguacuggucaggggcccaacaagagccagcaagcccucgcggaugcccuggaggaaggaucucagcaugaggaagcaugccagagacacccuggcgcuucagaggccgcugacggcuguuccccacuuuggggguugaguaaaagggaaauggcaagcggaaacacgggugaggcacccccuugccaaccggauucggucgcccugcucgacgcugugccaugucugcccgcguuagcgccugccucucccggcguaacaccaacccaggaugcuccugagacugaagccugcgacgagacccaggaagggcgccagcaacccgugccagcaccgcagcagaagauggagugucgagccacauccgacgcugaaagcccuaaacugcuugcgucauuccccagugccggagagcagggcggugaggcaggggcugccgaaaccggaggcucugcaggcgccggggauccaggaaagcaacaggcucccgagaaaccuggugaagccacuuuguccugcggccuccugcagacagagcacugucuaacgagcggggaggaagcgucaaccagugcacugcgggagagcugccaggccgaacauccaauggcuuccugucaagacgcccuccugcccgcucgugagcuuggaggcaucccuagaucuacuauggauuuuagcacacaccaggcaguuccggacccaaaggaauugcuguuauccggucccccugaggucgccgcuccagauacccccuaucuccauguggacucagccgcacagagaggggcggaggauucuggagugaaggccgucaguucggcugacccucgcgcccccggcgaaagcccaugcccgguuggcgagccuccccuggcacuugaaaaugcugccucccugaaauuguucgcagggucucucgccccacugcuacaaccuggagcugcggguggcgagauucccgccgugcaggcaucaagcggguccccaaaggcucggacaacugaaggaccuguggauaguaugcccugccuggacagaaugccgcuccuggccaaaggcaagcaggccaccggugaggagaaagcagcuacggccccaggggcgggagcuaaggccucuggcgaaggcauggcaggggaugccgcuggagagaccgaagguagcauggagaggaugggcgaaccuucacaggaccccaaacaagggacauccggaggcguagacacaaguagcgagcagaucgcaacccuuacagguuuuccagauuuccgagagcacaucgccaagauuuuugaaaagcccgucuugggggcgcuggcuacuccuggagagaaagccggcgcaggccgcucugccguggggaaggacuuaacccggccgcucggaccagaaaaacugcuugauggucccccuggcguugacgugacgcugcuacccgcucccccugccagacuccaggucgagaagaaacagcaacuggcaggggaggcugaaauaucccauuuggcccugcaggaucccgcgucagacaaguuacucggaccagccggccugacaugggagaggaaccuuccuggugcaggggugggcaaggaaauggcuggaguuccgcccacccugcgugaggaugaacgcccagagggcccuggggccgcauggcccggauuggagggucaggcuuacagccagcucgaacggucgagacaagagcuggccucuggccuaccaaguccugccgcgacucaggaacugcccguggagagggcugcagccuuccagguagcuccgcacucccacggggaagaggccgucgcacaggaccgaaucccaagcggaaaacaacaucaggagacaucagccugugauuccccucacggcgaagacggucccggggauuuugcucauaccggcgugccaggacacgugccccggucuacuugcgcgccuagcccccagcgcgagguccuuaccguuccagaagccaauagugagccuuggacacucgacacgcugggcggggaaagaaggccgggagugaccgcagguauuuuggagaugcggaacgcucugggcaaucaauccacucccgccccaccuacaggggagguagcagauacccccuuagaaccaggaaagguggccggcgcugccggugaggcggaaggggacaucacacucagcacugcagagacccaggccugugcuucuggcgaccugccugaggccggaacgacacgaaccuucucagucguggcaggcgaucuuguucugcccgggaguugccaggacccggcuuguuccgauaaagccccuggaauggaaggcacugcugccuugcauggugacagcccagcaagaccccagcaagcgaaggagcagccugggccagaacgccccauaccugccggagauggcaaagugugcgucucuucgccacccgagccggacgaaacccacgauccuaagcuccagcaccuggcucccgaggagcuacauacagacagggaaucaccacgucccgguccuagcaugcugccauccgugcccaagaaagaugccccucggguuauggacaaggugacaagugaugagaccagaggcgcagaagggacagagucuagcccagucgcugacgauauuauccagccggccgcacccgccgaccuugaauccccuacgcucgcggcuucaaguuaucacggagacguagugggccaaguuucuaccgaucugaucgcccagaggagcuccgacucagaggaggcauuugaaacuccagagagcacaacccccgugaaagccccuccagcucccccgccuccacccccugaagucauucccgagccagaagugucuacucagccgccucccgaggagccaggguguggauccgaaacaguacccgugccugauggcccacgcagugacagcgucgaggguucgcccuuccgaccuccaucccauucuuuuucagccguuuucgaugaagacaagccgaucgcaagcagugggaccuacaacuuggauuucgacaauauugaguuaguggauacguuucagacucuggagcccagagcuuccgacgccaaaaaccaagaaggaaaggugaauacccggaggaagucuacagauagcgucccuauaucaaaauccacccucagucgcagccugucucuucaggcgucagacuucgacggcgcuuccagcucugguaacccagaggccguggcacuggcccccgaugcuuauaguacuggcucguccagcgcaucaucuacauugaagcguaccaaaaagccuagaccacccagccucaagaagaaacagacaacuaagaagccuaccgaaacgccgcccguuaaagagacacaacaggaaccagacgaggagucccugguaccuaguggggaaaaucucgccucagagaccaagacugaaucugcgaaaaccgagggacccagcccagcccugcuugaagagacaccuuuagagcccgcugugggcccaaaggcagccugcccgcuggauuccgaaagugcugagggggucgugccucccgccagcggaggcggucggguucagaacuccccacccguggggaggaaaacucucccuuugaccacggcaccagaagcuggagaggucacacccucugacucaggcggccaggaagauagcccugccaaggggcugucggugcgccucgaguuugacuacuccgaggauaagaguucuugggacaaucaacaggaaaacccgcccccaaccaaaaagaucggcaagaagccuguagcgaaaaugccccugcgaagaccaaagaugaagaaaacuccugagaaacuugauaauacacccgccagcccaccgcggucaccagccgaacccaacgacauuccaaucgcuaaagguaccuacacuuucgauaucgacaagugggaugacccuaacuuuaaucccuucuccucuacaaguaaaaugcaggagagcccaaagcugccucagcaauccuauaacuuugaccccgauaccugugacgagucagucgauccguucaagacgagcucuaaaacuccaaguucccccagcaagagcccugccucuuuugaaauuccagcauccgccauggaggcuaauggcguggacggggauggauugaacaaacccgccaagaaaaagaagaccccucuaaaaacagacaccuucaggguuaagaaaucgccgaagcgcagcccccugagugauccaccuucucaggaccccacaccagcggcuacuccugaaacacccccagugauauccgcagucgugcacgccacggaugaggaaaaacucgcuguuacaaaucagaaguggacuugcaugaccguggacuuagaggccgauaaacaggacuacccucaacccagcgaccugucaacauuugucaacgagaccaaguucaguuccccgacugaagaacuugauuauagaaauagcuacgaaaucgaguauauggaaaagauuggaucuucacugccucaggacgaugacgcacccaaaaagcaggcccucuacuugauguuugauaccagccaagagucccccgugaaaucuaguccuguaaggaugucggagagcccaacacccuguuccgguucaucuuucgaagagacggaagcucuggugaacacugcggccaagaaucagcacccgguuccucgggggcucgcacccaaccaggagagccaucugcaggucccagagaaaaguucccaaaaggagcuugaggccaugggacuaggcacccccucagaagcuaucgagauucgugaagcagcccacccuacagacgugucuaucagcaagaccgcucuguauucccgcauaggcacugccgagguggagaaaccagcgggguuguuauuccagcagcccgaucuggacagugcacuccagaucgcccgagcugaaauuaucacaaaggagagagaagucagcgaguggaaagauaaguacgaagagucuaggcgggagguaauggaaaugcgcaaaauuguggccgaguacgaaaagaccaucgcacaaaugauagaggacgaacagagagagaagucaguuucccaucagacggugcagcaacugguccuugagaaagaacaggcucuggccgaucucaauagcguggagaagaguuuggcggaccuguuuaggcgguaugagaaaaugaaggagguucuagaaggauuccgcaaaaacgaggaggugcugaagagaugcgcccaggaauaccucucuagagucaagaaagaggaacagagguaucaagcucuuaaggugcacgcagaggagaaacuggaucgggccaaugcugaaauugcacagguacgugguaaggcccagcaagagcaggcugcccaucaggcauccuuaagaaaagaacaguugaggguggacgcccuggagcgcacucucgaacaaaagaacaaagagaucgaggaacugacaaagauuugcgacgagcuuaucgcgaagaugggcaaaucguga

SEQ ID NO: 63495 - RNA, 2517 nt, Artificial Sequence
  derived and/or modified sequence opt3 from TACC3__Homo_sapiens__NP_006333
augagccuucaggugcucaacgacaagaaugucuccaacgagaaaaauaccgaaaacugcgauuuccuuuucucucccccugagguuacaggcagaucaagugugcugaggguaagccaaaaggaaaaugugccaccgaaaaacuuggccaaggcuaugaaagucacuuuccagacgcccuuacgggacccucagacccaccgcauccuguccccaucuauggcaucgaagcuagaggcccccuuuacacaggaugacacucucgggcuggaaaauucacauccuguguggacccaaaaggagaaccagcagcuuauuaaagagguugaugcgaagacaacccacggaauacugcagaaaccaguggaagcugacacugauuugcucggugacgccagccccgcauucggcaguggguccucuagcgaguccggaccuggcgcccuggcugaucuggacuguucaaguagcucucaauccccagguucaagcgaaaaucagauggucaguccggggaaggugucuggaucccccgagcaggcaguagaggaaaaccucagcucguacucuuuagaucgacguguuacuccugccuccgagacccuggaagacccaugcagaacggagucacagcauaaagcugaaacuccccacggcgccgaggaggaauguaaggcggagaccccucauggcgcagaagaggaaugcaggcacgggggagugugugccccagcugccgucgcaacaagucccccgggugcuaucccuaaggaggccugcggcggggcgccccuucaaggauugccaggcgaggcccuggguuguccugcaggggugggaacucccgugccagcugauggcacccagacacuaaccugcgcccacacgagcgcucccgaauccacugccccuacaaaucaucucgucgcaggccgggccaugacccugucuccacaggaggaaguugcugcggggcaaauggcaagcucaagucgcuccggaccggugaaacuugaguuugacguaagcgacggugccacuucuaagagagcucccccuccaaggcggcugggcgaacgcucaggguugaaacccccucuccgaaaggccgcagugagacagcagaaagccccacaggaggucgaggaagaugacggaaggaguggcgcuggugaggaucccccgaugccugccagccggggguccuaucaccuggacugggauaagauggacgauccaaacuucauucccuuuggcggagacacaaaaucuggcuguucggaagcacaaccucccgagagcccagagacccguuuagggcagccugcggcugaacagcugcaugccggacccgcaacggaggaaccagguccgugccucucccagcaacuucacucagccagugcugaggauaccccugugguucagcuggccgcagaaacacccacugcugagucuaaggagcgcgccuugaauagcgcguccaccucacuaccaacaagcugucccggcucugaaccugugccaacucaccagcaggggcaacccgcccuggagcucaaggaagaguccuucagagacccugcugaaguccugggaaccggcgcagagguggauuaccuugagcaguuugguacaaguagcuucaaagaaucugcccugaggaagcaguccuuguaucucaaauuugacccgcuguuacgggacucaccagggcgacccguaccuguugcuaccgagacaaguagcaugcauggcgccaacgaaacgccaucgggacgccccagagaggcaaagcugguggaauuugauuuucuaggcgcgcucgacaucccugucccggggcccccaccuggagugcccgccccagguggcccuccccuguccacagggccaauugucgaucuuuugcaguacucucaaaaagaccuggaugcugugguuaaggccacccaggaggagaauagggaacuccggagccgcugcgaggaacugcacggaaagaaccuugagcugggcaaaaucauggacagauucgaggaagugguauaucaggcaauggaggaaguccaaaagcagaaagaguugucaaaggcugaaauacagaaagugcucaaggagaaggaucagcugacuaccgacuuaaacaguauggagaaauccuucucugaucuguuuaagagguucgaaaaacaaaaggagguuaucgaagguuaccguaaaaaugaggaaagccuaaagaagugcguggaggacuaucucgcccggauuacacaggaggggcagcgauaccaggcacugaaagcccaugcugaagagaagcugcaauuggcgaacgaagagaucgcccaggucagauccaaagcacaggcugaagcccuggcccuccaggcuucacugaggaaggagcaaaugcgcauucagagcuuagagaaaaccguggaacagaagacuaaagagaaugaggaacugacacggaucugugaugaccuuauaaguaagauggagaagauuuga

SEQ ID NO: 63496 - RNA, 894 nt, Artificial Sequence
  derived and/or modified sequence opt3 from TACO1__Homo_sapiens__NP_057444
augagcgccugggcugcagccucccugucuagagcggcugccaggugccuccuugcacggggccccggggugcgcgccgcuccuccacgagacccgcgucccucacacccugagccaagaggauguggugcagcccccggcaggacccugcauuucacagcugccgucccugcggggcacaacaaguggaguaaaguucggcauaucaagggaccaaaagauguggaacgcagcagaauuuuuagcaaguugugcuuaaauauaaggcuggcaguaaaagagggcggucccaacccugaacacaauucuaaccuagccaauauccucgaggugugucggucgaagcauaugccaaagucaacuauugaaacggcucugaaaauggagaaguccaaagacaccuaccuucuguaugaggggcgcggaccgggcggcaguuccuugcucaucgaagcccugucuaacagcucccacaagugccaggcagauauucgacacauccugaauaaaaacgggggagucauggcugugggugccagacauucauucgacaagaagggcguuauaguggucgagguggaagauagggagaaaaaggcgguaaaucucgagcgggccuuagaaauggcaaucgaggcuggggccgaagacguuaaagagacagaagaugaggaggaacguaacguguuuaaguucauuugugacgcuaguagccugcaccaaguccgcaaaaaguuggauucucuuggacugugcuccgugucaugugcccuagaguuuauccccaauagcaaagugcagcucgcagaaccugaccuggagcaggccgcucaucuuauucaggcgcugaguaaccacgaagaugucauccacguuuacgacaauauagaguga

SEQ ID NO: 63497 - RNA, 1224 nt, Artificial Sequence
  derived and/or modified sequence opt3 from TACR1__Homo_sapiens__NP_001049
auggacaacgugcugcccgucgauagcgaccucuccccuaauaucucuaccaacacaucagagccaaaucaguucguucaaccggccuggcagauugugcuuugggcugcagccuacacuguaauaguggucacgagugugguuggcaacguggucgugauguggaucauucuggcgcacaagagaaugaggaccguaacaaauuacuuuuugguuaacuuagcuuucgccgaagcaagcauggccgcuuuuaauacuguggucaacuucaccuaugcagugcauaaugagugguauuacgggcuguuuuauugcaaauuccacaacuuuuuccccaucgccgcuguguuugccuccauuuacucuaugacagcggucgcauucgaucgguauauggccaucauacauccucuacagccacgccucucggcuaccgccacuaagguugugaucuguguaauuugggugcuggcacuucuguuggcuuuuccccagggauacuacucaacaaccgaaacgaugccuagccgagucgugugcaugaucgaguggccagaacaccccaauaaaauuuaugagaagguuuaccauaucugugugacuguccucauauauuuccugccucugcucgugauugguuacgccuauaccguaguuggcaucacauuaugggcgagugagauuccaggggacuccucugaucguuaccacgaacaagugagcgccaaaagaaaggucgugaagaugaugaucgucgugguuugcacuuuugcaaucuguuggcugccguuccacauuuucuuucuuuugcccuauauaaacccugaccuguaccuaaagaaguucauccaacagguguaccucgcuauuauguggcuggccauguccucaaccauguauaauccaaucauauacugcugucuuaacgauagguuucggcugggauucaaacaugcuuuucgcugcugucccuucauuagugccggcgacuaugaggguuuggaaaugaaaagcacaagauaccuccagacccaggggucuguauauaaagucuccaggcuggagacgacuaucucaacagugguuggagcacacgaggaggaaccugaagauggcccaaaggccacccccagcaguuuagaccugacuucuaauugcuccagccggucggauucuaagacaaugaccgaguccuuuucauucaguagcaacgugcucuccuga

SEQ ID NO: 63498 - RNA, 1197 nt, Artificial Sequence
  derived and/or modified sequence opt3 from TACR2__Homo_sapiens__NP_001048
auggggaccugcgacaucgugacagaggccaacauuagcuccggccccgaaucuaauacuacgggaauaaccgcuuucucaaugccuaguuggcagcuggcacucugggccacagcguaccuugcucuggucuugguugccgugacugguaacgcaaucguaauuuggaucauuuuagcccacagaaggaugcggaccgugacaaauuauuuuaucgucaaccuggcucuagcagaucucuguauggccgcuuucaaugccgcguuuaacuucguguacgcaagccauaauauaugguauuuuggccgcgccuucugcuacuuucaaaaccuguucccaaucaccgcuauguuuguuuccauuuauucuaugacugccaucgcagcugaccgauacauggccauugugcacccguuccagccccgucuuucggcgccuucaacaaaggccgucaucgcagggauauggcugguggcuuuggcccucgcuagcccacaguguuuuuauaguaccguaacgauggaucagggagccacuaaaugcguuguggcauggcccgaggacuccggcgguaagacccugcugcucuaccauuuagucgugauugcccugaucuacuuccuuccuuuggcugugauguuugucgcguauucuguuauugggcugacacuauggagaagggcagugccaggacaccaagcccauggcgcuaaucuccggcaucugcaggccaugaaaaaguucguaaaaacuauggugcuugucgugcugaccuucgcaaucuguugguugcccuaccaccucuauuuuauccugggcagcuuccaggaagauauuuacugccacaaguuuauacagcaaguuuauuuagcccuguucuggcucgcuauguccucaacaauguacaacccuaucauuuauuguugccuuaaucaccgcuuuagaaguggguucaggcuggccuuucgguguugcccaugggugaccccgacgaaggaggacaaauuggaacuaacucccacaaccagccugucuacucgcgucaaccgaugucauacaaaggagacccucuucauggcaggagauacggcgccuuccgaggcuaccucaggugaagccggcagaccacaggacgggagcggacugugguuuggcuacggucuucuggcacccacaaaaacucacguggagaucuga

SEQ ID NO: 63499 - RNA, 1398 nt, Artificial Sequence
  derived and/or modified sequence opt3 from TACR3__Homo_sapiens__NP_001050
auggccacccugcccgcugcagagacauggaucgacggcgggggaggugugggcgccgaugcggucaaccucacugcuagccuugccgcaggggccgcuacgggagcaguugaaaccggcuggcugcaguuguuagaccaagccgguaaucuguccucuucaccuagugcucuagggcucccaguggccagcccggcgcccucccagccuugggcaaaccugacaaaucaguucguacagccaucuuggagaauugcccuuuggucgcuggcuuacggaguggucguggccguugcaguguugggcaaccucauagucaucuggauuauccuggcucacaagaggaugcggacugugaccaauuauuuucugguaaaccucgccuucucagaugcgagcauggccgcauuuaauacauuaguuaacuucauuuacgcucugcauagugagugguauuuuggcgccaauuacugccgcuuccaaaacuuuuuccccaucaccgcuguguuugccuccauauauucuaugacugcaaucgccgucgaccgauacauggcuauuaucgauccucuuaaaccacguuugagcgcgacagcaaccaagauugugaucggguccauauggauucuggccuuccuacucgcuuuuccccagugucuguauucaaaaacgaaggugaugccuggaagaacucuuugcuucguccaguggccagaagguccgaaacagcacuuuaccuaccauaucauuguuaucauccugguguacuguuuccccuugcucauuaugggcauaacauauacuaucguagggauuacccuguggggaggcgagaucccuggugacacaugcgauaaguaccacgaacaauuaaaggccaaaaggaagguggucaaaaugaugauaauugugguuaugaccuucgcaaucuguuggcugccauaucauaucuacuuuauucucacggccaucuaucagcagcuuaaucgguggaaguacauucagcaaguguaucuggcuaguuucugguuggccaugagcucuacuauguacaaccccauaaucuacugcugucuaaauaaacgcuuuagagcaggguucaagagggcguuucgguggugcccuuucauuaaggucuccucauaugacgagcuggagcucaaaacaacccgcuuucacccaaaccgacagagcaguauguacacugugacaagaauggaaucuaugaccguaguuuucgaucccaaugacgcugauacgaccagguccagccggaagaaacgugccacaccgcgcgacccuucguuuaacggauguucuagaaggaacuccaagucagcaagugccacuagcuccuucaucucuagccccuauaccucaguggaugaguacaguuga

SEQ ID NO: 63500 - RNA, 1008 nt, Artificial Sequence
  derived and/or modified sequence opt3 from TADA1__Homo_sapiens__NP_444281
auggccaccuucgugagcgagcuggaagcugcaaagaaaaaccucuccgaggcccuuggcgacaaugucaagcaguacugggcgaaccugaaauugugguuuaagcaaaagaucucuaaggaagaguucgauuuagaagcucacagacugcuaacacaggacaauguucauucacacaacgauuuucuccuggccauucuuacuaggugccagauacuggugaguacgcccgacggggcaggaagccuuccuuggccagguggcuccgccgcuaagccggggaaacccaagggcaaaaagaaacucucuucgguacggcagaaguucgaucaucgcuuucaaccucagaauccacugucaggagcacagcaguucguggccaaggacccccaagaugacgaugaccugaaacucuguagccacaccaugauguuaccuacacgaggucagcuggaggggcguaugaucgucacugcuuaugagcauggacuugauaacgugaccgaagaggccguuagugcgguggucuacgcaguggaaaaucacuugaaggacauucugacauccguaguuucuagaaggaaagccuaucggcuacgcgauggccacuuuaaguacgcuuucggcagcaacgugaccccacagcccuaucucaaaaauuccgucguggccuacaacaaucugaucgagucaccuccagcauuuacugcuccgugcgccgggcagaaccccgcgagucauccuccacccgacgacgccgagcaacaggcagcuuugcuguuggccuguagcggagauacacucccugcuucucugccacccgugaauauguaugacuuauucgaagcccugcagguccacagagagguuauuccgacccauacgguguacgcacucaacaucgaaaggauaaucacuaaacuuuggcacccuaaucacgaggaacugcaacaggauaaaguacaucggcagcgcuuggccgcuaaggagggucuacugcucugcuga

SEQ ID NO: 63501 - RNA, 1332 nt, Artificial Sequence
  derived and/or modified sequence opt3 from TADA2A__Homo_sapiens__NP_001159577
auggacagacugggcagcuucuccaacgaucccucugacaagccuccaugcaggggguguucaaguuaccucauggagccguauaucaaaugcgccgaauguggacccccuccauuuuuccuuugccugcaguguuuuacccgggguuucgaguacaagaaacaccaaagcgaucauacauaugaaauuaugacuuccgacuuucccguguuggauccuucuuggacggcucaggaggaaauggcauuacuggaggccgucauggacugcggcuucgggaauuggcaggauguugcgaaccagauguguaccaagacaaaagaggaaugcgagaagcacuacaugaagcauuuuauaaauaacccacuauucgcuucgacucuccugaaucuuaaacaagccgaagaggcaaagaccgccgacacagcuauccccuuucacucaaccgaugacccuccacgcccgacuuucgauagccuguugagucgagacauggcaggauauaugcccgcccgugcugauuuuauugaggaguucgacaacuacgccgagugggaccucagagauaucgacuuuguggaagaugacuccgauauucugcaugcgcugaaaauggcaguaguggacaucuaucacucuaggcucaaggagcggcagcgcaggaaaaagauaaucagagaucacggcuuaauuaaucugcggaaguuccagcuuauggaacgccgauacccuaaagagguccaggacuuguacgagacaaugagaagguucgcccggaucguggguccaguugaacaugauaaguuuauugagagccacgcucuggaguucgaacuacgucgcgaaaucaaaagacuccaagaguauaggaccgccgggauaacgaacuuuuguuccgcacggacuuacgaccaucugaagaaaacccgagaggaagaacgccuuaagagaacaaugcugucagaaguguugcaguauauucaggauaguagcgcuugccagcaauggcucaggcggcaggccgacaucgacucuggacugucccccucaauuccuauggcgagcaauaguggccgcagaucugccccacccuuaaaccugacuggccucccggggaccgagaaacuuaaugaaaaggagaaggagcugugucagauggucagguuggugccuggagcauaccuagaauauaaauccgcucugcucaacgagugcaauaagcaagguggccugcgucuugcccaggcucgggcccugaucaaaaucgauguaaacaagacacgaaaaauuuacgacuucuugauaagagaaggguauaucaccaagggauga

SEQ ID NO: 63502 - RNA, 1299 nt, Artificial Sequence
  derived and/or modified sequence opt3 from TADA3__Homo_sapiens__NP_006345
augagcgagcugaaggacugcccccuccaguuccacgauuuuaaauccguggaccaucuuaaggucuguccuagauacaccgccguucuggcuaggucugaagaugacggcaucgggauugaggaauuggauacauuacaacuggagcuagaaacucuccugucaagugcaagccggcgccuucgagugcuggaggccgagacgcagauauugaccgacuggcaggauaaaaagggagaccguagauuccucaaacuggguagggaucacgaacugggcgcgccaccgaagcaugggaagcccaaaaagcagaaacucgagggaaaggcuggccacgguccugggccaggacccggccggccuaaauccaagaacuuacaaccaaagauccaggaauaugaguuuacagacgaucccauugacguaccucgcauccccaaaaaugaugccccgaacagauucugggcaucuguggagcccuacugcgccgacauuacuucggaagaggucaggacccuggaggaacuuuugaagccuccagaagacgaggcugagcauuauaaaaucccaccucugggcaagcacuacucacagcggugggcacaggaagaucuacucgaggaacaaaaagacggggcccgcgcugccgcgguggcagauaagaaaaagggacugauggguccacuuacagagcuggacaccaaggauguugacgccuugcucaaaaagagcgaagcucagcacgagcagcccgaggauggcuguccguuuggggcccugacucagcgauuacugcaagcacucguggaagagaauauaaucaguccuauggaagacucccccauuccagauaugucuggaaaagagagcggcgcugacggugccuccacaucaccuagaaaccagaauaagcccuucagugucccacauaccaaaagccuugaaucuaggaucaaggaggagcugauugcgcagggguugcuagaauccgaggaucggcccgccgaagacucagaggacgaggugcuggcagaacuccguaagcgccaagcugagcugaaagcccuuagcgcucacaacagaacgaagaaacaugaucuguugaggcucgccaaggaagagguaagucggcaggaacugcgacagcgcguuagaauggcagacaaugaggugauggaugccuuuaggaaaaucauggcugcgcggcagaagaagcgcacuccuaccaaaaaggagaaagaccaagcauggaagacauuaaaagaaagagagucuauacugaagcuacucgauggauga

SEQ ID NO: 63503 - RNA, 1779 nt, Artificial Sequence
  derived and/or modified sequence opt3 from TAF15__Homo_sapiens__NP_631961
augagcgacuccggcucuuacgggcagucaggaggugagcaacagaguuauagcaccuacggcaaccccgggucccagggauauggccaggccucucaaucguacucagguuaugggcagacaacugauagcaguuacggacagaauuauuccggcuacucuagcuacggccagucccaaucaggguauagucagagcuacggagguuaugaaaaccagaagcagucuuccuacucacaacagccuuauaauaaccagggccaacagcagaauauggagagcagugggucucagggaggcagagcuccauccuacgaccaaccggauuauggucagcaggacagcuacgaucagcaaucgggguacgaccagcaccagggaucuuaugaugaacaguccaacuacgaccaacagcaugauucauauagucagaaucagcaaagcuaccacucccagagggagaacuauucucaucacacgcaggacgaucggcgcgacgugagccgauacggcgaagauaaucguggcuaugggggaucacaagguggcgggagaggaaggggcgguuacgacaaagacgggcggggccccaugaccggaaguuccggcggggaucgcggagguuucaagaacuuuggcgggcauagagacuacggaccuaggacagaugcagacagcgagucugauaauucagacaacaauacuaucuucguccagggccugggugaggggguuaguaccgaucaggugggcgaauuuuucaaacagauuggaauaaucaagacaaacaaaaagaccggcaagccaaugauuaaucucuauacugacaaagauacagggaagcccaaaggagaggccaccguaucauuugacgauccuccauccgcgaaggcugccaucgacugguucgacgguaaagaauuucacggcaacauuaucaaggugucuuucgcaacgcggcgccccgaguuuaugcgagggggaggcucgggugggggcagaaggggacggggcggguaccguggacgcggcgguuuccaagggagaggaggcgauccuaagagcggugacugggucugcccaaacccguccuguggcaauaugaacuuugccaggcggaauagcugcaaccaguguaaugagccccgaccugaagauagucgcccaucugggggagacuucagaggcaggggguauggaggcgagcgggguuaccgcgggagaggaggcagggguggcgaucgugggggauauggcggggaccggagcggaggcgguuacgggggagaucgauccucaggcgguggcuauagcggggacagaucuggaggcggguacggaggcgauagguccggugggggauacggcggcgaccgcgggggagguuauggcggggaucggggaggcgguuacgggggagacagaggcggcggguauggaggugauaggggcggguacggaggcgaccgcggugggggauauggcggcgaccgagggggauacgguggcgaucggggaggguauggcggugaccgugggggauacggcggcgauagagggggauacgguggcgacaggagucgcgggggauauggcggugauagagggggaggcagcggcuacgggggagaccggucugguggcuaugggggagauagguccggcgguggguacggcggagaccgaggcgggggauaugguggcgaucgcgggggauacggcgguaaaaugggcgggcggaacgacuauagaaaugaucagaggaaccgucccuacuga

SEQ ID NO: 63504 - RNA, 1767 nt, Artificial Sequence
  derived and/or modified sequence opt3 from TAF1B__Homo_sapiens__NP_005671
auggaccuggaggaagccgaggaguucaaggaaagaugcacccagugugcugcagugagcuggggccucacagaugaagggaaauacuauugcacuuccugucacaacgucacggagagguaccaagagguuaccaauacagaccuuauccccaacacucagauuaaggcccugaaucggggauugaaaaagaaaaacaauaccgaaaaggguugggauugguaugugugcgagggcuuucaguacauauuauaucagcaagcggaagcucugaagaaccuagggguaggaccugagcucaaaaaugacgugcugcauaacuucuggaagcgcuaccuucagaaaucuaagcaggccuauuguaaaaauccagucuacacaaccggccgaaagccgacugugcuggaggauaacuugucacacagugacugggcaagcgaacccgagcuccuguccgauguuucuugcccuccauuucuggaaucgggugccgagucacagagcgacauccauacacguaagcccuucccugugaguaaggcuucccaaucugaaaccagcgucuguuccgggucacucgauggaguggaguacagucagagaaaagagaaaggcauuguaaagaugacgaugccacagacuuuagcauuuugcuaucugagccuuuuguggcagagggaagccaucacccugucugaccuacuccgguucguugaggaagaucacauucccuacaucaaugcuuuucaacauuucccugagcagaugaaacuguauggccgcgacagagggauauuuggaaucgaauccuggccagauuacgaggacauuuauaagaaaacaaucgagguggguacuuuccuugaccugccgagguuucccgauauuaccgaagacuguuacuugcacccuaacauccucugcaugaaguaucugauggaggucaauuuaccagaugaaaugcacucacugacaugucauguggugaagaugaccggcaugggggaggucgacuuccucacguuugaucccauagccaaaauggcgaagacuguuaaauacgacgugcaggcaguagccauuaucguggucgugcuuaagcuguuguuccuacuggaugacagcuucgaauggagucucucuaaccuggcugagaaacacaaugagaagaacaagaaagauaagccuugguuugacuuccggaaaugguaccaaauuaugaagaaagccuuugaugaaaagaagcagaaaugggaggaagcacgcgcuaaguaucuuuggaaauccgagaagccacuguacuauagcuucguugacaaacccguggccuacaagaagcgagagauggucgugaacuugcagaaacaguuuucgacacucguagaaucuaccgcgacugccggaaagaaauccccgucaaguuuccaauuuaauuggacagaggaagacaccgauagaacgugcuuccauggccacagccugcaggguguuuuaaaggagaaagggcagucccugcuaaccaagaacucucucuauuggcugagcacacagaaauuuuguaggugcuacugcacucacgugaccacauaugaagagucaaauuacagucuuuccuaccaauucaucuugaaccuguuuagcuuccuccugcggaucaagacuucucuucugcaugaggaagucucauugguggagaagaaacucuuugaaaagaaauauagugucaagcguaaaaagagccgcuccaagaaagugagaaggcacuga

SEQ ID NO: 63505 - RNA, 1179 nt, Artificial Sequence
  derived and/or modified sequence opt3 from TAF1C__Homo_sapiens__NP_001230089
augcugaaguggaaccacggccuccccagcccucuucuguuggccagauuacugccaccgcccaggccuuccugcgugcagccacuacuccuugggggacaagguggccagcugcagcuguugcaucucgcugagggggcaucugucccccggcuggccggaccuccacagucacugcccagucgcaucgacagccucccugcguucccauuacuggaaccgaaaauucaauggcgacuucaggagcguuugaaggcucccaccauaggccuggccgcaguugugccuccacuacccuccgccccuacaccaggucucguacuguuucagcuuucugcugcaggggauguguucuaccagcaacugagaccccaggucgacucgucauugaggcgggaugccggaccgccuggcgacacucagcccgauugucacgcuccaacggccagcuggaccagucaggacacagcgggcugcucccaauggcucaaagcacuguuaaaggugccucuggcucccccaguuuggacugcccccaccuuuacacaucgccagaugcucgggucuaccgaacuuagaagggaggaagaggagggacagcggcuggguguguugcgcaaagccauggcacgaggccaacuacugcuccagagagaucuggggagccuuccugcugccgaaccaccgcccgcgccugaguccggacuggaagacaaguugucagagaggcucggcgaggccugggcaggucguggggcugccuggugggaacggcagcagggacgcaccagugagccaggcagacaaacaaggcggcccaagcgacgcacccagcugucuagcuccuucucauuaagcggccacgucgauccuagugaagacacgucuuccccacauagccccgaguggccgccugcugaugcccugccacuacccccuacuacucccccaucgcaggaacucacaccugacgcaugugcccagggggugcccucugagcaaagacagaugcugagggauuauauggcuaaacuuccaccgcagcgggacacuccuggaugcgcgaccacacccccacacucccaggcaucaaguguacgcgccaccagaagccaacagcacacgcccguuuuguccucuagccagccucugaggaagaaaccacguauggguuuuuga

SEQ ID NO: 63506 - RNA, 837 nt, Artificial Sequence
  derived and/or modified sequence opt3 from TAF1D__Homo_sapiens__NP_077021
auggacaagagcggcaucgauucccuggaccacgugaccucugaugccgucgagcucgcuaacagaucagacaauaguagcgauuccucucuuuucaaaacacagugcauucccuacucgccuaagggggagaaaaggaacccaauacggaaguuuguucgcacuccggaaucagugcaugcaagcgacaguuccucugauagcuccuucgaacccaucccucugacgauuaaagccaucuuugagcgauucaagaaucguaagaaaagauauaagaaaaagaaaaagaggcgguaccaaccaaccggacgccccagagguaggccugaaggccggcgcaacccaauuuauucauugaucgacaagaaaaagcaguuucgaaguagagggagcggauuccccuuuuuagagucugagaaugagaaaaacgcgccuuggaggaagauacugacauucgaacaggcuguagcccggggcuuuuucaauuacaucgaaaaacuaaaguaugagcaccaucucaaagagucccugaagcagaugaacgugggugaagaucuugagaaugaagacuuugauucacgucgcuacaaguuccuggacgaugacgggagcauuaguccaaucgaggaaucuacugcagaggacgaggaugccacccacuuggaagacaacgagugugauauuaaacucgcuggagacuccuuuaucgucagcucggaguucccggugagacugucuguuuaucuggaagaagaggauauaacagaggaagcagcccucuccaagaaaagggcuaccaaggccaaaaauacuggccaacggggcuuaaagauguga

SEQ ID NO: 63507 - RNA, 5688 nt, Artificial Sequence
  derived and/or modified sequence opt3 from TAF1__Homo_sapiens__NP_001273003
augggccccgggugcgaccugcuccuuagaaccgccgcuacuaucacugcagccgcgauuaugagcgauacggacuccgaugaggacucugcuggagguggcccuuucucacuggccggguuuuuguucggaaacauaaauggcgcaggucaguuagaaggggagagugugcuggaugacgaauguaagaaacaccuagccggacucggcgcucugggccuugggagccugaucaccgaguugacagcaaacgaagaacucacuggaaccgauggugcccuggucaaugacgagggcuggguuagauccacagaagaugcuguggacuacucugauauuaacgagguagccgaagacgagucgcggcgcuaucaacagaccauggggucacugcagccacucugccauagcgauuacgacgaggacgauuaugacgcggauugugaagacaucgauugcaaguuaaugccgcccccuccacccccuccaggacccaugaaaaaggacaaagaucaggacaguauuacuggcguguccgagaauggugaagggaucauacugccuucuaucauugcaccaagcucccuugccucagagaaggucgauuuuaguaguucuuccgacucagaaagcgagaugggaccgcaagaggcuacacaggccgaaagugaggauggcaaguugacccugccccuagcaggcaucaugcagcacgacgcuacgaaacuccugccuucugugacugaacuuuucccagaguuucgacccgggaagguucugcguuucuugagacucuuuggaccugguaaaaacgugccauccgucuggaggagcgcccggcgcaagaggaaaaagaaacauagggaacugauucaggaggagcaaauccaggaaguggaguguucgguagaaucugagguuucccagaaaucauuauggaauuacgacuaugcgcccccgccucccccagaacagugccugagugaugacgagauaaccaugauggccccuguggagagcaaguucucccaaucuacaggcgauauugacaaagucacugauaccaagccccggguggcagaauggcgcuacgggccagcucgacucugguaugacaugcuuggagugcccgaggauggcagcgguuuugacuacggguucaaacugagaaagacagaacacgagccugucaucaaaucaaggaugauugaggaauuucggaaguuggaggaaaacaauggcaccgaucuacuggccgacgagaacuuccucaugguuacgcagcugcauugggaagaugacaucaucugggauggagaggacgugaagcacaaaggcacuaagccacagcgugcuagucuugccggguggcugccguccagcaugacacgcaaugcaauggccuacaacguacaacagggauuugcugcgaccuuggacgaugacaaacccugguauucuauuuucccuauagauaaugaggaccucguguacgguagaugggaagauaacaucauuugggacgcacaggccaugccaaggcuguuagagcccccuguccugacucuagauccaaaugacgaaaaccucauccuggagauacccgaugaaaaggaggaggcuacaucaaacaguccgagcaaagaauccaagaaggagucuucgcuuaaaaagagccggauuuugcugggcaaaaccggggugaucaaggaagaaccucagcaaaauaugucccagccagaaguuaaagaccccuggaaccucucaaaugaugaguauuacuauccuaagcagcagggacugcgaggcacguucggugggaacaucauucaacacaguauccccgccguggagcuucgccagccauuuuucccuacccauaugggccccauuaagcugagacaguuucacaggccaccguugaaaaaguacucuuucggagcacucagccagccuggcccccauuccguccaaccacuguuaaaacacauaaagaaaaaggccaagaugcgggaacaggagcgccaggcuucagggggaggugaaauguuuuucaugagaacaccccaggaccugacuggcaaagauggggaccuaauccucgccgaguauagcgaggaaaauggaccucugaugaugcaagugggcauggcaaccaagauuaaaaacuacuacaagaggaaaccagguaaggaccccggggcgccugauuguaaauauggcgagacaguauacugccacacuucuccguuucuuggauccuugcauccaggccagcugcuccaggcuuucgaaaauaaccuguuucgugcccccaucuauuuacacaagaugccugagaccgacuuccugaucauucggacacgacaaggguacuauauaagagaacuuguugauaucuuuguggucggacagcaguguccauuguucgaggugcccggcccuaauaguaagagggcaaacacccauauucgcgacuuucuccaggucuucaucuaccggcuguucuggaaaagcaaggauagaccgaggcgcauucgaauggaggacaucaaaaaggccuuucccucucacuccgaaucaaguauacggaaacgucuaaagcugugcgcugauuucaagagaacugguauggacagcaauuggugggugcucaaaucggauuuuaggcugccaacggaggaagagauccgcgccaugguuuccccugaacaauguugcgcauauuacucuaugauugcugccgagcagcggcuuaaggacgcgggguacggagaaaagagcuucuuugcccccgaggaggaaaacgaggaagauuuccagaugaagaucgacgacgaggugagaacagcuccauggaauaccacuagggcauuuauugccgcuaugaaaggcaagugcuugcuggagguaaccggugucgccgauccuacaggcuguggggaaggauucucauaugugaagauccccaacaaaccaacccagcaaaaggacgauaaagagccgcagccuguuaagaaaacugugacaggcacggacgcagauuuacgacgccucagucugaagaaugcgaagcagcuucugcggaaauuugggguccccgaagaggagauaaagaaauuguccagaugggaagugauugacguagugaggaccaugucuacugagcaggcccguagcggagaaggcccaauguccaaguucgcucgcgguucacgguuuagcguugccgagcaucaagaaagauacaaagaggagugccagaggaucuucgaucuccagaacaagguccugaguucuacagaagugcuauccaccgacacagauagcucgucagcagaggacucugauuuugaagagauggggaaaaacauugaaaauaugcugcaaaacaagaagacaagcucccagcucagccgagagcgggaggaacaggagcgcaaagaacugcagagaaugcuuuuggcugccggaucugcagccagcggcaauaaccacagggacgaugacaccgcuuccgugacgucacugaauaguagcgcgaccggucgguguuuaaagaucuaucgaacauucagagacgaggaaggcaaagaguacguccgcugcgagacuguuaggaagcccgccgugauagaugcauaugugcguauccggaccacaaaagacgaagaguucauuagaaaguuugcucucuucgaugaacaacacagggaggagaugcgcaaggaacgaagacggauccaggagcagcugaggcgccuuaaacguaaccaggaaaaggagaaacugaaggggccuccagagaaaaagcccaagaaaaugaaggagagaccugaccuaaaacucaaguguggagccugcggcgccauugggcauaugcggacuaauaaauuuuguccgcuguacuaucaaaccaacgcuccacccucuaauccuguagcaaugacggaggaacaggaggaagaguuggaaaagacagucauccacaacgauaaugaggagcugauaaagguggaaggaaccaaaauuguuuuaggcaagcagcucaucgaguccgccgacgaagugaggcgcaaaucacugguccuuaaguuccccaaacagcaacugccaccuaagaagaaacgaagaguggguacuacaguucauugcgauuacuugaaccggccccacaagaguauccacaggcgcagaaccgacccaauggugacucucagcuccauucuggagucuaucauuaaugauaugagggaccuaccuaacaccuacccguuucauacacccguaaaugcgaaagucgugaaggauuauuacaaaauaaucacgcggccaauggaccugcagacccuucgugaaaacgugcgcaagcgacucuauccuucgagagaggaguucagggaacaccuggaguugauugucaaaaacagcgcuacuuacaaugggcccaagcauucacugacacagaucucccagaguauguuagaucucugugacgaaaagcugaaagagaaggaggacaaacuugcccggcuggaaaaggcaauuaacccauugcucgaugacgaugaccaaguugccuuuucuuucauccuggauaauauagugacccagaaaaugauggcuguaccugacagcuggcccuuucaccauccggugaacaagaaguucgucccagauuauuacaaagugaucguuaauccuauggaccuagagacaauucgcaagaacaucuccaaacacaaguaucagucaagagaaucuuuucuggaugacgugaaucuuauucucgcaaacagcgucaaauacaauggacccgagagucaauacacuaagaccgcccaggaaaucgugaacguuugcuaucagacgcugacagaguacgaugagcacuugacccaguuagaaaaggacauauguacugcgaaagaggcugcccuggaagaggcagaacucgagucccuggacccaaugacccccggcccuuauacaccgcaagccaagcccccagaucuuuacgacacuaauaccagccugucuaugucaagggaugcuuccguguuccaggacgagaguaacaugagcgucuuggauauuccuucggccacacccgaaaaacagguaacgcaggagggugaagacggcgauggggaccuagcagaugaggaagagggaaccgugcaacagccucaggcuucuguucuguaugaggaccuccugauguccgaaggcgaggaugacgaagaggaugccgggagcgacgaggaaggagacaauccauucucagcgauccagcuuagugagucuggcuccgauagcgacguggguucagggggaauccggcccaagcaaccucgaauguuacaggaaaacacuagaauggauauggagaaugaagagaguaugaugagcuacgagggcgacggcggggaagccucccauggacuggaggauucuaacauuagcuaugguuccuacgaggagccagaccccaaaucaaacacacaggauaccucuuuuaguucgauaggcggguacgaagucagcgaggaggaagaggacgaagaggaagaggagcaacgcuccggaccgucugugcucucacagguacacuugagcgaagaugaggaagacuccgaggauuuccauaguaucgcaggcgacucugaccuggauagcgacgaguga

SEQ ID NO: 63508 - RNA, 3600 nt, Artificial Sequence
  derived and/or modified sequence opt3 from TAF2__Homo_sapiens__NP_003175
augccccugaccggcguggagccugccagaaugaacaggaagaaaggggacaagggauucgaaagcccacggccguacaaacucacacaccaggucguuugcaucaauaacauuaauuuucaacgcaaguccgugguagguuucguggagcuuacuauauuucccacggucgcuaaccugaaucgaaucaaauugaacucuaagcagugucguauuuauagagugaggaucaaugauuuagaagcagccuucauuuacaacgacccuacccuggagguuugccauucagaaaguaagcagcggaaucuaaacuauuuuagcaaugcguacgcugccgcaguguccgccgucgauccagacgcuggcaacggggagcucuguaucaaagugcccucugagcuguggaagcacguagaugaacuuaaaguucugaagauacauaucaauuucucguuggaccagccuaaaggaggccuccacuuuguggucccaucaguggaggguagcauggcagaacgcggggcccauguguucaguugcggauaucaaaacuccacaagauuuugguuccccugugucgauucuuacagcgagcugugcacuuggaagcuggaguuuaccguugacgcugccaugguggcgguauccaauggcgaucucguggaaacagucuauacccacgacaugaggaagaaaacuuuccacuacauguuaacaauuccuaccgcagccucaaacaucagucuggcuauuggcccauuugagauccuuguggauccguacaugcaugaaguuacgcacuucuguuugccccagcugcuaccucuccugaagcauacuaccagcuaucuucacgagguguucgaauuuuacgaggagauacugacaugccgguauccauacucuuguuucaaaacugucuuuauugacgaagccuauguggagguagcagcuuacgccuccaugucaaucuucagcaccaacuugcuccacagugcgaugauuaucgaugaaacaccccugacccgccgaugcuuagcccagucucuggcacagcaauuuuucggguguuuuaucuccagaaugagcuggucggacgaguggguucucaagggaauuucugguuauauauacggccuuuggaugaaaaagacguucggggugaaugaauacaggcauuggaucaaagaggagcuggacaagauugucgcuuaugaauugaagacuggaggcgugcuacugcacccuaucuuuggugggggaaaagagaaggauaacccagccucccaucuccacuucucaauaaaacauccccacacacugaguugggaauacuauaccauguuucagugcaaggcucaccuugucaugcggcugauugagaaucguaucagcauggaguucaugcuucagguguuuaacaaacuccuguccuuagccucuacugcaagcucacagaaguuccaaagucauauguggucccagaugcugguuagcacaucuggcuuccuaaagucaaucaguaaugugagcggcaaagacauucagccgcucaucaagcaauggguagaucaguccggggucgugaaauuuuacggaucuuucgccuuuaaccgcaagagaaauguucuggaacuugagauuaaacaggacuauaccucgccugguacgcagaaguacgugggccccuugaaggucaccgugcaagaacuggaugggagcuucaaccacacacuccagauagaggaaaauucccugaaacaugacaucccaugccacucaaagaguaggcggaacaaaaagaaaaagauuccucuuaugaauggagaggagguagauauggaccugucugcuauggaugcggacagccccuugcucuggauccgaaucgauccagacauguccgugcugcgcaagguugaauuugagcaggcagacuucauguggcaguaucaauuaagauacgaaagggaugucguggcccagcaggagucaauucuggcucuagaaaaauuucccacuccugccagccggcucgcacugaccgacauacuugagcaggagcaauguuucuaccgcgugagaaugucugccugcuuuuguuuggcuaagaucgccaacuccauggucaguacauggacuggcccaccggcaaugaaaagccuguucaccaggauguuuugcuguaagucuugccccaauauuguuaaaacaaacaauuucauguccuuucagucauauuuccuccagaagaccaugccuguggcgauggcucuguuacgugaugugcacaaccuguguccaaaagaaguacuuacuuucaucuuggaccucauuaaguacaacgauaaucggaagaacaaauuuagugacaauuauuaccgagccgagaugaucgaugcacuggccaacagcgucacgcccgcugugucgguuaauaacgaagugagaacacuagacaaucugaacccugaugucaggcucauacuggaggaaaucacccgcuuccuuaauauggagaaguugcugccauccuaucggcauacuauuaccgugucuugcuuaagagccaucaggguucuccagaaaaacggucacgugcccagcgacccggcacuguuuaagucauacgcugaguaugggcauuucguagauauucgcaucgccgcgcuugaagccgucguggacuacacaaaaguggaucgaaguuacgaggaacugcaaugguugcucaauaugauacagaacgacccugucccauauguucggcacaagauucugaauaugcuaaccaagaaucccccuuuuacuaaaaacauggagucuccccuguguaacgaagcucucguggaccagcuguggaaguugaugaacuccggcacaagccaugauuggcguuugagaugcggagcaguagaccuguacuucacguuauuuggccucuccaggccaucaugucugccucuucccgagcuggggcuagugcucaaucugaaagagaagaaagccgucuugaacccaaccaucauuccggaaagcguggcuggaaaucaagaggccgcaaacaauccuaguucucacccccagcugguugguuuccagaacccauuuuccagcucgcaggaugaagaggagaucgacauggauacugugcacgacucacaagcguucauaucucaucacuuaaauaugcucgaacgccccaguacaccuggccuguccaaguaucggccagccagcucuagaagcgcucuuaucccccagcauuccgccgggugcgauucaaccccuacaacuaagccgcaguggagucuggaguuggcaaggaaaggaaccggcaaggaacaggcuccacucgagaugagcaugcaccccgccgcaucugccccucuguccgucuuuacgaaagaaucaaccgcuaguaagcauagcgaccaccaccaucaccaucaccacgagcauaaaaagaagaaaaagaaacacaagcauaaacacaagcauaaacacaagcacgauuccaaggagaaagacaaggaaccauucacauucucuucgcccgcgagcggucgaucaauucgcuccccuagucuaucugauuga

SEQ ID NO: 63509 - RNA, 2790 nt, Artificial Sequence
  derived and/or modified sequence opt3 from TAF3__Homo_sapiens__NP_114129
augugcgagagcuacuccagaucucugcucagggugucagucgcccagaucugucaagcucuuggcugggacaguguucagcugagcgcaugccacuuguuaaccgaugugcugcagcgguaucuacagcaacucgggcgcggaugucaucgauacuccgaacuguauggucguacagaccccauucuugaugacguaggcgaggccuuccagcugaugggggugucuuugcacgaacucgaggauuacauacauaacaucgaaccugucacuuuuccacaccagauuccgucguuccccgugucaaagaauaacguucugcaguuuccucaaccaggaagcaaagacgcggaggagagaaaggaauauauccccgauuaccugccuccaauugugaguucccaggaggaagaggaggaggaacagguccccacggacggcgguaccucugcugaagccaugcaagugccucucgaggaagaugacgaguuagaggaagaggaaaucauaaaugaugagaacuuccuggggaaaaggccacuugacagcccggaagcagaggaguugcccgccaugaagcggccucgccugcuauccacaaaaggagauacucucgacguaguucugcuugaagcuagagagccacugucaaguaucaauacccagaagauucccccuauguugagcccagugcauguccaggacucuacagaucucgcacccccguccccugaacccccaaugcuggccccuguggcuaagucacagaugcccaccgccaaaccauuagagacuaagagcuuuacacccaaaaccaagacgaaaaccaguucuccuggccaaaagaccaaguccccaaaaacagcgcagagcccggcaauggugggcucgcccaucaggucuccuaagacugucuccaaagaaaagaaaucaccagggcggaguaagagccccaaauccccuaagucuccaaagguuaccacacacauuccccagaccccggugcgcccugagacgccaaaccgaacucccagcgccacacugucagagaaaaucaguaaggaaaccauacagguaaaacaaauucagacuccucccgacgcuggaaagcucaauuccgagaaccagcccaaaaaggccguggucgcagauaagacaaucgaagcuagcauugacgccgugaucgcgagagccugcgcagagagggagccugaucccuucgaauuuucuucagguagugagagcgaaggcgacaucuucaccuccccaaaacggauuucugggccggaguguacgaccccuaaggcuucgacaagcgccaauaacuuuacuaaauccggaucaacuccccuuccacugaguggcgguacaucuagcuccgauaauucauggacuauggacgcuagcauagaugaaguugugcguaaggccaaauuggggacccccucuaacaugccuccaaauuuccccuauaucuccaguccuagcgucucuccgccaacacccgagccucuacacaagguguacgaggaaaagaccaaacugccauccucaguagagguuaagaaaaagcucaaaaaggaacugaagacuaaaaugaagaaaaaggagaaacagcgcgacagagaaagggagaaggauaaaaacaaggacaagaguaaagagaaggacaaagugaaggaaaaagagaaggauaaggaaacgggacgggagacaaaauaccccuggaaggaauuucuuaaagaggaggaagcagacccuuauaaguucaaaauuaaggaguuugaagaugucgacccgaaggugaaacugaaggauggcuugguccgaaaagagaaggagaaacauaaggacaagaaaaaggaucgcgaaaaaggcaagaaagacaaggauaaaagagagaaggaaaaggugaaagacaaggggagggaggauaaaaugaaggcccccgcuccaccucucguucugcccccaaaagaauuagcgcugccucuauucagccccgcaaccgccucgcgggugccagcuaugcucccgucccugcuuccuguauugcccgagaagcuguucgaggaaaaggagaaagucaaggaaaaagagaagaaaaaggacaagaaagaaaagaaaaagaaaaaggagaaggagaaagaaaagaaagagaaggaacgcgagaaagaaaagagagagagggagaagcgugaaaaagagaaggaaaaacacaagcaugagaaaaucaagguggagccaguugcccucgcacccucuccugugauaccacggcugacucuucgagucggagccggucaagauaaaauugugaucagcaagguagugcccgcuccugaagccaagccggcaccaucacagaauagacccaaaaccccucccccagcgccugcucccgccccaggcccuaugcugguuaguccggcacccgucccauugccucuccuggcccaggcugccgcagggcccgcuuuacugccauccccuggacccgccgcgucuggcgccagcgcuaaggcaccggugagguccguggucacagagaccguuucaacuuacgugauccgcgacgaaugggguaaccagauuuggaucugcccaggguguaacaaaccugacgauggcagccccaugauuggaugcgacgauugugacgauugguaucacuggccaugcgugggcauaaugacagccccaccugaggaaaugcaaugguuuuguccgaagugcgcuaauaaaaagaaggacaaaaagcacaaaaagcggaaacauagagcccacuga

SEQ ID NO: 63510 - RNA, 2604 nt, Artificial Sequence
  derived and/or modified sequence opt3 from TAF4B__Homo_sapiens__NP_001280654
augcccgccggccugaccgagccugcuggggcagccccaccggcggcugugagcgccuccggaacagucacuauggcacccgccggugcucucccuguuagaguggaaucuacgccaguagcacuuggcgccgugaccaaggcucccgucucagugugcguugagccuacagccagucagccacugaggagccccguggggacuuuggucaccaaaguggcgccuguauccgcaccaccgaagguuucuucgggaccccgguuaccugccccacaaaucguggcugucaaagcccccaacacaaccacuauucaguucccugcaaaucugcagcuaccacccggcacagugcucauaaagucaaacagcgguccgcugaugcuugugaguccucagcaaaccgucacgcgcgcugaaacuaccuccaauaucacaucucgacccgccguuccagcgaacccucagacugugaaaauuuguaccguacccaauagcuccucacagcugaucaagaagguggccgucacaccagugaaaaaguuggcacagauugggaccacgguugugacuacaguccccaaaccuaguagcgugcaaucuguagcuguuccaaccuccguggucacugugacaccgggaaagccccucaacaccgucacgacccugaaaccuucaagccugggcgccaguucuacaccauccaaugagcccaaccucaaggcugaaaauagcgccgcagugcagaucaacuuaucgccuacuaugcuggagaauguuaagaaaugcaagaacuuucuugccauguugauaaaacuggcuuguucuggcucccagucaccagagauggggcagaaugugaagaagcuaguagaacaacuccuggacgcgaaaaucgaggcagaagaguucacccguaaacuuuacgucgagcugaagaguagcccccagccgcacuuggugccuuuucucaagaaauccguuguggcccugagacaguuacugccaaacucucaaaguuucauucagcagugcguccagcaaacaucaagugauauggugaucgcuacuuguaccacaaccguaacuacgucccccgugguuacaaccacugucuccucuucacagagugaaaagagcauuaucguguccggagccaccgcaccuaggacagugucuguccagacccucaauccccuugccgguccaguuggcgcuaaagccgggguggugacucugcauucgguaggaccuacagcagcgacgggcgguaccacugcugggacaggauugcuacagaccagcaagccccuggucacauccguggccaacacuguuaccacggugucacuccaaccagagaaaccggucgugaguggcaccgcaguuacacugucucuuccugccgugacuuuuggcgaaaccagcggggcugccauaugccugcccuccguaaagccagucgugucaagcgcaggaacaacuucugacaagcccgugauugguaccccuguccagaucaaauuggcucagccaggccccguucucucccagccugccgggauuccgcaagcggugcagguaaagcagcuguucaguuuauuucaggugguccaacagccaagcggaggcaacgagaaacaggugacgacaaucucucacuccucaacccugacuauccaaaaguguggucagaaaacaaugcccguuaauaccauuauaccuacuagccaguucccacccgccagcauccuaaagcagauuacccucccugggaacaagauccugucgcuucaagcuagcccgacacagaaaaaucggauaaaggaaaacgugacgucuugcuuucgcgaugaggacgauauuaaugacgucaccagcauggcaggcgugaacuugaaugaggaaaacgccuguauccuggcuacuaauucagagcucguuggaacacugauccagaguugcaaagaugaacccuuccuuuuuauuggcgcccugcagaagagaaucuuggacauugggaaaaagcaugauauaaccgagcucaacuccgacgcagugaaucugaucucucaagcgacacaggaaagguuacggggacugcuagagaagcucacugccauugcucagcaccgcaugaccacguauaaagccagcgagaacuacauccuguguuccgauacacgaucacagcuuaaguucuuggaaaaacuggaccaacucgagaagcagagaaaagaucuggaagagagggaaauguuacugaaggcagcuaaaagccggaguaauaaggaggacccagagcagcuucguuugaagcaaaaagccaaggaacuccagcagcuggagcuagcacagauccaacaucgcgacgccaaccugaccgcucucgcggccauugguccuaggaaaaagagaccccuggaaucuggcauagaggggcuuaaagauaauuugcuggcauccggaacuagcucguuaaccgcuacaaagcagcuccaccggccacgaaucacucgcauuugccugagagaccuuaucuuuugcauggagcaggaaagggagaugaaguauucacgggcccuguacuuggcccuccugaaauga

SEQ ID NO: 63511 - RNA, 3258 nt, Artificial Sequence
  derived and/or modified sequence opt3 from TAF4__Homo_sapiens__NP_003176
auggccgcuggcagcgaccugcucgaugagguguucuuuaacuccgaagucgacgagaagguugugucugaucuuguagggucacuggaaagucaguuggcagccagcgcggcucaccaucaccauuuagcccccagaaccccugaggugagggcagccgcugcaggagcccuggguaaucacgucguguccggcucuccagcuggggccgcgggagcaggcccggccgcucccgccgaaggugcaccuggggcugccccagagcccccuccagcgggacgggcccgccccggcggcgggggaccucaacgaccagguccgcccucgccucguagaccccuaguucccgcaggcccugcuccacccgccgcuaaacucaggccgccucccgaggggucagccggaagcugcgcaccagugccugccgcugcggcagucgccgcuggccccgaaccagcccccgcagguccugccaagccagcugggccggccgcacuggcggcucgggccggacccggcccuggcccagggcccggaccugguccaggccccgggccgggaaaaccugcaggcccaggugccgcucagacacuuaacgggagugccgcacugcuuaauucccaucacgcugccgcgcccgccgugucucucguaaacaauggcccugcugcacugcugccccucccaaagccugccgcucccggaacuguuauccagacgccaccguucgugggcgccgcagcgccucccgccccagcugcccccagcccuccagcagcucccgccccugcagccccggcugcggccccacccccuccacccccugcaccggcuaccuuagcccgcccaccagggcacccugccggacccccaacagcugcuccugccgugcccccaccggcggcugcccagaacgguggcuccgcaggggccgcuccugcacccgccccagcggcuggaggccccgccggugucucagggcaaccuggcccaggagcagccgcugccgcacccgcuccuggcgugaaagccgagaguccgaagagagucguucaggcggccccacccgcagcucagacucuggccgcuagcgggccugcaucuaccgccgccuccauggugauuggacccacaaugcagggugcuuugccaagcccugcggcaguacccccuccagccccgggcacccccacuggguugccaaagggagcugccggcgcagugacacaaucacugaguaggaccccuacggccacuaccucugguauacgggcuacacuaacucccaccguccucgcgccacgccugccucagcccccgcagaauccaacaaacauccagaauuuucaacuuccucccgggauggugcugguucgauccgaaaacggccaguugcucaugauuccacagcaagcccuggcacagaugcaggcucaggcccaugcacaaccccagaccacgauggccccuagaccggcuacucccacaagcgccccaccugugcagaucucgaccguccaggcgcccggaacuccuauuaucgcaaggcaagugacaccaaccacgauaaucaaacagguaucucaggcccagaccacaguucaacccuccgcuacuuuacagcggucaccuggcgugcagccacagcugguccucgggggagccgcucaaaccgcaagucuuggcacagccacugcugugcagaccgguacaccccagcguaccgucccgggggccacuacgacaagcuccgcagcgaccgagacuauggagaaugugaagaaauguaagaacuuccugucuaccuugauuaaacuagccagcucaggaaagcaaaguacagaaaccgcugccaauguuaaggagcuggugcagaaccuccuggacggcaaaaucgaagcagaggauuuuacuucccgccuuuacagagaacugaauagcucuccucagccauauuugguacccuuccucaagaggucacugccugcuuuacggcagcugacaccagacagugccgcauuuauucaacagagccagcagcaacccccgccucccacgucccaggccaccacugcucuaacagcggucgugcucucuucgagcguucagcgaaccgccgguaaaacagcagcuacugugaccuccgcccugcagccaccuguccuuucauugacgcaacccacccaggugggcguagggaagcagggacaaccaacaccccuggugauccagcagccuccaaaaccgggcgcccucauaagacccccucagguuacucugacccaaacaccaauggucgcacuucgccagccccacaacaggauuaugcugacuaccccucagcagauccaauugaacccacuccagcccgugccuguggucaagccggcuguucugccagggacgaaagccuuaagugcggugucugcucaggccgcagccgcucagaagaauaagcugaaagagcccggaggcgguagcuuccgggaugacgaugacauuaacgauguggcauccauggccgggguaaaucuaucagaggaaagcgcgcgcauccucgcuacaaacucugagcuggucggaacccuuacuagauccugcaaggacgaaacauuuuugcugcaagccccucuccagaggcguauccuggagauuggcaaaaagcaugguauaaccgaauuacaccccgaugugguuaguuacgugagccacgcaacucagcagcggcugcaaaaucuugucgagaaaaucucugagaccgcccagcagaagaacuucuccuauaaggacgacgaucgauacgaacaagcaucagacgugagagcccaguugaaauuuuucgagcagcucgaucagauugaaaagcaaaggaaagacgagcaggaacgcgagauccugaugcgggcagcuaagaguagaagcaggcaggaggauccagaacagcuacgccugaaacaaaaggccaaggagaugcagcagcaggaacucgcgcaaaugcgacagcgggacgccaaucugacagcacuugcugccauaggcccucguaaaaagagaaaaguugauugucccgggccaggaucgggcgcagagggguccggaccgggcucugugguaccugguagcucaggggucggaacgcccaggcaguuuacccgccaacggauuacuagagugaacuugagggaccugaucuucugcuuagagaaugaacgagagacaagucauucccuccugcuuuauaaggcuuuccugaaauga

SEQ ID NO: 63512 - RNA, 978 nt, Artificial Sequence
  derived and/or modified sequence opt3 from TAF5L__Homo_sapiens__NP_001020418
augaagagagugagaaccgagcagauccaaauggccgucagcugcuaccugaaacggcgccaguauguugacuccgauggcccccucaagcaggggcuucgacugucucagacagcugaagagauggcagccaacuugacugugcaaucagaaaguggaugugcgaauauuguaagcgcugccccuugccaggcagagccacagcaguacgaagugcaauucggucguuuaagaaacuuucugacggacuccgauucucagcacucgcaugaggucaugccgcuacucuauccccuguucguguaccuucaccugaauuugguucagaacucaccuaaaagcaccguggagaguuuuuauuccagguuccauggcauguuucuccagaaugccucucaaaaggacgucauagaacagcugcagacaacucaaaccauccaggauauucugagcaacuucaaacuccgggcuuuucuugacaauaaguacgugguacgccugcaggaggauuccuauaacuaccuuaucagauacuugcagucagacaauaacacagcacuguguaagguucuaacccuccacauucaucuggaugugcaaccagccaaaaggacugacuaucagcuuuacgcuagugggucuagcucccggucagaaaauaacggacuggagcccccugauaugccaagccccaucuugcagaaugaggccgcgcucgaaguccugcaggagaguauaaagcgcgugaaagacggcccuccaucuuuaacaaccaucugcuucuaugcauuuuacaacacggaacaacugcucaauacugccgagauuuccccggauagcaaguuacuggcugccgguuucgacaacucguguaucaaauuguggucucuacgauccaagaagcugaaaucagaaccccaccagguggacgucaguaggauucaccucgcaugcgauauccuggaggaggaaguuuga

SEQ ID NO: 63513 - RNA, 2145 nt, Artificial Sequence
  derived and/or modified sequence opt3 from TAF6__Homo_sapiens__NP_001177344
augaccaagagaaggcugcagacaaucacugccugccuccaacuucgggagggcagccccucccugcaccgcggguugcauccuucucgagaagagaaacgugacucaagaauggcugaagagaagaaauuaaagcugaguaacacggugcuaccaagcgaauccaugaaagucguugcagagucuaugggaauugcccagauacaggaggaaaccugucagcuccugacagaugaggugucguacaggaucaaggaaauugcgcaagacgcucuuaaguucaugcacauggguaaacggcagaagcugacuaccucagauaucgacuaugccuugaaacucaagaauguagagccgcuguacggcuuucaugcacaggaguucauucccuuucgcuucgccagcgggggaggcagagaacuguauuuuuacgaggaaaaagagguggaucucagugacaucauaaacacaccuuuaccaagggucccccuggaugugugccuuaaggcucacugguuguccaucgaagguugucagccugcaauuccagagaaucccccuccagccccgaaggagcaacagaaagcugaagccaccgagccccugaagucugcgaaaccugggcaggaagaggacggaccacuaaagggcaaaggccagggggcaacuacagccgauggaaaggguaaagaaaagaaggcucccccucuccuggagggcgccccacuucggcugaaaccccgcagcauccaugaguuguccguugaacaacagcucuauuacaaggagauuaccgaagcaugcguggggucaugugaggcuaaacgagccgaagcgcugcagaguaucgccacggacccgggauuauaucaaaugcugccuagauucagcacuuuuauaucugagggcgucagggugaacguaguucagaauaaccucgcacuucugauuuacuugaugcggauggugaaggcucuaauggauaaucccacccuguaccucgagaaauauguccacgaacugaucccagccgugaugacaugcauugugucccgucagcuuugucugcgcccugacgucgauaaccacugggcuuugagagacuucgccgcaaggcucguugcccagaucugcaagcauuuuucaacuaccacaaauaacauccaaagccggauuaccaagacguucacuaaaaguuggguggacgagaagacacccuggaccacucgauacgguucuauagcugggcuggcggaauuaggacacgauguaaucaaaacacugauucuaccacgccuccagcaggagggcgagagaaucagguccgugcuggacggccccguccuuagcaauauagaucggauuggggcagaccaugugcagucguugcugcucaagcacugugccccuguucuggcuaaacuucgcccaccgcccgauaaccaagacgccuauagagcagaauuuggaucucuggguccuuugcucugcucccagguggucaaggccagggcucaggccgcacugcaggcgcaacaggugaaucguaccacguuaaccaucacacagccacggcccacucugacccuaucacaggcuccucaaccaggcccccgaacaccggggcuccugaagguaccuggaaguaucgcccuuccaguucagacuuuggugagcgcaagagccgcugcacccccucagcccuccccaccucccaccaaauucauugucaugucuagcucaaguuccgccccaagcacacaacaggugcugucucucucaaccagugcuccgggcagcgguuccacuacgacaucuccugucaccacuaccgugcccucgguucagccaaucgugaagcugguaagcacagccaccacugcgcccccuuccacagccccaucagggcccggcaguguccagaaauacauugugguuucuuuaccuccgacgggagagggcaaagggggaccaaccagccaccccuccccugugccacccccugcuucaagcccgucuccccuguccgguagugcacuuuguggcgggaagcaagaagccggagauagcccaccucccgcuccaggcacuccuaaggccaacgguucucagcccaauuccgggucaccacagccggcaccuuga

SEQ ID NO: 63514 - RNA, 1050 nt, Artificial Sequence
  derived and/or modified sequence opt3 from TAF7__Homo_sapiens__NP_005633
augagcaaguccaaagacgaugcaccccacgagcuggaaucucaguucauccucagacuuccuccagaguacgcuucaaccgugaggcgggcaguccaaaguggccauguuaaccugaaggaccgcuugacaauugaauuacacccggaugggcgacauggaauagugcguguagacagagugccccuggccagcaagcuagucgaucucccuugcgugauggagucccugaaaacuaucgacaaaaagacguuuuauaagaccgcggauauuugucagaugcuuguuucuacaguggacggugaucuguacccacccgucgaagaaccuguggcuucgacugacccaaaagccucaaagaaaaaggauaaagacaaggagaagaaauucaucuggaaucacggcauuaccuugccccucaagaacguaaggaaacggcgcuuuagaaagacagccaaaaagaaauauaucgaaagcccugauguugagaaggaagugaagaggcugcugaguaccgacgccgaggcugucuccacucggugggagauaaucgcagaagacgagacaaaagaagccgagaaucaggggcucgauauuucuagcccaggaauguccggccaucgccagggucacgacucauuagaacacgaugagcugcgagagaucuucaacgaccuuaguucuagcuccgaagaugaggacgaaacccaacaucaggaugaggaagacauuaauaucauagauacggaggaggacuuggaaagacagcugcaggauaagcuaaacgagucagacgaacaacaccaggagaaugaagggacuaaccagcucgugaugggcauucagaaacaaaucgacaauaugaagggaaaacugcaggagacccaggauagggcuaagcggcaagaggaccuuauuaugaagguggaaaaccuggccuugaaaaaucguuuucaggcgguccucgaugagcugaagcagaaagaagaccgcgagaaggagcaguuaagcagucugcaagaggagcucgaaucucuucuggagaaauga

SEQ ID NO: 63515 - RNA, 1131 nt, Artificial Sequence
  derived and/or modified sequence opt3 from TAF7L__Homo_sapiens__NP_001161946
augagcgagucccaggacgaagugcccgaugaggucgaaaaccaauucauccugagacucccucuugagcacgccugcaccguuaggaaucuggcucggucucagucagugaagaugaaagacaaguugaaaauugauuuacugccagacggccgccaugcaguaguggaagucgaggaugugccgcuagccgcgaagcucguugaccugcccugugugauagagagucuucgaacacuggauaaaaagacuuuuuacaagacggcugacaucagccagauguuggucugcaccgccgauggggacauucaccucuccccugaagaaccagcagccucuacagaucccaacaucgugcguaaaaaggaaagaggaagggaggagaaauguguauggaagcaugguauuacuccuccacugaaaaauguucggaagaagcgcuucagaaaaacccagaagaaagugcccgacgucaaggaaauggagaaaucgucauuuacagaauauaucgagagcccugauguggaaaacgaggugaagaggcugcuccggagugacgcugaggcagucuccacccgcugggaaguuauagccgaggacggcacuaaagaaaucgagucucaagggagcauuccaggauucuuaaucuccucaggcaugaguagccacaagcagggucauacaucuuccgaauacgauaugcugcgagagauguuuucagacagcagaaguaauaacgaugacgaugaggacgaagaugacgaggaugaagacgaggaugaagacgaggacgaggaugaagacaaggaggaagaggaggaagauugcucugaggaauaucuugagaggcaguugcaggcugaguucauugaguccgggcaauaccgggccaaugagggaaccagcucgaucgugauggaaauacagaaacagauugagaagaaagaaaagaaacugcacaagauccagaacaaggcgcaacgucagaaagaccuaauuaugaagguagagaaucucacgcugaaaaaccacuuucagucugugcuugaacaacuggaguugcaggagaagcagaaaaaugaaaagcucaucucccugcaggagcaauuacagcgcuuccugaagaaauga

SEQ ID NO: 63516 - RNA, 933 nt, Artificial Sequence
  derived and/or modified sequence opt3 from TAF8__Homo_sapiens__NP_612639
auggccgacgcugcagccaccgcgggcgcugggggaagcgguacaagauccggcucuaagcagucaacuaaccccgccgauaauuaccaccuggcaaggcggcgcacgcuccaaguggucguuaguagccuucugaccgaggccggguucgaauccgcugagaaagcaucuguggaaacauugacugagauguuacagucguauaucucagaaauuggacgaagcgccaagaguuacugcgagcauaccgcucguacacagccuacccuguccgacauaguagugacucuagucgagaugggcuuuaacguggauacacucccagccuaugcgaaaagaucucagaggaugguuaucaccgcaccgcccgugacgaaucaaccugucacuccaaaggcccugaccgcuggucagaaccggccccacccuccacauauucccagccacuucccugaauuuccagacccgcauacauacaucaaaacucccaccuaucgcgagccuguguccgauuaccagguacuuagagaaaaggccgcaucacagaggcgggacguugagcgcgcucugacacgauucauggccaagaccggggagacgcaaaguuuguuuaaagaugacgugagcacuuucccacucauugcggccagacccuuuacaaucccuuaucugaccgcacugcucccaucugaauuagagaugcagcagauggaagagacugauuccucagaacaggacgagcaaacagauaccgagaaucuggcccuucacauaagcauggaagacaguggagcugagaaggaaaacacgucugucuugcagcagaaucccucccugagcggcucgaggaacggcgaggaaaauaucauugauaacccguaccuacggccugugaaaaagcccaaaauccgucgcaagaagucucucuccuga

SEQ ID NO: 63517 - RNA, 795 nt, Artificial Sequence
  derived and/or modified sequence opt3 from TAF9__Homo_sapiens__NP_003178
auggagagcggcaagaccgccucccccaaaucuaugccuaaggacgcucagaugauggcacaaauccugaaagauauggggauuacagaauacgagccaagagugauaaaccagaugcucgaguucgccuuuagguaugucacuacgauccuugacgaugcgaagauuuacucaagucacgcuaaaaaggccaccguugacgcagaugacgugcggcuggccauccagugccgcgcugaucagagcuucacauccccgcccccucgagacuuuuuguuagauauugcacgucaaagaaaucagacuccacugccccuaaucaagccuuauucuggaccaaggcugcccccugaccgguacugucucaccgccccaaacuaucgccuuaaaucgcugcagaagaaggcuucaacaagcgccgguagaauaaccguaccgagguugagugugggcuccgucacuucucggcccagcacaccuacccucgggacgccaacuccccagaccauguccgugucaacaaaaguuggaacuccuaugagucugaccggccaacgcuucacagugcagaugccaaccagccagucucccgcggucaaagcauccaucccggccacgucagcugugcagaauguacugauuaacccuagccucaucgguaguaagaauauuuuaaucacuacaaacaugaugucuucccaaaauaccgccaacgaaagcucgaaugcacugaagcgaaaaagagaagaugacgaugacgacgaugacgaugacgaugacuacgauaaccuuuga

SEQ ID NO: 63518 - RNA, 2007 nt, Artificial Sequence
  derived and/or modified sequence opt3 from TAGAP__Homo_sapiens__NP_001265662
augagaaggcugagccccgccuccgacuucucuggcgcucucgagaccgaucuuaaggcaucacuguuugaccagccuuugaguaucauuugcggggauagcgacacauuaccacggccgauacaagauauccugacuauucuaugucucaaaggacccuccacggaagguaucuuccgccgagccgcgaacgagaaggcucguaaagaacugaaggaggaacuuaauucuggcgacgccguggaucuggagagauugccuguccaccuccuggcaguuguguuuaaagacuuccugaggucgauuccacggaagcucuuaucaagcgaucuguuugaggaauggaugggggcccuugagaugcaggacgaagaggaucgcaucgaggcuuugaagcagguagcagacaaacugcccagaccuaaccuacuccugcuuaagcaucugguguacgucuugcaccucauaaguaaaaauuccgaagugaacaggauggauucuagcaaucuggccaucugcauuggaccaaacauguuaacccuggagaaugaccagucccucucauucgaagcucaaaaggaccuuaacaauaaaguuaagacacugguggaguuuuugaucgauaacuguuucgaaauuuuuggcgagaauauccccguccauaguagcauaacuucugacgauucccuagagcacaccgacucaagcgaugugaguacacugcagaacgacucugccuaugauuccaaugacccugauguagaaagcaacucgucuuccgguauuucaaguccaagccggcagccgcagguucccauggcgaccgcagccgggcucgacuccgcuggaccucaagaugcccgcgaggugucuccagaacccaucgucagcacuguggcacgacugaagucaagucuugcucagccugacagaagguacuccgagccaagcaugcccucuucacaggaaugccuggagagucgggugacaaaucagaccuugacgaaaagcgagggcgacuucccggucccucguguuggcucccgccucgaaucugaggaagccgaggaucccuuuccagaagagguguucccugcgguacaagggaagacuaaaagacccguggaccugaagauuaaaaacuuagccccaggaucgguccugcccagggcucuagugcucaaggcauuuagcuccucaagucuggaugccucuagcgacuccucaccuguugcuagcccaucuuccccgaaacggaacuucuucagucgacaucagagcuuuaccacaaagacugagaaggguaaacccucucgcgaaaucaagaaacacuccaugucauucaccuuugccccucacaagaaagugcuuacaaagaauuugagugcaggcagcgggaagucgcaggauuucaccagagaccaugucccaaggggagugcggaaagagucccaacuggccggccgcaucguacaggaaaacgguugugagacgcacaaucagacugcuagaggguuuugccucaggccccaugcgcugucuguugaugacguguuccagggagcagauugggagcguccuggcagcccacccucauaugaagaggccaugcaaggcccggcugcccggcuugucgcaagugaaucccagacaguggggucuaugaccgucggaagcaugcgagccagaaugcuggaggcucacuguuugcucccuccacugcccccugcccaccauguggaagacuccaggcaccgcgguucaaaggagcccuuaccaggccaugggcugagcccucuacccgagcgguggaaacagaguagaacuguucacgcaucuggagauucccucggccaugugagcgguccagggaggccggaacugcuuccuuugcgcacaguaucggagucaguccagcgaaacaagcgggacugccuggugcguagauguucucaacccguuuuugaagcggaucaguuccaguacgcuaaagagaguuauauuuga

SEQ ID NO: 63519 - RNA, 663 nt, Artificial Sequence
  derived and/or modified sequence opt3 from TAGLN2__Homo_sapiens__NP_001264153
augagcgccuucucccuggcucucgcacuugugucuucaccccagccuccaccgcccaucggcauggccaacagagggccugcguacggacugaguagggagguccaacagaagauugaaaaacaguaugacgcugauuuggagcagauauuaauccaauggauuaccacacagugccggaaggacguuggucgcccacagcccggccgagaaaauuuucagaacuggcugaaagaugggacugugcuaugugagcucaucaaugcccuguacccugaaggacaagcaccaguaaagaaaauucaggccagcacgauggcuuucaagcagauggagcagaucucccaauuucuucaggcagccgagcguuauggcauaaacaccacagacaucuuccagacuguggaucugugggaagguaagaauauggcuugcguccaaagaaccuugaugaaccucgggggacuggccguggcgagggacgauggccuguuuucuggcgaccccaauugguucccuaaaaagucgaaagagaacccacggaauuuuucagauaaccagcuccaggaagggaagaauguuauuggauuacagauggguacaaaccgcggcgcaagccaagccgggaugaccggauacggcaugccgagacagauccuguga

SEQ ID NO: 63520 - RNA, 606 nt, Artificial Sequence
  derived and/or modified sequence opt3 from TAGLN__Homo_sapiens__NP_001001522
auggccaacaagggccccagcuacgggauguccagagaggugcagucuaaaaucgaaaagaaauaugacgaggaacuggaggaaaggcucgucgaguggauuauaguucaaugcggaccugaugugggucggccagaccgcggccgacuuggguuccagguauggcugaagaauggagugaucuugucaaaauuagucaacagucuguacccggauggcagcaagcccgugaagguuccugagaauccacccuccaugguguuuaaacagauggaacaggucgcucaauuccuaaaggcagccgaggacuauggugugauuaaaaccgauauguuucagacaguagaccucuucgaagggaaggauauggcggcuguucagcguacucugauggcccuuggaucucuggcagugacgaaaaacgacggccacuacagaggcgauccuaauugguuuaugaagaaggcccaggagcauaaaagggaguucaccgaaucgcaauugcaggaggggaagcacgucaucggacuccagauggguucaaaccggggcgcuagccaggcagggaugacaggauauggccgcccaagacaaauuaucaguuga

SEQ ID NO: 63521 - RNA, 996 nt, Artificial Sequence
  derived and/or modified sequence opt3 from TAL1__Homo_sapiens__NP_001277334
augaccgagagacccccuagcgaagccgcuagguccgacccacagcuggagggccgggaugcagccgaagcgucuauggcuccgccccaccucgugcuucugaacggggucgccaaggagacaucacgcgcagccgcugcagaaccuccaguuaucgaguugggagcccgagguggccccgggggaggcccugcuggugggggaggcgccgcgcgugacuuaaaaggcagagaugcagccacugcugaggccaggcaucgggugccaacgaccgaacugugcagacccccugggccagcaccggcucccgccccugcgaguguaacagccgagcuaccaggagacggucgcauggugcaacucagcccucccgcacuggcugccccagcugcccccggcagggcacuucuguacuccuugucucagccgcucgccucgcuggggucaggauucuuuggcgaaccugaugcuuuccccauguuuacuaccaauaaccgggucaagcgccgaccaagcccuuaugagauggagauuacagacgguccccacaccaaagugguuagaaggauauucacuaauagucgggaacguuggcgccagcagaacgugaauggggcguuugcagagcugagaaagcucaucccaacacaucccccugauaaaaaguuauccaagaacgaaauucugaggcuugccaugaaauacaucaauuucuuggcuaagcugcuaaacgaccaagaggaagagggaacccagcgggccaaaacgggcaaggauccagucgugggcgcagggggagguggcgggggaggcggugggggcgccccgcccgacgaucuccugcaggacguacuuucuccuaauagcuccuguggaucaagucuggauggcgcugccagcccagacucuuauacugaggaacccgcaccuaaacacaccgcgcgauccuugcauccagcuaugcuccccgccgcagacggggccggaccgcgcuga

SEQ ID NO: 63522 - RNA, 327 nt, Artificial Sequence
  derived and/or modified sequence opt3 from TAL2__Homo_sapiens__NP_005412
augaccagaaagaucuucacaaacacuagggagcgguggcgccagcaaaaugugaacagcgccuuugcuaaacugcgaaagcucauucccacgcacccuccagacaaaaagcuguccaaaaaugaaacccuucguuuggcaaugagauacauaaacuucuuagucaagguucugggcgagcagucucuacagcagacagggguggccgcgcaaggaaauauccucggucuguuuccgcagggcccccaucuuccugggcuggaagauaggacuuugcucgagaacuaucagguaccaucacccggaccuagucaccauauuccauga

SEQ ID NO: 63523 - RNA, 1014 nt, Artificial Sequence
  derived and/or modified sequence opt3 from TALDO1__Homo_sapiens__NP_006746
augagcuccucucccgugaagagacagaggauggagucagcccuggaccaacucaaacaguucaccacagucguugcugauacuggcgacuuucacgcaaucgaugaauacaagccucaggacgccacgaccaacccaagucuuauucuggcggcugcccagaugccggcauaucaagaguugguggaagaggccauagcuuacgggcggaaauuaggagguagccaggaagaucagaucaagaaugcaauugacaaacuguucguacuauuuggcgccgagauccucaagaagauucccgggcgcguguccacagaggucgaugcucgacugucuuucgacaaagaugccaugguggcgcgugcaagaaggcuuaucgaacuguauaaggaggccggaauaucgaaagaccggaucuugauuaagcucucaagcacuugggaaggcauccaggcugguaaagagcuggaggaacaacaugggauucacugcaacaugacccugcucuuuaguuucgcccaggcaguugcuugugccgaggcgggagugacauuaaucuccccuuuugucggccgcauacuggauuggcauguggccaauaccgacaagaagucuuacgaaccacuugaggaucccggcguaaaaagcguuacuaagauuuauaacuacuauaaaaaguucuccuacaaaacaaucgugaugggggcaucauuuagaaauaccggagaaauuaaggcuuuggccgguugcgacuuccugacgaucaguccuaaacuacucggcgagcugcuucaggacaacgcuaagcuggucccaguguugagcgccaaggcagcccaggcuucugaucucgagaaaauccaccuggacgaaaaguccuuuaggugguuacauaaugaggaucaaauggcgguggaaaaacugucagacgggauucggaaguucgcagccgaugcugucaaacucgagcgcaugcuuacugaacgaauguuuaacgccgagaauggaaaguga

SEQ ID NO: 63524 - RNA, 951 nt, Artificial Sequence
  derived and/or modified sequence opt3 from TAMM41__Homo_sapiens__NP_620162
auggcccugcagacccuccaaagcuccugggugacauucagaaagauccuuucucacuuucccgaggaacugucauuggcuuucgucuacggcagugggguuuauaggcaggcaggaccuagcuccgaccagaaaaacgccauguuagauuuuguguucacuguagacgauccaguggcguggcauucuaagaaucugaaaaagaacuggucgcacuacucauuucuaaaaguccucgguccgaagauuauaacgagcauccagaauaacuauggcgcugggguguacuauaauagucugauuaugugcaacggacggcuuaucaaguacggcguuauuuccaccaaugugcugaucgaggacuugcucaacuggaauaaccuguauauagccggucgccugcaaaaacccgucaagaucauuucugugaaugaagauguaacacuccgaagcgcauuagaccguaaccugaaauccgccguuacugcugcauuccuuauguugccugagucauuuagugaagaggaucuguucaucgagauugccgggcuaagcuacucuggagacuuuagaaugguggucggcgaagauaagaccaaagugcucaauaucgugaagccaaacauagcucauuucagggagcuguacggcuccauucuucaggaaaauccccaggucguuuauaagucacagcaaggguggcuggagaucgacaaaagcccugagggacaguuuacacaguugaugacccucccaaagacucugcagcaacagauuaaccacaucauggaucccccugguaaaaaccgggacguggaagagacauuauuccagguagcccaugauccagacuguggcgacgugguccgccuggggcucaagaaaagugugaucuacucuucccuuaagcugcacaaaauguggaagggaugguugagaaagaccagcuga

SEQ ID NO: 63525 - RNA, 5586 nt, Artificial Sequence
  derived and/or modified sequence opt3 from TANC1__Homo_sapiens__NP_203752
augcugaaggccgugcucaaaaagagcagagagggcgggaagggagguaagaaagaagcuggcuccgacuucgggcccgagaccucuccuguccuucaccuggaucauucagcagacaguccaguuagcuccuugccgacugccgaagauacuuacagggugucuuuagcgaagggaguaucgaugucacugcccagcaguccucuacucccacggcagucccaccuggugcagucucgcgucaacaagaaaagccccggcccugugcgaaagccaaaauauguugagagcccccgugugccuggugacgcugucaucaugccauuuagagaaguggccaagccgacggagcccgaugagcaugaagccaaagccgacaacgagccuucaugcaguccagcugcacaggaacuucugaccagguugggguuccuccugggagagggcauucccagcgccacccacauaacuaucgaggauaagaacgaaaccauguguacagcucugucucagggcauuuccccuugcucaacccucacuagcaguacagccucuccauccaccgacagccccuguucgacguuaaauucuugcguauccaagacugcggcaaacaaaucaccgugugagaccaucaguagcccuuccucuacacuggaaagcaaggauucagggauuaucgccacuauaaccaguuccagcgagaaugacgaucggucuggaucaagucuugaauggaacaaagacgguaauuugcgccugggcguucagaagggggugcuacaugauagaagggcugacaacugcagccccgucgccgaggaggaaacaaccggauccgcagagucuacgcucccaaaagcugaaucgagcgccggcgacgguccugugcccuacucccaagggucaaguucucugaucaugccacggcccaauagcguggcggccacuuccucaacaaaacuugaggaucugagcuauuuggacggacagcgcaacgcaccucuccgaaccucuauuagacugccauggcacaauacugcuggcggcagggcccaggaagucaaagcucgguuugccccguacaagccccaggauaucuuacugaagccucuccuuuucgagguuccauccauuacaaccgacaguguguuuguagggcgugauuggcuguuccaccaaaucgaggaaaacuugcgcaauacggagcuagcagaaaacagaggagccguggucguggguaauguuggcuuugggaaaaccgcuauaauuagcaagcugguggcgcucucuugucauggauccaggaugcggcagaucgcaucaaacagucccggcagcucgccuaaaacauccgacccaacucaggaucugcacuucacaccccuucugucuccgagcucaaguacauccgccucuagcacugcuaagaccccuuuggguuccauuucagccgagaaccagcgaccacgcgaagacgcagucaaauaucucgccagcaaggugguagcuuaccauuauugccaagccgauaauacauacaccugucugguucccgaguuugugcacaguaucgcagcguuacugugcagaucucaccagcuagcugccuacagggaccuccugaucaaggagccucagcuucaauccauguugagccugcggucguguguccaggaucccguggcagccuucaaacgcgggguccucgaaccacugacuaaccuuagaaaugagcagaagauuccugaagaggaguauauaauccugauugacggcuugaacgaagcugaguuucauaaacccgacuacggagauacgcucucaucuuucaucacaaagauaauuaguaaauuuccagccuggcugaaguuaaucgugaccguuagggcaaauuuccaggaaaucauuuccgcucugccguucgugaagcuaagccucgacgauuuuccugacaacaaagauauccacucugaccugcaugccuauguacaacaccguguccauagcucccaggauauucuuucaaauauaaguuugaacggcaaggcggacgccacucugaucgggaaagugagcucucaccucguucugcgguccuuaggaucauaccuguaucuuaaguugacccucgaucuguuccagcgaggucaccuagugauuaaaagugcuagcuacaaggucgugcccguaucccugucugagcucuaucugcuucagugcaauaugaaguuuaugacacaaucggcauucgaaagagccuugccaauccugaacguggcuuuagccagccuccaucccaugaccgacgagcagaucuuucaggcaauuaaugcgggccacauacagggggagcaaggaugggaagauuuccagcagaggauggacgcccugucaugcuuucuuaucaaacgccgggauaagacuagaauguucugucauccuuccuuuagggaguggcugguuuggcgcgcugacggcgaaaacacagccuucuugugcgagccacgaaauggucacgcacuccuggcuuuuauguucagucggcaggaagggaaacuaaaccgucaacagacgauggagcugggccaccauauucucaaggcccacaucuuuaaaggacugucuaagaaaaccggcauuagcuccucacaucuucaggcauuguggaucggguacucuacugagggacugagcgccgcuuuagcgagucucagaaaucuguacacacccaacgucaagguguccaggcuucugauacuagguggcgccaacgugaauuaucgcaccgaaguccucaacaaugcaccuauccuguguguucaaagccacuuggggcaugaggaaguggugacacuguuacucgaguucggagcuugccuggacggcacuucugaaaacgguaugaccgcccuuuguuacgccgcugcagccgggcacaugaagcugguaugcuugcucacgaaaaagggcguccggguggaucaccuggacaaaaagggacagugugcgcuaguucauucagcucugagaggccacggggauauucuucaguaucuccugaccugcgagugguccccgggaccaccccagccuggcacauugaggaaaagucaugcccugcaacaggcauuaacugccgcugcaagcaugggucacucgucugugguccagugucuccuggggauggagaaggaacaugagguggaaguuaauggaaccgacacacuuuggggcgagacugcccugaccgcggcugccggucgaggcaaguuggaggugugcgaacuccugcuagggcacggagcagccguaucccgcacgaaccggagaggcgucccaccccuguucugugcugccaggcaggggcacuggcaaaucgugcgucuucuccuggagcgcggaugcgaugugaauuugagcgacaaacagggccggacaccuuuaauggucgcagcuugcgaaggucaucugucaaccguugaguuucuccugaguaagggggccgcgcuuucuucccuggauaaagaaggauugagcgcccuaucaugggcaugucugaagggccacagagcugugguacaguaccucguggaggagggugccgcuauugaccagacugauaaaaacggcaggacaccgcuggaccuugcagccuucuauggggaugccgaaaccgucuuauaccugguggagaagggagcuguuaucgaacauguggaccacaguggcaugcgaccccucgaucgggcgauagggugccgcaauacuagcgucgugguugcauugcugagaaagggagccaaacucggcaacgcugccugggcaauggccaccuccaagccagacauucugaucauucuucugcaaaaauugauggaggaagguaaugugauguauaagaaagggaagaugaaggaggcugcgcagagguaccaguacgcccuacggaaauuuccucgagagggauucggcgaagacaugagacccuuuaacgagcugcgcgucucucucuauuuaaaucuguccaggugucgucggaagacaaacgauuucgguauggcagaagaguuugcuuccaaagcccuugaacugaagccaaaaucauacgaggcauucuaugccagagcuagggccaagcgcaauucucgacaauuuguagcggcacucgccgacuugcaggaggcugugaaacugugcccuacgaaccaggaaguuaagagacuccuggcccggguggaggaagaguguaagcagcuucaaaggagucagcagcagaaacaacagggcccccuaccagcuccgcugaacgauucggagaaugaagaggacaccccuacucccggguugagcgaucacuuccauuccgaagagacagaagaggaggaaaccucuccacaggaggaaucagucagccccacaccucgcucccagccaaguucuagcgugcccucauccuacauccguaacuuacaagagggacugcagaguaagggcagaccuguaagcccgcagucucgggcagggauaggaaaaucccucagggaaccaguggcccagcccggccugcuucugcaaccuucaaagcaggcucagaucgucaaaacuagccaacaccucgguucggggcagucugccguucgcaauggaaguaugaaggugcagauuuccagccagaaucccccaccuucacccaugccaggccgaaucgcagcgaccccugccggcuccagaacgcaacauuuggaggggacaggaaccuuuacuacccgggcugguugcggccacuucggggacaggcugggaccgucucagaaugugcgccuacaguguggcgagaacggucccgcccauccacugccuagcaagacaaaaacuaccgaaagacuccuuagucacuccagcgucgcaguggaugcugcacccccaaaucaagggggacuggcaacaugcucugacguuaggcacccugccucauuaacgaguuccggcagcucuggcucgcccucaagcuccauuaagaugaguucuagcaccuccucauugacaaguucuagcuccuuuucagauggguucaaaguacaaggaccggacacacggaucaaggauaaaguggucacccaugugcagagcgguacugcugagcaccguccacgcaacacaccuuucaugggcauaauggacaagaccgcgcgauuucagcagcaaucuaaucccccauccagaaguuggcauugucccgccccugaagggcugcucacgaacacuagcucggcagcuggacugcaguccgccaauaccgagaagccgucucuuaugcagguuggcgguuauaacaaucaagccaaaacaugcucagugagcacccugagugcauccguccacaacggggcucaggugaaggaacucgaggagucuaaaugucagauucccguacacagccaggaaaauaggaucacuaagacagucucacauuuguaccaagaguccaucaguaaacagcagccacacauuagcaacgaagcccaucggucucaccugaccgcggcuaagccuaagcgcucauucaucgaguccaacguguga

SEQ ID NO: 63526 - RNA, 5973 nt, Artificial Sequence
  derived and/or modified sequence opt3 from TANC2__Homo_sapiens__XP_005257260
auguucagaaacagccugaagaugcuccuuaccggcgggaaauccucuaggaagaaucggucaagugacggagguagcgaggaacccccugaucgccgacaguccucuguggacucgcgucaaucaagaagcggccaggggggaaucaguacagaguccgauugcgccuuugaaccagacuacgcugucccgccccugccuguuucugagggcgaugcagaacaggaguuggguccacccccuagcguggacgaggccgcgaacacuuuaaugacgaggcugggguuccuacucggagaaaaaguaaccgaggugcagccaggcgaucaauauuccauggaaguccaggacgagaaucagacaucagcuauuacucagcggauaagucccuguagcacccugacaucuuccaccgccucaccuccagcaagcaguccgugcucuacucuucccccuaucuccacaaacgccaccgcuaaggauuguagcuacggcgcagugacgucgccaacuucuacccuggagucccgcgacucagggauuaucgccacauugacuaguuauagcgaaaauguugagagaaccaaauacgcuggagaauccucuaaggagcucgguagcggcgggaacauuaagcccuggcaaucacagaaaaguuccauggauagcugccuguauaggguggacgaaaauaugacagccucuaccuacucacugaacaagaucccugagcggaaucucgagacggucuuaagucagagcgugcaguccauaccacuguaucuuaugccccgcccgaacucuguagcggcaacuucgagcgcccacuuggaagaucuggcuuaccuagacgagcaacgacauacaccucucagaaccucccugaggaugccccggcagucaaugggaggcgcccguacucagcaagaccuucgcguuagauuugcaccauacaggccucccgauaucagucugaaaccauugcucuucgaagugcccucuauuacaaccgagagcgucuuugugggucgggacuggguguuccacgaaaucgaugcucagcugcaguccucaaaugccagcgucaaccaggggguugugauuguaggaaauaucggcuuuggcaagacggcgauaauuucucgauuaguggcccuguccugucaugggacccgcaugagacaaaucgcaagugacagcccucacgcuucuccaaaacaugucgaugccaacagggagcucccgcuuacacagcccccuuccgcucacucaaguauuacuagcggaucgugcccagguacccccgagaugcggcgcagacaggaagaggccaugaggcgucuggcaucccaggugguugccuaucacuacugucaagcugacaaugcguauacaugcuuggugccugaauucguccauaacguggcagcccuacugugucggucuccacagcucacugcuuaccgagagcagcugcuuagagaaccccaccugcagagcauguugucacucaggaguugcguacaagauccgauggccuccuuucgccggggcguucuggagccuuuagagaaccugcauaaggaaagaaagaucccagacgaggauuucaucauucuaauagacgggcucaaugaagcagaguuucacaaacccgauuauggagacaccaucgugucuuuccugagcaagaugauuggcaaauuuccuuccuggcuuaaguugaucgucacagugaggaccucacugcaggagauaacuaaacuccugcccuuccaccgcauuuuccuugaccgacuggaagagaacgaagccaucgaucaggacuugcaggcuuacauccuccaucggauucacagcaguucugagauccaaaauaacauuucccugaaugguaagauggauaacacgacauuugggaaauuaagcucgcaucugaagacccuaucacagggcucuuaucucuaccugaagcuuacuuucgacuugauagaaaaaggauaccugguccucaagaguuccagcuauaaagugguuccagugucucugagcgagguauacuuacugcaguguaauaugaaguuuccuacccaauccucauucgaucgugucaugccccuuuugaacguggccguugcaagucuccacccacugacagacgagcauaucuuucaggcgauuaaugcuggcagcaucgaagggacccuagagugggaagauuuccagcagagaauggagaaccugucuauguuucucaucaaaaggcgcgacaugacucggauguucgugcacccguccuuuagagaauggcugauuuggagggaggagggagaaaagacaaaguuccuuugcgauccucgaucaggucacacguugcuggccuuuugguucagucgccaagagggcaaauuaaaucggcagcagaccauagaacucgggcaucacauccugaaggcacauauuuuuaaaggacuuagcaagaaagucggcguguccucuucgauccugcaggguuuguggauuagcuauucaacugaggggcucuccauggcccuggcuagucuaagaaaccuguacacacccaauaucaagguaucuaggcuccugauacuuggcggagccaacaucaauuaucguaccgaaguguugaacaacgcaccaauucugugcguucaaagccacuuaggcuacacagagauggucgcucuccugcuugaguucggggccaauguggacgcguccucagaaucuggacugacuccccuagguuaugccgcugcagccggcuaccucagcaucgugguccuguuguguaagaaacgcgcuaagguugaucaccuggacaaaaacgggcagugcgccuuagugcaugcagcgcuccggggacaccuggaggugguaaaguuccuuauucagugugauuggaccauggccggccagcaacagggugucuuuaaaaagagucaugcuauccagcaagcccugauagcagcugccuccaugggguacacggaaauugugagcuauuugcucgaccugccugagaaggacgaggaagagguugaaagagcacagaucaauucuuucgauucacuauggggcgagaccgcccugacagcugcggccggaaggggcaaacuugaagugugccgacuccuguuggagcagggggcagcugucgcccagccaaaccggcgcggagccgugccccuguuuuccacuguuagacaaggccacuggcagauuguggacuuacuccugacccauggugcugauguaaauauggcagacaagcaggggaggacaccucuuaugauggccgcgagugagggacaccugggcacugucgauuucuugcucgcucagggugccagcaucgcacugauggacaaagaaggccuaaccgcccugucgugggcuugucuuaaggggcaccucucuguggugcggucccuggucgauaacggagcagccacggaccaugcggauaaaaauggccgaacaccguuggacuuagcugccuuuuacggggaugcagagguugugcaauuccugguagaccacggagccaugauagaacauguggauuauagcggcaugagaccacucgaccgcgcugucgguugcaggaacaccucagugguugugacucugcuuaagaaaggggccaagaucggacccgcaacaugggcuauggccaccaguaagccugacauuaugaucauucuguugucuaaacuaauggaggaaggcgauauguuuuacaagaaagguaaggucaaagaggcggcccagcguuaucaguacgcacugaagaaguucccacgggagggcuuuggggaagaccucaaaacuuucagagagcugaaggugucccuuuuacugaaucucagcaggugucgccgaaaaaugaacgauuuuggaauggcugaagaguucgccaccaaggcuuuggaacugaaacccaagucauaugaggcauacuacgccagagcccgggcuaagaggaguagccgccaguuugcggcagcccucgaggaccugaaugaagcuaucaaacuuugcccuaacaaucgugagauacaaagacuguugcuacggguugaagaggaguguaggcagaugcagcagccgcaacagcccccaccucccccacagccucaacagcagcugcccgaagaggccgaaccagagccgcagcacgaagauauuuauuccgugcaagacaucuucgaggaggaauaccucgagcaggaugucgaaaacguaucuaucggcuuacagacagaggcacgcccuagccaggggcugcccgugauucaauccccacccucaucuccuccacaucgagacagugccuauaucucgagcuccccccuuggaucucaccagguuuucgauuuuagaucaagcuccagugugggcucuccuacgcggcagaccuaccagagcacuucaccggcucuguccccaacacaccaaaauagucauuauaggcccagcccuccccacaccucuccagcgcaucaggguggguccuaccgcuucucaccucccccagucggaggccaggguaaggaauauccuagcccgcccccaucgccucucagaaggggcccccaauaccgggccucuccaccugcagagaguauguccguguaccguagccagucagggucccccguacgcuaucagcaggagacaucugugagccaauugccgggacgaccaaaaaguccucuguccaagauggcucagagacccuaccagaugccacagcuccccgucgccguuccucaacagggccugaggcuucagccggcaaaagcccagauugugcggagcaaccaacccucuccagcugugcacucaaguacugucauaccuaccggggccuauggacagguggcgcacuccauggcaagcaaguaccagucuucgcagggcgacaucgguguuucacaaagccgccuaguauaucagggguccauuggaggcaucgugggcgaugggagacccguccagcaugugcaagccagucugucugcuggagccauuugccagcacgguggcuugacgaaggaagacuuaccucagaggccaagcuccgcuuaccgggggggaguucgauauucacagacaccccaaaucggcagaagucagucugcaagcuacuacccugugugucauuccaaacuggaccucgagcgcucaagcucucagcuggguuccccagaugucagucaccuuauaaggcggcccaucagcgugaacccgaaugaaauuaagccucauccacccaccccucguccacugcuccacucgcaguccguaggguugagauuuucucccucaagcaacaguaucuccucuacuagcaaucugaccccgacauucaggccuucauccaguauucaacagauggagaucccccuaaaaccagccuaugaacgcagcugcgacgagcugucuccugucucacccacucagggaggcuacccauccgagcccacccggagccgaacaacgccuuuuaugggcauaauugauaagaccgcuagaacucagcaauauccacaccuccaucagcagaacaggacaugggccgugucuaguguugacaccgugcuuucgccgacuucccccgggaaucugccucaaccagaaagcuucucacccccuucuagcaucuccaacaucgcauuuuacaauaaaacaaacaaugcgcagaacggacacuuauuggaggaugacuauuacaguccacaugguaugcuggccaauggcucacgcggggaucuccuggaacgggucucucaggcuagcuccuaucccgacgugaagguugccagaacccuuccuguggcacaggcuuaccaagauaaccuguaccgucagcucaguagggacagccggcagggacagacguccccgauuaaaccaaagcgccccuucgucgagucuaauguguga

SEQ ID NO: 63527 - RNA, 831 nt, Artificial Sequence
  derived and/or modified sequence opt3 from TANGO2__Homo_sapiens__NP_001270045
augugcaucauuuucuuuaaguucgaccccagaccugugagcaaaaacgccuacaggcugauacucgcugcaaaucgggaugaauuuuauucccgcccaucuaaacuugccgacuucuggggcaacaauaacgaaauccugucaggguuggauauggaggaaggaaaggaggguggcaccugguuagggauuaguacacgaggaaagcuggcggcucuaacuaauuaccuccagccgcagcuggacuggcaggcccguggcagaggugaacuugucacgcacuuucugaccacagauguugacagcuuguccuaucucaaaaaggugucuauggaggggcaucuguacaacggauucaaucugaucgcagccgaucucucgacugcuaagggcgacguaauuuguuauuacggcaacaggggagagcccgauccuaucguguuaaccccagggacauauggucugucaaaugcacuuuuggaaacccccuggcggaaacugugcuuuggcaagcagcuauuccucgaggccgucgaacgcagccaggcucugccuaaagacgugcuuauagccagucuguuggauguucucaacaaugaggaggcgcaacugccagaccccgcaaucgaagaucaagggggagaguacgugcagccuauguuauccaaguacgccgcugucugugugagaugcccaggcuaugguacuaggacaaacaccauuauccugguagacgccgacgggcacguuacguuuacugaacggucuaugauggauaaagaccucagccauugggagacccgcacauacgaguucacucuucaguccuga

SEQ ID NO: 63528 - RNA, 1278 nt, Artificial Sequence
  derived and/or modified sequence opt3 from TANK__Homo_sapiens__NP_004171
auggacaagaacaucggcgagcagcugaauaaagccuacgaggcuuucagacaagcaugcauggauagggacagcgccgugaaggaacuccagcagaaaaccgaaaacuaugagcagcggauucgcgaacaacaggagcagcuuucccugcagcaaacaauaaucgauaaguugaaaucucaguuacugcuagucaauucaacucaggacaacaauuacggguguguuccccuccuggaggauagugaaacgcgaaagaacaaucuuacccuggaccagccucaagauaaggugauuagcggaaucgcgcgugagaaauugccaaagguaagaaggcaggaaguguccucuccgcggaaagagacaucggcucgcucacucgguagcccccugcugcacgagagaggcaacauugaaaagacuuuuugggaccucaaagaggaguuccauaagaucugcauguuagccaaggcacagaaagaucaccugaguaagcugaauauaccugacaccgccacagaaacccaauguuccgucccaauccagugcacugauaaaacagacaagcaggaggcuuuguuuaaaccccaggcaaaggaugacauuaacaggggagccccuucuaucaccagcgugacgccacgggggcugugucgcgacgaagaggauacuuccuucgaaucacuaaguaaauuuaauguuaaguuucccccuauggacaacgauagcaccuuccuccauucuacaccagagcgaccgggcauucugucccccgcuacuucagaagccgugugccaagagaaguucaauauggaauuuagagacaacccugguaauuucgucaaaaccgaggagacacuuuuugaaauccaggggauagauccaauugcgagcgcaauccagaaccugaagaccacggacaaaacuaagcccaguaacuuggugaauacauguauuaggaccacucucgaucgggccgcuugccugccuccaggagaccacaacgccuuauauguaaauucuuucccccugcucgauccguccgacgcaccuuuucccagccuugauucgccaggcaaagcuauccguggcccucagcaacccaucuggaagccauuccccaaccaggacucugacuccguugugcugucagggacagauagugaguugcauauuccucgcgucugugaguucugccaggccguguuuccaccgagcauaaccuccagaggagacuuccuaaggcaccuuaauucucacuuuaacggugaaacguga

SEQ ID NO: 63529 - RNA, 2562 nt, Artificial Sequence
  derived and/or modified sequence opt3 from TAOK1__Homo_sapiens__NP_079418
augcccagcaccaacagagccggcucccugaaggacccugagaucgcugaacucuucuuuaaagaggauccagaaaaacuuuucacagaccugagggagauugggcacggaucuuuuggugcaguguacuucgcccgggauguccgcacuaaugaaguuguggcgaucaaaaagaugucauauaguggcaaacagagcacggagaaguggcaagacaucauuaaggagguaaaauuuuugcagcgaaucaagcauccgaacuccauugaauacaaagggugcuauuuacgugagcacaccgcuuggcuggugauggaauacugucuaggaucugccucggaucuccuggagguccauaagaaaccccuucaggagguggaaaucgcagccauaacacacggcgcucugcaggguuuggcauaucuccauucacacacuaugauccacagagacauuaaggccgggaauauccugcugaccgagccuggacaaguuaagcucgcugauuucggcagcgccaguauggcguccccagcaaacucuuuugugggcacacccuacuggauggccccugaagucauuuuagcuauggacgaggggcaguaugauggaaaaguggacguauggagccuggguauaaccugcauagaacuugccgagaggaagccacccuuguucaauaugaacgcaauguccgcucuguaccauauugcccagaaugagucaccuacucuacagaguaacgaauggagcgauuacuuucggaauuucguugacucuugucuccaaaagaucccacaggaucgcccgacauccgaggaacugcuuaagcacauuuuugugcugagagagaggcccgaaaccgucuugaucgaccucauccagcggacgaaagacgcggugcgcgagcuggauaacuuacaguaucgaaagaugaaaaagcugcuuuuccaagaggcccauaauggcccugcaguggaagcucaggaggaagaggaggaacaggaccacggggucggaagaacuggcaccguuaacucaguggguagcaaucaaaguauuccaucuauguccauaagcgccucgucucaguccucaaguguaaacagccuucccgauguguccgacgauaagucugagcuggacaugauggaaggggaucacacagucaugagcaauucaagugugauccauuugaaaccugaggaagagaacuacagggaggaaggagacccacggacucgugcuuccgauccccagagcccgccucagguuucucgccacaagucacauuauagaaacagggagcacuuugccaccauucggacagcaagucuagugacccgacaaaugcaggaacaugagcaggacagcgaacugcgcgagcagauguccggcuacaaaagaaugaggcggcaacaccagaagcagcucaugacgcuggagaauaaacuuaaggccgaaauggaugagcaccgccugagauuggacaaggaccucgaaacucagaggaacaauuucgcugcggagauggaaaaacugaucaagaaacaucaagcagccauggagaaggaggcuaaagucaugucuaacgaagagaagaaguuccagcagcacauacaggcccaacagaaaaaggaauuaaauucguuucuggagagccagaaacgugaauauaagcuacggaaagagcaacucaaggaguccaaggaacugcagauuaaaaagcaguuccaggauacaugcaaaauccaaacccgacaguacaaggcacuuagaaaccauuugcuggagacuacacccaaaucagaacacaaggccgugcucaaaaggcugaaggaggagcagacccgcaagcucgcuauccuggccgaacaguaugaccacaguauuaaugagauguugucuacgcaagcacuccggcuggaugaagcgcaggaggcugaaugucagguauuaaaaaugcagcugcaacaggagcuagagcuccugaacgccuaccagagcaagaucaaaaugcaagcagaagcccagcaugacagagagcuuagggaauuggagcagcgcguuucccugcgacgggcucuccuggaacagaagauugaggaggaaauguuagcccugcaaaaugagcguaccgaaagaauaaggucacuuuuggagcgccaggcacgggaaaucgaggcuuuugauagcgagucuaugagacucggcuucuccaacauggugcugaguaaucuaagcccagaagccuuuucucacuccuacccuggggcgucaggauggagucauaaccccacagguggcccagggccccacuggggacauccuaugggcgguccaccgcaggccugggggcaccccaugcagggcggaccucaaccauggggccaccccagcgggccuaugcagggagucccaagggguucguccaugggcgugcgaaauucuccccaggcucugcgccggacugcaagcgggggaagaaccgagcagggcaugucaaggaguacauccgucacuucucaaauuagcaacgguucccauaugucauauaccuga

SEQ ID NO: 63530 - RNA, 3369 nt, Artificial Sequence
  derived and/or modified sequence opt3 from TAOK2__Homo_sapiens__NP_001238972
augcccgccggcgggagagcuggaagccugaaggacccugauguggcagaacucuucuuuaaagacgauccagaaaaacuuuucuccgaccugagggagaucggucacggcucuuuuggggccgucuacuucgcgcgggauguucgcaacucagaagugguagcuauuaaaaagaugaguuauagcggaaaacaguccaaugagaaguggcaagacauaaucaaggaagugcgauuuuugcagaaauuacgucacccgaacaccauucaguacagaggcugcuaucugagggagcacacagccuggcuagucauggaguacugucucgguucugcaucggaucugcuugaagugcauaagaaaccccugcaggagguugaaaucgccgcugugacucacggggcauugcaaggacucgccuaucugcauucacacaauaugauucaccgggacgucaaggcuggcaacauccugcucagcgagccuggcuuagugaaacugggggauuucggaagugccuccauaauggcgccagcaaauucuuuuguagguacgcccuacuggauggccccugagguuauccuugcuauggacgaaggccaguaugaugggaagguggacgucuggagcuugggaauuaccugcaucgagcuggccgaacgcaagccaccccuauucaacaugaaugcaauguccgcucucuaccauauugcccagaacgagucaccugugcugcagaguggccacuggagcgaauacuuuagaaauuucguggauucuugucuucaaaagaucccacaggacaggccgacauccgagguccuguugaagcaucgguuuguucuccgcgagcgacccccuacugugauaauggaccugauucagagaaccaaagaugcgguaagggaauuagacaaccugcaguaucggaagaugaaaaagauccucuuccaagaggccccaaauggucccggggcagaagcuccugaggaagaggaggaagccgagccauacaugcaccgugcuggaacacuuaccucacuggaaagcagucacucugugcccuccaugagcauuucggccucuucccagucaaguagcgucaacuccuuggcagaugccucugacaaugaggaagaggaggaagaggaagaggaggaagaggaagaggaagagggcccggaggcucgcgaaauggcgaugaugcaggagggcgaacauacugugacaagccacucaaguaucauccauagacuaccuggguccgauaaccuguaugacgaucccuaccaaccagagauuaccccuagcccccuccagccacccgcagccccugcuccaacgucuacuaccucaagugccaggcggcgagcauauugccgcaauagagaccacuuugccacaauaaggacugcuagccugguuucccggcagauccaggaacaugagcaagauucugcccuucgcgagcagcugucgggauacaaaagaaugaggcgucagcaccagaagcaauugcucgcacuggaaagccgguuacgaggugagagagaggagcacuccgcgaggcugcagcgcgaacuagaggcucagcgggccggcuucggggcagaggccgaaaagcucgcuagaaggcaucaggccauuggagagaaagaagcacgcgcugcccaagcggaggagcgaaaguuccagcagcacauccugggccagcagaaaaaggaacuugccgcuuugcuggaggcacaaaaacggaccuauaagcuccguaaggaacagcugaaagaggaacuucaagagaacccgucaacacccaagagagagaaagccgaauggcuguugaggcagaaggagcagcuccagcaaugucaggcugaagaggaagccggucuguuacgccggcagagacaguacuuugagcugcaaugcaggcaguacaaacgaaagaugcuacucgcacgccauagucuggaccaggaucuuuugcgggaggaccugaacaagaaacagacccaaaaggaccucgaaugugcgcuguuacugagacagcacgaggccacgagggaacuugaguugcgucagcuccaagcugugcagcgcacucgggccgaacugacaagacuacagcaccagaccgagcuggggaaucaacucgaguauaacaaaaggcgagaacaggagcugcggcagaagcaugcagcucagguccgccaacagccuaaaucucuuaaggaaagaagcauagugggccaggaggaggccggaacuugguccuuguggggcaaggaagaugagucacuguuagacgaagaguucgaacucggguggguacagggaccagcacugacacccguuccugaggaggaagaggaagaggaagagggugccccaauuggcacccccagggauccgggggacggaugcccuagcccagauauucccccugagcccccaccuacgcaccuucggcccuguccagcuucucaacugccgggcuugcucucccauggucugcuagcggggcugaguuuugccgugggcucuagcuccggacuccugccucuuuugcuguuacuccugcuuccccugcuagcagcucagggcgggggaggucuccaggccgcccuguuggcucuggaagucggcuuaguggggcucggagcaucauaccugcuucugugcaccgccuugcaccucccaaguagccuguuccuacugcuugcgcagggcacagcucucggugccguccugggguugucguggcgaagaggccugaugggagugcccuuaggccucggggcagccuggcugcuugcuuggccuggacuggcauugccacucguugccauggcggcuggcggucgcugggugaggcaacaggggccccguguacggagaggaaucuccaggcuguggcuacgcguccugcuucgacucucuccuauggccuuuagagcacugcagggcuguggugccgugggcgaccggggguuguucgcuuuauauccgaaaacuaauaaggauggauuuaggagccgccugccaguucccggcccucguagacggaacccaaggaccacacaacauccccucgcccugcuugcacgcguguggguccugugcaaaggguggaauuggcgauuggcuagagccucacagggacuagcgagucaucugccuccgugggccauccacacucucgcauccuggggccugcuucggggugagaggcccacccgcaucccaagauuacugccuaggucucagcggcagcucgggcccccagcuagccgucaaccuuugcccggaacacuggccggccgccgauccagaaccaggcagucacgggcucucccaccguggcgcuga

SEQ ID NO: 63531 - RNA, 2697 nt, Artificial Sequence
  derived and/or modified sequence opt3 from TAOK3__Homo_sapiens__NP_057365
augagaaagggcgugcugaaagaccccgagaucgccgaucucuucuacaaggacgauccugaagaacuuuuuauugggcugcacgaaauaggacaugguagcuucggcgcugucuauuuugcaaccaacgcccacacauccgagguuguggcgaucaaaaagaugucuuacucagggaaacagacucaugaaaaguggcaagacauuuugaaggagguaaaauucuuaaggcagcugaagcacccaaauacgaucgaguauaaaggaugcuaccuaaaggaacauaccgcuuggcucgugauggaguauugucugggcagugccagcgaucuucuggaaguccacaaaaagccguugcaggagguggagauugcagccaucacacacggugcucuccaugggcuggcauaccugcacucccaugcccucauacaccgggacaucaaggcuggaaacauuuuacugacugaacccggccagguuaaacuugccgauuuuggcucugcgucgauggcaagcccugccaauucauucguggggaccccauauuggauggcucccgaggucaucuuggccauggacgaaggacaauacgaugguaagguggacauuuggagucugggcaucacaugcauagagcuagcagaacgcaaaccuccacucuuuaacaugaaugcuauguccgcccuguaccacauugcgcagaacgauucucccacccuucagagcaaugaguggacugacuccuuccgacguuuuguagauuauugucugcagaagaucccucaagagagaccaacaucagccgaauugcucaggcaugacuucguucggcgcgacagaccgcugaggguguuaauugaucugauccagcggaccaaagacgcaguccgcgagcucgauaaccuucaguaccgaaagaugaaaaagauccuguuucaggaaacgagaaaugggcccuugaacgagagucaagaagacgaggaggauagcgaacacggaacuucucuaaauagggagauggacucccugggcucaaaccauagcauuccuaguaugucuguguccaccgguagccagucgucuuccgucaauucaaugcaggaagugauggaugagaguagcuccgaacucguuaugaugcacgacgaugagucuacaauaaacagcucaaguuccgugguacauaagaaagaccacguguucauccgggaugaggcugggcacggagacccacgucccgaaccucgcccaacucaaagcguccagucucaggcccugcauuauagaaauagggagcgguuugcuaccauuaagucagccagucuugugacacgacagauccacgaacaugagcaagagaacgaacugcgcgagcagaugagcggcuacaaaagaaugaggcggcagcaccagaagcaauugauagcacucgaaaacaaacugaaggccgagauggacgaacaccgcuuaaagcugcagaaagagguugagacccaugcuaauaacuccucuauugaacuagagaagcucgcgaaaaagcaaguggcaaucaucgaaaaagaggccaaggucgcugccgcagaugaaaagaaauuccagcagcagauucuggcccagcagaagaaagaccuuacgacuuucuuggagucgcaaaagaaacaguauaagaucugcaaggagaaaauuaaggaagagaugaaugaagaucacagcacacccaaaaaggagaaacaggaaagaauauccaagcauaaagagaaccugcaacacacccaggcugaggaagaggcccaucuccugacucagcagaggcuuuacuaugacaagaauugucgguuuuucaagcguaaaaucaugauuaagcgacacgaaguggagcaacagaacaucagagaggaacugaauaaaaagaggacacagaaagagauggaacacgcaauguugauccgccaugaugagucaacccgggaacucgaguacagacagcugcacacguuacaaaagcugaggauggaccuaauucgccuccagcaucagaccgagcuggaaaaccagcuugaguacaauaagcgacgggaacgugaguugcacagaaaacauguaauggaacugaggcaacagccgaagaaccucaaagcgauggagaugcagauaaagaaacaauuucaggauacaugcaagguucagacuaagcaguauaaagcucugaagaaucaccaauuagaggugaccccuaaaaacgaacacaagacaauccugaaaacucuuaaggacgagcagacccgcaaguuggccauucucgcagaacaguacgagcagaguaucaaugaaaugauggccucucaagcucugcggcuagaugaggcccaggaggcagaaugucaggcucugagacuccagcugcaacaggagauggaacuuuugaacgccuaucagagcaaaauuaagaugcagacagaggcgcaacaugagagggaacugcagaaauuagagcagcgagucucccuccgccgggcccaccuggaacaaaagaucgaggaggagcuugcugcacugcagaaagagagaucagaaaggauaaagaauuugcucgagcgucaggaacgcgagaucgaaaccuucgacauggagagccugcggaugggcuuugggaaccuagugacucuggauuuccccaaagaggacuacagauga

SEQ ID NO: 63532 - RNA, 2427 nt, Artificial Sequence
  derived and/or modified sequence opt3 from TAP1__Homo_sapiens__NP_000584
auggccgagcugcucgcuagcgcaggcuccgccugcucuugggacuuccccagagcgccuccaucauuuccgcccccugcugccaguaggggagggcuugguggcacccggagcuuccgcccacaccgaggggcagaaucuccccguccuggaagagauagggacggcgugcgggucccaauggccuccucgcgcugucccgcuccuagagguuguaggugccugccaggggcaucauuggccugguuaggaacaguucugcuacuccuggcugauugggugcuucugcggacugccuugccgcgcaucuuuagccuccugguacccacggcgcugccucucuuacgagugugggcagucggccugaguagaugggccgugcuuugguugggcgcuugcgggguucugagggccaccgugggauccaagucugagaacgcuggugcacagggcuggcuagccgcgcucaaaccacuggccgcagcucuugggcuggccuugcccggacucgcucuguuccgggaauuaauuagcuggggcgccccugguuccgcagacucaacacgucugcuccauugggggagucacccaacugccuuugucgugagcuacgcugcggcacuucccgccgcugcccuguggcauaaguugggaucucuauggguaccgggcggccaagggggauccgguaauccuguucgcagacugcucggcugucuggggucagagaccaggcggcuuagccuguucuuggugcucgucgugcugaguucuuuaggagaaauggcaauacccuuuuucacaggccgacugaccgauuggauccuacaggacgguuccgccgauacuuuuacacgcaaccucacccugaugagcauucuuacgaucgcuucggccguguuggaguucgucggggacggcauuuauaauaacacuaugggacacguucauucucaccuccagggcgagguguuuggggcaguacucagacaggaaaccgaguucuuucaacagaaucagacaggaaacaucauguccagggugacugaagauaccucaacacugagugacagccuuuccgagaaucugucuuuguuccucugguaccugguccgggguuuaugccugcuaggcauaaugcucugggggagcgugucacugaccaugguuacgcuuaucacuuugccacugcuguuccuguuaccuaaaaaggugggaaaaugguaucagcugcuugagguccaagugcgcgaaaguuuggcgaaguccagccagguagcuauugaggcccucucugcaaugcccacaguuagaucauuugccaacgaagagggcgaagcucagaaguucagggagaaacugcaggagaucaagacccuaaaucaaaaagaagccguggcauacgcugucaacaguuggacuacaagcauuuccgguaugcugcucaagguggggauccuguauauaggcggacagcuugucaccucuggcgccgugucgagcgggaauuugguuacguuugugcuguaccagaugcaauucacccaggcgguagaggucuuacucuccauuuauccacgugugcagaaagccguuggaucaagugaaaagaucuuugaguaccuggaucggacaccccgauguccuccaucuggucuucugacuccguugcaccucgaaggccuggugcaguuccaagacgucagcuuugcuuaccccaacagaccugaugugcuaguacugcaggggcucaccuucacacugaggccaggagaggugacugcacuuguuggccccaaugguuccgggaagucaaccgucgccgcuuugcugcagaacuuauaucagccuacaggcggacaacuccugcuugacggcaaaccacugccccaguacgagcaucgcuaucuacacagacagguggccgcaguggggcaggaaccgcaagucuuuggacggagccuccaggagaauauugcguacggccugacccagaagccuacuauggaagagaucacggccgcugccguuaaaucuggugcacauuccuucaucaguggguugccacagggauaugacacagaaguggaugaggcuggcagccaacugucugguggccagaggcaggccguggcauuagcccgcgcucucauucgaaagcccugcguacugauacuugacgaugcgaccuccgcccuggacgcaaacucacaauugcaggucgagcagcuccuguacgaaaguccugagcgguauagccguucggugcuacugaucacucagcaccuuucccucguugaacaagcugaucacauucuguuuuuggaagggggagccaucagagagggcgggacccaucagcagcugauggagaaaaagggauguuacugggccauggugcaggcucccgcagacgccccagaguga

SEQ ID NO: 63533 - RNA, 2112 nt, Artificial Sequence
  derived and/or modified sequence opt3 from TAP2__Homo_sapiens__NP_000535
augagacugcccgaccucaggccuuggaccagccuucuguugguggaugccgcuuuacuguggcuacuccagggcccacuggggacacuucugccgcaaggauugcccggucucuggcuggagggcacucugcggcucgggggauuauggggccugcuuaaguugcgcggucugcuaggguucgucggaacgcuccugcuuccucugugcuuggcaaccccacucacaguuucccugcgagccuuaguggcgggcgcuucucgugcacccccugccagaguagccucagcuccauggaguuggcugcucgugggcuacggggcagccggacuuagcuggucccugugggcugucuugucucccccuggugcccaggaaaaagagcaggaccaggugaauaauaagguucuaauguggaggcugcucaaacugucgcggccagaucuuccgcuguugguggcggcauuuuucuuucucguccuggccguguuaggcgaaacucugaucccccacuauucagggcgcguaauugacauacuaggaggcgauuucgacccucaugcuuuugccagcgcaaucuucuuuaugugucucuucaguuuugguuccucucugagcgcugggugcagaggaggcuguuucaccuacacaauguccaggauuaaccuucggauccgcgagcaauuguuuucaagucugcuccgacaggaucugggcuucuuucaggaaaccaagacuggggagcuuaauagcagacugucuuccgacacaaccuugaugucaaacuggcucccacugaaugccaacguuuuacugaggagccuagugaaagucgugggacucuaugguuucaugcugaguauuucuccccggcuuacguugcugucccuccugcacaugccuuucacuaucgcggccgagaagguguacaauacccgucaucaggaagucuuacgcgagauacaagaugcaguugcuagagccggccaggugguaagggaagcugucgggggacugcagacagugcggagcuuuggcgccgaggagcacgaagugugccgauauaaggaggcacuugaacagugucgccaauuguacuggagaagggaccucgagcgggcccuguaucuacugguucgcagagugcuccaucuggguguccagaugcuuauguugucgugcgggcugcagcaaaugcaggauggcgaauuaacucagggaucucuccuguccuucaugaucuaccaggagucagugggcaguuacguacaaacccuuguuuauauuuacggggacaugcugagcaacgugggagcugcggagaaagucuuuuccuauauggauaggcagccaaauuugcccucuccggguacacucgcaccuaccacgcugcagggcguggucaaguuccaggacgugagcuuugccuaccccaaccguccagaccggccuguucuaaaagggcugacuuucacacuccgacccggagaagugaccgcucugguaggcccaaaugguucagggaagaguacugucgccgcacuuuugcaaaaccuguaucagcccacaggcggacagguguuacucgaugagaaaccuaucucccaguacgaacacuguuaucugcacagccaaguugugucugucggccaggagccagugcuguuuucagggaguguaagaaauaacauugccuacggacuucagagcugcgaagacgauaaggugauggcugccgcacaggcggcucaugccgacgauuucauccaagagauggagcacgguauauacaccgacguuggcgaaaaggggucccagcuagcagccggacagaaacaaaggcucgcuauugcccgcgcacugguccgggauccgagaguguugauccuggacgaggcuacgucugccuuagaugugcagugugaacaggcgcuccaggacuggaacucgaggggcgaucgcaccguccugguuauugcccaucgacuucaagcugugcagcgggcacaccagauccugguguugcaggaggguaagcuccaaaaacuggcccagcuacaggaagggcaggaccuguauagccgucuuguacaacagagacucauggacuga

SEQ ID NO: 63534 - RNA, 1347 nt, Artificial Sequence
  derived and/or modified sequence opt3 from TAPBP__Homo_sapiens__NP_003181
augaaaagccugucccuccuucuggccguggcuuugggcuuagcaaccgccgucucugcggggcccgcuguuaucgagugcugguucguggaagacgccucaggaaagggucuggcaaagagaccuggcgcccuacuccugaggcaggggccaggagagccgcccccucggccagaucuugaccccgaacuguacuugaguguacacgauccugcuggcgcacuccaagccgcuuuucgccgauauccacguggugcccccgcgccucauugugagaugagcagauucgugccacugccggcauccgccaaaugggcuucugggcugacacccgcccagaacugcccuagggcacucgacggagcuugguuaauggucucgauuucaagcccagugcugagucuuuccucuuugcugcggccccagccugaaccacagcaagagcccguucuaauaacuauggccacggugguccucaccgugcugacacacacuccggcgccucgcguaagacuuggccaggaugcccuguuggaccucagcuuugcauacaugcccccaaccuccgaggcugccucaagucuggcuccugggcccccacccuucggcuuagaauggaggcggcagcaucugggaaagggucaccuccuucuggccgcaacaccuggcuugaaugggcagaugccagccgcucaagagggagcgguugcauuugccgcuugggaugacgaugaaccguggggccccuggaccgguaacgggacuuucuggcuaccuacagugcagccauuucaggagggaaccuaucuggccacgauccaucuccccuaccugcagggccaagucacucuugagcuggcaguguauaaaccuccaaaggugagcuugaugcccgccacccucgcucgcgccgcaccgggcgaagcgccuccagagcuguuaugucuggucucucacuucuaccccuccgggggacuagaaguugagugggaacuccgagguggcccugggggaagaucacagaaggcugagggccagagguggcugagcgcccuucggcaccauagugacgguucuguguccuugagcgggcaucugcaacccccaccuguaacaacugagcagcacggcgcacguuaugccugccgcauucaccaccccucgcucccagcuucuggaagauccgccgaagugacccuggaggucgcaggccuuucagggccgagucuggaagauagcgugggauuguuucucuccgcuuuccuguuacugggucuauuuaaagcccucggcugggcggccguuuaccugucuacauguaaggacagcaaaaagaaagcugaguga

SEQ ID NO: 63535 - RNA, 1407 nt, Artificial Sequence
  derived and/or modified sequence opt3 from TAPBPL__Homo_sapiens__NP_060479
augggcacccaggagggguggugccugcuccuuugucuggccuugagcggagcugcagaaacaaagccccacccugccgagggucaauggagagcgguggacgucguuuuagauugcuuccuggcuaaagacggcgcccaucguggggcacuagccuccucugaagaucgggcucgcgcaucacucgugcugaagcagguaccagugcuugacgauggaagucuggaggacuuuacugauuuccagggcgguacguuggcccaggacgauccgcccaucauuuuugaagcuagcgucgaccucgugcaaauaccucaggccgaggcgcugcugcacgcagauuguuccgggaaagagguuaccugcgaaaucucucgauacuuccuccagaugacagagacuaccgugaagacagccgcuugguuuauggccaacaugcaggucucgggaggcggcccaucaauuagcuuagugaugaaaacccccaggguaacuaagaaugaagcacuguggcauccuacacuuaacuugccacugaguccccaagggaccguuagaacggcuguggaguuccaggucaugacucagacccagucccuaucuuuucuccugggaagcuccgccucacuugacugugguuucaguauggcgccuggccuggauuugaucagcguggaguggaggcuccaacacaaggggcggggacagcugguguauucuuggacagccggccagggucaagcaguccgcaaaggggcuacuuuagaaccagcccagcugggaauggcuagagacgccucccucacccuuccgggccugacaauucaggacgagggcaccuacaucugccagauaacgacuucauuguauagggcacaacagaucauucagcuaaauauccaggccagccccaagguucggcugagucucgcuaacgaagcgcugcuuccuacacugauuugugauaucgcaggguacuauccauuggacgugguagugaccuggacucgcgaggaacucggagguucucccgcccaagucuccggcgcuagcuuuucgucucugcgacaguccguggccgggacauacucaauaaguagcuccuuaaccgcagagccuggaucugccggcgcuacguauaccugccagguuacacauauuagccuggaggaaccacuaggugccucaacucagguggugcccccggagagaaggaccgcacucggggucaucuucgcgaguucccuguuucuuuuggcucugauguuccucggccugcaacggcgucaggccccuacaggacuuggccuguugcaggcagaacgcugggagacuaccagcugugccgauacacagucuucacaccuccacgaagacagaaccgcuaggguaagucaacccagcuga

SEQ ID NO: 63536 - RNA, 4866 nt, Artificial Sequence
  derived and/or modified sequence opt3 from TARBP1__Homo_sapiens__NP_005637
auggagugggugcuggccgaagcucuccuuagccaguccagagaccccagggcacuguugggcgccuuaugccaaggggaggcgucugcugaacgggucgagacccugcgcuuccuacuccagcgacuggaagaugaggaggcccguggaucagguggcgcaggggcccuuccugaagcugcaagagagguugccgcuggauaccuggugccauugcucaggagucugcggggccgcccggccggugggcccgacccuagccugcagccaagacacaggcggcgcguacuccgagcggcaggagccgcuuuaagauccugugugaggcuggccggccggccccagcuugcagcugccuuggcggaagaggcccugcgugaucuacucgcaggcuggcgcgcuccuggggccgaggcugccgucgaagugcuggcagccguuggaccaugccuuagacccagggaggacgguccucuguuggaacggguggcuggcacagcggucgcacucgcccuugggggaggcggugauggggacgaggcuggaccagccgaagaugcagccgcuuuaguggccggccgacugcucccgguacuuguucaauguggcggggcagcgcugcgcgcuguguggggagguuuggccgcacccggcgccucucuagggucgggaagagucgaggagaagcugcucgugcugucagcucuugccgaaaaacuguugccugagccaggcggugacagggcacgcggggcucgggaagccggccccgaugcgagaaggugcuggcguuuuuggcggacugugcaggccggacucggccaggcugacgcacugacgcgaaagagagccagguauuuacugcagcgcgcugucgagguuagcgccgaacuaggggcagauuguaccugcggaccucaagaggguaacggcccaagucucuucuggugguccgagcggaaaaaggacgaacugcuuaaauuuugggagaauuacaucuugauuauggaaacacuggaggggaaccagauacaugugaucaagcccguacucccgaagcugaauaaccuuuucgaauaugcggugucugaggagaauggauguuggcuguuucacccuagcuggcauaugugcauuuacaaaagaauguucgaauccgagaacaagaucuugucaaaagaaggcgucauucacuuucucgagcuguaugagacuaagaucuuacccuucaguccagaauuuagcgaguucauaaucgguccucugauggaugcccuaucugaauccucacucuacagcaggagucccgggcagccaauuggcucuuguagcccccugggacuuaaauugcagaaguuucuggugaccuauaucagccuccugccugaggaaauuaagucgucuuucuuacugaaauuuauccgcaagaugacaucccgacauuggugcgcuguuccaauacuuuucuugucaaaagcccucgcaaaugugccgcggcacaaggcucugggcauugacgggcuacuggcccuccgugacgucauccacuguaccaugauuacucaucaaauccugcuuagaggagcagcccagugcuacuugcugcagacagcuaugaacuuacucgauguggagaaaguaagucugagcgacguuuccaccuuccuuaugucucugaggcaagaggaauccuugggucgcggcacgucacucuggacugagcugugcgauuggcuacgggugaaugaaaguuacuuuaagcccuccccuaccuguagcucuaucgggcugcacaaaacaucacucaacgcguaugucaagaguauugugcaggaguacgucaagagcuccgccugggaaacuggagagaauugcuucaugccagacugguuugaggcaaaacuggugucucuuaugguuuugcuggcuguggauguagaaggcaugaagacccaguauucggguaaacagagaacagagaacgucuuaaggauauuccucgacccccugcuugaugugcugaugaaguuuagcaccaaugccuacaugccucuacucaaaacggaccgaugucugcaauugcuguuaaagcuccugaacacuugccgccuuaagggguccucagcccaggaugacgaaguuaguacagugcugcagaauuucuuuaugucuaccacugagagcaucuccgaguucauuuugcggagacucacaaugaacgaacugaacucagucagcgaucuagacaggugucaucuguaucuuauggugcucaccgagcugaucaauuugcaccugaaaguaggcuggaagcguggaaacccaauauggcgcgugauuucuuuacucaaaaaugcuuccauccagcaucugcaagaaauggacaguggccaggagcccacgguugggagccagauccagcgggucgugucuauggcagcccuugcgauggugugcgaagcuauugaucaaaagccggagcugcaguuggacucccuccacgccggaccucuggagucauuucuaaguagccugcagcuuaaccagacccuccaaaaaccacacgcagaggaacagucguccuacgcccauccccuggaauguucuagcgucuuggaggaaucaaguuccucucagggcugggguaagaucguugcucaauauauucacgaucagugggugugcuugagcuuccugcucaagaaauaccauacacugauaccuacuaccggguccgagauccuugagcccuuucugccagcagugcagaugccuauuagaacauugcagucagcccuagaagcgcugacuguacucagcagugaccaaguccugcccguguuccacugucuuaagguuuuagugccaaaacugcucaccucuuccgagagcuugugcaucgaaucguuugauauggcuuggaagaucauuucaucucugaguaauacacagcucauauucugggccaaccugaaagcauucguccaguuuguguucgacaauaagguucuuaccaucgccgcuaagauuaaaggacaggccuacuuuaagaucaaagagauuauguauaagaucauagaaauguccgcaaucaaaacuggcguguucaacacgcugauuagcuacuguugccaaucuuggaucguaagcgcuuccaaugucucacaggguaguuugagcucugccaagaacuauuccgagcuaauucuggaggcgugcaucuuuggcacaguguucaggcgagaucagcggcucgugcaggacguccaaaccuuuauagaaaauuuagggcacgauugugccgcaaacauuguuauggagaauacuaaacgcgaagaccauuacgugagaaucugcgcuguaaaguuccugugucuucuggauggaucaaacaugagucacaagcucuuuauugaggacuuggccaucaaacugcucgauaaggacgaacuggugagcaaauccaagaaaagguauuacgucaauucucuucagcaucgggugaagaaccgaguuuggcagacccuacugguguuguucccgagauuagaccaaaacuuucugaauggcauaaucgaucgcauuuuccaggcuggguuuacaaacaaucaggcaucgaucaaguauuucauugaguggaucauaauucucauccugcacaaauucccucaguuucuucccaaguucugggacugcuuuagcuacggagaggaaaaccugaaaaccucaaucuguacuuuccucgccgucuugucccaccuggauauuaucacacaaaauauuccagagaagaaacuaauacugaagcaggcccucaucgugguucuucaguggugcuuuaaccauaauuucagugugaggcuguacgcuuuagucgcguugaagaaacuguggacgguauguaaggugcucucuguugaagaguuugacgcacugacccccgugauugagagcucccuucaccaggucgaaucaaugcauggcgccgguaacgcuaaaaagaauuggcaacguauccaggagcacuucuuuuucgccacuuuucauccucugaaagauuauugccucgaaacaauuuucuacaucuugccacggcugucuggguuaauagaggacgaauggaucaccauugauaaguucacaagauuuacugacgugccccuagcagccggauuccagugguaucugagccagacccaacucaguaagcugaaaccuggcgauuggucccagcaggacaucgguacgaaccugguagaggcugauaaucaggcggaguggaccgacgugcaaaagaaaauuaucccguggaacagcagggucucugauuuggaccuggaacuccuguuucaggaccgcgccgcacgacuuggcaagucaauauccagacucauuguuguggcuagucugaucgauaaaccaacaaauuuagggggacugugucggacuugcgagguguucggcgccagcgucuuagugguugggucgcuacaguguaucucugacaagcaauuucagcaccuguccguaagcgcagaacaguggcucccccuuguggaggucaaaccuccacagcugauugauuacuugcaacagaagaagaccgaaggauauacaauaaucggcguggagcagacugccaaaucacuggaccucacccaguacugcuuccccgagaagagucugcuuuuacuggguaacgaaagggaggggauuccugcuaaucucauccaacaguuggauguuugcguggaaauuccgcagcagggaaucauacgcucucugaacguccacguguccggcgcccuacugaucugggaguauacgcgucaacagcuccuuagccauggugacacaaaacccuga

SEQ ID NO: 63537 - RNA, 1101 nt, Artificial Sequence
  derived and/or modified sequence opt3 from TARBP2__Homo_sapiens__NP_599150
augagcgaggaagaacagggcuccgggaccacaacuggaugcggucugcccucuaucgaacaaaugcucgccgcuaacccuggcaagacgccaauuucacuucugcaggaguacgggaccagaauaggaaaaacaccgguguaugacuuguuaaaggcagaaggccaggcccaccagcccaauuucacuuuuagggucaccguuggugauacaaguuguaccgggcaaggaccuagcaaaaaggcggcuaaacauaaggccgcagagguggcccugaagcaccuaaaaggcggcuccaugcucgagccagcucuggaagacucuucgucauucagcccccuugauaguucccugccugaggacaucccaguauuuacugcagccgcugccgcgacacccgugccuucugucguguugacccggagcccaccgauggaacuccagcccccuguuuccccacagcagucagagugcaaccccgugggggcacugcaagagcuggucgugcagaagggauggcgccucccugaauacacgguaacucaggagagugguccagcccaucgaaaagaguucaccaugacaugucguguugagagauuuauugaaaucggcagcgggacuucuaagaaauuagcuaagaggaaugccgcagcuaagaugcugcuucgggugcacaccguccccuuggaugcccgcgacggaaacgagguggagccggaugacgaucauuucuccauuggcguggguucaagacuggacgggcuaaggaaucggggaccuggcugcacaugggauagccuccgcaacagugucggcgagaaaauccugucucuucgauccuguagccuggggucguugggagcgcucggucccgccugcuguagaguucugucugaguuauccgaagaacaggcauuucacgugucauaucuggacauagaggaacucagucuuagcggccugugccaauguuugguagagcuauccacccagccagcuacggugugccacgggucugccacuacaagggaagcugcccggggagaggcagcccgucgcgcucugcaguaccucaagaucauggcgggcagcaaauga

SEQ ID NO: 63538 - RNA, 924 nt, Artificial Sequence
  derived and/or modified sequence opt3 from TARP__Homo_sapiens__XP_011513708
auguucaucggcaacagcccccugcuccuuaccguggggcugggauuguccaaggucgagcaguuucaauuaucuauuucaacagaaguuaaaaagaguauagacaucccuugcaaaauuagcuccacuagauucgagacggaugugauccacugguacaggcagaagccaaaucaggcccuggaacaucuaauuuauaucguaucuaccaaaucggcugcacggcgcucaauggguaagacaagcaacaagguggaggcccguaaaaauagucagacucucaccuccauacugacaaucaagucugucgaaaaagaggacauggcgguguacuauugugcugccugggauuuuggccacuacaagaaacuuuucgggagcggaaccacucugguugugacagacaagcaauuggaugcagacgucuccccgaagcccaccauuuuucucccuucaaucgccgagacgaaacugcagaaggcuggcacuuaucugugccucuuagaaaaauucuuuccagaugugauuaagauccauuggcaggagaaaaagaguaacaccauacuggguagccaggaagggaauacaaugaaaacuaacgacaccuacaugaaguucucuuggcuuacaguacccgagaaguccuuggauaaagagcaccgauguauuguuagacaugaaaauaacaagaauggaguggaccaagagaucauuuuuccuccaaucaaaaccgaugucaucacgauggaccccaaggauaacugcucaaaagacgcaaaugacacucugcuacuccagcugacaaacaccagcgccuauuacauguaccuucuguugcuccugaagagugugguguauuucgcuauuauaacuuguugcuuacugaggcggacagccuuuuguugcaauggcgaaaagucuuga

SEQ ID NO: 63539 - RNA, 2172 nt, Artificial Sequence
  derived and/or modified sequence opt3 from TARS__Homo_sapiens__NP_001245366
auguucgaggaaaaggccagcucccccucuggcaaaaugggaggagaggaaaagccuaucggugcuggcgaggaaaaacagaaggagggcgggaaaaagaagaacaaagaggggucaggugacgggggaagggcagaacugaauccauggccggaguacauuuauaccagacucgaaauguacaacauacuuaaggccgagcacgauaguauccuggcggagaaagcugaaaaggacagcaaacccauuaaggugacauugccugauggcaagcaagucgacgccgaguccuggaaaacuacgccauaucagaucgcaugcggcauuucucagggguuagccgauaauaccguuaucgcuaaggugaacaauguagugugggaccuggaucggccccuagaagaggacuguacacucgaacugcuuaaauuugaggaugaggaagcacaggccgucuacuggcauucgucagcucacauaaugggagaggccauggaacgcguguaugguggcugccuguguuacgggccuccaaucgagaacggauucuauuacgacauguacuuggaagagggcgguguuagcaguaaugauuuuuccucucucgaggcgcugugcaagaaaauuaucaaggaaaaacaagcauucgagcgacuggaagugaagaaggagacucucuuagccauguuuaaauauaacaaguucaaaugucguauucugaaugaaaaggucaacacccccacaaccacuguguacagaugcgggccucuuaucgacuuguguaggggaccacauguacggcacacaggcaaaauaaaggcucugaagauucauaaaaauagcuccaccuauugggagggcaaggccgauauggagacgcuacagcgcaucuacgggauuucauuuccggaccccaaaaugcucaaggaaugggagaaauuccaggaagaggcaaagaacagagaccacaggaagaucggacgggaucaggagcuguauuucuuccacgaacuuaguccugguagcugcuuuuuccugccaaaaggcgcuuacaucuauaaugccuugauugaguuuauacgcucugaauaccgaaagagaggguuccaagagguugugacucccaacaucuucaauuccaggcucuggaugaccucaggacauuggcagcacuacagcgaaaacauguuuaguuucgaggucgagaaagaacuguuugcguuaaagccuaugaacuguccaggccauugccugauguucgaccaccggccccguucuuggcgcgagcucccgcuuagacuggccgauuuugguguguugcacaggaaugaacuauccggggcacugacaggccucacucgggugcgacgcuuccagcaggacgaugcucauaucuuuugugccauggagcaaauugaagacgagauaaaaggaugccuggauuuccuuagaaccgucuauagcguuuuuggcuucucguuuaagcugaacuugucuacaaggccugagaaguuccucggggacauugaagugugggaucaggcugagaaacagcuggaaaauuccuuaaacgaguuuggagaaaagugggagcuaaauucaggugacggcgccuucuacgggcccaaaaucgauauccaaauuaaggacgcaaucggacgguaucaccagugcgccaccauucagcuggacuuccagcucccaauacgcuuuaaccugacguacguaagucaugauggcgacgauaaaaagagaccugugaucguccacagggcuauucuugguagcguggagcguaugaucgcgaucuugacugaaaauuaugggggcaaauggcccuucuggcuguccccacggcaaguuauggugguccccgugggaccuacaugugacgaguacgcacagaagguacgacagcaguuucaugaugccaaguucauggcugacauugaucucgacccaggcugcacccugaacaaaaagauaagaaaugcccaacuugcacaguauaacuuuauccugguugugggggaaaaagagaagauuucuggaacugucaauaucaggacacgcgauaacaaagugcacggugagcggaccauuagcgaaacgaucgagagauugcagcagcucaaggaauuuaggucaaagcaagccgaggaagaguuuuga

SEQ ID NO: 63540 - RNA, 2409 nt, Artificial Sequence
  derived and/or modified sequence opt3 from TARSL2__Homo_sapiens__NP_689547
auggccgcugaggcacuggccgcggaagcuguggccagcagacucgagaggcaggaagaggacauccgguggcuuugguccgaagucgagcgccugcgagaugagcaauugaacgcacccuacucuugccaggccgaaggcccuuguuuaacccgugagguugcucagcugagagcagaaaauugcgaccuaaggcaccggcucuguucacugcgccuuugccuggccgaggagagaaguaggcaggcuacauuggaaagcgccgagcucgaagcggcacaagaggccggggcucagccaccgcccucccagucucaggauaaggacaugaaaaagaaaaagaugaaagaaucggaggccgauucagaggugaagcaucaaccuauuuucauaaaggaacggcugaaacuguuugagauccucaagaaagaccaccaguuacugcuugcaauuuauggaaagaaaggugauacuagcaacaucauuacgguacgcguggcugacggccagaccguccagggggaaguguggaagacaacuccauaccaaguugccgcggagaucagucaggaauuggccgaguccaccgugauagcaaaggucaauggagagcugugggaucuagaccgaccccucgaaggcgauucuagccuggagcuucugacauucgacaacgaagaggcucaggccguguauuggcauuccucagcucacaucuugggugaagccauggagcucuacuaugggggacaucuguguuacggcccuccaauugagaauggcuuuuauuacgauauguucaucgaagacagagcaguaaguagcaccgaguuaucugcccuggaaaacauuugcaaagcuaucauaaaggagaaacaacccuuugagaggcucgaaguuuccaaggagauucuucuggaaauguucaaauacaauaaguuuaaaugucggaucuugaacgagaaggugaauacugcgacaaccacggucuaucguugcgggccucuaauugaccuguguaagggaccacacgugcgccacacugguaaaaucaagaccaucaaaauuuucaagaacucaagcacauacugggaaggcaauccggagauggagacucuccagagaauauaugggaucaguuuucccgauaacaaaaugaugagggacugggaaaaguuccaggaggaagcaaagaaucgggaucaucgaaaaauuggaaaggagcaggaacuguuuuucuuucacgaccuuucuccuggcuccugcuucuuccugccacgcggugccuuuaucuacaacaccuugacagauuucauaagagaggaguaucauaaaagggacuuuaccgaagugcucagccccaauauguacaacucgaagcugugggaggcuucugggcacuggcaacacuauuccgaaaacauguucacguuugagauugaaaaagauacuuucgccuuaaagccuaugaauuguccaggacauugccugauguuugcacaccggccccgcucauggagagagaugccgaucagguucgccgacuuuggcguccuacaucguaacgagcucaguggcacacugagcgggcuuacccggguucgaagauuccagcaggaugacgcucacaucuuuugcacuguggaacagauugaggaagagaucaagggauguuugcaauuccugcaguccguauacucuacauuugguuucagcuuccagcucaaucugucaaccaggccugagaacuuucuuggcgaaauugagauguggaaugaagccgagaaacagcugcaaaacaguuugauggauuucggggaacccuggaagaugaauccaggagacggcgcauuuuacgguccuaaaauagacaucaagauuaaagaugcgaucgggcgcuaucaucagugcgcuacgauccagcucgacuuccagcugcccauucgguuuaacuuaaccuacguguccaaggauggcgacgauaagaaaagaccagucauaauccacagggccauucugggaagcguggagcgcaugaucgcaauucuaucugagaauuauggcgggaaguggcccuucuggcucucaccucgacaaguuauggugaucccagucggaccgacaugugaaaaauacgccuuacaggugaguagcgaguuuuucgaagaggguuuuauggcugacguagaucuugaccacuccugcacuuugaacaagaaaauacggaaugcccagcuggcacaauauaacuucauccucguugugggcgaaaaggagaaaauugauaaugcugucaacgugcguaccagagacaauaagauccauggggagauucuggucacaucugccaucgauaagcugaaaaaccugaggaagacucgcacccuuaacgcggaagaggccuuuuga

SEQ ID NO: 63541 - RNA, 924 nt, Artificial Sequence
  derived and/or modified sequence opt3 from TAS2R10__Homo_sapiens__NP_076410
augcugagaguggucgagggcaucuucauuuuuguugugguaagcgaauccguguucgggguccucggaaacgguuuuauaggccuugugaauugcaucgacugugccaagaacaaacugucuaccauuggguucaucuugacaggauuagcuauuucaaggaucuuucugauauggaucauuaucacugauggcuucauucagaucuuuagucccaauauauacgcaagcgguaaccuaauugaguauaucuccuacuucuggguuauugggaaucaaucuucgaugugguuugccacgucacucagcaucuucuauuuucugaagaucgcgaacuucaguaauuacauuuuucuuuggcugaaaucccggaccaacaugguguugccuuucaugauagucuuccuccugaucucuagccugcucaauuuugcuuauauugccaagaucuuaaacgacuacaaaacaaagaaugauacugugugggaccugaacauguauaaguccgaauacuucauaaaacagauucuuuugaaucugggaguaaucuuuuucuuuacccuaucacucaucacaugcauuuuccugaucauuagucuuuggcgccacaaccgacagaugcagagcaauguuaccggccugcgugauucuaacacugaggcacaugugaaggccaugaaagucuugauauccuuuaucauucucuucauccuguacuuuaucggcauggcuauugaaauaucauguuucacagugagagagaacaaguuacugcucauguuugggaugaccacgacugcaaucuauccauggggacacagcuucauucuuauccuggguaauaguaaauugaagcaagccucucuaagggugcugcagcagcucaagugcugugagaaacggaagaaccugcgcgucaccuga

SEQ ID NO: 63542 - RNA, 912 nt, Artificial Sequence
  derived and/or modified sequence opt3 from TAS2R13__Homo_sapiens__NP_076409
auggagagcgcccugcccuccaucuucacccucgugauuauagcugaauuuaucauuggcaaccuuucuaauggguucaucguccugauuaacugcaucgacuggguuucaaagagagaguugaguagcguggauaaauuacugauaauccuagcaauuuccaggaucggacucauuugggaaauccugguaucuugguuucuugcccugcacuacuuggcgauauucgugucggguacaggccuccggauuaugaucuuuucauggauugucagcaaucauuucaaccuguggcuggcuacuaucuuuaguaucuucuaucucuuaaagauugccuccuuuucuagcccugcauuccuguaccuuaaauggcgcgugaauaagguuauauugaugauccugcuagggacgcucguguuucuguuccuuaaccugauucaaaucaauaugcacauaaaagacugguuggaucgauaugagcguaacaccacauggaauuuuuccaugucagacuucgaaacuuucagugucagcgugaaguuuaccaugacaauguucucucucaccccauuuacuguagccuucauuuccuuucuguuacugaucuucucacuccaaaagcaucuucagaaaaugcagcugaacuacaagggacacagagauccgaggacaaaaguucauaccaaugcuuugaagaucgugauuagcuuucuacuguucuaugcaaguuucuuucucuguguccugaucucuuggauuuccgagcuuuaccagaacacggugauauauaugcugugcgagacuaucggcguguuuagccccucgucucacuccuucuugcucauucuggguaaugccaaauuacggcaggcuuuucugcuagucgccgcgaagguuugggcaaagcgcuga

SEQ ID NO: 63543 - RNA, 954 nt, Artificial Sequence
  derived and/or modified sequence opt3 from TAS2R14__Homo_sapiens__NP_076411
augggcggggugaucaagagcauuuucaccuuuguccugauaguugaguucaucauuggaaaccucgguaauuccuuuaucgcccuugugaacugcauugacuggguaaaaggcagaaagaucucuucaguggauaggauacugacagcuuuggcaaucagucggauuagcuuagucuggcugaucuucggguccuggugugugucuguguuuuuccccgcccuauuugcgacugagaaaauguuccgcaugcucacgaauauuuggaccguuaucaaccacuuuucggucuggcuggcuacaggacuuggcacuuucuacuuucugaagauagccaauuucucaaacagcaucuuuuuguaucucaaauggcgagugaagaagguaguucuggugcugcucuuagucaccaguguguuccuguuccuuaauauugcauugauuaacauccauaucaaugccuccauuaacgguuaccguagaaauaaaacaugcucuagcgacuccucaaacuuuaccagguucaguagccugauagugcuaacuucuacagucuuuaucuucauuccuuuuacccucucccuggcuauguuccuucuguugaucuuuucaauguggaagcaccggaaaaagaugcagcauacgguuaaaauaagcggggaugcaaguacuaaggcccaccgcggagugaagucuguaauuaccuucuuucuccuguaugcuaucuucucccugagcuuuuucaucucgguguggacaucugaaagauuagaagagaaucucauuauccuuucccaagucaugggcauggccuacccaucaugucauaguugcgugcugauuuugggcaacaaaaagcuaaggcaggcgagccuguccguucuccuguggcuucgguauauguuuaaagacggggaaccgucuggacacaaggaguuccgcgagagcucauga

SEQ ID NO: 63544 - RNA, 876 nt, Artificial Sequence
  derived and/or modified sequence opt3 from TAS2R16__Homo_sapiens__NP_058641
augauccccauucagcugaccguguucuuuaugauaaucuacguccucgagagccuuacaauuaucguucaauccucucugauuguggccguauugggcagagaaugguuacaggugaggcggcugaugccugucgacaugauccuaauaucacucgggaucagucgcuucugccugcagugggcuagcaugcuuaacaauuuuuguuccuauuucaaccugaauuacguguugugcaaccucacuauuacgugggaguuuuucaauauccugaccuuuuggcugaacucucucuuaacaguuuucuauuguauuaaggugucgucauuuacucaccauaucuuccuguggcuucgauggcguauauugagacuguuuccauggauucuacucggaagccugaugauuaccugcgucacaaucaucccgagugcaaucgguaauuacauucagauacaacuucugaccauggaacacuugcccaggaacuccacugugacagauaaacucgagaauuuccaucaguaucaguuucaggcccacaccguagcgcugguuaucccuuucauuuuauuccuggcuucuacgaucuuucucauggccagccuuacuaagcaaauacagcaucacuccaccggccacuguaacccaucaaugaaagcacgguucacagcccugcgcaguuuggcugugcuauuuauugucuucacuagcuacuuucugaccauccucaucacaauuaucgggacccuguucgacaagagaugcuggcuuugggugugggaagcauuuguguaugccuucauucugaugcauucuacguccuugaugcucucaagccccacucugaaaaggauauuaaagggaaaguguuga

SEQ ID NO: 63545 - RNA, 900 nt, Artificial Sequence
  derived and/or modified sequence opt3 from TAS2R1__Homo_sapiens__NP_062545
augcuggaaagccaccucaucauuuacuuccuucuggccgugauacaguuuuuguuaggcaucuucaccaacgggauuaucgucguugugaauggaauugaccugaucaagcauagaaaaauggcuccccuagaucuccugcuuuccugccuggcaguaucuaggauauuuuugcaacucuucaucuuuuaugugaacgucauugugaucuucuuuauugaauuuaucauguguucagccaauugcgcgauacugcuguuuauuaacgagcucgaauuauggcuggcuacauggcuugguguuuucuacugugccaagguggcaaguguccggcacccuuuguuuaucuggcugaaaaugcgcauuagcaagcuagugccauggaugauccucggcucccugcuuuauguaucuaugaucugcguuuuccauucgaaauacgccggguuuauggugccguauuuccugcgaaaguucuuuucacagaaugcuacuauucagaaggaggacacguuggcaauacagaucuucagcuuugucgccgaguucagugugccccuccugauuuucuuauucgcugugcugcuccuuaucuuuucccugggacgucacaccagacaaaugaggaacacagucgccggcucucggguuccuggucgcggggcgccaauaagcgcauugcuauccauucugucauuccucauccuguacuuuagucauuguaugaucaaaguguuccuuagcucucugaaguuucacauuagaagguucaucuuuuuguucuucauucucguaauaggaaucuaucccuccggccacucacugauuuuaauccugggcaauccuaaacuaaagcagaacgccaaaaaguuucuccugcauagcaagugcugucaguga

SEQ ID NO: 63546 - RNA, 1002 nt, Artificial Sequence
  derived and/or modified sequence opt3 from TAS2R38__Homo_sapiens__NP_789787
augcugacccucacaagaaucaggacugugagcuacgagguccgguccacguuccuuuuuauuucuguucuggaguucgccgugggcuuuuugaccaacgcuuucguauuuuuagugaauuucugggacgucgugaagcgccaggcacugucaaacagugauugcguucuacucugucugagcauaucccgacuuuuucugcacgggcucuuguuccugucugccauccaacugacacauuuucagaaacucucggaacccuuaaaucacucauaucaggcgauuaucaugcuguggaugauugcuaaccaggccaaucuuugguuggcagccugccugagccuacucuacuguaguaagcugauccguuucucccauacuuuucuuauaugccuggcuucuugggugagcagaaaaaucucccaaauguugcucggaauuauccuguguucaugcauuuguaccgucuuaugcgugugguguuucuuuaguaggccucacuucacaguaaccacuguucuguucaugaacaauaacacacggcucaauuggcagaucaaggaccuuaaccuguuuuauagcuucuuguuuugcuaccuauggucugugccaccguuccugcucuuucuggucuccucagguaugcuuaccgugagccugggccgccauaugagaacgaugaaaguguauacuaggaauagucgggaucccucuuuggaagcacacauaaaggcccucaagucccuggucagcuucuuuuguuucuuuguuauuucgucuugcguggcuuucaucuccguaccuuuacugauucuauggcgcgacaaaaucggggugauggucugcgugggaaucauggccgcguguccaucaggccacgcagccauucucauaagugguaacgcuaagcugagacgagccguuaugaccauccuuuugugggcacagagcucccugaaagugagggcugaucauaaggccgacucucggacacucugcuga

SEQ ID NO: 63547 - RNA, 900 nt, Artificial Sequence
  derived and/or modified sequence opt3 from TAS2R50__Homo_sapiens__NP_795371
augaucaccuuccuguacauauuuuucagcauucucaucauggugcuuuuuguccugggcaacuucgccaauggguuuauugcuuugguuaacuucaucgacugggugaagaggaaaaagauuuccucugcagaucagaucuuaacagcccuggcgguaucaagaauaggacuacucugggcucugcuucugaauugguauuugacugugcucaaccccgccuuuuacagugucgagcugcggaucacgagcuauaaugcaugggugguuaccaaccacuucuccauguggcuggccgcuaaucucucuaucuuuuacuuacugaaaauugcaaacuucucgaaucuuuuguuucugcaucuaaagcgccgagugcguucagucauucucgugauccugcuugguacacugauauucuugguaugccaccuccugguugccaacauggacgaaagcaugugggcugaggaauaugagggcaauaugacugggaaaaugaaguuaagaaacaccgugcaucugaguuaccucacagucaccacucuuugguccuuuauuccuuucacacugucuuugaucagcuuccuaaugcugauuuguucccucugcaagcaccugaaaaagaugcaacuucauggagaaggcucacaggaucugaguaccaaagugcacaucaaggccuugcagacgcucaucagcuuucuguuacugugugcgauuuucuuucuauuccucauagugucugucugguccccaaggcggcugcgcaaugacccgguugugaugguaucaaaagcaguggguaacaucuaucuugccuuugauagcuucauuuugaucuggagaacuaagaagcugaaacacaccuuucuccugauacuuugccagauuagguguuga

SEQ ID NO: 63548 - RNA, 957 nt, Artificial Sequence
  derived and/or modified sequence opt3 from TAS2R60__Homo_sapiens__NP_803186
augaacggcgaccacauggugcuggggagcuccgucaccgauaagaaagccaucauucucguuacaauacuucuguuguuaagacugguggcuaucgcaggaaaugguuucauuacugccgcgcuaggcguagagugggugcucaggcggaugcugcuucccugcgacaagcuguuggucucucucggggcuucacgcuuuugucugcagagugugguuaugggaaaaacgaucuacguguuccugcauccuauggccuuuccauauaacccgguccuccaauucuuagcauuucagugggauuuccugaaugccgcuacccuuuggagcuccacaugguugucuguguuuuacugcguaaagauugcaacuuucacccaccccguguuuuucuggcugaaacauaagcuaucgggcuggcucccuuggaugcuguuuucaagcguuggucuuaguuccuucacaaccauccuguuuuucauagggaaccaccgaauguaucagaauuacuugcguaaccaucuccagccauggaaugucacuggagacucuaucagaagcuauugugaaaaguucuaccuguuucccuuaaaaaugauuacauggaccaugccuacggccguguucuuuaucugcaugauucugcucaucacuucccuuggcaggcaccggaagaaagcucuguugaccacaucaggcuuccgcgagccaagugugcaagcccacauaaaggcgcuacuggcacuccugagcuuugccaugcuuuucauuucuuauuuucuguccuuggucuucucagcugccgggaucuuucccccucucgauuucaaauuuuggguuugggaaagcgugauuuaccugugugcagcuguacauccaaucaucuuacuguucaguaacugcagacuaagggccgugcucaagucucggcgcuccagccgauguggaacuccguga

SEQ ID NO: 63549 - RNA, 939 nt, Artificial Sequence
  derived and/or modified sequence opt3 from TAS2R9__Homo_sapiens__NP_076406
augcccagcgccaucgaagcuauuuacauaauccugauugcaggggaacucaccaucgggauuuggggaaacgguuucaucgugcuugucaauugcauagacuggcugaagagaagggauaucuccuugauugacaucauuuuaaucucucuggccauaucacggauuugucuacucugcguuaucagucuggauggcuuuuucaugcuucuguuuccugggacauauggaaacagcguguugguauccauugugaaugucguguggacuuucgcgaacaauucuucgcucugguuuacgucaugucugagcaucuucuaccugcucaaaaucgcuaacauuagucacccauuuuucuuuugguuaaagcugaaaauaaauaagguuaugcuugccaucuugcugggcuccuuccuaauuucucucaucauaagcgugccgaaaaacgacgauaugugguaucaucuguuuaaggucucccacgaggaaaauauuaccuggaaguucaaagugucaaagauccccgguacauuuaaacagcuuacucugaacuuggggguaaugguuccuuucauccucugccugauuaguuucuuuuuacuccuguucagccuugugcgccauaccaagcaaauccgacugcacgcaacaggauuucgugacccaucuaccgaggcccauaugagagcuauuaaagcagucauaaucuucuugcuacugcucauuguguacuaucccguguuucuggucaugacuuccucagcccuuaucccucagggcaagcugguuuugaugaucggcgauauugugacaguaauauucccaagcagucacucuuuuauccucauuaugggcaauuccaagcugagggaggcuuucuuaaaaaugcugcgguuugugaaguguuuccuacgcagaaggaaacccuuugucccuuga

SEQ ID NO: 63550 - RNA, 1263 nt, Artificial Sequence
  derived and/or modified sequence opt3 from TASP1__Homo_sapiens__NP_060184
augaccauggagaagggcaugagcuccggggaaggacugcccucuagaucaagucaggugagcgccgguaaaaucacagcuaaggagcucgaaacuaaacaauccuacaaggagaaaaggggcggguucguccuuguucacgcaggagccggcuaucauucugaaucgaaggcgaaggaguacaaacacgugugcaagcgggcuugucagaaagccauugagaagcugcaggcaggggccuuggcuacggacgcaguaaccgccgcuuuaguggaacuggaggauucaccuuuuacaaacgccgggaugggaagcaaucuaaaccuccugggcgaaauagagugcgacgcgaguaucauggauggcaaaucccuuaauuucggggcagucggagcccugucugguauuaagaacccagugagcguugcuaaucgcuugcucugugagggccagaaggggaaacuguccgccggacgaaucccgcccugcuuucuggugggcgaaggugcauaucguugggcugucgaccaugggauuccuucauguccacccaacaucaugacuaccagauucagucucgccgcguuuaagaggaauaaacggaaguuagagcuggccgaacgcguggauacagacuucaugcaacuuaaaaagagaaggcagagcucugagaaagaaaacgauuccggaaccuuggacacuguaggcgcaguuguggucgaucacgagggcaauguggcugccgcugugucaagcgggggacuggcccuaaagcauccuggucgggucggccaggcagcccucuacgggugcggauguugggcugagaacacaggcgcgcacaauccauauaguaccgcaguuucuacguccgguugcggggaacaccuggugcgcacuauacuugcccgagaguguagccaugcucugcaggccgaagacgcacaccaagccuugcucgagaccaugcagaacaaguuuaucucgucucccuuccuggcuuccgaagauggcguauuaggaggcgugauuguccugagaucauguaggugcagugccgagccugacagcucccagaauaaacagacacuccuuguggaguuucuguggucucauacuaccgaaagcaugugcguuggguacaugucagcacaagauggaaaggcgaaaacacacaucagucgguugccaccgggugcuguggccggccaguccgucgcaauugaggguggagugugccgucuagaaagccccguaaacuga

SEQ ID NO: 63551 - RNA, 753 nt, Artificial Sequence
  derived and/or modified sequence opt3 from TATDN1__Homo_sapiens__NP_001139632
augaucaccggcgggaaccugcaggacagcaaggaugcccuccaccuugcucaaacaaauggaauguucuuuuccacuguggguugccaucccacgagauguggcgaguucgagaaaaacaauccugaccuguacuugaaggaauuacugaaccuagcagaaaauaacaaagggaaggucguugccauuggagagugcggccucgauuuugacaggcugcaguucuguccaaaagauacccagcuuaaguauuuugaaaagcaguucgagcugucugagcaaacaaaauugccgauguuucuccacugccgcaauucacaugcggaguuccuggacauaaugaagcggaaccgagaucguugugugggugggguagugcacaguuuugacggaacuaaagaagcugccgcagcccugaucgaucucgacuuauacauuggcuucaauggcugcagccugaagaccgaagcuaaccuugaggucuugaaauccauccccucugagaagcugaugauugaaacagaugcaccuugguguggggugaagucgacccaugccggaucaaaauauaucagaacugcuuuuccaacaaagaaaaagugggagagcggucacugccuaaaagacaggaaugaacccugucacauaauccagauucucgagaucaugagugccguucgggaugaagacccucuggagcuugcgaacacccuguacaauaacacgauuaagguguucuuuccaggcaucuga

SEQ ID NO: 63552 - RNA, 1365 nt, Artificial Sequence
  derived and/or modified sequence opt3 from TAT__Homo_sapiens__NP_000344
auggaccccuacaugauccagaugagcuccaagggcaaccugccuucuauucucgaugugcacgucaauguugggggaagaucaagugugccagguaaaaugaagggcaggaaagcccgguggagcguacgcccguccgacauggcuaagaaaaccuucaaccccauacgagcaaucguggauaauaugaaggucaagccuaacccaaauaaaacaaugauuucucuuucgaucggggaccccacuguguuuggaaaccugccuacggauccagagguuacccaagccaugaaggacgcguuggauucaggcaaauauaaugguuacgcucccagcauuggguucuuaaguucccgugaagagaucgccucuuauuaccauugcccugaagcaccacuggaggccaaggacgugauacuaacaagcggauguucccaggcuaucgaucucugccuggcaguccuugccaacccgggccagaauauucuggugcccagaccuggcuuuucauuguauaaaacucucgcugaaaguauggggaucgagguaaagcuguacaaccugcucccagaaaagagcugggaaauugacuuaaaacagcuggaguaucuuaucgaugaaaagaccgccuguuugauaguuaauaaccccucuaauccuugcggauccguguucucaaaaaggcaucugcaaaagauucuagcggucgcagcccggcagugugugccaauccucgcugacgagauuuacggugauaugguguuuagcgacugcaaauacgagccccuggccacacuuaguaccgacgucccgauccugucuuguggcggguuggcaaagcgcuggcucguuccuggauggagacugggcuggaucuuaauucacgauaggcgggacauauucgguaacgaaauccgcgaugggcuggugaaacucucccagcgaauccuuggacccugcacuauuguacagggcgcucugaaaagcauauuguguagaacaccaggcgaguuuuaucacaauacccuaucguuccugaagucuaacgccgaccucugcuacggggcgcuggccgcaauuccuggacuuaggcccgugcggccauccggugcuauguaucugauggucggcaucgaaauggagcauuuucccgaguucgagaacgauguggaguuuacggaacguuugguugccgagcaaucagugcacugucucccugcuacuugcuucgaauacccaaauuuuauccgcgucgugauuaccguaccggagguuaugaugcuggaagccugcaguagaauccaggaguucugugagcagcacuaucauugcgcagaagggagccaggaggaaugugacaaguga

SEQ ID NO: 63553 - RNA, 2244 nt, Artificial Sequence
  derived and/or modified sequence opt3 from TAX1BP1__Homo_sapiens__NP_001073333
augaccagcuuccaggaggugccccugcaaacauccaacuuugcccacgucaucuuccagaauguugcuaagucuuaccucccuaacgcacaucuugaaugccacuauacucugacgccauacauucauccgcaccccaaagacugggugggcauauuuaagguaggguggucaaccgccagagauuauuacacauucuuguggaguccuaugccagagcauuauguggaaggaagcacugucaauuguguguuagcguuucaggguuacuaucugcccaacgacgauggcgaguucuaccaguuuugcuacguuacccacaaaggggaaaucaggggagcuuccacaccuuuccaauuucgggccucuucgccaguggaggagcuacucaccauggaagacgagggcaauucagauaugcuggucgugacuacaaaggcaggucuucuggaauugaaaauugagaagaccaugaaggagaaagaagaacuccugaagcugaucgccguacucgaaaaagagacggcucaguuacgcgaacagguugggcgaauggagcgugagcugaaccacgaaaaggagagaugugaccagcuucaagcagaacagaaaggauugacugaggugacccagagccugaagauggaaaaugaggaguucaagaaaagguuuagugaugccacauccaaggcucaucagcuagaagaggacauugucucugugacucacaaagccaucgaaaaggagaccgaacucgauagccugaaagacaaacuuaagaaggcgcaacaugagcgggagcagcuggaaugccaguugaagacagagaaagaugaaaaggagcucuauaaagugcaccugaagaacaccgagauagaaaauacgaaauuaauguccgagguccaaacucugaagaaccucgacggcaauaaggaaucaguuaucacacacuucaaagaggaaauuggccgccuucagcuguguuuggcagagaaggagaaccuacagagaaccuuucugcucacuacaaguagcaaagaagauaccugcuuccugaaggagcagcuuaggaaagccgaggagcaagugcaggcuacgcggcaggaaguaguguuccuggccaaggaguugucugacgcagucaaugugcgcgaccgaaccauggcugaucuccauacagccagacuggagaacgaaaagguuaaaaagcaguuagcggacgccguggcagagcugaaacuaaaugcuaugaagaaagaucaagacaagacugauacccucgaacacgagcugaggcgggaagucgaggaccuuaaguugcgucugcagauggccgcugaucauuacaaagagaaguuuaaagaaugucagcgccuccagaagcaaaucaacaaacuguccgaccagucagccaacaauaacaauguguucacaaagaaaacugggaaccagcagaagguaaaugaugcaagcguuaacaccgaccccgccacaagugcuucuaccguggaugucaagccuuccccaagcgcggcagaggccgacuuugacauugugacuaaaggacaagucugcgaaaugacgaaggagaucgcugauaaaacagagaaguauaauaaauguaagcagcuucugcaggacgaaaaggccaaaugcaacaaguacgcagaugaguuggccaaaauggaacucaaguggaaagagcaagugaagauagcugaaaauguuaagcuggaguuagccgaggugcaggacaacuauaaagaacugaagagaucgcuagagaauccggcagaaaggaaaauggaggauggugcggacggcgcuuucuaccccgaugaaauucagcggccuccaguacgaguccccucuugggggcucgaggacaacgugguuuguucccagccugcccgcaauuuuucaagaccagauggacuggaggacagugaagauagcaaggaggacgaaaacgugcccaccgcaccggauccucccucccaacaccuuaggggccaugguacuggguucugcuuugacucuagcuucgacguccacaaaaagugcccauugugugagcugauguuuccucccaauuaugaucagucaaaguucgaggaacacguggagagucauuggaaaguaugcccaauguguuccgaacaguuucccccugacuacgaucagcaaguguucgagcggcacguucagacccauuuugaccagaacguccucaacuucgauuga

SEQ ID NO: 63554 - RNA, 375 nt, Artificial Sequence
  derived and/or modified sequence opt3 from TAX1BP3__Homo_sapiens__NP_055419
augagcuacauccccggccagccugugaccgccgucguucaaagaguggagauucacaagcugaggcagggggaaaaccucauacuuggauucuccaucgguggcgggauugaccaggauccaucucagaauccguuuucagaggacaaaacagauaagggaaucuauguaacucgggugagugaaggcggucccgcugagauugcagggcugcaaaucggagacaaaauaaugcaggucaacggcugggauaugacgauggugacccaugaccaggcccgcaagcgauugacaaaacguagcgaagagguugugagauuacuggucacuaggcagucccuacaaaaggcggugcagcagucuaugcucucguga

SEQ ID NO: 63555 - RNA, 879 nt, Artificial Sequence
  derived and/or modified sequence opt3 from TAZ__Homo_sapiens__NP_000107
augccccugcacgugaaguggccuuucccagccgucccgccccucaccuggacacuugcuagcuccguugugaugggccugguagggacuuacucuugcuuuuggacgaaauauaugaaccauuugaccgugcacaauagagaggucuuauacgaacugaucgagaagaggggaccugcaacaccacuaauuacugugucaaaccaucagaguuguauggacgauccccaccucugggguauacugaaacuucggcauaucuggaaucugaaguugaugcgcuggaccccugccgcggcugacauuugcuucacaaaagaacuccacagccacuuuuucucccugggcaaguguguuccagugugccgaggggccgaguuuuuccaagcagaaaacgagggaaagggcguccuggauaccggucgucauaugcccggggccggaaaaagaagggagaagggcgacggcguguaucagaaagggauggauuuuauccucgaaaaguuaaaucacggagacuggguacauauuuucccugaggguaaaguuaacaugucuucggaauuucugcgguucaaguggggcaucgggcgccuuauagcugagugucacuugaauccaaucauucugccgcuauggcacgugggaaugaacgauguccuccccaauucaccuccauacuuucccagauucggccagaagaucacugugcugauugguaaaccuuuuagcgcacuuccagugcuggagagguugcgggccgaaaacaagagugcugucgagaugcgcaaagcccucacagacuucauccaggaagaguuccaacaucugaagacccaggcggaacaguuacacaaucaucugcagcccgggcgauga

SEQ ID NO: 63556 - RNA, 1482 nt, Artificial Sequence
  derived and/or modified sequence opt3 from TBATA__Homo_sapiens__XP_011537769
auggccaccgacgugcagcuggcugauuacccccucaugagcccuagaucccuuaggggcgaguggcggauggaacaagagacacaggggccaucucaguggucaccgcagcgcguccgaggacgucacgcacuguugaguacuagcagaguucauuuauauuccaagaggacgcccuucucucaaggucaccgggaaaaaggcaugcagaccgccaucucgccuaaggcggagcugaaacuagaaaagaaaucagggcgcaagccaagaagccccagggacaguggaccucagaaggagcucgugauuccaggcauaguagauuuugagcggauccgccgagcucugagaacacccaaaccucagacuccagguaccuacugcuucgggaggcuuucccaucacagcuuuuucagccggcaucacccgcacccccaacaugugacacacauucaggaccugaccggaaagccugucugugugguucgugauuuuccagcccccuugccugaauccacuguguucucaggcugccagaugggcaucccaacaauuaguguccccaucggggacccgcagagcaaccgcaauccucaacucucuuccgcauggaaaaaggagcugaaagaacuggccucaagaguggcuuuucucaccaaggaggaugaguuaaagaaaaaggaagacacgacuagccugaacuggaauuguaaaaguaggcggccccaggcaccaggacuuucugguaccgauuugggcgccgcugagcuggggauaaagaaagaacagaaggaggaaccucuacgagagcaaggagccaaauauuccgcggagacaggccgccucauccccgcaagcacuagagccguagguaggcggcgcucgcaucaggggcagcagucucaauccucaaguagacacgaaggaguucaggcuuuccugcuucaggaccaggagcuguuggugcucgaacuguuaugcaggauucuggagaccgaucuccuuagcgccauccaauuuuggcuguuguacgcaccacccaaggaaaaggaccuagcucugggccuccugcagacagccgucgcgcagcuucugccucagccauugguguccauuccgaccgagaaacuccugucucaauuacccgaggugcacgaaccuccacaggagaagcaggaacccccuugucguugggccccacaucccgcacugccguucugcagccuacucucaagucaguccaucccugaggaaaacgaggauauaacguuuuauaaaaagcggaaaacucgaguccacuggagaucuucuucaccacccgacgcuuucaagccugagcauagggaagaggacauugaagccgagggccgcgagcugcgggggcccaauacauguaccugccuugcucaagaacagccacagggauuuagagguguuagugugagcacuacauucaccgccguaccugauuccuugcccuga

SEQ ID NO: 63557 - RNA, 2025 nt, Artificial Sequence
  derived and/or modified sequence opt3 from TBC1D15__Homo_sapiens__NP_001139685
auggccgcugcaggcguggucagcgggaagaucauuuacgagcaggaaggaguuuauauacacuccucuugcgguaaaaccaacgaccaagauggccugaucucagggauucucagagugcuugagaaggacgccgaaguaaucguggauuggaggccccuggacgaugcguuggacaguagcuccauuuuauacgcucggaaagauucuucgucagucguggaguggacacaggccccuaaggaacgcggacaucgaggcagcgagcaccugaauaguuaugaggcagaaugggacaugguuaacacuguguccuucaaacguaagccacauacgaauggugaugccccgucucacagaaacggaaagagcaaaugguccuuucuauucucacucaccgaccugaagaguaucaaacagaauaaggaggggaugggcuggagcuaccuugucuuuugucugaaagaugacgugguauugcccgcucuccauuuccaccagggcgauucuaagcugcugauagaaucccucgagaaguauguuguguuaugcgagucaccucaagacaaaaggacacugcuugucaacugucagaauaagagcuugagucagucuuuugaaaaccugcuagacgagccagcauacgggcucauccagaaaauuaagaaagaucccuauacugccaccaugaucggauucuccaaggugacaaauuacauuuuugacagccugcgggguucggauccuucuacccaccaacgcccacccuccgaaauggcugacuuccuuucagaugccaucccuggccugaaaauaaaccagcaggaggaaccaggguuugaggugauuacuagaaucgacuugggagagaggccggucguucagcggcgcgaacccgugagucucgaggaauggacaaagaauauugauagcgagggccgaauccugaacguagacaauaugaagcaaaugaucuucagagguggguuaucccaugcgcugaggaaacaggcauggaaguuucuccuuggauacuucccuugggauucuaccaaagaagaacggacgcagcugcaaaagcagaaaacugacgaguauuuucguaugaaguugcaguggaaaagcauuucacaggaacaagagaagcgcaacaguagacuaagggauuaccggucccugauagaaaaggacgugaaucgaaccgaccgcacaaacaaauucuaugagggccaggauaacccaggccucauccugcuucacgacauucugaugacuuacugcauguaugauuucgacuugggguacguccagggaaugagcgaucuccugucucccuuacuguaugugauggaaaaugagguugacgccuuuugguguuucgcuucauacauggaucagaugcaucaaaacuuugaggaacagaugcaggguaugaagacccagcuaauccaacucaguacacugcuuagauugcuggacagcggcuucugcuccuaccucgagucucaggauucgggguaucuguacuuuuguuucagguggcuucugauacgguuuaaacgcgaguucagcuuuuuggacauucucagacugugggaggugauguggaccgaguuaccuugcacgaauuuccaucugcuacucuguugcgccauccuggaauccgagaagcagcagaucauggaaaagcacuauggauuuaacgagauucuuaaacacaucaaugaauugucaaugaagauugaugucgaggacauacuguguaaagcagaggcuaucagucuccaaauggugaagugcaaagaacugccacaggccguaugcgagauuuuaggccugcaggguucugaaguuacuacacccgauagcgacgugggggaggacgaaaacgucgugaugaccccguguccuacuuccgcguuccaaucaaaugcccuucccacauugagcgcaucuggcgcuaggaacgauuccccaacccagaucccugucaguagcgacgugugccgucucacgcccgccuga

SEQ ID NO: 63558 - RNA, 1218 nt, Artificial Sequence
  derived and/or modified sequence opt3 from TBC1D16__Homo_sapiens__NP_001258774
augaagguggcccccgacaaaaccugcaugcaguucagcaucagaaggccuaagcugccauccucugagacacacccggaagagucaauguacaaacggcucggcgucagugcuuggcuuaaccaucugaaugaauuggggcaaguugaggaagaguauaaguuacgcaaagcaauuuucuucggagguauagaugugagcauccgaggcgagguauggcccuuucugcuacguuacuauucccacgaaucuacuucggaggaaagagaggcccucaggcugcagaagcggaaggaguacucagaaauucagcagaaacgccuuagcaugacgccugaggaacauagagcguucuggaggaacgugcaauuuaccgucgacaaggaugugguucggacagaccgcaauaaccaguucuuucgaggggaggauaauccaaacguggaaaguaugagaaggauccuguugaauuaugcugucuacaaccccgccgugggauauucccagggcaugucugaccucguagcaccuauucuggccgagguucuggaugagagcgacacuuucugguguuuugugggucucaugcagaauaccaucuucgucuccucaccacgggaugaagacauggagaaacaauuacuguaccuucgugaauugcugcgccuaacacacgugagauuuuaccagcaucucgugagucugggggaggauggacuucagaugcuguucugccacaggugguugcuccuguguuuuaagcgggaauuucccgaggcugaggcauuacgaauaugggaagccugcugggcucacuaucagaccgacuacuuccaucuguuuaucugugucgccauuguugcgaucuauggcgaugacgugauugagcaacagcucgcaacugaccagaugcuucugcacuucggcaacuuggccaugcauaugaauggggagcuaguacugcgcaaagcuagaagccuccuguaccaauuuaggcuucugccucggaucccaugcucuuugcacgaucucuguaagcugugcggauccgguaugugggacucaggcagcaugccggccguggaauguacagggcaccaucccggaagugaaucuugcccuuauggcgguaccgucgagaugccaucccccaagagcuuacgcgaggggaaaaagggaccuaaaacgccacaggauggcuucggcuuuagaagguga

SEQ ID NO: 63559 - RNA, 3480 nt, Artificial Sequence
  derived and/or modified sequence opt3 from TBC1D1__Homo_sapiens__NP_001240841
auggagcccaucaccuucacagccagaaagcaucugcucagcaacgaaguguccgucgacuuuggccuucagcugguugggucuuugccugugcacucauuaacuacgaugccaaugcugccguggguaguggcugaggucaggcggcuaagucgccaaagcacccgaaaagaacccgugacaaagcagguucgucucugcguguccccuucuggacugagaugugagccagaacccgguaggucgcagcagugggauccucuuauuuacucaagcauauucgagugcaaaccacaacggguccacaagcugauccauaauagucacgaccccuccuauuuugcauguuugauuaaagaggaugccgugcaucgccagucuaucugcuacguauucaaggcggacgaucagacuaagguuccugaaauuaucagcuccauaagacaggcuggcaaaaucgccaggcaagaggaacuccacuguccaucagaguuugacgauaccuucaguaagaaauuugaggugcuguucugcgggcgggucacaguggcacacaagaaagccccgcccgcucugauugacgaauguaucgagaaguuuaaccaugugagcggaucucgcggcuccgaaucaccucgaccaaaucccccucacgcagccccaaccgguagccaggagcccgucagaaggccgaugcggaagaguuucucucagccugggcuccguuccuuagcuuuucgcaaagaacugcaggauggaggccuuagaagcucgggcuucuuuucuuccuucgaggagucagacauugaaaaccauuugaucagugggcacaauauaguucaacccacugauauugaggaaaacaggacaaugcuguucaccaucggacagagcgagguguaucuaauuuccccagacacgaagaaaaucgcccucgaaaagaauuuuaaagagaucucuuucugcagccaggguauucggcacguagaucauuuuggcuucauaugucgagagucaagugggggaggcgguuuucacuucgugugcuacgucuuucaauguacuaacgaagcgcugguggacgagaucaugaugacccuuaagcaggcauucacaguugccgcugugcagcagacugccaaagcuccugcacaacugugcgaagggugccccuugcagucccuccauaagcugugugagcgcauugaaggaaugaauagcucuaagaccaaauuagagcugcagaagcaccucacaacccuuacgaaccaggagcaagccacuaucuuugaagagguccagaaacugagaccaaggaaugaacagcgggagaacgaguugauaauuucauuccuacgcugccuguaugaagagaagcagaaagaacauauccacaucggcgagaugaagcaaacaagucagauggcggccgaaaauauuggcagcgagcugcccccuuccgcaaccagauuuaggcuggacaugcuuaagaacaaagcuaagcguucucugacugagucguuggaaagcauccucucccgggggaauaaagcccgaggacugcaggagcacucaauuaguguggauuuagacucuagccuguccucaacacuaagcaacaccucuaaggaaccauccguaugugagaaagaagcucucccgauaagugagagcucuuucaagcugcuugguuccucagaggauuugaguagcgacucggaaucccaucugcccgaggaaccugccccacucucuccccagcaagcauuuagaaggcgcgccaacacgcugagccacuucccuaucgagugccaggaaccaccccagccggcucggggcucaccugggguuagucaaagaaaacuuaugagguaccauuccgugucuaccgagacaccacacgagcgcaaugucgaucccagcccugugggagaauccaaacaccgacccggccagucaagcgcgccagcaccucccccacggcugaacccgagugccucuuccccuaauuucuuuaaguauuugaaacauaacagcucgggugagcagucagggaaugcuguccccaagucuauuaguuaccguaacgcccucagaaagaagcugcacuccagcucuagcgugccaaauuucuuaaaguuucuggcacccguugacgaaaacaauacuuccgauuucaugaacaccaaaagggacuuugagucaaaggccaaucaucuaggcgauaguggaggcacaccugugaaaacucgccggcacagcuggagacagcaaaucuuccucaggguagcuaccccacagaaggccugugacucuuccucacgauacgaggauuauagugaacugggggagcuucccccucgcagcccguuggaaccagucugcgaggacggacccuuugguccuccacccgaagagaaaaagcggacauccagagagcugagggaacucuggcagaaagcaauccugcagcaaauuuuacugcuucguauggagaaggaaaaccagaaguugcaggcgucugagaaugaccuccugaacaaacgccuaaagcuggauuacgaagagauaaccccuugucucaaagaggugacuacgguuugggaaaagaugcugucgacaccgggccggagcaaaaucaaguucgacauggagaagaugcauucagcuguggggcagggaguccccagacaccacaggggcgaaauuuggaaauuucuugccgagcaauuccauuugaagcaccaguuuccauccaaacagcaaccuaaggaugugcccuauaaagaacuguuaaagcagcucaccagucagcagcaugcaauccugauugaccuuggucgaacuuucccaacccacccuuacuuuucugcccaacugggggcuggccaguugagccucuauaauauccugaaggccuacucccuacuggaucaggagguaggauauugccagggccucucauucguggcagggauacugcuuuugcauaugucugaggaagaggcuuucaaaaugcugaaguuuuuaauguucgacaugggacuccggaaacaauaccgccccgauaugaucauucugcagauggaaaagacaaucaaccagguuuuugagauggacauugccaaacagcuucaagcguacgaggucgaauaucacgugcugcaggaggaacuaaucgauagcaguccacucuccgacaaccagagaauggauaagcuggagaagaccaauagcucuuugaggaaacagaaccuggacuuacucgaacaacuccagguggccaauggucggauacagucacuugaggcuacuauugagaagcuguuguccagugaaagcaaacucaagcaagcaaugcugacacuagagcuggaacgaucggcccuucuccagacggucgaggaacugagacgcaggucugcugagccguccgaucgugagccugaauguacccagcccgagccaacuggcgacuga

SEQ ID NO: 63560 - RNA, 1212 nt, Artificial Sequence
  derived and/or modified sequence opt3 from TBC1D20__Homo_sapiens__NP_653229
auggcccugagaagcgcucagggcgacgggcccaccuccggacacugggaugguggcgcagagaaggccgacuucaacgcgaaaaggaagaaaaagguggcugaaauccaucaagcccucaauucugauccuacagacgucgcagcccuucggcgcauggcuauuucagaagggggacuguugacugaugagauacgacguaaaguuuggccaaaguuacugaacgugaaugcaaacgacccgcccccuaucaguggcaagaaucuaagacagaugagcaaagauuaccagcagguacuccuggacgugaggcggucccuucgcagauuuccacccgguaugccugaggaacaaagggaggggcugcaggaggaauugauugauaucauucuccugauccuggagcggaacccacagcuccacuauuaccagggauaucaugacauagucgugacguucuuacugguugugggcgaacgccuugccaccucuuuggucgagaagcugucgacacaccaucuacgagauuuuauggaccccacuauggauaauaccaaacacauccucaacuaccugaugccuauuaucgaccaagugaauccagagcuucacgacuucaugcagucagcugaaguaggcacaauuuuugcccugagcugguugaucaccugguucgggcauguucucagugauuuuagacacguggucaggcuguaugacuucuuuuuagcgugccauccgcugaugcccauauacuucgcagccgugauugugcucuaucgggagcaggaaguccuugauugugacugcgauauggcuuccguucaccaccuguugucucagaucccucaagaccuaccauacgagacucugauuagccgugccggagaucucuuugugcaguuucccccuuccgaacuggcacgcgaggcugccgcgcagcaacaggccgagagaacagcagcuucaaccuucaaggacuucgaacuugccagugcucagcagaggccagauaugguacugcggcaacgauuccgcgguuugcucagacccgaggacaggacgaaagaugugcugacuaagccgcggaccaaccgcuuugucaaguuagccgugaugggccugacaguugcacuaggggccgcugcgcucgcaguggucaaaagcgcccuggaaugggcuccuaaguuccagcuucaguuguuucccuga

SEQ ID NO: 63561 - RNA, 1320 nt, Artificial Sequence
  derived and/or modified sequence opt3 from TBC1D22A__Homo_sapiens__NP_001271232
auggccagcgacggcgcuagaaagcaguucuggaaaagguccaacucuaagcugcccgggucacuccuucggaguaccgcaaaaaugccuacaacuccagugaaggccaaacgcgucagcacguuucaagaguucgaauccaauaccucugaugcgugggacgcuggagaggaugacgaugaacuguuggccauggcagccgagucguuaaacucagaaguugugauggagacagcuaaucgaguacugcguaaccacagccagagacaggguaggccgacucuacaggagggccccgggcuccaacagaagccucggccagaagcagagcccccuaguccacccuccggagaccugcgccuugugaagucugucagcgaaucccauaccucaugcccugccgaggagcugagaagguugaguuggagcggcaucccaaaaccggugcggcccaugacauggaagcuccugucugguuaccugccugcuaauguugaucgccgaccagccacccuccagagaaaacagaaggaauauuuugcguucauugagcacuacuaugacuccaggaacgaugaagugcaucaagacacuuaccggcagauacacaucgauauuccccguaugucaccugaggcauuaauccugcagccaaaagucacagaaauuuuugagcgcauccuuuucauaugggccaucagacaucccgcuagcggguaugugcagggaauuaaugacuugguaaccccguuuuucguuguguuuaucugugaguacauugaagccgaggaagucgauacgguggacgugaguggcgucccugcagagguucugugcaacaucgaagcugacacuuauugguguaugucuaagcuacucgauggcauacaagacaauuacaccuucgcccagcccgggauucagaugaaggugaaaaugcuggaggagcuuguauccaggaucgaugaacaagugcaccggcaccuggaccagcaugagguccgauacuugcaguuugcguuccgcuggaugaacaaucuccugaugagagaagugccauuaaggugcacaauucggcugugggauacuuaucagagcgagccugacggauuuucgcacuuccaucucuacguuugugccgcauuccuugugcgcuggagaaaggaaauccuggaggagaaagauuuucaagaauugcuacuguuccuccagaaccugcccaccgcucacugggacgaugaggacaucucucuucuguuggccgaagccuauaggcucaaguuugcuuucgcagaugccccaaaucacuacaaaaaguga

SEQ ID NO: 63562 - RNA, 1518 nt, Artificial Sequence
  derived and/or modified sequence opt3 from TBC1D22B__Homo_sapiens__NP_060242
auggccgcugagaacagcaagcaguucuggaaaagauccgcaaagcugcccggcucuauccaaccuguguacggggcccagcacccaccgcucgaccccaggcuuaccaaaaauuuuauuaaggaacggucaaaagucaacacaguuccucugaagaauaagaaagcgaguagcuuccaugaguuugcucgcaacacuuccgaugccugggacauaggagaugacgaagaggaagauuucucuucgccaucauuucagacguugaauagcaagguggcauuagccaccgcugcacagguacuggagaaccacaguaaacuacgagugaagcccgagcguucccaaucuacaacuagcgacgucccugccaauuauaaagugaucaaguccucaagugaugcucagcucagcagaaacucuuccgauaccugccugaggaauccacuucauaagcagcagucacugcccuugcggccuauuaucccacucguugcccgcauuagcgaccaaaacgcgaguggugcaccgcccaugacagugagagagaaaaccaggcuggaaaaguuccggcagcugcucucuucccagaauacugacuuagaugaacugcgcaaauguagcuggccuggcgucccacgagaggugagacccaucacauggaggcuuuugucgggguaccugccugccaacaccgagcggcguaagcuaacgcuccagcgcaaaagagaagaguauuuuggauucauagaacaauacuaugacucuaggaaugaggaacaccaucaggauacuuaccggcagauccacauugacaucccacgaaccaacccccugauuccgcuuuuucaacagccucugguacaggagaucuucgagcgcauauuguuuauuugggcuaucagacaccccgccuccggcuauguucaggguauuaaugaccucgugacaccauucuuugucguguuccugucagaauacguggaggaagaugucgagaacuucgacguuacuaacuuaagucaagauaugcugaggagcaucgaagcagacuccuuuuggugcaugucuaagcuccuugaugggauccaggacaauuacaccuucgcucagccuggcauucagaaaaaggugaaggcccuggaggaguugguaagccggauagaugaacaagugcauaaccacuuucgcagauaugaggucgaauaccuacaguucgcguuuagguggaugaauaaccugcucaugcgugagcugccccuucgguguacaauccgacugugggacaccuaucagucagaaccagagggauucagucauuuucacuuguacgugugcgccgcauuccucauuaaauggagaaaggagauccuggaugaagaggacuuucagggcuuacugaugcuacuccaaaaucugcccacgauacacugggggaacgaagagauuggacuuuugcuggcugaggccuauaggcucaaauacauguucgcugaugccccuaaucauuaucgccgguga

SEQ ID NO: 63563 - RNA, 1680 nt, Artificial Sequence
  derived and/or modified sequence opt3 from TBC1D24__Homo_sapiens__NP_001186036
auggacagccccggcuacaacugcuucguggauaaggacaaaauggaugccgcuauccaggaccuggggccuaaggagcucuccuguaccgaacuucaagagcugaaacaguuggcaagacagggauauugggcccagucucacgcguuaagggguaaggucuaccaacggcugauucgcgauauaccaugccgaacaguuacuccggacgcuucaguguauagugauaucguaggcaaaauuguggggaagcauagcuccucuugucuaccccucccugaauuugucgacaauacccaggugccaucguacugccugaacgcccguggagagggcgcaguuagaaagauccuucuguguuuggccaaucaguuccccgauauuucauuuugcccugcucucccagcaguggucgcccugcugcuccacuauagcaucgacgaagcugaguguuucgagaaagccugcaggauauuagcguguaacgaucccggucggcgccugaucgaccagaguuuucuugcauucgaauccucuugcaugacguuuggggauuuggugaauaaguacugucaagccgcucauaaacugaugguagccguuagcgaggacgugcuacaggucuaugcagacuggcagagauggcuguucggagaacucccucuuugcuacuuugcuaggguguucgauguguuucuggucgagggcuacaagguuuuguaucggguggcccucgcgauucugaaauucuuucacaagguacgcgccggccagccauuagaguccgacucagugaagcaagauauccgaacauucgucagagacauugcaaaaacugugaguccggaaaagcugcucgagaaagccuucgccaucaggcuuuuuagccggaaggaaauacagcuguugcagauggcuaacgagaaagcccuaaagcaaaaagggauuaccguuaagcagaagucugugucccugucaaaacgucaguucguccaucucgcagugcacgccgaaaauuuucgcagcgagaucguaaguguuagagagaugagggauauuuggucuugggugcccgaacgguucgcucugugccagccucuucuguuguuuuccagccuccaacacggauacucgcuggcgcgauucuauuuucagugugagggucaugaaccaacauuacugcuaaucaagaccacucagaaagaggucugcggcgcauaccucucuacagacugguccgaacgcaacaaguucgggggaaaacugggcuuuuucgguaccggggaguguuuuguguucagacuucagcccgagguccaaagguaugaaugggugguuaucaagcacccugaguugacgaagccacccccgcugauggccgcugaaccuacugcuccccucucacauagugcaagcuccgauccagccgaccggcugucuccuuuucuugcugcccgccacuucaaucugcccagcaaaaccgagucaauguucauggcaggaggcagugauugcuugauugugggcgggggagguggccaggcgcucuacauagacggggaucugaacagaggaaggacaucccacugugacacuuuuaauaaccagccauuaugcagcgaaaauuuccugaucgcugccguagaggcauggggcuuucaggaccccgauacccaauga

SEQ ID NO: 63564 - RNA, 2067 nt, Artificial Sequence
  derived and/or modified sequence opt3 from TBC1D25__Homo_sapiens__NP_002527
auggccaccgcuagcggcgcauccgaccugucugggucaggagcucccccuccaggugugggcgcgcaggcugccgcagccgcugaggaagaggaaagagaggucguuagggugcggguaaagaaaugcgaaaguuuccucccgcccgaguuucgcagcuucgcaguggauccucaaaucacaucccuugacguccugcagcacauuuugauacgagccuuugauuuaucugggaagaaaaacuucggaaucucguaccugggccgugacagacuaggucaggagguguaucucucacugcuuagcgauugggaccugaguacugcuuuugccacggcguccaagccauacuugcagcucaggguugauauucggcccucugaagacagcccucugcuggaggauugggacaucauuuccccaaaagaugugaucgggucagacguccucuuagcagaaaagcgcaguagccugaccacagccgcccuucccuucacucaaucuauauugacccaggugggaagaacacuguccaagguacagcagguucuaucauggagcuauggcgaggaugugaaaccuuuuaagccaccgcucagugacgccgaguuccauaccuaccugaaucacgaaggccaacuuucuaggcccgaggaacugcgguugcgcaucuaucaugggggagucgagccuucccuccgaaaagugguguggagauaccuguuaaacgucuauccagacggucugacuggcagggaacggauggauuacaugaagcguaaaagccgcgaguacgagcagcucaagucggaaugggcacagagagcuaaucccgaggaccuugaauuuauuaggucuacaguucugaaggauguguugcggaccgaccgagcccacccuuauuacgcggggccagaggauggaccccaucuacgcgcccugcacgaccuccugacgacuuaugcaguaacccacccucagguguccuacugucaaggcaugucagaucuugcuaguccgauccuggccgucauggaccaugaaggucacgcuuucgugugcuuuugugggauuaugaaaagauuggccgcaaacuuccaucccgauggaagggccauggcuacaaaguuugcgcaccucaaacuguuacugcggcacgcagacccagauuucuaucaguaccuacaggaggccggcgcugacgaccucuucuuuugcuaucgcuggcugcuuuuggagcugaagagagaguucgccuuugaugacgcacucaggaugcuggaaguuacuuggagcucccuuccucccgauccacccgaacaugagguggaacuggucggcccuccaucucaaguggccgacgcuggguucggaggucaccguggcuggccgguacggcagcgacauauguugagacccgccgggggaggcgguagcaccuuugaggaugcaguugaccaccucgcgacagcuucacaggggccuggcggaggcgggaggcuguuacgccaggccagucuggauggacuacaacagcuccgggacaauauggguuccagaagggauccacuggugcagcuuccccauccugcagccuugaucagcucuaaaucacugagugagccacuccugaacagccccgacccguuacuguccucuuucucgcacccugauagcccauccucaaguucucccccuagcacccaggaggcuucccccacgggcgacauggccgucgggucaccacuuaugcaagaagugggaagcccuaaggaucccggcaaaucuuugccaccggucccucccaugggucucccacccccucaggaauuugggcgcggcaauccauucaugcuguuucuaugucuggcaauacuccuggagcaccgagaccauauuaugcggaacggacuugacuacaaugaguuggcuaugcacuucgaucgucuggugagaaagcaucacuuaggcaggguucuccgccgggccagagcgcuguuugccgacuaccuucaguccgaagugugggauagugaggaaggggcugaggcaacugccgcuagcuga

SEQ ID NO: 63565 - RNA, 2787 nt, Artificial Sequence
  derived and/or modified sequence opt3 from TBC1D2__Homo_sapiens__NP_001254500
auggagggcgccggggaaaacgcucccgagagcuccucuucagcaccuggaagugaagagagcgccagagacccacaggugccgcccccugaagaggaguccggugauugcgcgaggucucuggaagcugucccaaagaaacucuguggcuaccuuucgaaguucgggggaaaaggccccauccgggguuggaagucacgcugguuuuucuaugacgagcgaaaaugccaacuguacuauagccguaccgcccaggaugcaaauccuuuggacaguauugauuuauccucugccguuuuugacuguaaggcugaugcagaagaggggauauucgagaucaagacaccaagcagagugauuacucugaaagccgcuacgaagcaggccaugcuauacuggcuccagcaacugcagaugaaaaggugggaauuucacaacucacccccugcgccaccggcaacccccgacgccgcucuugccggaaauggcccuguacugcauuuggagcucggccaggaagaggcagaacuggaggaguuccugugcccagugaagacacccccugggcucgucggaguggcugccgcguuacagccauuucccgcccugcaaaacaucucccuuaaacacuuggguacugaaauucagaauaccaugcauaacauccggggcaauaagcaggcacaggggacaggacacgagccgccuggcgaagauaguccccaaagcggugagccacagcgcgaagaacagccucuggcuucugacgccuccacccccgggagagagccagaagauucacccaagccugcuccaaaaccgagccuaacuauaaguuucgcccaaaaggcaaaaaggcagaacaauacauuucccuucuuuucugagggaaucacccggaaccgcacggcccaggaaaagguugcugcgcucgagcagcaagugcugaugcuuacuaaagaacugaagucccagaaagaguuggucaagauucuccauaaggcacuggaggccgcucagcaggaaaaacgagccagcucggcauauuuagccgcugccgaggacaaggauagacuggaacucgugaggcacaaaguacggcaaaucgcagagcuuggccgucgcguugaggcgcuggaacaggagagagaaucuuuggcucacaccgccucccuaagggagcaacaggugcaggaacugcagcagcauguccagcuccugauggacaagaaucacgcaaaacaacaggugauuuguaaguugucagagaaggugacacaggacuucacucauccuccagaucaaaguccccugcggccugacgccgcuaaccgagauuuucuuagccagcagggcaaaaucgagcaccucaaggacgauauggaagccuaccgcacccagaauugcuuccugaacuccgagauacaccaagucacaaaaauuuggagaaagguugcagaaaaagagaaggcuuuacugaccaagugugccuaucuacaggcgaggaauugccagguggaaucuaaauaccucgccgggcugcggcgccuucaggaggcuuugggagacgaggcaagcgaauguucagagcugcucagacaacugguacaggaagcccuucagugggaggcuggugaagccaguuccgauagcaucgagcugucuccaauuucaaaguacgacgaguauggcuucuugacggugcccgauuacgaagucgaggaccucaaacuguuagcaaagauccaggcgcuggaaaguaggagccaucaccuacucgggcuggaggccguggaucguccgcuucgggagcgaugggcugccuugggagaccugguuccuuccgcagaacucaaacaacuguuaagagcuggcgugccaagggagcaucgcccccgggucuggagauggcuggugcaccuuaggguacagcauuugcacacuccugguugcuaucaggaacuccugucucgcgggcaagcccgagagcaccccgcagcccggcagaucgaacuagaccugaaccguacauuuccaaacaauaagcauuucaccuguccuacuucgagcuuucccgauaagcucagaaggguucugcuugcuuucuccuggcagaacccaacaauuggcuacugccagggauugaaucgccuggcggccauagcauuacucgugcuggaggaggaagagucagcuuuuuggugccuugucgccaucguggaaaccauuaugccggccgacuauuacuguaacacgcugaccgcuagucaagucgaucagcggguguugcaggaccuccugucugagaaacuaccuagacugauggcacaccucggccagcaucacguugaucugagccuugugacauucaauugguuuuugguagucuucgccgacucccugaucucaaacauauuacucagggugugggaugcguuucuguaugaagggacuaagguuguguuccgauacgcucuugccauuuuuaaauacaaugagaaggagauccugcgccuacaaaacggacucgaaaucuaucaguaccugcgguucuuuaccaaaacaauuagcaauucuagaaaguugaugaacaucgcauucaaugacaugaaccccuucaggaugaaacagcugcgucaguuacgcaugguccaccgggagagacucgaagccgagcugagggaacuugagcaacugaaggcugaguauuuggaacgacgggcaucccgcagaagggccgugagugaggguugcgcgagcgaagaugagguagagggcgaggcuuga

SEQ ID NO: 63566 - RNA, 3774 nt, Artificial Sequence
  derived and/or modified sequence opt3 from TBC1D32__Homo_sapiens__NP_689943
auggcccacuucagcuccgaggaccaggcuaugcugcaagcaaugcucagaaggcuuuuucagucugugaaggaaaagaucaccggcgcccccucacuggagugcgcggaagagauuuuguuacaucuggaagagacagaugagaacuuccacaauuacgaauuugucaaguaucuacggcagcauauagggaacacucucggaaguaugaucgaggaagagauggagaaauguacgagcgaccgcaaucagggugaagagugcggcuacgauaccguugugcaacagguaacaaagcgaacucaggaauccaaagaguauaaggaaaugaugcacuaccugaagaacauuaugaucgcuguggucgagucuaugauuaauaaauucgaggaagacgagacccguaaccaggaaagacaaaagaaaauccagaaggagaaaucgcauucauauaggacagauaauuguagcgacagugauuccucucuuaaccagagcuacaaguuuugccaggggaagcugcaauugauacucgaccagcuggauccuggacagccaaaagaagugcgguaugaggcccugcaaacccucuguuccgcaccgcccucagacguuuuaaauugcgagaacuggacuacacugugugaaaaacuuaccgugaguuugagcgauccugacccagucuucucugaucgcauccugaaauuuugcgcccagacguuccuacucucccccuugcacaugacuaaggagauuuacaccucacuugcuaaauaccuggaaagcuauuuucugaguagagagaaucacaucccuacacucucugcaggcguggacauuacuaacccaaauaugaccaggcuguuaaagaaaguacggcugcucaacgaauaccagaaggaggcccccuccuucuggauccgccauccugagaaguauauggaagagauaguugaaagcacacuuucgcuguugaccgugaaacacaaucagucucaugucgugucccaaaagauucuagacccaaucuacuuuuucgcucugguggauacgaaagccgucugguuuaagaaauggaugcacgcgcacuauucacgaacuacaguucucagacugcuugagaccaaguacaagagucuggugacuacagcaauucagcaguguguacaguauuucgagaugugcaaaaccaggaaggccgacgaaacguugggucauagcaaacacugucggaacaagcaaaagaccuucuacuaccucgggcaggagcugcaguauaucuacuuuauccauuccuuaugccugcuaggacgucuccugauuuauaagcagggccgcaaacuuuucccgauaaaauugaagaacaaaaagggccuggugucucucaucgaucugcuuguccuguuuacacaauugauuuacuauagccccucaugcccuaaaaugacuagcgcugcccacuccgaaaauuacagcccagcaucuauggugaccgagguucucuggauccugucagaccagaaggaaugugcuguggagugcuuauauaacaauauagucauugagacacugcuacagcccauccauaaccucaugaaggggaaugaagccaguccuaacuguagcgagacugcgcugauccacauugccggaauccuugcaagaauugcuuccguggaagaggguuugauacugcuccuguacggcgccaauaugaacucuucggaagagagcccaaccggggcucacaucauugcccaguucuccaaaaaguuacuggaugaggacaucucaaucuuuaguggaucugaaaugcuucccguaguuaaaggcgcauucauuagcgugugcaggcauauauacuccacaugugaggguuugcaaguccucaucaccuauaaucugcacgaaucaauugccaaggcuuggaaaaagacuagccuacugucugagcggaucccgacgccuguggaaggguccgauagugucagcucugugucccaggagucacagaacauuauggcgugggaggacaaucuccuggaugaccuuuugcauuuugcagccacacccaaaggacuguuacuccugcaacgaaccggcgcuaucaacgaaugcguuacuuucauauuuaaucgcuacgccaagaaacuucaggugaguagacacaagaaguucggcuaugggguacuggucaccaggguggcaagcacagccgcuggagguaucgccuugaaaaagucgggcuuuauuaacgagcucaucaccgaacugugguccaaucuagaguacgggcgggaugacguucgcgugacucacccaagaacaacgccugucgaccccauugauaggucuugucagaaaaguuuccuggcacucgugaaccugcuuucauauccagcgaucuacgaguugguacguaaccaggaccugcccaauaagaccgaauauaguuuacgggaggugccuacuugcguuauagauauuaucgaccgacucauuauccugaacuccgaagcuaagauaagaucucuuuuuaauuacgagcaaagccauaucuucggacugagggauuucauuaucgacggccuauccgucgaacgcaaccacgugcucgugcggauuaaucuggucggugggccauuggagagaauccugccgcccagguuacucgagaaaucagauaacccuuacccauggcccauguuuagcaguuauccucugccaaauuguuaccuuucugacauaacacgcaacgccggcauuaagcaggauaaugaccuggauaaauugcuccugugccuaaagaucuccgacaaacagaccgaauggaucgagaacugucagcgacaauucugcaagaugaugaaggcaaaacccgauauuaucagcggagaagcccugauugagcuucucgaaaaguuuguucugcauuugacagagucgccgucagagugcuauuucccuucuguggaauacacugcuaccgacgccaaugugaaaaacgagagucuguccagcguacagcaguuaggcauaaagaugacgguccgguaugggaaauuucucucucugcuuaaggacggagcagaaaaugaucugaccuggguguugaagcacugugagcguuuccucaaacagcaacagacaagcaucaaguccucacugcuaugccugcaggguaacuacgcuggccaugacugguuuguuaguagccuuuucaugauuaugcucggggauaaagaaaagacuuuucaauuccugcaccaguuuucuagauuguuaaccuccgccuuccuguggcucccaaggcugcacaucucaaguuaucuucccaaugacacaguggagagcggcauucauccugucuacuuuuguuccacucacuacaucgagaugcuguugaaagcggaacuaccccugguguucucugccuuccauaugucgggauuugcuccaagccagauaugccuccaguggaucacccaauguuucuggaacuaucuggauuggauugagaucugccacuacauugcaacguguguuuuucuugguccugacuaucagguguacaucugcauagccguauucaagcauuuacagcaggauauucugcaacacacacagacccaggaccuccaggucuuuuugaaagaagaggcucugcacggguuccgcgugucagauuauuuugaguacauggaaauccucgagcaaaacuaucggacugugcugcuuagagacaugaggaauauccgacugcaguccacauga

SEQ ID NO: 63567 - RNA, 1584 nt, Artificial Sequence
  derived and/or modified sequence opt3 from TBC1D3C__Homo_sapiens__XP_006721970
auggacguggucgagguugccggcagcuggugggcucaggaaagagaggauaucauuaugaaguacgaaaaagggcacagggcaggacugcccgaggacaaggguccuaaaccauuccgguccuauaauaauaacguggaucaucucggcauaguacacgaaaccgagcuuccgccccugacagcccgcgaggcgaagcaaauccgacgugaaauuucuagaaaaucaaaguggguggacauguugggggauugggagaaguacaaaaguagcaggaaguuaaucgaccgggcuuauaaaggaaugccuaugaauauucgcggcccaaugugguccguccugcuaaacacugaagagaugaagcucaaaaaucccgguagauaccagaucaugaaggagaaggggaaaaggucuucggaacauauacagcggaucgaucgcgacgugucaggaacgcugcgaaagcacauuuucuucagagauagguauggcaccaaacagcgggagcuucugcauaucuugcucgccuacgaagaguauaacccugaaguuggcuacugccgugaccugagccacauugcagcccuguuucucuuauaccugccagaggaggaugcuuucugggcacuugugcaauugcuggccagugaacgccacucccuacagggguuucauucucccaauggagguacaguccagggccuccaggaccaacaggagcacgugguagcuacuagccagccuaagaccauggggcaucagaucucccugggacuuacacugagauugugggauguuuaucucguggaaggcgagcaagcccugaugccaauaaccaggauugcguucaaaguccagcagaagcgguuaacuaaaacaucacgaugugguccgugggcacgcuuuugcaacagauucguggacaccugggccagggacgaagauacggugcugaagcaccuccgggcuaguaugaagaaacuuacucgcaagaaaggggaccugcccccuccagccaagcccgagcaaggaagcucugcauccagaccugucccagcuucaaggggcggcaaaaccuuguguaagggggaucgucaggcgcccccgggaccucccgcccgguuuccacgaccuaucuggagcgccagucccccaagagcacccaggucuuccacaccuugcccagguggcgcuguucgcgaggacacuuacccgguggggacccagggaguacccagcccugcccuagcucagggcgguccacaagggucguggcgguuccugcaguggaacucuaugcccagacucccuacagaucuggacguggaaggcccaugguuuaggcacuaugauuuccgccaguccuguuggguccgagccauuucacaggaggaccaacuugcacccugcuggcaggccgaacauccggcugagcgggugcguagugcguuugcagccccuagcaccgauuccgaccagggaacgccauucagagcuagggaugaacagcaaugugcccccacuucuggcccuugccuguguggguugcaccucgagagcucacaguuucccccaggauuuuga

SEQ ID NO: 63568 - RNA, 1650 nt, Artificial Sequence
  derived and/or modified sequence opt3 from TBC1D3F__Homo_sapiens__NP_115634
auggacguggucgagguugccggcagcuggugggcucaggaaagagaggauaucauuaugaaguacgaaaaagggcacagggcaggacugcccgaggacaaggguccuaaaccauuccgguccuauaacaauaacguggaucaucucggcauaguacacgaaaccgagcuuccgccccugacagcccgcgaggcgaagcaaauccgacgugaaauuucuagaaaaucaaaguggguggacauguugggggauugggagaaguacaaaaguagcaggaaguuaaucgaccgggcuuauaaaggaaugccuaugaauauucgcggcccaaugugguccguccugcuaaacaucgaagagaugaagcucaaaaaucccgguagauaccagauaaugaaggagaaggggaaaaggucuucggaacauauccagcggauugaucgcgacgugucaggaacucugcgaaagcacaucuuuuucagagauagguauggcacgaaacagcgggagcuucugcauauuuugcucgccuacgaagaguauaacccugaaguuggcuacugccgugaccugagccacaucgcagcccuguuucucuuauaccugccagaggaggaugcuuucugggcacuugugcaauugcuggccagugaacgccacucccuacagggguuucauucucccaauggagguaccguccagggccuccaggaccaacaggagcacgugguagcuacaagccagccuaagacuauggggcaucaggauaaaaaggaccuguguggacaaugcuccccacuuggcugucugauaagaauuuugaucgacgguauuucacucgggcugaccuuaaggcugugggauguuuaucucguggaaggagagcaggcccuuaugccgaucacacggaucgcguucaaaguccagcaaaagcgacugaccaagacuucccgcugcggccccugggcaagauuuuguaacagguucguggacacaugggcccgggaugaagacaccguguugaaacaccuacgcgcuagcaugaagaaacugacgagaaagaaaggcgaugucccuccacccgccaagccugagcaggggucuuccgcaucaaggccaguucccgcuagccguggagguaagacucucugcaaaggcgaccggcaggccccgccugggcccccagcgcgauuuccuagacccauuuggagugccucuccacccagggcaccucgcuccagcaccccauguccgggaggcgcugugcgggaggauacauaccccguagguacucagggggugccuucgccagcccuggcucaaggcggaccccagggcucuuggagauuccuucaguggaauaguaugccuaggcugccaaccgacuuggaugucgaagggcccugguuucgccacuaugacuuccgacagucaugcugggugcgggccauaagucaagaggaucagcucgcaccguguuggcaggccgaacauccugcugagcguguuagaagcgcguuugcagccccauccacagacucugaccagggaacccccuucagggcucgcgaugaacaacagugcgccccuacgagcggucccugucugugcggcuuacaccuggagucaagucaguucccaccuggguuuuga

SEQ ID NO: 63569 - RNA, 3873 nt, Artificial Sequence
  derived and/or modified sequence opt3 from TBC1D4__Homo_sapiens__NP_001273587
auggagcccccuagcugcauccaggacgaaccauucccgcacccccuggagccugaaccaggcguguccgcccaacccgggccuggaaagccaucugauaaaagauuuaggcucugguacgucgguggcucaugucuugaccaucggaccacacugcccauguugccuugguuaauggcugagauucgccgacguagucagaagccagaagcagggggaugcggcgccccggcggcuagagagguuauacuggugcuaagcgcccccuuccucagguguguaccugcaccaggugccggggcuuccggaggcacuucucccucggcaacgcagccuaacccagccguguuuaucuucgagcacaaagcucagcauauuucacgguuuauccacaauagccaugaucugaccuauuucgccuaccuuauuaaggcgcaacccgacgauccggaaagucagauggcaugccacgucuuucgcgccacagacccuucccaggugcccgauguuaucucuagcauaagacagcuguccaaagcugccaugaaggaggacgcaaagccaucaaaagauaacgaagacgcuuucuauaauagucaaaaguuugagguguuguacuguggcaaagucacugugacccacaagaaagccccuagcucucucaucgaugacugcauggagaaguucucccugcaugaacagcagaggcugaagauucagggggagcaacggggacccgauccaggugaagaccucgcggacuuagagguaguugugcccggcucaccuggggauugucugccagaagaggccgacggaacagauacccaccuuggcuugccggcuggugcuagccagcccgcccugacuagcucucgcgucugcuuuccugagcgaauccuagaagacuccggguucgaugagcagcaagaauuuagaaguagguguucgucugugacaggagugcagcggcguguccaugagggcucccagaaaucacagccacgcagaaggcacgcuagugcccccagccacguucaaccuuccgacucugaaaagaaccggaccauguuguuccaggugggccgauucgagauuaaucugaucagcccagauacgaaaucaguagugcuugagaagaacuuuaaagacauaaguuccugcagccaggggauuaagcaugucgaucacuucggauuuaucugucgcgaaucucccgagccgggucugucacaguauauuugcuacguguuccaaugcgcaagugaaagccucguugacgaggugaugcucacucugaaacaggccuuuuccaccgcugcggcauuacagucugccaagacacagaucaagcugugugaagcaugcccuaugcauucgcuccacaaacuuugugagagaaucgagggccuguauccacccagggccaaguuggucauucaacggcaucuaagcucccugacugauaaugaacaggcagacauauucgagcgcgugcagaaaaugaagccuguaucagaccaggaagagaacgagcucguuauccugcaccuuagacaacugugcgaagccaaacagaagacccacgugcauauuggggagggacccaguacaaucucuaauagcaccauaccagaaaacgcuacguccucaggcagguuuaaguuggauauucucaaaaauaaggccaaacguagccugacuucuuccuuagagaacaucuucagucggggugcaaaucgaaugagagggaggcugggcagcgucgacucuuuugaacgcuccaacucacuagcgagugagaaggauuacagcccuggagacucgcccccaggcacaccgccugcuucucccccauccagcgccuggcagaccuuccccgaggaagauucagacaguccucaauuucggagaagggcacacacuuucucccauccacccucuagcacaaaacgcaagcucaaucugcaggaugggcgagcccagggagugcgguccccucuuuugcgucagucaagcagugagcaauguucuaaccuguccagcgucagaaggauguacaaggaaucgaacucaucuaguucccucccgagccugcacaccucuuuuagcgcuccauccuucacggcccccucauuccuuaaaaguuuuuaucagaauagcggucgccugucuccucaguacgagaacgaaaucuccgacggcgaggggcggaagagaaccucaaguacaugcagcaaugaguccuugucugugggaggcacuucgguuaccccaaggcgaauuagcuggcgccagcggaucuuccucagaguggcaucacccaugaacaaauccccuagugcuaugcaacagcaggauggucuggacaggaaugaauuacugccgcuaucuccccucagcccaacaauggaggaagaaccucugguagucuuucuuuccggggaagaugaccccgagaagauugaggaacguaaaaagucaaaggaguugcgcucucuguggcggaaagccauacaccagcaaauccuccuguuaagaauggaaaaggagaaccagaaacuggaggcgagcagggaugaacuucagagucgaaaggugaaauuggacuaugaggaaguuggcgccugucaaaaggaggugcucauuacuugggacaaaaagcugcuaaauugccgggcuaagauccgcugugauauggaagacauccauacccugcucaaagagggagucccaaaguccagaaggggcgagauuuggcaguuccuggcacuucaguaccgguugcgacacagacugccuaacaaacagcaacccccagauauaagcuauaaggaauuacucaaacagcugacagcccagcagcaugcuauccuuguggaccuggggcgcaccuuuccgacucacccuuacuucucuguacaauugggacccggucagcucucacuguuuaaucuacugaaggccuauucccuccuggauaaggaggugggcuacugccaggggauuaguuucguugcaggaguccuuuugcugcauaugagcgaggagcaggcguuugaaauguuaaaauuccucauguacgaccugggcuuuaggaagcaauaucguccagauaugaugucgcuucagauccagauguaccagcugucucggcuacuccacgacuaucacagagaucuguacaaccauuuggaggagaaugaaauuucccccagccuguaugccgcuccuugguucuuaacgcucuuugccucacaauucagucuggguuucguggcaaggguguuugacaucauauuccuucaggggacagaggucaucuuuaaaguugcucugucuuugcucuccagccaggaaacccugauuauggagugugaaucauucgagaacaucguggaguuucuaaagaauacucugccagauaugaacaccagugaaauggagaaaauuaucacacaaguguucgaaauggacauaagcaagcagcuucacgccuacgagguagaguaucauguccuccaggaugaacugcaggaguccucuuacagcugcgaagacuccgagaccuuggaaaagcuggagcgcgcaaauucacaauuaaaacgacagaacauggaccuccuggagaaacuucagguggcccacacuaagauucaggcucuggaaucuaacuuggagaaucuccugacaagagaaacgaagaugaaaagucuaauccggacccuggagcaagaaaagauggcguaccagaagacuguugagcagcuuaggaaacuccugcccgccgaugcauuggugaacugcgacuuacugcuccgcgaucugaauuguaacccuaauaacaaggcuaaaauuggcaauaagccguga

SEQ ID NO: 63570 - RNA, 2454 nt, Artificial Sequence
  derived and/or modified sequence opt3 from TBC1D5__Homo_sapiens__NP_001127853
auguaccacagccuguccgagaccagacauccccuccagccugaagaacaagaagugggcaucgacccacuuucuucauauaguaacaagagcgggggagauuccaauaaaaacgguaggcggacaucuucgacucuggacucagagggcacguucaauagcuaccgcaaggaaugggaggaguuguuugucaacaauaacuauuuagccaccauucgacagaaagggauaaauggacagcugcguaguuccagauucaggucuaucugcuggaagcuauuucucuguguucugccgcaggauaaaagccaauggauuucccggaucgaggagcuucgcgcuugguacucaaacauuaaggaaauccacauaacaaaucccagaaaggugguaggccagcaggaccugaugaucaacaauccuuugagucaggaugaggguagccucuggaacaaauucuuucaagacaaggagcugaggucuaugauugaacaggaugugaaacggacuuucccagagaugcaguuuuuccagcaagaaaauguccgcaagauccugaccgacgugcucuuuugcuaugcacgagagaacgaacaguuacuguacaaacaggggaugcaugagcuuuuggcccccauuguuuucgugcugcacugugaucaucaagcguuucuacacgcuuccgagucagcccagccuagcgaagagaugaagacaguccucaauccagaauaucuggagcacgacgcauacgccguguucagucagcuuauggaaaccgcugagcccugguuuucuacuuucgagcaugauggacagaagggcaaagaaacacugaugaccccuaucccauucgcaagaccgcaagacuugggccccacgauagccauuguaacuaagguuaaccagauccaggaucaccuccugaaaaagcaugacauugaguuauacaugcaccugaacaggcucgaaaucgcuccucagaucuaugggcuucggugggugcgucuguuguuuggacgcgaguucccacuacaagaccugcucgucgugugggaugcccuguuugcggacggucuuucccugggcuugguggauuacauuuucgucgcaaugcuccuguauauaagagacgccuuaaucagcucgaauuaccagaccugccuggggcuacucaugcacuaucccuuuauuggagauguucauucucugauccuuaaggcuuuguuccugagggacccuaaacggaacccacgacccgugacauaccaguuucacccgaaucucgauuauuacaaagcccgcggcgcagaccugaugaacaaguccagaacuaaugcuaagggugccccucuuaacauaaauaaaguaucaaacagucugauuaauuucgggaggaaguugaucagccccgcgauggccccaggauccgcaggcggcccugugcccgggggaaacucuagcucaaguuccagcgucgugaucccaacccggacaucugcugaagcccccucacaucaccuccagcaacagcagcagcaacagcgccugaugaaaagugagagcaugccuguucaguuaaauaagggugauguggucaccggcuccgacgcucaagugucuguaccaguucagacgcugacugaucuacaggggcucucgagcaaaaacauuuccucaaguccgucuguggagagccugcccggaggcagagaauuuacagguuccccuccaucaagcgccaccaagaaggacucuuucuuuuccaauaucaguaggagccguucucauuccaaaacuauggggcggaaggagucagaagaggagcuugaagcacagauuaguuucuugcaaggccagcugaacgaccucgaugccauguguaaauacugcgcuaaggucauggacacacaccuggugaauauacaggaugucaucuuacaggagaaccuggaaaaagaggaccaaauucuugugagcuuggcgggacucaagcagaucaaggauauccugaaaggcucgcuacgauuuaaccagucccagcuggaagcagaggagaaugaacaaauuaccauagccgacaaccacuauuguucuagcgggcagggacaggguagaggccaagggcagucaguucagaugaguggagcuaucaagcaggccuccucugagacgcccggcugcaccgauagggguaauagcgacgauuucauucucaucuccaaagacgaugacgggucaagcgcacgcggcaguuucucuggacaagcccagccucugcggacacuuagauccacuagcggcaagucgcaggcuccaguguguucacccuugguauuuucugauccgcugauggggccugccagugcauccagcucuaacccaagcuccucacccgacgacgauaguagcaaagacucuggauucaccauugucuccccuuuagauaucuga

SEQ ID NO: 63571 - RNA, 801 nt, Artificial Sequence
  derived and/or modified sequence opt3 from TBC1D7__Homo_sapiens__NP_001137438
augaccgaggacagccagagaaacuucagguccguguacuaugaaaaggucggcuuucgcgggguugaggaaaagaagucucuggagauccuccuuaaagaugaccggcugggaauuuugcccccucaccaugaaucacacgccaaggugaugauguaccgaaaagagcaauauuuagauguacugcaugcucuaaaggugguccguuucgugagugacgcaacaccacaggccgagguuuaccucagaauguaucagcuggaaagcgguaaacuuccgaggucccccucuuuuccucuggagccagaugacgaaguguucuuggcgauagcuaaagccauggaggagauggucgaagauucgguggacugcuacuggaucacucggcgcuuuguaaaucagcucaacacgaaguauagagauucacugccccaacugccuaaagcauucgagcaguaccucaauuuagaagacggcaggcugcuuacccacuugcggauguguagcgccgcuccaaagcugcccuacgaucuaugguuuaaacgcugcuucgcagggugucucccugagaguucccugcagcgaguuugggacaagguggucucuggaagcugcaagauucuuguguuuguggccgucgaaauccuguugacauucaaaauuaagguuauggcucucaacuccgccgagaaaaucacuaaguuucuggagaauauaccacaggauucaagugacgcgaucgugagcaaagcaauugacuuauggcauaagcacuguggcaccccgguacacucuuccuga

SEQ ID NO: 63572 - RNA, 3423 nt, Artificial Sequence
  derived and/or modified sequence opt3 from TBC1D8__Homo_sapiens__NP_001095896
auguggcugaagcccgaggaagugcuccuuaagaacgcccugaaguugugggucacccagaaaagcuccugcuacuucaucuuacaaagaaggcggggccacggggagggagguggccgccugacagggcgacugguuggagcucucgacgcagugcuggauucuaaugcccguguagcgccuuuuaggauucuucuacaggugccaggcucacaggucuauaguccgauagcuuguggugccacuuuggaagagaucaaccagcauugggacuggcucgaacaaaaucugcugcacacgcucagcguguucgauaacaaggacgauauugcauccuuuguuaaagggaaggugaaggccuuaaucgcugaggagaccucuucgagacuggcagaacaggaggaagaacccgagaaauuccgggaagcccuugucaaguuugaggcucgcuucaauuuuccugaagccgagaaauuggugacauacuauucaugcuguugcuggaagggaagaguaccaaggcagggcuggcuguaccuaagcauuaaccaucucuguuucuauaguuucuuucugggcaaagaacuuaagcugguugugcccugggucgacauccagaaguuggagcggacuuccaauguguuucucaccgauacaauacgcaucaccacucaaaacaaagagcgagacuucucuauguuucugaauuuagaugaaguguucaaggucauggagcagcuggcggacguuacacucagaaggcuucuggauaacgaaguguucgacuuggauccugaccuacaggagccaagccagauuaccaaacgggaccuggaagcacgugcccaaaaugaguuuuuccgcgccuuuuucagacuccccaggaaggagaaacugcacgcuguaguggauugcucccuuuggacgccuuuuucacggugucauacuaccgggcgaauguucgcaagugacagcuacaucugcuuugcuucucgcgaagauggauguugcaagauuauccugccauugagagaggucguguccauagaaaagauggaggacacaucacuccugccgcaccccauuaucguuagcauuaggaguaagguggccuuccaguuuaucgaauuacgggaucgcgacucucuggucgaggcgcuacucgccagacugaaacaggugcacgcaaaccauccuguacacuaugauacuuccgcugacgaugacauggccagccuuguuuuccauucgaccucuauguguuccgaucacagguuuggugacuuggagaugaugucaagucaaaauagcgaagaguccgaaaaagagaagucuccacugaugcaccccgacgcucucgugacagccuuccagcagagcggcucacagaguccugauucccguaugagccgggagcaaaucaaaauuucucuguggaacgaccauuuugucgaauacgggcgaaccgugugcauguucagaacggagaagauaaggaaacuugucgcaaugggaaucccagaaucacugcgcggccgguuguggcuccuguucagugaugccgugacugacuuagcuagccaccccgguuacuaugggaaucugguugaggaaucccuaggaaagugcugucucgugacagaggagauugaaagagaucugcauaggucucuuccggagcacccugcguuucagaacgaaaccggcaucgcagccuugcgccgaguacugacugcuuacgcccaucggaaccccaagauaggcuauugccagucgaugaauauucucacaagcguccuguuacuguacaccaaagaggaagaggcauucuggcuuuugguggccguuugugagcguaugcucccagacuauuuuaaccacagagugaucggggcucaggucgaucaauccguguucgaggagcugaucaagggacaccuaccugaacuggccgagcauaugaaugaccucucagcacuggcgaguguaucucuuagcugguuuuugacgcuguucuuauccauuaugccccucgaaucagcugugaacguugucgauugcuuuuucuacgacgguaucaaagccauuuuucagcugggccuugcagugcuggaggccaaugcugaggauuuguguagcucuaaggacgaugggcaggcccucaugauacuguccagguuccuagaccacaucaaaaacgaagacaguccaggacccccugugggcagccaucacgcauuuuucucugaugaccaggagccauauccggucaccgauauuuccgaccugauccgcgauucauacgaaaaguuuggugaccaaaguguugagcagaucgagcaccuccgguacaagcauagaauuagggugcugcaggggcacgaagauacaacuaaacagaaugugcuucgaguagucauacccgaggugagcaucuugccugaagaccuggaggaauuauaugaucucuucaagcgcgagcauaugaugucgugcuacugggagcaaccacggcccauggcuuccagacacgacccuucuaggccauaugccgaacaguaccguauugaugcgcgccaguucgcccaucuguuucaacuuguuagccccuggaccuguggcgcucacacagagauccuggcagaacggacuuucagacuacucgacgauaacauggaccagcugauugaguuuaaagccuucgugucaugcuuggacaucauguauaauggagaaaugaacgagaagauaaaacuguuauacaggcuccacaucccgccugcucugaccgagaaugaucgagacagucaguccccacuucggaacccccuguugucuacaagccgcccucucgucuuuggcaagcccaauggggaugccguggacuaucagaagcaacugaaacagaugauuaaggaucuagcaaaagaaaaggacaaaaccgagaaggaacugccaaaaaugucccagagagaguucauccaguuuuguaagacucuuuacucaauguuccaugaagauccugaggagaacgaccucuaccaagcgauugccacgguuacaacccuguugcugcagaucggagaagugggucagaggggcagcaguucuggguccugcagccaggaguguggagaagaguuacgggcuucggcccccucaccagaggauucuguauuugcagacacuggcaagaccccgcaagauagucaggcuuucccugaagccgcagagcgagacuggacagucucccucgaacacauacuggccagccuucugaccgagcagucuuuggugaacuuuuucgaaaaaccccucgacaugaaaagcaagcuggagaaugcuaagauuaaccaauauaaucuaaaaacuuucgagaugucccaucagucacagagugaacugaaacuuagcaaccucuga

SEQ ID NO: 63573 - RNA, 3801 nt, Artificial Sequence
  derived and/or modified sequence opt3 from TBC1D9__Homo_sapiens__NP_055945
augugggugaaccccgaggaaguccugcucgccaaugcucuuuggaucaccgagagagcaaacccuuacuucauucugcagaggcggaagggccacgccggggacggagguggcgggggaggcuuggcggguuuacugguugggacacuagaugugguacucgacagcuccgcucgcguggccccauaucgaauacuguaccaaacuccggauucucuugucuauuggacgaucgcaugcggaggcucacguaaagaaauuaccgagcauugggaauggcuggagcagaauuugcuccagacacugaguaucuuugagaacgaaaaugacauuacuaccuucgugagaggcaagauccaggggauaaucgccgaguacaacaaaauuaaugauguuaaggaagacgaugacacagagaaauuuaaggaggcuaucgugaaguuccacaggcuguuuggaaugcccgaagaggaaaaacucgucaacuauuacagcuguuccuauuggaaggguaaagugccucggcaaggcuggauguacuuaucuauuaaucaucugugcuucuacucguuucuuauggggcgcgaggcaaaguugguaaucagauggguugauauaacccagcuggaaaagaacgccacucuacuccugccagacgugauuaaggucucaacaaggagcagugagcacuucuuuuccguguuccuuaauaucaacgagaccuuuaagcugauggaacaguuggcuaauauugccaugcggcagcuccuggauaacgagggauucgaacaagaccgcucuuuacccaaacugaagcgaaaaagcccuaagaaaguguccgcgcucaagagagaucuugacgcaagggccaaaucagagcgguaucgugcucuguuucgcuugccaaaggacgaaaagcuagauggccauacggacuguacucuguggacccccuucaauaaaaugcacauccucggucagauguucgucaguacaaacuacaucugcuuuacuagcaaggaggagaaccuguguucucuuauuauaccucugagagaaguuaccaucguggagaaagccgauuccucaagcguauugccaaguccgcucucuauuuccacaaggaaucggaugaccuuccuguuugcaaacuuaaaggaccgagauuuccuggugcagcgcaucagcgacuuucuacagcaaacgacuucgaaaauauauucugauaaggaguucgcuggguccuacaauucaagugacgaugaagucuauagcagacccuccucucucgugagcucaaguccucagagguccacaagcucugacgccgauggagaacggcaguuuaaccugaauggcaacucaguuccaaccgcgacucaaacacuuaugaccauguaccgcagaaggagucccgaggaguucaauccuaaguuggccaaagaauuucugaaggagcaggcauggaaaauucacuucgcugaauauggccaggggaucugcauguaccguacggagaagacccgggagcucgugcugaaaggaaucccagaaagcaugcgaggugagcuuuggcuguugcucuccggcgccauuaacgaaaaggcuacacaucccggguacuaugaggaccuggucgaaaagucuaugggaaaauacaauuuagccacugaggagaucgaaagagaccugcacaggucgcuaccggagcauccugcauuucagaacgaaaugggcauugccgcucuccgccgggugcugaccgcguaugcauucagaaaucccaacauagguuacugucaagccaugaauaucguaacaagcguucuuuugcuguaugcuaaggaggaagaggccuuuuggcuccugguggcauuaugcgagaggaugcugccagauuacuauaacacucgcgucgugggggcccuugucgaccagggcguguucgaagaguuggcucgagauuacguuccucagcucuacgacuguaugcaggaucugggagugauuuccaccaucucacuaaguugguuccugacacucuuucugucuguaaugcccuucgaaagcgccgucgugguuguggacugcuuuuucuaugagggcaucaaagucauuuuucaacuugcauuggcggugcuggaugcuaauguagacaaguuacucaacuguaaagaugacggggaagccaugaccgugcugggacgguaccuugauuccguuacuaacaaggacucaacgcugccacccauaccucacuugcacagccuccugucugaugacgucgagccauauccggagguggacaucuuccgucuaauuagaacauccuacgaaaaguuugguaccaucagggcagaucugauugagcagaugcgcuucaaacagcggcucaaggugauccagacucuggaagacaccacaaaaagaaaugucguuaggaccauagugacugagacaaguuuuacgaucgaugagcuugaagaguuguaugcccuguucaaggcugaacauuuaaccagcugcuacuggggcgggucuuccaacgcccucgaccgacacgaucccucacugccuuaucuugagcaauaccgcauugacuuugaacaguucaaaggaauguuugcacugcuauucccaugggcuugcggcacucauagugaugugcucgccagccggcuguuccaguugcuggacgagaauggugauucguuaaucaacuuuagagaguucguauccgggcucucugcggccugucacggcgaccugacagaaaaacuuaaacuguuguacaagaugcauguccuccccgagccuagcucagaucaggacgaaccagauagugcuuuugaggcaacccaauauuucuuugaagacauuacacccgagugcacucacgugguuggacuggacuccaggucuaagcagggcgccgaugacggguucgugaccgucagccuaaaaccggauaagggaaaacgugcuaauucccaggagaaccgcaauuaccugcggcuuuggacgccugaaaacaagucaaaaagcaagaaugccaaggaccucccaaaacugaaccaaggucaguuuaucgaguuguguaagaccauguauaauauguucagugaagaucccaacgagcaggaacuguaccacgcaacagcggccgugacuucuuuacuccuggagauaggcgagguugggaaacuuuuuguggcucagccugccaaggaaggaggcuccggugggagcggccccucgugccaucaaggcauuccaggaguacuguucccuaaaaaggggcccggacagccauaugucguggagucaguggaaccguugccugcaucucucgcucccgacagugaggagcacucccugggcggucagauggaagauaucaagcuagaggacagcucuccaagagauaauggggccuguagcuccaugcugauuucagacgaugacaccaaagacgauaguagcaugucuuccuacucaguccuuagugcaggaagccaugaagaggacaagcuccacugcgaagauaucggcgaggacacaguucuggugagguccggucagggcacugccgcuuugccccgaucuaccucguuagaucgggacugggcgauaacguuugagcaauuccuggccagccuccugacagaaccugcacuuguaaaauauuucgauaagccaguguguaugauggcucgcaucaccucagccaaaaacauuagaaugauggggaagccccugacuuccgccagugacuacgagaucucugcuaugagcggauga

SEQ ID NO: 63574 - RNA, 390 nt, Artificial Sequence
  derived and/or modified sequence opt3 from TBCA__Homo_sapiens__NP_001284667
auggccgaccccagagugaggcagaucaagauuaaaaccggcgucguuaagcggcuggugaaagagaagguaauguacgaaaaagaggcuaagcaacaggaagagaagauagagaaaaugcgcgcagaagauggggagaacuaugacaucaagaaacaggccgaaauucuccaggagagccgaaugaugaucccugauugccaacguagacuugaagcggcuuaccuggacuugcagaggauuuuaguguccaaggauuucugugucauguuuaaauucuuuuucucuauccaguauauggagucacagaaguuuaaguaccugacacuacggacgaguuggcaauauuuccucuuuacuugcccacuguaccgcuauauacuuaaauga

SEQ ID NO: 63575 - RNA, 1041 nt, Artificial Sequence
  derived and/or modified sequence opt3 from TBCC__Homo_sapiens__NP_003183
auggagagcguguccugcucugccgcugcagucagaaccggcgacauggaaucacagagggaucugagucucguucccgagcggcuucaacgccgagaacaggagcgucagcuggaaguggagagaaggaagcagaaacggcaaaaccaggagguagaaaaggagaauagccacuucuuuguggccacauucgcgcgcgaaagagcugccgucgaggaguuguuagaaagggcagaguccguggaacggcuggaggaagccgcuucucgccuacaggggcuccagaaacugaucaacgacucgguguuuuuccuugcagccuacgaucugcgacaaggacaggaggcuuuggccagacuccaggcggcacuggccgagaggcggcguggucugcagccuaagaaacgcuuugcuuucaagacuagaggcaaggacgccgcaucaagcacgaaaguugaugcugccccagggauuccgcccgcggucgaaaguauacaagacuccccucucccaaagaaagccgagggagauuuaggccccucuugggugugugguuuuagcaaucuggaaucccagguacuugagaagagggcaucagaauugcaucagcgggacguucugcuaaccgagcucaguaacugcacagugcgacuguaugggaauccuaacacucuucgccugaccaaagcucacagcuguaaguugcucugcggaccagucucuacauccguguuccuggaggauuguucagacugcguguuagccgucgcuugucaacagcugagaauccauagcaccaaggauacuaggauuuuucuccagguuacaagucgggccaucguggaagacugcucuggcauucaguucgcacccuacaccugguccuauccugagaucgauaaagacuuugaaagcucgggccuugaccgcucuaagaauaacuggaaugauguagacgauuucaacuggcuggccagagacauggcuuccccaaauuggucaauauugccggaggaagagaggaacauccaaugggauuga

SEQ ID NO: 63576 - RNA, 3579 nt, Artificial Sequence
  derived and/or modified sequence opt3 from TBCD__Homo_sapiens__NP_005984
auggcccugagcgacgagcccgcugcaggcgggccugaagaggaagccgaggaugaaacccucgcguucggagcugcccuugaggcauuuggugaguccgccgaaacaagagcucuguugggcagguuacgggaggugcacgggggaggcgcagaacgcgaggucgcccuggagcgauuccguguuaucauggacaaguaccaggaacaaccacaucuacucgauccgcaccuggaguggaugaugaaccuucuguuggacauugugcaggaucagacuucucccgcuucacucguacaucuggccuuuaaauuccuguauauaaucacgaaggugagagguuacaaaaccuuucucagguuauucccucacgaagucgcggacguggagccaguucuggaucuugugacaauucagaaucccaaggaccaugaagcaugggagacucgguauauguugcugcuauggcucagugugaccugccugaucccuuuugauuucagccgccuugacgggaaccuguugacacaaccaggacaggccagaauguccauuauggauaggauccuccagauagcugagucuuaccugaucgucucggacaaagcccgggaugcagcugccguauuaguuucacgcuuuauuacccgacccgacgugaagcagagcaagauggcggaguuccuggacuggagucucuguaaucuugccagauccucuuuucaaacuaugcagggcgucaucacaauggauggcacccugcaggcauuggcucagauuuucaaacacgggaagagggaagacugccuaccuuaugccgcuacggugcugcggugucucgauggaugccgucugccagaaagcaaccaaacucuucugcgcaaauugggugugaagcucguccagagacugggcuuaaccuuucugaaaccgaagguugccgcauggagguaccagcgggggugucgaucccuagccgcuaaucuccaacugcuuacacagggacagucagagcagaagcccuugauccugacugaagacgaugacgaggaugacgaugugccugagggcguagaacgcgugauagagcaacuccuggucggucuuaaagacaaggauaccgugguuagauggagugcggcaaaagggauuggaaggauggccggccggcugccacgcgcuuuggccgacgacguggucggcagcgugcucgauugcuucucuuuccaggaaacagacaaggcauggcacgggggaugucuggccuuagcugagcuggguagaaggggccuacuccugcccucccgucuuguagauguuguggccgucaucuugaaagcacugaccuaugacgaaaagcgaggggcgugcucagugggaacgaacguccgggaugcugccuguuacgugugcugggcauuugccagagcuuacgagccucaggagcucaaaccauucguuacugccauuagcagugcacuggugaucgcugccguauuugacagggauaucaauugucgccgggcggccucugcugcauuccaggaaaacgucggcagacaagguacauuuccccaugggauugacauauuaaccacugccgauuauuucgcugugggcaauagguccaacugcuuucugguuaucagcguguucauugccggauuuccggaguacacacagccuaugaucgaccaccuugucaccaugaagauaucgcauugggauggcgugauucgcgaauuggcagcgcgagcccuccacaaucuggcucagcaggcccccgaguucucugcaacgcaaguauuuccacggcuacuguccaugacccucucaccugaccugcacaugcgucaugggaguauccuugcuugcgccgagguggcauaugccuuguacaagcuggcugcgcaggaaaacagacccguuacagaucacuuagacgagcaggccguccagggacucaaacaaauccaucagcagcuguaugacaggcaacuuuaccgcggucugggcgggcaguugaugcggcaggcagugugugugcucauugaaaagcugagccuauccaaaaugccauucagaggagauacugucaucgacggcuggcaguggcugauuaaugauacccucaggcaucugcaccuuauaucuagccacucacgacaacagaugaaggacgcugccguuagugccuuggcugcacugugcuccgaguauuacaugaaagaacccggugaggccgauccugcgauccaggaggaauuaauuacacaguaccucgcugagcugcgcaacccagaagagaugacucgguguggguuuagccuugcccugggcgcacuaccgggauuccuccugaagggcagauugcaacaggugcugaccggguuaagggccgugacacacaccucucccgaagacguaucauucgcugagagucgucgcgauggacucaaggcaaucgcccggaucugccagacugucggugugaaagcgggcgcuccugacgaggccguuuguggggaaaaugugagccagauuuauugcgcacugcuuggauguauggaugacuacacgacagauuccagaggcgacgucgguaccugggugaggaaggccgcuaugacuucucugauggauuugacccuccugcuagcccgaucgcaaccagagcugauagaagcacauacaugcgagcggaucauguguugcguugcucagcaggccagcgaaaagauugaccgcuuuagagcgcacgccgcauccguguuccuuacccuccugcauuuugacucacccccuaucccacacguaccccacaggggcgaguuggagaagcuguucccgcggagugaugucgcuucugugaacuggagcgccccuucccaggcuuuuccacgaauuacucaauuacucgggcugcccacauauagauaccaugugcuucugggauuggucguuucacucggcgggcugacggaaagcaccauccgccacucuacucagucccuauucgaguauaugaaaggaauacagagugacccucaagcacugggcagcuuuucugguacacuucuccagaucuucgaagauaaccuguugaaugagaggguguccguacccuuacugaagacccucgaccaugugcugacacacggguguuuugauauuuucacuaccgaggaagaccauccauuugccgucaaacuucuggccuugugcaaaaaggagaucaaaaacucaaaggauauucagaaacuacugaguggaaucgcuguguucugcgaaaugguucaguuuccuggcgacgugcgucggcaagcgcuccugcagcuuuguuuacugcucugccacagauuccccuugauaaggaagacgaccgcaagccaggucuacgagacacugcucacuuauucggaugugguuggugccgacgugcuggaugaagucguaaccgugcuuuccgacacagcuugggacgccgagcuggcaguugugcgcgagcagcgaaauagauugugugaucuacugggcgucccacggccgcaacucgugccucagcccggggccugcuga

SEQ ID NO: 63577 - RNA, 1584 nt, Artificial Sequence
  derived and/or modified sequence opt3 from TBCE__Homo_sapiens__NP_001072983
augagcgacacccugacagccgaugugaucggcagaagggucgagguuaacggggaacacgcuacugugcgguucgcaggaguagugcccccugucgccgguccauggcucggcguggagugggacaauccggaacgcgggaagcaugauggaucccacgagggcacgguuuacuuuaaaugccgacaucccaccggugggucuuucauucguccuaacaaggugaauuuuggaacagacuuccuuacugcgaucaaaaacagauauguccuggaagauggcccagaggaggacaggaaggaacagauagugaccauuggcaauaaacccguagagacaaucggguuugauucaauuaugaagcaacagagucaguugagcaaguuacaggaaguuucccugcggaacugugcugugucuugcgccggagagaaagguggcgucgcagaggccuguccuaauauccgcaagguggaccuaucgaaaaaccuccugucaagcugggaugaagugauacacaucgcugaccaacuuagacaucuggaggucuugaauguuagugaaaacaagcucaaauucccauccgggucugugcugaccggaacucugagcguacucaagguguuaguccugaaucagacaggcauuaccugggcagaggugcuuaggugcguugccgguugucccggguuggaagaacuguaccuagaguccaacaauaucuuuauuucagaacggccuacggaugugcuccagacugucaagcugcuugaccugaguagcaaccaguugaucgaugagaaucaacucuaucugauagcucacuuaccacgccuggaacagcucauucuuucugacaccggaaucuccucacugcacuucccggacgccggcauuggcugcaaaacaagcauguuucccaguuugaaguaccuagugguaaacgauaaccagaucucucagugguccuucuuuaaugagcuggaaaaacucccuagccugcgagcgcuuucgugucugagaaacccauugacuaaggaggacaaagaggcagaaaccgccaggcuccugaucauugcuucuauagggcaauuaaagacacugaauaaaugcgagauccuacccgaggagcggcgucgcgccgaacucgauuauagaaaggcauucggaaacgaguggaagcaggcugguggccauaaagacccugagaagaauaggcuguccgaagaguuucuuaccgcccacccacgguaccaguucuugugucugaaauauggggcgcccgaagauugggagcucaagacgcaacagccgcugaugcuuaaaaaccagcuguugacucucaagauuaaguacccucaucagcuggaccaaaaaguuuuagagaagcagcugcccggaucaaugacaauccagaaagugaagggccuacucagucgacugcuuaaagucccagugagcgauuugcugcucuccuacgaaucuccuaagaagcccggucgcgagauagaacuggagaaugacuuaaaaagccugcaguucuauucagucgaaaacggggauugccuuuuggugagaugguga

SEQ ID NO: 63578 - RNA, 1275 nt, Artificial Sequence
  derived and/or modified sequence opt3 from TBCEL__Homo_sapiens__NP_001123519
auggaccagcccagcggcagauccuucaugcaagugcugugcgagaaguacucuccugaaaacuuuccauauaggcgggggccgggaauggguguccacguucccgccaccccucagggcucaccaaugaaagaucgccucaaucuucccagugugcugguauugaacagcugugggaucacaugcgcuggagacgagaaggaaauugcagccuucugugcgcauguguccgaguuagaucugucugacaauaaacuagaagauuggcacgaggucucgaagauagugucaaacguuccucagcucgaguuucugaaucuuagcaguaacccacugaauuuguccgugcucgaacgaacuugcgcuggcucuuucagcgguguccguaaacuggugcugaacaauuccaaggccucaugggagacgguacauaugauccuccaggaauuacccgaccuggaggaguuguuucuuugucugaacgauuacgaaaccguuaguugcccuagcauuuguugccacucucuaaagcuccugcauaucacagacaauaaccuucaagauuggacugagauuagaaaacugggggugauguucccauccuuggacacccucguccuggcaaauaaccacuuaaaugccaucgaggaaccggaugacucacuggcuaggcucuuucccaaccuucggagcauaagucugcacaagucuggauugcaguccugggaagauaucgacaaacuaaacagcuucccuaagcuggaggaggugcgccuccugggcauuccacuucugcagcccuauacaaccgaagagagaaggaaauuggugaucgcacggcucccuucggucucuaagcugaauggcuccguugugacugacggggaacgcgaggauucagaacgauuuuucauuagauacuauguagacgugccacaggaggagguccccuuuagguaccaugaauuaaucacaaaguauggaaaacuggagccgcuagccgaaguggaucuccggccucaaaguagcgcuaagguugaggugcacuucaacgaccaggucgaagagauguccauacgucuggaucagaccguggccgagcuuaaaaagcaguugaaaacgcugguacaacuccccacuucuaauaugcugcuuuacuacuuugaccaugaagcgccauucgguccugaggaaaugaaguauagcucacgcgcacugcacaguuucggcauuagagauggggacaaaaucuacguugaguccaagaccaaguga

SEQ ID NO: 63579 - RNA, 2190 nt, Artificial Sequence
  derived and/or modified sequence opt3 from TBK1__Homo_sapiens__XP_005268867
augcagagcaccuccaaccaccuguggcuccuuucugacauccugggccaaggggccacagcuaauguguucagaggaaggcauaagaaaacuggugauuuguuugcaauuaaggucuucaacaauauaucauuuuuacggcccguugacgugcagaugcgcgaguucgaaguacugaaaaagcuaaaccacaaaaauaucgugaagcucuuugccauugaggaagagacgaccacacgacauaagguccugaucauggaguucugcccuuguggcagucuuuacacugugcuggaggagccaagcaacgcguauggguugccggaauccgaguuucucauuguucugcgugauguggucggaggcaugaaucaccugagagaaaacgguaucgugcauagggacauaaaacccgggaauaucaugcggguaauuggagaggauggccagucuguuuacaagcucaccgacuucggcgcugcccgcgaguuagaagaugacgagcaguuugugucgcuguaugggacagaagaguaccuucacccugauauguaugaaagagcagucuugaggaaagaccaccaaaagaaauacggagccaccguggaucuguggucaaucggugugacuuucuaucaugcugcaacaggcagccuaccauuucggcccuucgaggggccucgccgaaacaaggaggucauguacaagauuaucaccggaaaaccaaguggcgccauauccgguguucagaaggcugaaaaugggcccauugacuggucuggagauaugccugugagcugcucccucucaagaggccugcagguacuucugacgccaguguuggccaacauccucgaggcggaccaggaaaaauguuggggcuuugaccaauucuucgcagagaccagugauauucugcacaggauggucauccauguguuuagcuuacagcagaugacugcccacaagaucuacauucacucuuauaauacagcuacuauauuccaugaacugguuuacaaacagaccaagaucauuuccucaaaccaagagcucaucuaugaggggcggcgucuugugcuggaaccgggacgcuuggcccagcacuuucccaaaacaaccgaggaaaauccuauauucgucgugagcagagagccacuaaacacgauuggucugaucuacgaaaagaucagucuccccaagguacauccuagguaugaccuggauggcgacgcaucuauggcuaaagccauuacugggguugugugcuacgcgugucggaucgccuccacacuucuguuguaucaggagcucaugcgaaagggcauucgcuggcugauagaguuaaucaaagaugacuacaacgaaaccguccacaagaaaacugagguggucauuacacuggauuuuugcaucagaaauaucgaaaagaccgugaagguuuacgagaaacuaaugaagauuaaccucgaggcagcugaacugggagagauaagcgacauccauacgaaacuuuugaggcugucgucuucccaagguaccauugaaacaucacuccaggauaucgacagucggcugagcccagggggcucccuugccgaugcuugggcccaccaggagggaacucaccccaaggaccgcaauguggaaaaacugcagguauugcucaacuguaugaccgagauuuauuaccaauucaagaaggacaaagcagagagaaggcuggccuauaaugaagaacagauccauaaguuugauaaacagaaguuauacuaucacgcuacaaaagcgaugacucauuucaccgacgaaugcgucaagaaguacgaggcauuucugaacaaaucugaagaguggauacguaagaugcuacaccuccggaaacagcugcuuagcuugacaaaucaauguuucgauaucgaggaagaggugucaaaguaucaggaauacaccaacgagcugcaggaaacucucccgcagaaaauguuuacggccaguuccggcauuaagcacacaaugaccccuaucuaccccagcucuaauacucugguugagaugaccuuagggaugaaaaagcugaaggaggaaauggagggaguggucaaagaacuugcugagaacaaucauauuuuggagcgauucgguucacucacaauggacggcgggcugagaaacguggauugccuauga

SEQ ID NO: 63580 - RNA, 1848 nt, Artificial Sequence
  derived and/or modified sequence opt3 from TBKBP1__Homo_sapiens__NP_055541
auggagagcauguucgaagacgauaucuccauucugacccaggaggcccucggccccucugaaguguggcuugacucaccuggggauccaagucugggaggugacaugugcagcgcuucccacuuugcauugauaacagccuacggcgauaucaaggagagauuagggggacuggaaagggagaacgcgacucuacggcgccgacucaaagucuaugagauuaaguacccgcugaucucugacuucggcgaagaacaugguuuuucgcuuuaugaaauuaaagaugggucacuguuggagguugagaaggugagccuccaacagcgucugaaucaguuccagcacgaacugcagaaaaacaaggagcaagaggagcagcucggagaaaugauccaggcuuacgagaaguuauguguagagaaaagugaccuggaaacggagcuuagagaaaugagggccuugguggagacccaucugcggcaaauaugcggccuagaacagcagcuccgccagcaacagggccugcaggaugcagccuuuuccaaucuuucucccccuccagcucccgcaccuccauguacagaccuggauuugcacuaucucgcccugagagggggaagcgguuuaucccaugcuggcuggcccgggucaacuccuagugucagcgaccuggagaggcggcgccucgaggaagcccuugaggcggcacaaggagaagcccgaggcgcucagcugagagaggaacaguugcaggccgagugcgagaggcuacaaggugaacugaagcagcuccaggagacccgggcacaggaucuggcuucuaaccaauccgaacgugacauggccugggugaaacgcguuggggacgaucaggugaaucuugcgcuggccuacacagaguugaccgaggaacucggaagacugagggaguuaucaagccugcagggccggauccuacgaacucuccugcaggaacaagcacgcaguggcgggcagagacacucuccacuuucccagaggcacagcccggcuccccaguguccuucgccaucucccccugcccgggcugccccacccugcccgccuugucaaucccccgucccacagcgcagaucaccugugcccccaugccccaguccucagcaaaggcguagcccagcauccccgucuugucccagcccuguaccacagcggcgaucacccguuccuccaaguugccagucccccagcccgcagagaaggucuccugugccacccucauguccugcuccccaaccacgcccucccccaccgccucccccaggagagcggacauuggccgaaagagcguaugcaaagcccccuagucaucacgucaaagccgguuuccagggcaggcgcagcuacuccgagcuggcugagggggccgcauacgccggagcuucuccacccuggcuccaggccgaagcagcgacccugccuaagccgcgagcuuauggcucggagcuuuacgguccagggcggccccugagcccucguagagccuuugaaggcauuagguugcgcuucgagaagcagccauccgaagaggacgagugggcagugcccacgucaccuccgagucccgaagugggaacuauccggugcgccucuuuuugcgcuggcuucccaauuccugagagccccgccgcaaccgcuuaugcccaugcggaacacgcccaauccuggccaucaaucaaccuccugauggagacagucgggagcgauauaagaucuuguccuuuaugccagcugggauuucccguugguuacccagacgaugcucuaauuaaacacaucgacucccaucucgaaaauaguaagauuuga

SEQ ID NO: 63581 - RNA, 1734 nt, Artificial Sequence
  derived and/or modified sequence opt3 from TBL1X__Homo_sapiens__NP_001132938
augacggagcuggccggcgcuagcuccucuugcugucacagacccgcagggaggggagccaugcagucagugcuccaucacuuccaacggcuucgcggucgagaaggcgggagucauuuuaucaacacaagcuccccucguggagaggcgaagaugucuauuacuucggacgaagucaauuuccugguuuacagauauuugcaggagucaggcuuuagccacagugcuuucacguuugguauagaaucccauaucucucagagcaacauuaaugggaccuuagugccaccggccgcacugaucuccauucuacagaaaggacuccaauacguagaggccgagaucucaauaaacgaagauggcacaguguucgacggcaggcccaucgagagucugagccuuauugaugcugucaugccugacgugguucagacucggcagcaggcauuucgcgaaaagcuggcccaacagcaggcuucugccgcggcagccgcugccgcagcuaccgccgcggccacagcagcuaccacuacauccgccggggugucacaccagaauccaagcaaaaacagagaggcuaccgucaauggagaggaaaacagggcccacagugugaauaaccaugcaaagcccauggagaucgauggugaaguagagauuccuucuuccaaagccacgguuuugcggggccacgaaagcgagguguucaucugcgcuuggaauccagucucggaccuccuggcgucuggguccggagauucaacugcacgcauauggaaccugaaugagaacaguaauggcgguagcacccaacucguguuacgacauuguauuagagaagggggacacgacgugcccuccaacaaggaugucacaucucuggacuggaacacuaauggcacccuuuuggccacaggcagcuaugauggguuugcuaggaucuggaccgaggacggaaaccuggccucaacgcuaggucagcacaagggcccuauuuucgcacucaaauggaaucggaaggggaacuacauccugagugccggaguugauaaaacuacaaucauuugggacgcucauaccggcgaagccaagcagcaauuuccauuccacuccgcaccggcgcuugacguggauuggcagaauaacacuacauuugcuagcugcucuaccgacauguguauacauguaugccgucuggguugugaucgccccgugaaaacguuccaggggcacaccaaugaggucaacgccaucaagugggacccuucaggcauguugcucgcaaguugcagcgaugacaugacacugaagauuugguccaugaaacaggaaguguguauccaugauuuacaagcccacaauaaggagauauauacuauuaaauggucuccaaccggacccgcuacaucgaacccuaauagcaacaucaugcuggccuccgcaucauucgacaguacuguuagacucugggauaucgagaggggcgugugcacccacacacuuaccaagcaucaggaaccagucuacucuguggcuuuuagccccgacgggaaauaucuggccuccggaucauucgauaaguguguacacauuuggaauacucagagcgguaacuugguucauucuuaccggggcaccgggggaaucuuugaggugugcuggaaugcgcgaggcgacaaagucggugccuccgcuagugacgggagcgugugcguccuagaucugcgcaaguga

SEQ ID NO: 63582 - RNA, 1575 nt, Artificial Sequence
  derived and/or modified sequence opt3 from TBL1XR1__Homo_sapiens__XP_005247828
augggcgugaagcaccagcaacagcagcuggucaucgggggagacagaauuuucagcugcaccucuccccaucaguguacagccaacgguuuuucccacucagcuuucacuuuuggcauagagagucauaucagccaauccaauauuaacggggcacucguuccuccagccgcgcuuaucucuauuauccagaaaggacugcaguacguggaagcugagguaucgauaaaugaagauggcacguuguucgacgguaggccgaucgagucauuaagccugauugaugccgugaugcccgacgucgugcagacccggcaacaggcauaucgcgauaagcuagcccagcagcaagcugcagccgcugccgcggcagccgcugccgcaagucagcagggguccgcuaaaaacggagaaaauacagccaacggcgaggagaauggcgcgcacacuaucgccaacaaucauaccgacaugauggaaguugauggggacguggagauuccuccaaacaaggcagucgugcuccgaggacacgaaucugagguauuuaucugcgcuuggaaucccguuagcgaucugcuugccuccgguucaggcgacaguacagcucguauauggaaccugagcgaaaauucuaccuccgggucaacucaauuggugcucagacacuguauuagggagggaggccaggaugucccuagcaacaaagacgugacaagucuggauuggaacucugaggguacccugcucgccacgggguccuacgacggauucgcacggaucuggacuaaggacggcaauuuagccagcacccugggccagcauaaggggccaauuuuugcucuuaaauggaacaagaaaggaaauuucaucuugucggcggguguggauaagacaacuaucauuugggacgcacacaccggcgaagccaaacagcaauuucccuuccauucugcuccugcccuggaugucgacuggcaguccaacaauacauuugcaucaugcaguaccgauauguguauacacguuugcaagcuagggcaggaccgcccaaucaagacguuccagggacacacuaacgaggugaaugccauuaaaugggauccgacaggcaaccuccuggcuagcuguuccgacgauaugacccuuaagaucuggucuaugaaacaagacaauugcguacaugaucugcaggcccacaacaaggaaauauauacuauuaaauggagccccacagguccugggaccaauaacccaaaugcaaacuugaugcucgcgucagcuaguuuugacuccacggugagacugugggacgucgauaggggcaucuguauccauaccuuaacaaagcaccaggagcccguguacagcguugccuucucuccugacggacgguaucuggcaucaggcaguuucgauaaaugcgugcauauuuggaauacucagaccggggcccucguccacagcuaccgcggaacagguggcaucuuugagguguguuggaacgcugccggggacaagguaggagcauccgcuucugauggcucgguuugcgugcuugaccugcgaaaguga

SEQ ID NO: 63583 - RNA, 1569 nt, Artificial Sequence
  derived and/or modified sequence opt3 from TBL1Y__Homo_sapiens__NP_599021
augagcaucaccuccgacgaggugaacuuccuggucuacagauaucuccaggaaucuggcuuuucacacagugccuucacauuugggauugagagccauauaucccaaucuaauaucaacggaacucuuguucccccuucggcucugauuucaaucuugcagaaggguuuacaguacguggaagcagagauuagcaucaauaaagauggcacgguauucgacaguaggccaauagaaucccugucucuaaucguggccgucauuccggaugugguucagaugcggcaacaggcguuuggggagaagcucacccagcagcaagcuagcgccgcagccacagaggcuuccgcaauggccaaagcugccacuaugacccccgcggcaaucucacagcagaacccuccaaagaaucgcgaagccacagugaacggagaggaaaauggcgcucacgagauuaacaaucauaguaaacccauggagaucgacggugaugucgaaauaccuccaaacaaggccaccgugcugcgagggcacgagagcgaaguauucauuugcgcauggaaucccguuucugaccuucuggcuuccggaucaggcgauagcacugcccguaucuggaacuugaaugagaacaguaauggcgggucuacacagcucgugcugagacauuguauuagggaaggaggucacgacgucccuuccaacaaggaugugaccagccuggacuggaacucggauggcacgcucuuagcgauggggucuuaugacggauuugcccggaucuggacugagaauggcaaccuggcauccacccuuggucaacacaaagggccaaucuucgcuuugaaguggaauaaaaagggaaacuacgugcugucagccggcgucgauaaaacaacuauuauaugggacgcucauaccggcgaggccaagcagcaguuuccguuccacagugcacccgcccuagacguugauuggcaaaauaacaugacauuugcuagcugcuccaccgacauguguauccaugugugccgccucgggugugaucacccuguaaagacguuccagggacacacuaaugaagugaacgcgauuaaaugggacccaucugguaugcugcuugcaagcugcucagaugacaugacacugaagaucuggaguaugaaacaggaugccuguguccaugacuugcaggcucacuccaaggagauauauaccauuaaauggagccccacuggcccugccacaucuaauccaaacucaaguaucaugcucgcaagcgccuccuuugauucuaccgugagacugugggacguugaacaaggggugugcacgcauaccuuaaugaagcaccaggagcccgucuacucgguggcuuucagcccggauggaaaauaucuggccuccggcucauucgacaaguacguacauaucuggaauacacagagugguucucucguucacagcuaccaggggacuggcggaauuuuugaaguguguuggaacgcaaggggcgacaaggucggggcguccgcuucagauggaagcgugugcguccuugaccuguga

SEQ ID NO: 63584 - RNA, 1344 nt, Artificial Sequence
  derived and/or modified sequence opt3 from TBL2__Homo_sapiens__NP_036585
auggagcugagccagauguccgaacucaugggccuuucugugcuguugggguuacuggcccuaauggcuaccgcagccgucgcgagaggauggcucagggcuggugaggaacggucaggccgccccgccugccaaaaggcaaacggguucccuccagacaaaaguagcggauccaagaaacagaagcaguaccagcgaauccguaaagagaagccgcaacagcacaauuuuacacauagacugcuugccgcugcacugaagucucacucgggcaacauuucauguauggauuucagcaguaaugguaaauauuuggccacuugcgcugacgauaggacgauacggaucugguccaccaaggacuuucuccagcgcgaacauagaucuaugagggccaacguugagcuggaucacgcgacacuggugcgguucagccccgacugucgcgcauuuauuguauggcucgccaauggggauacuuuacgaguguucaaaaugaccaagagagaggacggaggcuacacauuuaccgcuacuccugaagauuuccccaaaaagcauaaggccccagucaucgacauuggcaucgcaaacacagggaaauuuauaaugaccgcuuccucagauacgacugugcugaucuggagucuuaagggacagguuuugagcaccauuaauacaaaccaaaugaauaacacucacgccgcggugucuccuugcgguagguucgucgccuccuguggcuuuaccccagacgugaaaguaugggagguuugcuucgggaagaaaggagaauuucaggaggugguccgggcauucgagcugaagggccacucagcugccgugcauagcuucgcuuuuaguaaugauucucgucgcauggccuccgugagcaaagacgguacauggaagcuaugggacaccgaugucgaauauaagaaaaagcaggaccccuaccuccugaaaacggggagauucgaggaagcagccggagcugcgccuuguaggcuugcacugucgccaaacgcccagguuuuggcucucgccucuggcuccucaauccaccuguauaauacucggcgaggcgagaaggaagagugcuuugagcgcgugcauggggaauguauugcaaacuuaaguuucgauaucacaggaagauuucuggccagcugcggugacagggcuguacgccucuuccacaauaccccgggccaccgggccaugguggaggaaaugcaagggcaucuuaaaagagcauccaacgagucuacuaggcagcgucugcagcaacaguugacacaggcgcaggaaacccuaaagagccugggagcucucaagaaauga

SEQ ID NO: 63585 - RNA, 2427 nt, Artificial Sequence
  derived and/or modified sequence opt3 from TBL3__Homo_sapiens__NP_006444
auggccgagaccgcugcaggcguggggagauucaagacaaacuacgccgucgaaaggaaaaucgagcccuuuuauaagggagguaaagcgcagcuggaccaaacuggccagcaccucuucugcguuugugggacgcgggugaauauucuugaaguagcuagcggagccgugcugcgcuccuuggagcaggaagaucaggaggacauaaccgcauuugauuuaucuccugacaacgagguccuggugacagccucacgagcucuacuccuggcacaaugggccuggcaggaaggcaguguuacucgucuuuggaaggcuauccauaccgccccaguggcgacaauggcauucgauccgaccagcacucuguuggccacaggugggugcgacggagcugucagagugugggauauuguaaggcacuacggcacccaucacuuucggggcucccccgggguugugcaucucgucgccuuccacccugacccaacgcgccugcugcucuuuucuucggcaacugaugcugccaucagaguguggucauuacaggacaggagcugucuggcggugcuuaccgcccacuauagugcagucacauccuuggcuuucucugccgauggacauacuaugcugagcuccggucgggacaaaauuugcaucauaugggaucuacagucaugucaagcuacccgcacaguucccguguuugagaguguagaagccgcagugcuccugccugaggagccagucagccagcuuggcgugaagucucccgggcuguacuucuugaccgccggagaccagggcacgcuccgaguuugggaagcugcguccggucagugcguguauacucaagcacagccuccagggccgggacaggagcugacacacuguaccuuagcccauacugcuggcgucgugcugacagccaccgcagaccacaaucuccuucuguacgaagccagaucauugaggcuacaaaagcaguuugcuggcuauagcgaggaaguacuggauguucgguuccucgggcccgaggacagucacguggucguggccucuaacuccccuugccugaaagucuuugagcuucagacgagcgcaugucagauccugcauggacacaccgauauuguguuggcgcucgacguuuuccguaaggguuggcuguucgcuucgugcgccaaagaucaaucugugcgcaucuggagaaugaauaaggcaggccagguaaugugugucgcccagggguccggacauacacacucagugggcacuguuugcugcaguagguuaaaagagagcuuucuggugaccgguucccaggacuguacagucaagcuauggccacuccccaaggcucugcuuucuaaaaacacugccccugauaaugggccaauuuugcugcaagcacagaccacacagcggugccaugacaaggauaucaacagcguggcuauagcccccaaugacaaacuccuggcgaccggcucacaggaucgaacugccaaacuuugggcucugccgcaaugucaguugcucggaguauucaguggccaccgcagagggcuguggugcgugcaguuuuccccuauggaccagguuuuagcaacggccagcgcugacggaacaauuaagcugugggcccuacaagauuucucuugucucaagaccuuugaaggucacgacgcaucaguccugaaaguggcguucgugaguaggggcacucagcuuuugagcuccgggucugauggacuggucaagcucuggaccaucaagaacaaugaaugcguucggacacuggacgcccaugaggauaaaguguggggcuuacacuguucgcgccuggacgaucaugcucuuaccggugccagcgacuccagagugauuuuguggaaggauguaacugaagcagagcaggcugaggaacaagccaggcaggaggaacaggucgugcgucagcaagagcucgacaaccugcuacacgaaaaacgguaccugcgagcacucgggcuggccaucucacuugauagaccccacacaguuuugacggugauccaggcuauuaggcgcgacccagaggcgugcgagaagcuggaagccaccauguuacggcucagaagggaucagaaagaggcacugcuucgcuuuugugucacuuggaauacaaacagucgacauugccacgaagcucaggccgugcugggcguuuugcuccggcgugaggccccugaggaacugcuagcuuacgagggagugagagcagcccuggaagcgcuccugcccuauaccgagaggcauuuccaacgccuuucucggacauugcaggcugccgcauuucuggacuucuuauggcacaauaugaagcucccaguacccgccgcugcaccuacuccaugggaaacccauaagggcgcccugccguga

SEQ ID NO: 63586 - RNA, 960 nt, Artificial Sequence
  derived and/or modified sequence opt3 from TBP__Homo_sapiens__NP_001165556
augacccccggcaucccuauuuucagcccaaugaugccguacgggacaggacugacuccccagccuauacaaaacaccaauucccucucuauccuugaggaacagcagagacagcaacagcagcagcaacagcagcagcaacagcagcaacagcagcagcaacagcagcagcaacagcagcagcaacagcagcagcaacagcagcaacagcagcagcaacagcaggccguggcugcagccgcgguccagcaaucaacgagucagcaggcuacacaggguacuagcggccaagccccacagcuguuucacucccagaccuugacaaccgcacccuuaccugggacuacaccacuguaucccucuccuaugaccccaaugacgccgauuacucccgccaccccugcuucggagucaagcggaaucguuccacaacuacagaacauugugaguacaguaaaucucggcugcaagcuggaccuuaaaacuaucgcacugagggcccggaacgcugaauacaaucccaagcgcuucgccgcggugauaaugcgaauccgugagccuagaaccacagcauugaucuuuuccucugguaaaauggucuguaccggggccaagagcgaggaacaguccaggcucgcugcccggaaauaugcacgcgugguucagaagcugggauucccagcuaaguuucuggauuucaaaauucaaaacauggugggcucaugcgacgucaaguuucccauuagacucgagggcuuagugcugacgcaucagcaguucaguagcuacgaaccggagcuuuuuccuggguugaucuauaggaugauaaaaccccggauuguacugcuaaucuucguuucuggaaaggugguccucacuggugccaaagugcgcgcggaaauuuacgaggccuuugagaauaucuauccaauccugaagggcuuccgaaagacaaccuga

SEQ ID NO: 63587 - RNA, 561 nt, Artificial Sequence
  derived and/or modified sequence opt3 from TBPL1__Homo_sapiens__NP_004856
auggacgccgauagcgacguggcucuggauauccucauuaccaacgucguuugcguguucagaacaaggugucaccuuaaucugcggaagauagcauuggagggcgccaacguaaucuacaaacgcgacguggggaaggucuuaaugaaacugcgaaagccccguauuacugcgacgaucugguccucuggaaaaauuaucugcaccggugcuacaucagaagaggaagccaaguuuggcgcaagaaggcuagcccggagucuccagaagcugggguuccaagugauauuuacugauuucaaaguugugaauguccuugcuguguguaacaugccuuuugagauccgccugccagaguucaccaagaauaacagaccgcaugcaagcuaugaacccgaguugcacccugccguaugcuacaggauuaaaucccuccgggcuacacugcagaucuuuucuaccggaucgauuacuguuacaggcccaaaugugaaggccgucgcgaccgcaguggaacagaucuaucccuucguguuugagucacgcaaagaaauacuguga

SEQ ID NO: 63588 - RNA, 1128 nt, Artificial Sequence
  derived and/or modified sequence opt3 from TBPL2__Homo_sapiens__NP_950248
auggccagcgcucccuggccugagagagugccaaggcugcucgcaccgcggcuucccuccuacccuccacccccuccaaccgucggccugcgcucuauggaacaggaggaaacauauuuggaguuauaccuggaccaaugcgccgcgcaggaugggcuagcucccccucgaucaccacucuucaguccgguugugcccuaugacauguacauccugaacgccagcaauccugauacugcauuuaacuccaauccagaaguaaaggagacgucuggagacuucucgucaguggaucuuagcuuucugcccgacgaggucacccaggaaaacaaagaucagccugugauuaguaagcacgagacagaagagaauagcgagucucaaagcccacagucccguuugcccucaccgagugaacaggacguuggucucggccugaacuccucuucccugucaaauagccauagucagcuccacccuggggauacugacucugugcaacccuccccagagaaaccuaacagcgauucguuaucucuggccuccauaacccccaugacaccaaugacccccaucucagaauguugcggaauugucccucagcuucagaauaucgugaguacuguaaacuuggcuuguaagcuggaccucaaaaagauugcacuacaugccaagaaugcugaguauaacccaaaaagauucgccgcgguuaucaugaggauacgggaaccgcgcacaaccgcacugaucuuuagcuccggcaagauggugugcacgggugccaaaucugaggagcagagcagacuugcugccaggaaguacgcacgggucgugcaaaaacugggguuccccgcucgcuuuuuggauuucaagauucagaauauggugggaucaugugacguccgauuuccuaucagacucgaaggccugguuuuaacucaccagcaauucaguuccuaugagccagaacuguuucccggccucauuuacaggauggugaagccucggaucguacuucugauauucgugagcgggaaagucguguugaccggagccaaggagcguucugaaauuuacgaggcguuugagaacaucuauccaauucuaaaagguuucaagaaagccuga

SEQ ID NO: 63589 - RNA, 2049 nt, Artificial Sequence
  derived and/or modified sequence opt3 from TBR1__Homo_sapiens__NP_006584
augcagcuggagcacugccucagccccuccaucaugcuuucuaagaaauuccugaacgugucaaguagcuacccucauuccggcgggucugaauuggucuuacacgaccauccaauuauaucgaccacagauaaucuggagagaucaagcccgcuaaagaaaaucacuaggggaaugacgaaccaaagugacaccgauaauuuucccgacuccaaggauucuccuggugacguucagcggagcaaacucuccccagugcuggauggcguaucagaacuucgccacaguuucgacgggagcgccgcugaucgauaucuguugucucaguccucacagccccaaagcgcagccacagcgccuagugcuauguuuccauaccccggacagcauggcccugcccacccagcauucucuauugguuccccgagccguuauauggcccaccaucccgugaucacuaacggggcuuacaauucgcuccugucuaacuccucaccucagggauauccaaccgcaggcuaccccuauccucagcaauacggccacaguuaccagggggccccauuuuaucaguucagcuccacacagcccggacuggucccggguaaggcucaaguguaccucuguaauagaccuuuauggcugaaguuucauaggcaccagaccgagaugauuaucacuaaacagggccggcgcauguuccccuuucuuucuuucaacauaagcggguuggacccaacagcccacuauaauaucuuuguugaugugauucuggcggacccuaaccauuggagauuccaaggaggcaaguggguccccugcgguaaagcagauaccaaugugcaggggaacaggguauacaugcacccagacucacccaauacgggagcccauuggaugcggcaggaaaucaguuuuggcaagcuaaaacucacuaacaauaagggcgcuuccaacaacaaugggcagaugguugugcugcaaagccuucacaaguaucagccucgccugcaugucguggaggugaacgaggacggaaccgaagauacaucucagccaggucgaguccagacuuucaccuucccggagacacaauuuauugccguuaccgcauaccagaauacggacaucacucaguugaaaauagaucacaaccccuucgcuaagggcuuuagagacaauuaugauacaauuuacaccgggugugacauggauaggcucacuccuucaccaaacgacaguccccggagccagaucgugccuggagcccguuacgcgauggccggcuccuuccugcaagaucaguuuguaucuaauuaugcaaaagcucgcuuccacccaggugccggggcuggccccggaccgggcacagacagaucggugccucauaccaacggguuacugagcccacagcaggccgaagaucccggagcaccuucaccccaaaggugguuugucacgccagccaauaaccggcucgacuucgcugcguccgcauacgacaccgccacagauuuugcugguaaugccgcaacucuucugaguuaugccgcugccggcgugaaggcauugccucuacaggcggcugggugcaccggacgaccccugggcuacuaugccgacccaucugguuggggcgcacgcagcccgccucaguacugugggacaaaauccggaucaguucuccccugcuggccaaacagcgccgcugccgcagcuagaauggccggcgcgaaucccuaucugggggaggaggccgaaggacuugcugcagagaggucuccucugccacccggugccgcugaagaugccaagccuaaagacuuguccgauaguagcuggauugagacuccgucuuccaucaagucaaucgacaguagcgauucgggcauuuacgaacaagcaaagcggcgcagaauauccccagcggacacccccgugucugagagcucaaguccucucaaauccgagguccuggcccagagggauugugaaaagaacugcgcuaaagacaucucuggguacuauggauucuacagccacuccuga

SEQ ID NO: 63590 - RNA, 1236 nt, Artificial Sequence
  derived and/or modified sequence opt3 from TBRG1__Homo_sapiens__NP_116200
augagccugcucgacggccuugccuccucucccagagcuccucugcagucaaguaaggcaaggaugaaaaaguugccgaaaaagagccaaaacgagaaauaccgguuaaaguaucugcgccuacgaaaggccgcgaaagcuaccguguucgaaaaugccgcaaucugcgaugagauugcccgucucgaagagaaguuucugaaagcuaaggaagagagaagguaccuucugaaaaaguugcuccagcugcaggcacugacagagggggaaguccaggccgcugccccaucccacucuucgucacuccccuuaacuuauggaguugcgagcaguguggguacgauacaaggcgcagggccuaucuccggaccaucuaccggcgccgaggaacccuucgguaagaaaacaaagaaagagaagaaagagaaggggaaagaaaacaauaagcuggagguacuuaagaaaacuuguaagaaaaagaaaauggcuggaggcgcccggaaguuggugcagccuauugcacuggacccaagcggccgccccgucuuuccuaucgggcuaggaggucucaccguguacucccugggcgaaauuaucacagauagaccaggguuccacgacgagucagcuauauauccgguuggauacugcaguaccaggaucuaugccagcaugaagugucccgaucagaaaugccuuuacacuugucagauuaaggacggcggugugcaaccucaguuugaaaucgucccagaggaugacccccagaacgcgauugugucuuccucagccgaugcaugccacgcugagcuguugcggacaaucagcaccacgauggggaaacucaugccuaaucuguuaccagccggagcugacuucuuuggcuucagucaucccgccauacacaaccugauucagucuuguccgggcgcacgcaagugcaucaauuaccaauggguaaaauuugauguuuguaagccuggggacggacagcuccccgaaggucuuccagagaacgaugccgcuauguccuucgaagcguuucagcgacaaauuuucgacgaggaccagaaugauccucuguugcccggcagccuagaccugccagaacuccagcccgcagccuuugugucgucuuaucagccuauguaccugacucaugagccacuugucgauacccaucugcaacacuugaaguccccgucacaggggagucccauccagagcuccgacuga

SEQ ID NO: 63591 - RNA, 1158 nt, Artificial Sequence
  derived and/or modified sequence opt3 from TBX10__Homo_sapiens__NP_005986
auggccgcuuuccugagcgcaggccucgggauccuugcccccuccgagaccuacccucugccaacaacuucuucaggaugggaaccgagauuggguagucccuuuccuagcggcccaugcacguccucuaccggggcgcaggcuguggccgagcccacaggacaaggcccuaagaacccaagggucucgcggguuacugugcaguuagaaaugaaaccccugugggaggaguucaaucagcuagguaccgaaaugauuguaacaaaggcagggcgccgaauguuuccuccauuccaggugaaaauacucggaauggacucacuggccgauuaugcacuucugauggacuuuaucccguuggaugacaagcguuacagauaugcuuuccacagcagugccuggcucgucgcuggcaaagccgaucccgcgaccccuggcagggugcauuuucacccagacucccccgcaaagggggcccaauggaugcggcagauuguuucuuucgauaagcugaaacugacuaacaaucucuuagacgauaacggacauaucauucugaauagcaugcaccgcuaccagccuagauuucauguggucuucguggacccaaggaaggauuccgagcgguaugcucaggaaaacuuuaaaucauucaucuuuacagagacccaauucacggccguaacugcauaccagaaucaccgcauaacccagcuuaagaucgcuaguaaccccuucgccaaagguuuucgagaaagcgacuuggauucuuggccgguugcgccuagaccccugcuauccgugccagccaggucacacagcagucucucuccuuguguccugaagggcgcaacagaccgggagaaggaccccaauaaggcuuccgccagcacuucgaaaaccccagcuuggcuucaucaccagcuguugcccccuccagaggugcuccuggccccggcaacauaucgucccgugaccuaccaaucuuuauacuccggggccccuucacaucugggcauuccacgcacgagacccgcuccuuauccacuccccaacaucagggcggaucgggaccagggaggucuuccgcugccugcaggguugggacuacugaguccaacugucguuugccucggccccggccaggauagccaauga

SEQ ID NO: 63592 - RNA, 1824 nt, Artificial Sequence
  derived and/or modified sequence opt3 from TBX18__Homo_sapiens__NP_001073977
auggccgagaagagaaggggcagccccugcuccaugcugucucucaaagcucacgcauucucaguggaagcccuuaucggggcggagaagcagcaacagcugcagaaaaagcggcgcaaauugggagcugaagaggccgccggugcagucgacgauggcggguguagucgaggaggcggugcuggggaaaagggaagcuccgagggcgacgagggcgcagccuuaccuccaccggcuggggccaccucuggacccgcgcguucgggugcagaucuggaaagaggcgccgcugggggaugcgaggacggcuuucagcaaggugccucaccucuagcaagcccagggggaagucccaagggcuccccugcuaggucucucgcccggccaggcacaccccugccuagcccacaggcgccgcgcguugaucuucagggggccgaacuguggaaaagauuccaugagauuggaacugagaugauaaucacgaaggcagguaggcggauguuucccgcuaugcgcgugaaaauuuccggcuuggacccucaccagcaauacuauaucgccauggauauuguaccaguggacaacaagcgauacagauaugucuaccauucaaguaaauggaugguggcugggaaugccgauagccccguuccuccaaggguguauauccaccccgacucuccggcauccggagaaaccuggaugcggcaggucauaucauucgauaagcucaagcugacaaacaaugagcuggacgaucagggccauaucauucuccacagcaugcacaaauaccagccucgugugcauguaauccgcaaggacuguggugacgauuuaagucccauuaaaccaguuccuucuggggaaggcgugaaggccuuuuccuuccccgagacugucuuuaccacagugaccgcuuaucaaaaccagcagaucacuagacugaaaauagacaggaauccauucgcgaagggauuucgggauagcggccgaaaccgcauggggcuugaagcauugguggagucguacgccuucuggagacccucucugaggacacuaaccuuugaggacauuccuggaaucccaaaacaagguaaugcuuccucaaguacgcuccugcagggcacugggaacggagucccggccacccacccccaucuucugagcggcuccucuugcagcagcccugcauuccacuuggguccaaauacaagucagcucuguucccuggcccccgcugauuacagcgccugcgcacggucuggguuaacucugaaccgcuauucaaccagucucgcggaaacauacaauagacuuaccaaccaggcuggcgagacguuugccccuccaaggacucccagcuauguuggaguguccucuucgacaagcguaaauauguccaugggcgggaccgacggagauacuuucucauguccgcaaacaagucugucuaugcagauuagcgguauguccccucaguugcaguacaucaugccaucacccagcucuaacgcauucgccaccaaucaaacgcaccagggcuccuauaacaccuuucgucuacauaguccuugcgcucuguacggguauaacuucagcacaucucccaagcucgccgcauccccagaaaagaucgugucaagucagggaucauuucugggcucguccccuucugguacuaugaccgaccggcagaugcuucccccagucgagggggugcaccuguugagcucaggcggacaacagaguuucuuugauucccgaacacucggcucucugacuuuaagcuccucacagguuagcgcucauaugguguga

SEQ ID NO: 63593 - RNA, 1347 nt, Artificial Sequence
  derived and/or modified sequence opt3 from TBX19__Homo_sapiens__NP_005140
auggccaugagcgagcugggcaccagaaagcccuccgacgggacagugucucaccuccuuaacgucguugaaucagagcugcaggcuggaagggaaaaaggugauccuacugagaagcaauugcagaucauuuuagaagacgcaccacuguggcagcgguucaaagaggugacgaaugagaugauaguaaccaagaacggccgccgaauguuuccggugcuaaaaaucagugucacagggcucgaucccaaugccauguacagccugcuucuggacuucgugccuacugauucccaucguuggaaguauguuaacggagaaugggugccagcgggcaagcccgaggucucuucgcacucaugcguguacauucauccugacagcccaaauuuuggugcucacuggaugaaagcccccaucaguuucuccaagguaaaauugaccaacaagcucaaugggggaggccagauuaugcugaacucucugcauaaauaugaaccucaaguucacaucgugagagucggcagcgcacacaggauggugacaaauuguuccuuuccagagacccaguucauagccgugacugcuuaccagaacgaggaaaucacagcacucaagauuaaguauaauccguuugccaaggcuuucuuagaugccaaagagcggaaccaucugcgcgacguccccgaagcgaucucagagagucagcacguuaccuacagccaucuugggggauggauuuuuaguaauccugauggugugugcacggcaggcaacuccaauuaucaauacgccgcuccauugccccugccugccccacacacucaccaugggugugaacacuacucaggacuaagaggccauaggcaggcacccuauccgagcgcuuacaugcaccggaaccauaguccuucuguaaaccucaucgaguccagcucgaauaaccuucagguguucucuggucccgacuccuggaccucacugaguagcacaccacacgccuccauacugucugucccucacacuaaugggcccauuaacccaggacccagcccuuauccaugcuuguggaccaucucaaauggcgcgggcgggccgaguggacccgguccugaggugcaugccuccacaccaggcgcauuucuccuggggaaccccgcuguuaccagcccuccaucuguguuaucaacgcaggcccccacuucugcuggagucgaagugcugggcgagccgagccucacauccauugccguaucuaccuggacugcaguugccucgcacccuuucgcugguuggggcgggccaggagcgggcgggcaucacagccccuccucacuugauggauga

SEQ ID NO: 63594 - RNA, 1119 nt, Artificial Sequence
  derived and/or modified sequence opt3 from TBX1__Homo_sapiens__NP_005983
augcacuucagcaccgugacaagagacauggaggccuuuacugcuuccucucugucaagucucggcgcagccgggggauuccccggugcggcuagcccuggcgccgauccauacgggccgagggaacccccuccacccccuccacgguaugaccccugcgcagccgcugcaccuggagccccaggcccgcccccuccaccccaugcuuacccuuuugccccagcggccggugcagcuacguccgccgcagcugagcccgaagggccgggagccucuugugcggccgcagcuaaggccccugucaaaaagaacgcuaaaguugccggcgugucgguacagcuugagaugaaggcacugugggaugaguucaaucaauugggcaccgaaaugaucgugacaaaagccgggcgccgaauguuucccacuuuccaggucaaguuauuuggaauggacccaauggcugauuauaugcugcuaauggacuucgugccuguugaugacaagcguuacagauaugcguuucacucaagcaguuggcucguggcagguaaagccgaucccgcuaccccaggcaggguccauuaccaccccgacuccccugccaagggggcacaguggaugaaacagauugugucuuucgauaagcugaaacuuacaaacaaucuguuggacgauaacggacauauaauccucaauagcaugcaccgguaucaaccacgcuuucacguaguuuacguggacccgagaaaggacuccgagaaguacgccgaagagaacuucaaaaccuuugucuucgaagagacuagguucacagcugugaccgccuaucagaaucaucggauuacgcagcugaagaucgcaucaaaccccuuugcgaaaggcuuccgcgauugcgacccugaggauuggccacgaaaucacagacccggugcucugccucucaugagugccuuugcaaggagccggaacccaguggccucucccacucagccguccgggaccgaaaagggauuagucacagagggcucaggccugcaaccugggcuuuuggacguucugcuaaaaccacccagcaagaaaagugaaucucuccguccuccccauuguaaggauacuuga

SEQ ID NO: 63595 - RNA, 1344 nt, Artificial Sequence
  derived and/or modified sequence opt3 from TBX20__Homo_sapiens__NP_001071121
auggaguucaccgccagccccaagccucagcuguccucuagagcuaacgcauuuucaaucgccgcgcucaugaguagcggcggguccaaagaaaaggaggcuacagaaaauacuauuaaaccacuugagcaauucguggaaaagucuucgugcgcccagccgcugggagaguugacgucauuagacgcacacggugaguuuggcgggggaagcggcaguucccccucuagcuccucacuguguaccgaaccucuaauaccaacaacucccaucauuccuagugaggaaauggccaaaaucgcuugcagccucgagaccaaggagcugugggauaaguuccaugaacuugguacagagaugauuaucaccaaaucugggaggcggauguuuccaacuauacgcgucuccuucucaggaguugaccccgaagcaaaguacaucgugcugauggauauuguaccuguggacaacaaacgauaucguuacgccuaucacagaagcaguugguuggucgcuggcaaggccgauccaccgcuccccgcgaggcuguacgugcauccugacucuccauuuacaggcgagcagcugcucaaacagaugguuuccuucgaaaaggugaaguuaaccaauaacgagcuggaucaacacgggcauaucauucuuaauagcaugcacaaauaucagccccggguccacaucauaaagaaaaaggaccauacggcaucguugcugaaccuaaaaucugaggaauuucgcacuuucauuuuuccugagaccguguucacagccguaacugcuuaccagaaucagcucaucaccaagcugaaaauugauuccaacccauuugccaagggauucagagacucaaguaggcuuacagauaucgaacgggagagcguugaaucccugauccaaaagcacucuuaugcacgcagccccauucgaaccuacgguggcgaggaggacguguugggggaugaaucacagacgacuccgaauagaggaagugcuuucacaaccuccgacaaccucagccugucuucaugggucaguagcuccucuucguuuccuggcuuccagcauccccagagcuuaacugcccuggguacauccaccgcgucaauagccacgccaaucccucaccccauucaagggagucucccacccuacucuaggcuuggaaugccucugaccccaagcgcaaucgcuuccucaaugcagggcagcggcccgacauuucccucuuuccacaugccucgguaucaucacuacuuucagcaagggccauaugccgcuauacagggauugcgucauuccagugccgugaugacucccuucguguga

SEQ ID NO: 63596 - RNA, 1608 nt, Artificial Sequence
  derived and/or modified sequence opt3 from TBX21__Homo_sapiens__NP_037483
augggcaucguggagcccgggugcggagacaugcugaccgguacagaaccuaugccaggcagcgaugaggggagagccccgggagcugacccccagcacagguacuucuauccugaaccaggcgcacaagaugccgacgagcggcgcggugggggaucccucggcucucccuacccuggcggggcgcuugucccagcucccccuucacgauuucugggagccuaugcauacccaccgcguccccaggccgcugguuucccuggcgcaggggaaaguuuuccacccccugccgaugcugagggauaucagccaggcgaggguuacgccgcgcccgacccgagagcaggguuguauccuggacccagggaagauuacgccuuaccagcuggccuggagguuagcggcaagcuacggguggcccucaacaaucaucugcuuugguccaaauucaaccagcaccaaacugaaaugauuauaacgaagcaggggcgcagaauguuuccuuuccugucuuuuaccguagcaggauuggagcccacaucgcauuacaggauguucguggacgucgugcucguugaucagcaccauuggcgguaucagucagguaaaugggugcaauguggcaaggcugaggggagcaugccaggaaaucgccuguacguccaccccgacaguccuaacacuggcgcccacuggaugcgacaggaaguguccuuugguaaacugaagcucaccaauaacaagggggcgucuaauaacguaacacagaugaucguuuuacagagccugcauaaauaucaaccaagacuucacauuguggaggucaaugauggcgaaccggaggccgcaugcaacgcuuccaauacccauaucuucacuuuucaggaaacacaguucauugccgugaccgcuuaccaaaacgccgagaucacgcaguugaagauagacaauaaccccuuugcaaaaggauucagggagaauuucgaaucaauguauaccaguguggauacuagcaucccuucuccacccggcccuaacugucaguuucuagggggagaccacuacuccccacugcuccccaaccaguauccggucccuucacgguucuacccagaccugcccggucaagccaaggauguugugccucaggcuuacuggcuuggcgcgccccgugaccacagcuaugaggcagaauuucgcgccguaaguaugaaaccagcuuuccugccuucugcccccgggccaacaauguccuacuauagaggacaggagguguuggcaccgggcgccgguuggccugucgcuccccaguacccacccaagauggggccugccagcugguuuaggccaaugcggacucuccccauggaaccuggcccgggaggcucggaggggcgaggaccagaggaucaaggucccccucugguguggaccgaaauugcaccaauccgccccgagucuuccgacucaggcuuaggggaaggagauaguaagagaaggcggguuagcccuuauccguccucuggcgacagcucaagucccgcgggugcuccauccccuuucgauaaagaggccgaagggcaguuuuacaauuauuuccccaacuga

SEQ ID NO: 63597 - RNA, 1563 nt, Artificial Sequence
  derived and/or modified sequence opt3 from TBX22__Homo_sapiens__NP_001103348
auggcccugagcuccagagcuagggcauucucuguggaggcccucgucggccggcccucaaagcgcaaacuucaggacccuauccaagcggaacagccagagcugcgagaaaagaaagggggagaggaagaggaggaacguagaaguagcgcugccgguaaguccgagccguuggaaaaacagcccaagaccgagccuucuacaucggcaucaagcggcugcgggagugauuccggauacggcaacucuagcgaguccuuagaagagaaggacauucagauggaacugcaagguucagagcuauggaaaagguuucacgauauagggacugaaaugaucauuacgaaggccggacggcgcauguucccaaguguuagagugaaaguaaagggccucgaccccggcaaacaguaucauguggcuaucgaugucgugccuguugacagcaagagguaccgguauguguaccacucuucccaguggauggucgcagggaauaccgaucaucuguguauuaucccacgcuuuuaugugcaccccgacucaccuugcagcggagagacauggaugcgacagauaaucaguuucgauagaaugaaacuuacuaacaaugagauggacgauaagggucauauuauccugcaaucuaugcacaaguacaaaccaaggguacacguuauugaacagggcuccagcguggacuugucgcagauccagucucucccgaccgagggggucaagacauuuuccuucaaagaaaccgaguuuacuacagugaccgccuaucaaaaccagcagauaacgaagcugaaaauugaacggaaucccuucgcuaagggauuucgugauacuggccgcaacagaggugugcuggacgggcucuuagagaccuacccuuggaggccaucauucacacuggacuuuaagacuuucggagccgauacccaaaguggcagcuccggcucuagccccgucacaucaagugggggagcgccuuccccacuuaauagcuugcugucuccccuauguuuuucaccgauguuccaucucccuaccaguagccuggguaugcccugcccagaggcauaccuuccuaacguuaaucugcccuuguguuauaaaaucugcccaacgaacuucuggcagcagcagccccucgugcugccugccccagaacgguuagcuuccucuaauucgagccaaucccuggccccgcucaugauggagguacccaugcuuucaagucugggcgugacuaacucuaagagcggguccucagaagacagcucugaucaguacuugcaggcaccuaauuccacaaaccagaugcuauauggacugcaaaguccaggcaauauuuuucuccccaacagcaucaccccugaggcucugucuuguuccuuccacccaucauacgacuuuuaucgauacaacuucaguaugcccagccgccuuaucucggguuccaaucaucugaaagucaacgaugacucucaggugagcuuuggggaaggcaagugcaaucacguucacugguauccggccauuaaccauuacuuguga

SEQ ID NO: 63598 - RNA, 2139 nt, Artificial Sequence
  derived and/or modified sequence opt3 from TBX2__Homo_sapiens__XP_011523460
augagagagcccgcccuggcugcaagcgccauggcguaccacccuuuccaugcuccaaggccggccgacuuucccauguccgcauuccucgccgcugcacagccuucauuuuucccagcccuugcucugcccccuggcgccuuggcgaagccauuacccgauccugggcuggcaggagccgcugccgcagcugccgcggccgcagcugccgcugaagccggucuacacgugucagcacucggcccacauccgcccgccgcucaucugcggagucuuaaaagccuggagccugaagacgaggucgaagaugacccaaagguuaccuuggaggcgaaagagcucugggaucaauuucacaagcuggggacagaaauggugaucacuaaauccggacgccgaauguucccaccuuuuaagguacgugugucuggccuggacaagaaagcaaaguauauucucuuaauggauauagucgccgcugacgauugcagauacaaauuccacaacucgagguggaugguggccgguaaggcagacccagagaugcccaaacggauguauauccacccggauucuccugccacgggggaacaguggauggcuaagcccguugccuuucauaagcugaaacuuaccaauaacauuagcgacaagcacggauucacaaucuugaauaguaugcauaaauaccagccacgcuuucacauugugagagcaaacgauauccugaagcuaccuuauuccacuuucaggaccuacgucuuucccgagacagacuucauagcggugaccgcuuaucagaaugacaaaaucacucaacucaagauugauaacaauccauucgccaaaggcuuucgggacacaggcaacgggcgccgagagaagagaaagcagcugacccuucccucucugagguuguacgaagaacacuguaaaccugaacgggauggagcagagagcgacgccuccucaugcgauccaccgcccgcucgugaaccuccaacgagucccggugccgcaccuagcccacuccgccugcauagagcuagggccgaggagaagucuugugcggccgacuccgaucccgaaccggagcgguuaucagaggagcgagcuggcgcaccucuggggcgcagcccagcccccgacagugcuucuccuacuagacucaccgaacccgagagggcccgggagcgcagauccccagaaaggggaaaagagccugcagaaagcggcggugaugggcccuucggacuucguucgcuggagaaggaacgggcggaggcccgaagaaaagacgagggcaggaaggaagcugccgagggcaaggaacagggguuggcaccccuaguaguucagacagauucugcuuccccgcugggagccggucaccucccuggccuggcauuuucaagucaucuucacgggcaacaguucuuuggaccccugggcgccggucagccauuguuccuccaucccgggcaguuuacuaugggcccuggagcuuucagcgcgaugggcauggggcaccuguuagccuccguggcaggagguggcaaugggggaggcggugggccaggcaccgcugccggacuggacgccggcgggcuaggacccgcugcaucugccgcgagcacagcugccccuuuuccguuccaccucucacaacauaugcuggcaagucaggguaucccaaugcccaccuuuggcgggcuuuucccuuacccauauacguacauggccgcugcagccgcggcugccuccgcauugcccgccacuagcgcugccgcagcugccgcggccgcagcuggaucucugucacgcaguccuuuucucggcagcgcccggccgagacugagguucucccccuaucagauuccagucacaaucccucccucuaccucgcuucugacuacagguuuggcuagcgagggguccaaagcagccggcggaaacucacgcgagccaaguccucuccccgaacuggccuuacgaaaggugggcgcuccaucucguggggcgcugagcccguccggaucagcaaaagaggccgcuaaugaacuacaaagcauacagcggcucgugucuggccuggagucccagagagcccuuaguccugguagggaaagccccaaguga

SEQ ID NO: 63599 - RNA, 2172 nt, Artificial Sequence
  derived and/or modified sequence opt3 from TBX3__Homo_sapiens__NP_005987
augagccuguccaugagagaccccgugaucccuggcaccucuauggccuaccacccauuccucccgcauagggcucccgauuuugcaaugucagccguccuugggcaccagccuccauucuuucccgcgcugacauugccuccaaacggagcugccgcauuaagucugcccggugcccuagcuaagccuauuauggaccaacucguuggcgcagccgagacugggauaccauucagcucccugggaccgcaggcucaucuucggccccugaaaacgauggaaccugaggaagagguggaagaugacccaaagguacacuuggaggccaaagagcucugggaucaguuucauaagcgcggcaccgaaauggugaucacaaaaucuggucgacguauguuucccccuuucaaggucagaugcucggggcuggacaagaaagcgaaguauauucugcucauggauaucauugcagccgacgauuguagguacaaauuccacaauucacgguggaugguggcuggaaaggccgacccagagaugcccaaacgcauguauauccacccggauagcccugcaacuggcgaacaguggaugaguaagguugugaccuuucauaaguuaaaacugacaaacaauauauccgacaagcacggcuucaccauccuuaacucuaugcauaaauaccaacccagauuucacauugucagggcuaaugauaucuugaagcugccauauagcacuuuccggacauaccuauuuccugagaccgaguucauugccgugacggcguaucagaacgacaaaaucacucagcucaagauagacaauaaccccuucgccaaaggguuucgcgauaccggaaauggucgaagagaaaagaggaagcagcugacacuucaauccaugcggguauucgacgagcgucacaaaaaggaaaacggcacuucagaugagaguagcucugaacaggcagcuuuuaauugcuucgcccaggcuuccucaccagccgcaagcaccguugggacaaguaaccugaaagacuugugucccucugagggagaguccgaugccgaagcugagagcaaggaggaacauggcccugaagcgugcgacgcagccaaaauuucgaccacgacuucugaggagccaugucgcgauaaggguuccccggcugugaaggcccaccucuuugcagccgaaagacccagggacucagggcggcuggauaaagcuaguccugacagccgacauuccccagccacaaucucuagcucaacccgcggauuaggcgcagaggaaagaaggagucccguccgggagggcacugcgccugcuaagguggaagaggcccgcgcacugccagggaaagaggccuucgcuccccucacagugcagaccgaugccgcagcugcccaccuugcgcaaggaccgcugccugguuugggcuuugccccagggcuagcuggacagcaguucuuuaauggccauccccuguuccuccacccuucccaauuugcaauggguggggccuucagcucuauggcugccgcaggcaugggaccccugcuugcgacggucucaggcgccaguaccgggguuagcggacuggacuccacagcuauggccucugcagcugccgcacaggguuugucgggcgccagcgcugcgacucucccauuucaucugcagcagcacguguuagccucccaagggcuggcaaugucaccuuucggaagucuauuccccuacccauacaccuauauggcugccgccgcugcagccucuagcgcggcugccuccucaagcguacacagacauccguuucucaaccugaauacaaugaggccucgucuucgguacucucccuauuccauuccagugcccgucccugacggcaguagcuugcugacuaccgcacucccaucuauggccgcugcagccgguccccuggaugggaagguggcggcucuugccgcauccccugccucaguugcuguggacaguggcagcgaacugaacucgcgauccucuacauugagcucaaguuccaugucucucagcccgaaacugugcgccgagaaggaagcagcuaccuccgaguuacagucaauccagagacuggucagcggacuagaggccaagccagauaggagucgcucugcgucccccuga

SEQ ID NO: 63600 - RNA, 1638 nt, Artificial Sequence
  derived and/or modified sequence opt3 from TBX4__Homo_sapiens__NP_060958
augcugcaggacaagggccucagcgaguccgaagaggccuucagagcucccgggccugcacuuggagaagccucugcggcuaacgccccagagccggcacuggccgcucccgguuugucaggcgcagccuuagggaguccuccaggacccggcgcugauguggucgccgcggcagccgcugaacaaaccaucgagaauauuaaaguuggucugcacgagaaggaacuauggaaaaaguuucaugaggccgggacagaaaugauaaucacuaaagcaggaaggcggauguucccuagcuacaaggugaagguaacgggcaugaacccaaaaaccaaguauauucuccugaucgacauugugcccgcugaugaccaccgcuacaaauuuugcgauaauaaguggauggucgccggcaaagcggagccugccaugccagggcgacuuuaugugcauccggacucccccgcaacaggagcucacuggaugcgucagcugguuucuuuccagaaguugaagcucacuaacaaucaucuggauccuuuuggucacaucauacugaacucgaugcacaaauaccagccaagacuccauaucgugaaggccgacgagaauaacgcuuucggcagcaaaaauaccgccuuuuguacacacgucuuccccgaaaccucauuuauuagugugacuuccuaucaaaaccauaagaucacacaguuaaaaauugagaauaacccuuucgcaaagggguuuaggggaucugaugacagcgaucugcggguagcccgccuucaguccaaagaauacccaguuaucucaaagaguauaaugagacagagguugauuagcccccaacugucugcuaccccggacgugggcccucuacucgguacgcaccaggcgcugcagcacuaucagcaugagaauggggcacacucccaacuugccgaaccccaggaucugccauugucaacuuucccuacccagcgggacagcagucucuuuuaccauugccugaagcgccgagacggaacaagacacuuagaucugcccuguaaaaggucuuaccucgaggcuccauccagcgucggcgaggaccauuauuuccggucgcccccuccauacgaucaacagaugcuuucuccguccuauugcucagaagugacuccccgugaggccuguauguacaguggcagcgggccugaaaucgcaggaguguccggugucgacgaucugccacccccuccauugucuugcaacauguggaccagcguuucacccuauacaaguuacuccgugcagaccauggagacgguaccguaucagccuuucccaacucacuuuacagccaccacuaugaugccccgccuaccuacacugagcgcucaaucuucacagcccccaggcaaugcccacuucaguguguacaaccagcucagccagucccaagucagagaaagggggccuucugcaucguuuccccgggagcgaggacugccacagggcugugagcgcaagccgccuagcccccaucuuaacgcggcuaaugaguuccuguacucccagaccuuuucauugaguagagaaucuagccuccaguaucacuccgguauggggacgguggaaaacuggaccgacggcuga

SEQ ID NO: 63601 - RNA, 1407 nt, Artificial Sequence
  derived and/or modified sequence opt3 from TBX5__Homo_sapiens__NP_542448
auggagggcaucaagguguuccugcacgaaagagagcucuggcuuaaauuucaugaagucgggaccgagaugauuauaacaaaggccggaaggcggauguuccccagcuacaaaguuaaggugacuggucugaacccuaaaacgaaguauaucuuguuaauggacauuguaccagcugaugaccaccgcuacaaguuugcagauaauaaaugguccgugaccggcaaggccgaaccggcgaugcccgggcgacuguauguccauccugacucuccagcuacaggagcccacuggaugcgucagcuagugucauuccaaaaacucaagcugacuaacaaucaucuugaucccuuuggccacaucauucugaacaguaugcacaaauaccagccuagauugcauaucguuaaggcagacgagaauaacgguuucgggagcaagaauaccgccuuuugcacacacguguucccagagaccgcuuuuauagcagucacuuccuaucagaaccauaaaaucacacagcucaagauugaaaauaaccccuucgccaaaggauuuaggggcucugaugacauggagcugcaccggaugucgcgcaugcaaucaaaggaauacccugugguaccaagaagcaccguuaggcagaaaguggcuaguaaucacuccccguucucuagcgagucccgggcccugucaacgaguagcaaccucggcucucaguaucagugugagaauggggucuccggacccucacaagauuuacugccuccacccaacccuuacccacuuccccaggaacauagccagaucuaccacugcacuaagcgcaaagaggaagaguguaguaccacagaccauccguauaagaagccuuacauggaaacuucucccuccgaggaggauagcuuuuaucgaucgucuuacccacagcaacaggguuugggcgcguccuauagaaccgaaucagcacagaggcaagccugcauguacgcuaguagcgccccucccuccgagccagugcccucucuggaagacauuagcuguaauacauggccuucaaugccaaguuauuccagcugcaccgugacgacuguccagccgauggaucggcuacccuaccagcacuucucugcacauuucacaucagggccucucguuccacgucuggcuggaauggccaaccacggcaguccccagcuuggugaggggauguuucaacaccagaccagcguggcgcaucagccuguagugcgccaguguggaccacaaacuggccugcagucccccggcacauugcagccgccugaguuccucuacucucacggggucccaagaacccugucgccccaucaguaucacagcgugcacggaguugguauggugccugaaugguccgacaacucauga

SEQ ID NO: 63602 - RNA, 1311 nt, Artificial Sequence
  derived and/or modified sequence opt3 from TBX6__Homo_sapiens__NP_004599
auguaccaccccagagagcuguauccuagccucggcgccggguacaggcuuggaccagcucagccgggugcagacuccucuuuucccccugcccuggcggaaggcuaucgguacccagaguuggauacccccaaguuagacugcuuccugucagggauggaagcugccccucgcacacuagcagcccauccaccccucccucugcuuccaccggcuaugggaacugagcccgcaccuagugccccagaagcucugcacagcuugcccggcgugucccucucucuggagaaccgagagcuguggaaagaguucucgucagucgguacggaaaugaucauuaccaaggccgggcguagaauguuuccugcguguaggguuagcgugacaggacucgauccagaagcacgguauuuauuccugcuugacguaauacccguggauggcgcccgcuacagauggcaaggcaggcggugggagccgagugggaaagcugagccucgcuugcccgaccgagucuauauccauccagauuccccugccacuggagcacacuggaugagacagcccgugucuuuucauaggguuaagcugaccaauagcacacuagacccacacggucaccucauucugcauuccaugcacaaauaccagccccggauccaucuugugcgugcugcccagcugugcucacaacacuggggcgggauggcgaguuuccgcuuuccugaaaccacuuucauuagcgucacagccuaccagaacccacagaucacccaguugaagauagcagcuaauccguuugccaagggauucagagagaacggcaggaauuguaaacgggaacgagaugcucgcgugaagagaaaacucaggggucccgagccugccgcaacggaagccuaugggucuggagacacuccaggcggccccugcgauuccaccuuagggggagacauccgggagucagauccugagcaagcuccagcgcccggugaagcaacagccgcuccggccccucuguguggcgggccaagcgcagaggccuaccugcuccaccccgcugccuuucauggagcaccuagucaccuucccacucgcucuccauccuucccugaagcgcccgacagcggcagaucggcuccauauucugccgcauuucuggaguugccgcaugguuccgggggcucaggauacccugccgcucccccagccguacccuucgcaccucacuuccuacagggcgggccauuuccccugccuuauaccgcuccgggagguuaccucgacguuggcaguaagccaauguauuga

SEQ ID NO: 63603 - RNA, 1224 nt, Artificial Sequence
  derived and/or modified sequence opt3 from TBXA2R__Homo_sapiens__NP_963998
auguggcccaacggcagcucccuggggccuugcuucagaccaaccaauaucacacucgaggaaaggcggcuuauugccucuccgugguuugcugcaucauucuguguggucggacuggccaguaacuuguuagcgcugagcguucuagcuggugcccgccagggcgggucccacacucgaucuucguuucucacguuccugugcggacuugugcugaccgacuuuuugggccuccugguaacagguacuauaguggucucacaacaugcagcccuguucgaguggcacgcuguggaucccgggugucgucucugcagauuuaugggaguugugaugaucuucuuuggcuuaagcccucugcuuuugggcgcagccauggcuagugaaagguaccuggggauuacccggccauucucccgccccgccgucgcgucucagagaagggcaugggccacagugggucuaguaugggcugccgcacucgcucugggacuucugccuuugcucggcguugggcgguauaccgugcaguacccaggaagcugguguuuucugacuuuaggcgccgaguccggugacgucgcguucgggcugcucuuuucaaugcuuggaggccugagugugggcuugagcuuccuacugaauacagugucugucgccacccucugccauguuuaucacgggcaggaagcagcucaacagcgcccccgagauuccgagguggagaugauggcccagcugcuuggaaucaugguaguggcuucagucuguuggcugccuuugcucguguucauugcccagacgguucugagaaacccaccggcaaugagccccgccggucaauuaaguaggacuaccgaaaaggagcugcuaaucuaccuccggguggcuacauggaaucagauacuggacccuugggucuauauccuuuuucgucgcgcgguguugagaaggcugcagccacggcucucuacucgaccccgcagaucccugacccuuuggccuagccuggaauacucgggcacaauuucugcacauugcaacuugaggcucccaggguccucagauagucgggccagcgcuucccgcgccgcaggaaucaccggcguaucucacugugccagacccugcaugcuguucgacccggaguuugauuuacuggcugguguucagcuacucccuuucgagcccccaacggggaaagcccugagcaggaaggacuga

SEQ ID NO: 63604 - RNA, 1605 nt, Artificial Sequence
  derived and/or modified sequence opt3 from TBXAS1__Homo_sapiens__NP_001052
augauggaggcccugggcuuccucaaacuugaagugaacgggcccauggucaccguugcucugagcguggcauuguuagcccugcuaaaaugguacuccacaucugcguuuucaagacucgagaagcugggacuuaggcacccuaaaccaaguccguucaucgguaaucugacguuuuuccggcagggcuuuugggaaagccaaauggaguugcgcaagcucuaugggccccugugcggauacuaucugggccgacguauguucauuguaauauccgaaccugacaugaucaaacaggugcucgucgagaacuuuucuaauuucacuaacagaauggcuucggguuuagaguuuaagucaguggccgauagcguucuguuccuuagggacaagcggugggaagaggugcgcggggcauugaugagugccuuuuccccagaaaaacugaaugagauggucccccuaauuucucaggcuugugaucuccugcuugcacaucugaagagauacgccgagagcggagacgcuuucgauauccagaggugcuauuguaacuacaccacagacgugguagccuccguugcguuuggcacuccuguggauucauggcaagcaccagaagaccccuucgucaaacacugcaagcgguucuuugaguucuguauuccucgcccaaucuuggugcuccuguuaaguuuuccgagcauaauggugccccuggcccgaauccucccuaauaaaaacagagaugaacuuaauggcuucuuuaacaagcugauuaggaaugucaucgcuuugcgggaccagcaggccgcagaggaacgucgcagagauuuccuacagaugguucuggacgcuaggcauucugccuccccaaugggggugcaagauuuugacauuguacgggacguguucucaagcaccggaugcaagcccaacccuagucgacagcaccagccaucucccauggcgcgcccgcucacagucgaugagaucgugggucaggccuuuauauuccugauugcaggcuaugagaucauuaccaauacucuuuccuuugcuacauaccuguuggccaccaacccugacugucaagaaaaacuccugagagagguugauguguucaaggaaaaacauauggcucccgaguuuugcagcuuagaagaggggcugccauaccuagacauggucaucgccgagacgcucaggauguauccucccgcauuccgguucacucgcgaagccgcucaggauugugaggugcugggacagagaaucccagcgggcgcaguacuugaaauggccguuggugcuuugcaccacgaccccgagcauuggccuucgccagaaaccuuuaauccggagagguucacagccgaggcacgucaacagcaccggcccuuuacuuaccugccuuucggggccggaccacgaucuugccucggcgugagacugggccuucuggaagucaaguugacccuccugcauguguuacacaaauuuagguuccaggcuugucccgagacacaggucccucugcaacuagaauccaagucagcccucgggccaaagaacggaguguauauuaagauaguuagucgcuga

SEQ ID NO: 63605 - RNA, 213 nt, Artificial Sequence
  derived and/or modified sequence opt3 from TCAIM__Homo_sapiens__NP_001025010
auguucugccaccugagacccaugaggcggcucugucuugagaagaucuuuccucauugguucccauuuagccgcgcccuguccggcgcugaagcagugaacgccuugcgaccguucuacuuugcgguccaccccgacuucuuugggcagcauccuguugagcgugaugacaccuggaaaucuuuccaaugcccaucagauuuuaguuuauga

SEQ ID NO: 63606 - RNA, 504 nt, Artificial Sequence
  derived and/or modified sequence opt3 from TCAP__Homo_sapiens__NP_003664
auggccaccagcgagcuguccugcgaagugucugaggaaaacugugagagaagggaggcuuucugggcagaguggaaggaccucacacuuucaacucggcccgaggaaggcugcagucugcacgaggaagauacgcagcgccaugagaccuaccaccaacaggggcagugucaggucuugguucaacgaagcccuugguuaaugaugcguaugggaauccuggguagaggccuacaggaguaucagcucccauaccagagggugcugccgcuucccauuuuuacacccgccaaaaugggggcgacuaaggaagaacgggaagacaccccaauacaacugcaggaguugcucgcucuggaaacagcccugggaggccagugcguagaucgccaggagguggcagagaucaccaaacaacucccuccugucgugccaguuuccaagcccggugccuuaagaaggucucugucgcggucaaugagccaggaagcucagcgcggguga

SEQ ID NO: 63607 - RNA, 906 nt, Artificial Sequence
  derived and/or modified sequence opt3 from TCEA1__Homo_sapiens__NP_006747
auggaggacgaaguggucagauucgccaagaaaauggauaagaugguucagaaaaagaacgcugcaggcgcccuggaccuccuuaaagagcugaagaauauccccaugaccuuggaauuacugcaaagcacaaggauugggauguccgugaacgcgauacggaagcagucuacugaugaggaaguaacgucacuagcuaaaagucucaucaagagcuggaaaaagcugcuugacggaccuuccaccgagaaagaucuggacgagaagaagaaagaaccagccauuacaucucaaaauucgccggaggcacgcgaagagucaacuagcagugguaacguguccaaucgaaaggaugagaccaacgcccgugacacauacgucucuagcuuucccagagcuccuuccaccucagauagugugagguugaaaugccgggaaaugcucgcagccgcucugcgcacuggcgacgauuauaucgccauuggggcggacgaggaggaacugggaagccagaucgaagaggcaauauaccaggagaucagaaauacagauaugaaguauaaaaacaggguucggucucgcauuuccaaucucaaggacgccaaaaacccaaauuuacgaaagaacgugcuguguggcaauauucccccugaccuuuucgcuagaaugaccgccgaagagauggcaucagaugaauugaaggagaugaggaaaaaccugacgaaggaagcuauccgggagcaccagauggccaaaacuggugggacccagacagaccuauuuacuugcggaaaguguaaaaagaagaauugcaccuacacacagguccaaacccguagcgcggaugagccaaugacgacuuucgugguauguaacgaaugcggcaaccgcuggaaauuuuguuga

SEQ ID NO: 63608 - RNA, 900 nt, Artificial Sequence
  derived and/or modified sequence opt3 from TCEA2__Homo_sapiens__NP_003186
augaugggcaaggaggaagagaucgccagaauugcuaggcggcuggacaaaauggugaccaagaaaagcgcagaaggggccauggaucuccuucgcgagcugaaggcgaugcccauaacauugcacuuacugcaguccacucgagucggaaugucuguuaacgcucuacguaaacaaucaagugacgaagaggugaucgcccucgcaaagagccugauuaaguccuggaaaaagcugcuugaugccucugacgcuaaagcaagagagaggggucggggcaugccuuugccaacgucgucacgcgaugccagcgaagcuccggaccccaguagaaagaggccugagcucccacgggcccccuccaccccucgcaucacaacuuucccacccguaccugugaccugcgaugcgguccgaaauaaauguagagaaaugcugacagcagcccugcagaccgaccaugaucacguggcuauuggggccgacugcgagaggcucucugcacagaucgaggaauguauauuucgggauguuggaaacacugacaugaaguacaagaaucgugugcgcagcagaaucuccaacuuaaaagaugcuaagaauccagaccugaggcggaacguccuuugcggcgccauuacaccgcagcaaaucgcggugaugaccucagaggaaauggccagugacgaguugaaagaaauucgaaaggcaaugacgaaagaggcuauccgcgagcaucagauggccagaacuggugggacccagacagaucuguucacuuguggaaagugcaggaaaaagaauuguaccuauacacagguacaaacccggagcucugacgaacccaugacgacuuuuguugugugcaacgaguguggcaaucgcuggaaguucugcuga

SEQ ID NO: 63609 - RNA, 1032 nt, Artificial Sequence
  derived and/or modified sequence opt3 from TCEA3__Homo_sapiens__XP_011540358
augggccaggaggaggaacugcucagaaucgccaagaaacuugaaaagaugguggcuaggaaaaacaccgagggggcacuggacuuguuaaagaaacugcacagcugccaaauguccauucagcuacuccagacaacucggauaggagucgccguuaauggugugcgcaagcauuguucugauaaggaaguagugucacuggcgaaaguccuuaucaagaacuggaaacgacuguuggacagucccggcccuccaaagggggagaaaggagaggaacgugagaaggcuaagaaaaaggaaaaaggccucgagugcagcgauuggaagccggaggccggucugucucccccuaggaaaaagagagaagacccaaaaacgcgguccaauucgucaaagagcaaggcagagagucccaaaaccccuuccucuccacugacacccacuuucgccagcuccaugugucucuuagcuccuugcuaccugaccggggauucagugcgcgacaaguguguugaaaugcuuagugcagccuugaaagcugaugacgauuauaaggacuacggagugaacugcgauaaaauggccagcgagauugaagaccacaucuaucaggagcugaagucuacagauaugaaguacagaaauaggguccggucccgcauuucaaaccuaaaagacccacgaaauccgggccucagaaggaacgugcugagcggcgcgaucagugcagggcuuauagccaagaugaccgcugaggaaauggccucugacgagcugcgggaauugcguaaugcaaugacucaagaggcuauccgcgaacaucagauggccaaaacaggagguaccacgacugaucucuuucaguguuccaagugcaaaaagaagaacuguaccuauaaucagguacaaacaagaagcgcggacgagcccaugacuaccuucguucugugcaacgaguguggcaauagguggaaaccuccauggcggaugccccgaaacuuaucgaauuuuguggccuuccugguccucuga

SEQ ID NO: 63610 - RNA, 480 nt, Artificial Sequence
  derived and/or modified sequence opt3 from TCEAL1__Homo_sapiens__NP_001006641
auggacaagcccagaaaagagaacgaagaggaaccucagagcgccccaaagaccgaugaggaaaggccgcccguggagcacuccccugagaaacaaucuccagaagaacagucaagugaggagcagagcuccgaggaagaguucuuucccgaggaacugcucccugaacuucugccagagauguuguuaucugaggaacggcccccucaggagggccugucgcgcaaggaccuauucgaagggcgaccaccgauggagcaacccccuugcggagucgguaaacauaagcucgaagagggcucauuuaaggagcgucuggcuagaagcaggccacaguuccgcggggauauccacggacggaaucuuaguaacgaagagaugauucaggcagccgacgaacuggaggaaaugaaaagaguuaggaauaaguugaugauaaugcauuggaaagcgaagcggucccgccccuacccuaucuga

SEQ ID NO: 63611 - RNA, 684 nt, Artificial Sequence
  derived and/or modified sequence opt3 from TCEAL2__Homo_sapiens__NP_525129
auggagaagcuguucaacgaaaaugagggcaugcccagcaaccaggggaaaaucgacaaugaggaacaaccuccacacgaaggaaagccggagguggccugcauucucgaggauaaaaagcuggaaaacgaggguaauaccgaaaacacaggcaaaagagucgaggagccccuuaaggacaaggaaaaaccugaguccgcugggaaggcaaaaggagaaggcaagucugagaggaaagguaagucagaaaugcaagggggaaguaagacugagggcaaaccagagcggggcgggcgcgccgaaggagagggugaacccgauagcgagcgagaaccugaguccgagggcgaaccagagucugaaacgcgugcggcugggaagagacccgccgaggacgauauaccuaggaaagcaaagcggaaaaccaauaagggauuggcccaguacuuaaaacaguauaaggaagcuauccaugacaugaacuuuucgaaugaggauaugauucgcgaguucgacaacauggcaagaguugaagauaagaggcggaaaucaaagcagaaacugggcgccuuucuauggaugcagcgcaaucuccaggacccauucuacccgcgaggucccagagaguuuaggggagggugucgggcuccucgucgcgauacagaagacaucccauauguguga

SEQ ID NO: 63612 - RNA, 1077 nt, Artificial Sequence
  derived and/or modified sequence opt3 from TCEAL4__Homo_sapiens__NP_001287830
augcccgccggcgggcaggcuccucaacugaccccagugaucccggcauucugggaggccagaggacuccccaacagcaaggguagggacaaaguccacauuugccagugugaagaguggaagggccauauauccuacguugaacgggauaucacaacuucugagauuaaaucacuuccucaggugaguguacgcgcguuucacgcugccagcgggacgcuggaauggcgaaagggaaauggcuauggucgugggaaaggauggggcuggggcagaguggaguccagggaggcagggccaucugucgaccgggauggagguuugcgcgugugcuguucgcagagaucagccaagcccgaaaaggaggaacaaccuguucagaacccaaggcggagcgugaaagaccgcaagcgaagaggcaauuuagauauggagaaacuguacagugagaacgaagggauggcuuccaaucagggaaagauggagaacgaagaacagccccaagacgaaaggaaaccugaggugaccugcacacuagaggauaagaagcucgaaaaugagggcaaaacugaaaacaaggguaaaaccggggacgaggaaaugcugaaggauaaaggaaagccagagucugagggcgaagcaaaagagggcaagagcgaacgggagggggaauccgagauggagggagguucagaacgugagggcaagccggaaaucgaggggaaacccgagagugaaggagagccuggcagcgaaacacgcgccgcugguaagagaccagccgaggacgauguccccaggaaagcgaagcggaaaaccaauaaggggcuugcacauuaucugaaggaauacaaagaggccauucacgacaugaacuucucuaaugaggauaugauccgagaauuugacaacauggcuaagguacaggacgagaaacgcaaguccaaacagaaguugggcgccuuccucuggaugcagagaaaucugcaagauccuuuuuauccaaggggaccccgggaguuccgcggcggguguagagcaccgaggcgugacauagaggauaucccuuacguuuga

SEQ ID NO: 63613 - RNA, 303 nt, Artificial Sequence
  derived and/or modified sequence opt3 from TCEAL7__Homo_sapiens__NP_689491
augcagaagcccugcaaagagaacgaaggcaagccuaaauguagcgugccaaagagagaggaaaagaggccguacggggaguucgaacggcaacagaccgagggaaauuuucgccagcgacugcuccagucccuugaggaguucaaagaagacaucgauuaucgucacuuuaaggacgaagagaugacaagagagggugaugaaauggagaggugccuggaagagauucggggcuugcgcaaaaaguucagagccuuacauucuaaccacaggcauucacgggaccgccccuacccuauauga

SEQ ID NO: 63614 - RNA, 291 nt, Artificial Sequence
  derived and/or modified sequence opt3 from TCEB1__Homo_sapiens__NP_001191793
auguacgugaagcugaucagcuccgacggccacgaguucauugucaaaagagaacaugcccucaccucugggacaauaaaggcuaugcuuucaggacccggucaguuugcagagaacgaaacuaaugagguuaacuucagggaaaucccuagucacgugcugagcaaaguaugcauguauuuuacguacaaggugcgguauaccaauuccucuacagagauuccagaguucccgaucgcccccgaaauugcguuggaguuacugauggcugccaacuuucuagauuguuga

SEQ ID NO: 63615 - RNA, 357 nt, Artificial Sequence
  derived and/or modified sequence opt3 from TCEB2__Homo_sapiens__NP_009039
auggacguguuccugaugaucagaaggcacaagaccacaauuuuuacugaugccaaagagagcuccacggucuucgaacucaagcggauaguugagggcauccuuaaacgacccccugacgaacagcgccuguacaaggaugaccaauuguuagaugacgggaaaacccugggagagugcgguuuuacaucucagacugcucguccacaggcaccggccaccgugggccuagcguucagagcugaugacacauuugaagcccucuguauugagcccuucucaaguccuccagagcugcccgauguaaugaagccucaggacagcggguccucugcaaacgaacaagccgugcaguga

SEQ ID NO: 63616 - RNA, 1641 nt, Artificial Sequence
  derived and/or modified sequence opt3 from TCEB3C__Homo_sapiens__NP_663628
auggccgcuggcagcaccacacugagagcaguggggaagcuccaggucaggcuugccacuaaaacggagcccaagaaacuggaaaaguacuugcaaaaauuauccgcgcugccuaugaccgcugacauccuagccgagacagggauucggaagacuguuaagcgccuccgaaaacaccagcaugugggugauuucgcacgugaccuggccgcuagauggaagaaacuuguacugguggauaggaacaccggcccagacccgcaggaucccgaagagucugcaucacggcagcgcuuuggggaagccuugcaagagagagagaaggcuuggggauucccugaaaaugccacagcgccaaggagucccagccacuccccugagcaucggcgcaccgcacgaagaacuccacccggccagcagaggccucacccacggucuccgucgcgugaaccccgcgccgagagaaaaaggccucggauggcuccagccgacucagguccccaucgagauccuccaacacgcaccgcaccccucccgaugccugaggggcccgaaccagcugucccuggagagcagcccggcagaggccacgcccacgcggcccaagggggaccacugcugggucagggcugccaggggcagccccaaggagaagcagugggcagccauaguaagggucacaaguccucuaggggagcuagcgcccagaaauccccuccaguucaggagucacaaagugaacggcuccaggcugccggagcagacagcgccggcccgaagacggugcccucucaugucuuuuccgaguuaugggauccuucagaggcuuggaugcaggcgaacuaugaccugcuuagcgcauucgaagccaugaccagucaggcuaauccagaggccuugucugcacccgcccugcaagaagaggcugccuuuccuggccgcagagugaacgcaaaaaugccaguauacuccgggagcaggcccgcgugucagcuacagguuccgacucuccgucagcaaugccugcgggugccucgaaauaacccagaugcucuuggagacgucgaaggugugcccuauucggugcuggagccugucuuggagggcuggacacccgaucagcucuacagaacugaaaaggacaaugccgcacuggccagggagaccgacgaauuauggcgcauacacugucugcaggauuucaaagaggaaaagccacaggagcacgagucuuggcgggaacucuaucuuagacugagggacgcucgcgagcaacgauugcggguugugacaaccaaaauccguuccgccagagaaaacaagccuucagggaggcagacgaagaugauuugcuuuaauaguguagcaaaaacucccuacgaugcuagccgccggcaggagaaguccgccggagcggccgacccaggcaacggugagauggaaccggcuccuaaacccgcagggucuagccaggccccaucaggccuaggagauggcgacgggggaaguguguccgguggcgggagcucuaauagacaugcugcccccgcagauaagacaaggaaacaagcggccaagaaggucgcuccucugauggccaaagcaauccgagacuauaagggacgcuucucacggagauga

SEQ ID NO: 63617 - RNA, 3234 nt, Artificial Sequence
  derived and/or modified sequence opt3 from TCERG1__Homo_sapiens__NP_001035095
auggccgagagaggcggggacggaggugaaagcgagagguucaaccccggcgaacugcggauggcucagcaacaggcacuccgcuuucgagggccugccccaccgcccaaugcggugaugcguggaccuccaccccuuaugagaccuccacccccuuucggcaugaugagggguccaccgcccccuccacggcccccuuuugggcgcccacccuucgauccgaacaugccucccaugccaccucccggaggcaucccacccccuaugggcccaccgcaucugcagagacccccuuuuaugccacccccuauguccucuaugccacccccgccugggaugauguucccacccggaaugccucccgucaccgcuccagguacuccugccuugcccccaacagaggaaauuuggguugagaauaagacgccggacggcaaaguguacuauuacaacgcaaggacccgggagucagccuggacaaagccugaugggguaaaagugauacagcaaagugaauuaacucccaugcuggcugcacaggcccagguccaggcucaagcccaggcgcaggcacaggcccaagcucaggcccaggcacaagcucaggcccaggcgcaggcccaagcacaggcucaggcccaggcucaagcccaggcacaggcccaggcucaagcgcaggcacaggcccaggcucaagcccaggcacaggcccaagcucaggcccaggugcaggcacaaguucaggcucaggugcaggcgcaagccgucggagcaagcaccccaacaaccuccucucccgccccugcugugucgacuucaacaagcaguuccaccccaucuagcacgacuuccaccacaacuaccgccacaucaguagcacagaccguuaguacgcccacuacacaggaccagaccccuagcucugcuguguccgucgccacuccgacagugucagugagcaccccagcgcccacggccaccccuguccaaacaguuccacagccccacccucagacucuaccgcccgcugugccacacaguguaccucaacccaccacagcaaucccagccuuuccucccgugauggucccaccguuccgcgugccucuccccggcaugccaauuccccugccugguguucuuccagggauggcucccccuaucgugccgaugauucauccacaggucgccaucgcagcgucucccgccacucuggcuggagccaccgcaguguccgaguggacagaauauaagaccgcugauggcaaaacuuacuauuacaauaaccgaacguuggagagcacaugggagaagccucaggaacucaaggagaaagaaaagcuggaggagaaaauaaaggagcccaucaaagagccaucggaagaaccucugcccauggaaaccgaggaagaggacccaaaggaggaaccuauuaaggagaucaaagaagaaccgaaggaagaggagaugacugaagaggaaaaagccgcacagaaggccaaacccguagcuaccgcgccaauuccuggcacacccuggugcguuguguggaccggggaugagagagucuuuuucuauaauccaacuacaaggcucucuaugugggaccggccugaugacuuaaucggacgugccgauguggacaagauaauucaagagcccccgcacaaaaaggguauggaagaacugaagaaacuucgccauccaacgccuaccauguuguccauccagaaguggcaguuuucaaugagugcaauuaaagaggagcaggaacugauggaggagaucaacgaagaugagcccgucaaggcuaaaaagagaaagagggacgacaauaaagauaucgacagcgaaaaggaggccgccauggaagcugagauuaaagcagcccgggagcgagcgauagugccacuagaagcucgcaugaagcaauucaaagauaugcuccuggagagaggcguuuccgccuuuucuacuugggaaaaggagcuucacaagaucguguucgaccccagguaccuguugcucaacccuaaagaacggaagcagguauucgaucaguacgucaaaacacgcgcagaggaggaaagaagggagaagaaaaauaagauuaugcaggccaaggaagacuuuaaaaagaugauggaggaggcuaaauucaacccgcgugcaaccuuuagcgaguucgccgcgaagcacgcuaaagauucacgguuuaaggccaucgagaaaaugaaggaccgagaagcacuguucaaugaguuuguggccgcugccagaaagaaagaaaaggaggauaguaaaacaaggggcgagaagauaaaauccgacuucuuugaauuacugagcaaccaucaccucgauucucaaucacgcuggaguaagguuaaggacaaaguggagagcgacccccgguauaaggcagucgauuccucuucgaugagagaagaccuuuucaaacaguacauugagaagaucgcuaaaaaucuggauagcgaaaaggagaaggaguuggaaaggcaggcccgcaucgaggcgucccuacgagaacgggagcgugaagugcagaaagccagaucagagcaaacuaaggagauugacagggaacgcgagcagcauaaacgggaagaggcaauccagaacuuuaaggcucugcucagugauaugguaagaucuagcgacguguccuggucagauaccaggcgaacgcugcgcaaagaccaccggugggagagcggaucucuucuggaaagagaggaaaaggagaaguuguucaacgaacacauugaggcccucaccaaaaagaaaagggagcauuuucgucaacuguuagaugaaacauccgcuauaacucugaccaguacauggaaggagguuaaaaagaucauuaaagaagacccacgcuguaucaaguucucuagcuccgaucggaagaaacagagagaguucgaagaguauaucagggacaaguacauuacugcaaaagccgauuuucgaacccuacucaaggagacgaaauucauaacauaucggucaaagaagcugauccaggaaagugaccagcaccuuaaagacgucgagaagauuuugcaaaaugauaaacgcuaccuggugcucgacugcgugccugaagagagaaggaagcugaucgucgccuauguugaugaccuugaucggcgagggcccccuccacccccuaccgcuagcgaaccaacuagacgcucgacaaaauga

SEQ ID NO: 63618 - RNA, 1761 nt, Artificial Sequence
  derived and/or modified sequence opt3 from TCERG1L__Homo_sapiens__NP_777597
augcaggccggcgcuagauuccaaaggcggcgccgacagcugcagcagcaacagccccguagaaggcagccucuccuuuggccaauggacgcagagccgcccccuccacccccuuggguguggauggucccagggagcgccggacuguugcgguuauccgcggguguugugguacccccugugcugcuagcuucugccccaccgcccgcagccccucuccugccaggccuucccggguggccugcuccaucagaacccguccugccguugcucccucugcccagugcaccagauagcgccgcugccgcggcagcccauccuuuucccgcucugcauggacagugguuguucggcggucacuccccaucuuuagggcugcccccuucgucaaccguggagcuuguuccaguguuuccgcauuugugccccagcgcccuggcaacaccuaucggaaagaguuggauugacaaacgcauaccaaacuguaagaucuucuuuaauaacuccuucgcucuagauucuacuuggauucaccccgaagagagcagauuuuuccauggccacgaaaaaccuaggcuccuggccaaucaagucgcggugucccuuucacggccagcccccgcaagucgcccgcugccuacgguaguuuuggcuccacagcccaucccuggcgggugccacaacagccucaaggugaccucuucccccgccauugcuaucgccacagcagccgcugcggcaauggucucaguggacccagagaaucugcgaggaccuagccccaguucugugcagccaagacacuuuuuaacucuggccccgauaaaaaucccucucaggaccucccccgucagcgauacacggaccgagcguggucgcguugcuagaccacccgcccuuaugcugagggcacagaagucgcgggacggcgauaaggaagacaaagagccuccacccaugcucgggggaggcgaagauucuacugcccgagguaaccgcccuguggcuuccacaccgguaccagggucacccugguguguggucuggaccggagacgauagaguguucuuuuucaauccuacgaugcaucuaaguguuugggagaagccaauggaccugaaagauaggggcgaccucaaccggauuaucgaggaucccccucauaagcgcaaacuggaagccccggcaacugacaauagcgacggcuccucuagcgaggauaacagagaagaccaagaugugaagaccaagaggaaucguacagaggggugcggaucacccaaaccagaagaggcgaagcgggaggacaaagguacucgaaccccucccccacagauucuucugccuuuggaagagagagucacacacuuuagggauaugcuccuggaacgcggcgugagugcuuucuccaccugggagaaggaauuacacaaaaucguauucgacccccgguaccugcuacucaacagcgaggagagaaagcagauauuugaacaauucguuaaaacgaggauuaaggaggaauauaaggagaaaaagucuaaacugcuuuuggccaaggaagaguuuaaaaagcugcucgaggaaucaaaggugaguccacgcacuacauucaaagaguuugcagaaaaguacgggcgagaucagcgguuccgucugguccagaaaagaaaggaccaggagcacuuuuucaaucaauuuauccuuauucugaaaaagagggauaaggagaaccgcuugcggcucagaaaaaugagguga

SEQ ID NO: 63619 - RNA, 2049 nt, Artificial Sequence
  derived and/or modified sequence opt3 from TCF12__Homo_sapiens__NP_003196
augaacccccagcaacagagaauggccgcuaucggcaccgacaaggagcugagcgaucuccuugacuucuccgcaauguuuucuccuccagugaauagugggaaaacaaggccgacuacgcugggaaguagccaguucuccgguucuggcauugaugaacgcgggggaaccacaucguggggcacuucaggucagcccagcccuaguuacgacuccucucggggguuuaccgauagcccacacuauuccgaccauuugaacgauucacgauuaggagcccacgagggccugagucccacaccuuucaugaauagcaaccuaaugggcaagaccucugaacguggguccuuuucacucuacagcagagacacuggacugccagguugccaaaguucucuucugaggcaggauuugggccucgggucccccgcgcagcugagcucgucuggaaaaccuggcacagcuuauuacuccuucucagccaccaguagccggcgcagaccacugcaugacuccgcagcccucgauccguuacaggcuaagaaagucaggaagguucccccuggucugccaucuagcguguaugcacccucaccuaauagugacgauuuuaaccgggaguccccaagcuaccccucuccgaagccucccacgucaauguucgccaguaccuuuuucaugcaagacgggacucacaauagcuccgaccuuuggucuucgagcaacggaaugucccagccaggcuuuggcgggauauugggaacaucaacuucacauaugucucagagcuccucauaugguaaucugcacagccacgaucgccuaucuuacccuccccauuccguaaguccaaccgacaucaacacaagccugcccccuaugucuuccuuccaccgaggcucaaccaguagcucgccauacguggcugccucccauacgccgcccauuaaugggucugauagcauccucggaacuagaggcaacgcggcagguucaagucagacaggggacgcccuuggcaaagcucuggccuccauuuauucuccugaucacaccagcuccucauuuccaagcaaucccaguacuccugucggaucuccaucccccuugacaggcaccagccaauggccgaggccugggggacaggcaccaucgucacccucuuacgaaaacagucuccacucccugcagagccggauggaggaccguuuagaucgccuggacgaugcuauccaugugcucagaaaucacgccguugguccuucuacgagccuucccgcgggccauuccgacauacacucacuguuggggccaagucauaacgccccuaucggaagccuaaacucuaauuauggcgguuccucacugguggcaaguagcagguccgcuucuauggucgggacccaccgggaggauucggugagccucaacggcaaucacucaguacuguccaguacaguuacuaccucuagcacagaccuuaaccauaagacucaagaaaauuaccgaggaggccugcagucccagucagggaccguggucacaaccgagauuaaaacugaaaacaaggagaaagacgagaauuugcacgaacccccaucuagcgaugacaugaagagugaugacgaguccagccagaaggauaucaaagugucuucacgcggaagaacguccaguacaaacgaagacgaggaucucaauccggaacaaaagauugagagggagaaagaacggcgcauggccaacaaugcuagagagaggcugcgugugcgggacaucaacgaagccuucaaggaguuaggucgaaugugucagcugcaucuaaaaagcgaaaagccucagaccaaacuccugauacuucaccaggcagucgccguuauuuugucgcuggagcaacaggugagagagaggaaucucaaccccaaggcugcgugccugaagcgccgggaagaggaaaaaguaucugcaguguccgccgagccacccacuacccuuccuggcacacacccagggcugagcgaaaccacuaaucccaugggacauauguga

SEQ ID NO: 63620 - RNA, 600 nt, Artificial Sequence
  derived and/or modified sequence opt3 from TCF15__Homo_sapiens__NP_004600
auggccuucgcucugcucagacccgugggcgcacacguccuuuacccugacguuaggcuguugagcgaggaugaagagaaccgguccgaaucugacgccucagaucagaguuuugggugcugugagggaccagaagcggcucgccgagguccgggccccgggggaggccguagagccggugggggaggcggcgcagggccugugguaguggucaggcaacggcaggccgcuaaugcacgcgagagagacaggacccagagcgugaacacagccuucacugcuuuacggacgcugaucccaaccgagcccguugaucgcaagcuauccaaaauugaaacacuccgacuggccucuucguauauagcgcaucuugcaaaugugcuguugcucggagacucagccgaugacggucagccuugcuuuagagcugccggcagcgcaaagggggcugucccagccgcggccgauggaggcaggcaaccccggaguaucuguacuuucugccuguccaaccagcguaaaggugggggacgcagagaccugggcggcucuugucucaaggugaggggaguagcaccuuuacgggggccacgacgcuga

SEQ ID NO: 63621 - RNA, 1038 nt, Artificial Sequence
  derived and/or modified sequence opt3 from TCF19__Homo_sapiens__XP_005249391
augcugcccugcuuccagcuccuuagaaucggcgggggaagggguggcgaccuguacaccuuucacccuccagccggggcuggauguacauaucgguugggccaucgcgcagauuuaugcgacguggcccugcgaccgcaacaggagcccggucuaauuagcgggauacacgcggaacuccaugcugagccucguggagaugacuggagagucucccuggaagaucacucuucacagggcacucuuguuaacaaugugaggcugccacggggccaucgcuuggagcucagugacggggaucugcugacguucggacccgaagguccuccaggcaccagccccuccgaguuuuacuucauguuucagcaaguaagagugaagccucaggacuucgccgcaaucacaauuccaaggucucgcggggaggcccgggucggagcuggcuuucgaccgaugcuccccucgcagggugcaccucagagaccauuaucaacuuucagccccgccccuaaagcuacccugauccuuaacaguauuggguccuugucuaagcugaggccacaaccccuaacauuuagcccguccuggggaggcccuaaaucacuccccgugccagccccucccggcgaaauggggaccacuccaagugcgcccccucagcggaaucgucgcaagagcguucacagagugcuggcagagcuugaugacgaaucugagccaccggagaaucccccuccaguccugauggaacccaggaaaaaguugcggguggauaaggccccucucacaccaaccggaaaccgacgcgguagacccaggaaauauccgguauccgcuccuauggccccacccgcaguuggcgggggagagccuugugcugcccccugcuguugccugccacaggaagagacgguggcguggguccagugugacggcugcgaugugugguuccacguggccugugucgguugcucaauccaagcagcucgggaagccgacuuucgcuguccugggugcagagcuggcauacagacuuga

SEQ ID NO: 63622 - RNA, 5883 nt, Artificial Sequence
  derived and/or modified sequence opt3 from TCF20__Homo_sapiens__NP_005641
augcagagcuucagagagcaauccucuuaccacggcaaccagcagucauauccccaggaagugcaugggaguagcaggcuggaggaauuuuccccucggcaagcccagauguuccagaauuuuggagguaccggcgggucuucgggaucaagcggcagugguuccgggggaggccgccgaggcgcugcagccgcggcugccgcaauggccucugagacaagcgggcaccagggauaccaagguuuccguaaggaagcuggcgacuuuuauuacauggcagggaacaaagauccagucacuacgggaaccccgcagcccccucagagaaggccauccggccccguucagucauaugguccuccacaagggaguagcuucggaaaucaguacggcucugagggccauguggggcaguuucaagcccagcacuccggacucgguggcguaucacauuaucagcaggacuacacagggcccuucagcccuggaagugcucaauaccagcagcaggccucuucccaacagcagcagcaacaggugcagcagcuucggcaacagcuguaucagagccaccaaccauugccgcaggcgacuggccagcccgcaucgucuuccucacacuuacagccuaugcaacgcccaaguacccugcccagcuccgccgcugguuaccagcuaagagucgggcaguuuggccagcauuaucaaucuagcgccucaaguuccagcucuucaaguuucccuagcccacagagguuuucccagucuggacagucguacgauggcagcuauaacgugaaugcagggucccaauacgagggacacaacguugguucaaaugcucaggccuauggcacacagaguaacuacucuuaccaaccccagagcaugaagaauuucgaacaggcgaaaaucccgcaggggacccaacagggacagcagcaacagcagccucagcaacagcagcaucccucccagcacgugaugcaauauacuaacgccgcaacaaagcucccacugcagucacaggucggccaauacaaucagccugaggugcccguacggagcccaaugcaguuucaccagaacuucucucccauuuccaauccuaguccagcugccagcguugugcaaucuccguccugcucaaguacccccagcccucuuaugcagacgggugaaaaccugcagugugggcagggcucggucccaaugggaucccgcaaucgaauauugcaacucaugccccagcugucuccuacuccaagcaugaugcccucaccgaacagucaugcugccggcuucaaaggguuuggacuggagggugugccugagaagagacucaccgacccaggcuuauccucucugagcgcacuuuccacacagguggccaacuugcccaauacuguccagcacaugcugcuaucagaugcucucaccccucaaaagaaaacaagcaagaggcccaguucuuccaaaaaggcggacagcugcaccaacucggaagggucaucucagccagaggaacagcugaaaaguccuauggcagagucccuugauggaggcuguagcucuagcuccgaagaccaaggugagcggguucgucagcugucagggcagaguacgagcucugauacuacauauaagggcggagccuccgagaaggcuggcucaagucccgcccagggggcacaaaaugaaccaccgcgcuugaacgccagcccugcugccagagaggaagcaaccucccccggagcgaaagacaugccacucucuucggauggcaaucccaaggugaacgagaaaacuguaggugugaucgucagcagggaagcuaugacagggcggguggagaagccuggaggccaggacaaagguucacaggaggaugacccagccgcaacccagcgacccccuuccaauggcggggccaaggaaacgagucaugcuucucugccgcaaccagagcccccuggaggcgggggaagcaaaggcaacaagaauggugacaacaauuccaaccacaauggggaaggaaacggccagucaggucauucugccgcaggcccaggguucaccagccgcacagagcccaguaaguccccuggaagcuuaagauacucuuauaaagauucauuuggcuccgcuguuccgaggaaugugaguggguucccccaguacccaacuggacaggaaaagggcgacuuuaccggucacggggagcggaaaggacgcaacgagaaguucccuagccugcuccaagaaguccuucagggcuaucaccaucaccccgauagaagguacucgcguucuacacaggagcaucaggguauggccggcucccuggaagggacuacccggccaaacguguugguaagccaaacaaaugagcuagcgucacgaggacugcucaacaaaaguauuggcucucugcuugagaauccucacugggggcccugggaaagaaaguccagcucaaccgccccagagaugaagcagaucaaccugacugacuacccgauuccuaggaaauuugaaaucgagccccagaguagcgcucacgaaccaggaggcuccuugucugagcgccggagcguuauaugcgauaucuccccccucagacaaauugugagggacccuggugcacauucacuggggcacaugucugccgauacgcgcaucggacgaaaugaccgguuaaacccaacacugagucagucggucauucuacccggcggccucgugagcauggagaccaagcugaaaucccagucugggcagaucaaggaagaggauuucgaacaaucaaaaagccaggcuuccuuuaauaacaagaagaguggagaccauugucacccuccgucuauaaaacaugagagcuaucgugguaaugccucaccaggcgcagcgacucacgauucccuuagugacuacgggccccaggacagcagaccuacccccaugaggcgcgucccaggacgggugggcgguagagaagggaugaggggacgaucuccuucccaguaucacgauuucgccgagaaguugaaaaugucacccggccgcagccggggcccagggggagacccucaucacaugaacccgcauaugacauuuucggagagagcuaauaggucuagucugcacacccccuucuccccaaacagcgaaacucucgccucagcauaccaugcuaauacacgugcccacgcauauggugauccuaacgccggccugaauucccaacuucacuacaagcgccagauguaucagcagcaacccgaggaauacaaagacuggucuagcgggagugcucagggaguuauugcggccgcacagcaucggcaagagggcccaagaaaguccccuaggcagcagcaguuucuggaucgagugcggagccccuugaagaacgacaaagaugguaugauguacgggccgccaguaggaacguaucacgacccuucugcucaagaagccggccgcugccucaugucaagugauggccugcccaacaaggggauggaguuaaaacauggaucccagaagcugcaggagagcuguugggaccuaucuagacagaccucgccagccaaaucaagcggucccccuggcauguccagucaaaagagguacgggccgccccacgaaacugauggacacggccucgcugaggcaacacagucuagcaaaccagguuccgucaugcugcggcuuccugggcaggaagaccauucaagucagaaucccuugaucaugcgaagacgcgugaggucuuucauuagcccuaucccauccaagcgucaaucacaggauguuaagaacagcucuaccgaggacaaaggacggcugcuccacuccaguaaggagggcgccgacaaagcguucaauagcuaugcucaucugucgcacucccaggauaucaagucuauucccaaaagagacucaagcaaggauuuaccuaguccagacuccaggaacugccccgccgugacacugacuucuccggcaaagaccaaaauacuuccuccacgcaagggccgaggguugaaacucgaagccaucguccaaaagauuacgagccccaauaucagacggucagcuuccaguaacagcgcagaggccggaggugauaccgugacacuggacgauauacuaucucugaaaucaggcccuccagaagggggauccguagcggugcaggacgcugauauugagaagaggaagggcgaaguugccagcgaccucgucucucccgcaaaucaggagcugcauguggagaaaccgcuuccucgcaguucggaagaguggcgugguuccguggaugacaaggucaaaacugaaacccacgccgagacaguuacugcugggaaggaacccccaggagccaugaccagcacgacaucacagaaaccuggcucuaaccaaggcagacccgaugggagcuugggagguaccgcaccacugaucuuucccgacuccaagaaugugccuccagugggcaucuuagcuccggaggccaaccccaaggcggaggaaaaagagaaugacacuguaacaauuaguccuaagcaggaaggguucccacccaaaggauacuuuccuucaggcaagaaaaagggucggccaaucgggucugucaacaaacagaagaagcagcaacagcccccuccgccacccccucagcccccacagauuccugagggcagcgccgauggagaacccaaaccaaagaaacaaaggcagcgccgagagagacggaagccgggcgcacagccuaggaaacgcaagaccaagcaggcugugcccauaguugagccacaagaacccgagaucaaacucaaguaugccacucagccucuggacaaaaccgaugcuaagaauaaauccuucuacccauauauucacguggucaacaagugugaacuuggggcagugugcacaaucaucaaugccgaggaggaagagcagacgaagcugguuagaggaaggaaaggucaacggaguuugacccccccuccgagcuccacugaaucuaaggcccucccagcuucaagcuuuaugcugcagggccccgugguaacagagucguccgucauggggcaucuaguguguugccugugcggaaaaugggcgaguuaccguaacaugggcgaccucuucgguccuuuuuacccacaggauuaugcagccacccugcccaagaacccucccccaaaacgcgcuacagaaaugcagucuaaggugaagguccgacacaaaagcgccucaaauggguccaagacugacaccgaggaggaagaggaacaacagcagcagcaaaaagagcagagaucucuugcagcccauccgagguucaagcggcgccacagaagugaagauuguggcggaggcccuaggagcuugucccgggggcugcccugcaaaaaggcugcgacggagggaucaagcgagaagacaguuuuagacucuaaaccaagugugccuaccacuuccgaagguggccccgagcucgaacugcagauuccagagcuuccucuggauagcaacgaauuuuggguacacgagggguguauacuaugggccaauggaaucuaccucgugugcggccgacuguaugguuugcaggaggcacuggaaauugcuagagagaugaaguguucacauugccaagaagccggggcaaccuuaggcuguuacaacaaaggaugcucuuuccgcuaucacuaccccugugccaucgacgcugauugccuccugcaugaggagaauuuuuccgucagguguccgaagcacaaaccaccucuucccugcccacugcccccuuugcagaacaagacagccaaaggcucgcucagcacugaacagagugagcggggguga

SEQ ID NO: 63623 - RNA, 540 nt, Artificial Sequence
  derived and/or modified sequence opt3 from TCF21__Homo_sapiens__NP_003197
augagcaccggcucccugucugacguggaggaucuccaggaagucgagaugcuugaaugcgacgggcugaagauggauucaaacaaagaguucguuacaaguaaugaaagcacugaggaguccucuaacugugaaaauggaucgccccaaaaggguagaggcggguugggaaaaaggcggaaggccccuacgaaaaagucaccauuaagcggcgugagucaggaggguaagcagguacagcgcaacgcugcaaaugcccgagaacgugcgagaaugagggugcuguccaaggcuuuuucucggcuaaagaccacacucccgugggugcccccugacacuaaacugagcaaacuugauacccugcgcuuggccuccucauacaucgcacaccucagacaaauucuggccaacgacaaauaugagaauggguacauacauccagucaaccugacauggcccuucaugguugcuggaaagccugagagugaucucaaggaaguggucaccgcaagcagguuaugcggcacuacagccucuuga

SEQ ID NO: 63624 - RNA, 2031 nt, Artificial Sequence
  derived and/or modified sequence opt3 from TCF25__Homo_sapiens__NP_055787
augagcagaagggcccugcggcgccuccgaggcgagcagcgugggcaagaaccccuuggaccuggugcucugcacuucgacuugagagaugacgaugacgcagaggaagagggcccaaagagggaauuaggggugcggcgcccgggaggcgccgguaaagagggggucagaguuaacaauagguuugagcugaucaacauugaugaccuagaagaugaccccgugguaaauggagagcgguccggcugcgcgcucaccgaugcuguggccccuggcaacaaggggcgcggacagcgagguaauacagaaucuaaaacugacggcgaugacacggagaccgucccaucagagcagagucaugcaagcgggaagcugaggaaaaagaagaaaaagcagaaaaacaagaaauccucuacaggagaagccucggagaauggccuugaagauauagacagaauccuggagcggauugaagacucaacugguuugaaccgucccgggccugcuccacucagcagucgcaagcacgugcuguacguugagcauagacaccugaaucccgauaccgagcucaagagguauuucggagcacgggccaucuuaggcgaacaacgaccucgccagagacagaggguguacccaaaauguacauggcugaccacuccgaaguccacauggccccgguauucuaaaccuggccuuagcaugcgcuugcuggaguccaagaaagggcuaucauuuuucgcuuuugaacauagugaggaauaccagcaagcccagcacaaguuccucgucgcgguggagagcauggagccaaacaauauuguaguucugcuucagaccucucccuaucacguggacucccuguugcagcucucagaugcaugcagauuucaagaagaccaggagauggccagggaucuggucgaacgugcuuuauacagcauggagugugccuuccauccucuguuuagucucacgucuggagcaugccggcuugacuaucgaagaccagaaaacagguccuucuaccuggcuuuguacaaacagaugagcuuucuagagaagcgcgguuguccccggacugcccuggaguauugcaagcucauccugucgcuugaaccggaugaggacccucuguguauguugcuccugauagaucacuuagcgcugagagccaggaauuacgaauaucuaauccgccucuuccaagagugggaggcacaucgaaaccugucucagcuucccaauuuugcuuucuccgugccauuggccuacuuccugcucucacagcagaccgaccugccugaaugcgagcaaaguagcgcucggcagaaagccucccuucugauucagcaggcauugacaauguuucccggcgugcuccugccauuacuggaaucuuguagcguccgucccgaugccucaguuaguucccacagauucuuugggccuaacgcugagaucagccaaccaccggcgcuaucucagcucgugaaccuguaucuuggaaggucacacuucuuguggaaggaacccgcaacuaugaguuggcuggaggagaauguacaugaagugcuccaggccgucgacgcuggcgacccugccguggaggcaugcgaaaaccgccggaaaguucuguaccagagagccccaaggaauauucaccgacaugugaucuuaagcgagauaaaggaagcugucgccgcacugcccccugaugugaccacacaauccguaauggguuuugacccacuucccccgucugauaccauuuauucguacguucgcccugagcgguugagcccaaucucccacgggaacacgauugcccucuucuuuagaucacugcuacccaauuacacuauggagggcgaaaggccugaggaaggaguggcuggcgggcugaaccguaaucagggacucaaccgccugaugcuugccguccgggacaugauggcaaauuuccauuugaacgaucuggaggcgccccacgaagacgaugcugagggugagggcgaaugggacuga

SEQ ID NO: 63625 - RNA, 1956 nt, Artificial Sequence
  derived and/or modified sequence opt3 from TCF3__Homo_sapiens__NP_001129611
augaaccagccccaaagaauggccccugugggcaccgacaaggagcugagcgaucuccuugacuucuccaugauguuuccacugccggucacaaaugggaaaggaaggcccgcuucuuuggcaggcgcccaguucggcgggucaggauuagaagaucggccuaguagcggcuccugggguucuggggaccagucgucaagcaguuuugauccaucccgcacuuucucugagggaacgcacuuuaccgaaagccauuccucacugaguagcucuacauuccuaggccccggccucgggggaaaguccggugagcgaggcgcguacgcuucauuugggcgugacgccggaguuggcggucugacucaggcaggguuccuuagcggagaacuggccuugaacaguccuggcccacucucucccuccggcaugaaagggaccagccaauauuacccuucguauucuggauccucaagaaggcgggcugcagaugguagucuggacacacagccaaagaaagugcgcaagguaccgcccggccugccuagcuccguguacccacccucuagcggggaggauuauggaagagacgccaccgcuuacccuucagccaagacuccaaguuccacauaucccgcgccguuuuacgucgcagauggcagccuccacccuucugccgaguuauggucacccccaggucaggcuggguucggcccuaugcugggaggcgggaguagcccccuuccauugcccccuggauccgguccaguggguucuucggggagcuccucaaccuuuggaggccugcaucagcacgaaaggauggguuaccaacuacauggggccgagguuaauggcggacucccgagugcaucuagcuucuccucagcucccggcgccacguaugggggagugagcucucacacuccuccagucuccggugcggacagucugcuuggcagccgggggaccacagccggaucuuccggcgaugcacuggguaaagccuuggccucaaucuacagucccgaccacagcucgaacaauuuuuccucuagcccuucaacuccaguggggaguccccagggccucgcuggaaccucccaguggccgcgcgccggcgcaccuggggcccugucuccaagcuaugacggaggcuuacauggucugcaguccaagauugaagaucaccucgacgaggcuauacauguacuucgaucacacgcgguugggacagcaggagauaugcacacccuguugcccggccauggugcccuagcuagcggcuucacggggccuaugagucugggaggcagacacgccgggcucgugggaggcucucaucccgaggacggucuggcaggguccacuagccuuaugcacaaccaugccgcucugccaucgcaaccuggaacauugcccgaucucucaaggccaccggacucuuacaguggccugggucgggccggcgcaaccgcggcugccuccgaaaucaaacgugaggaaaaggaggaugaagagaauacuagcgcagccgaccacucugaggaagagaaaaaggaauuaaaggcuccucgcgccagaacaagcuccaccgaugagguccugucacuagaagagaaagaccucagggaucgggagcgacgcauggcaaacaaugcuagagaaagggugcgggugcgcgacauuaacgaggccuucagagaacuggggaggaugugccagaugcaccuuaagagugacaaagcgcagacgaaguugcugauccuccaacaggccguccagguuauucugggacuugagcagcaagugcgugaacggaaucugaaccccaaagcugcauguuugaagcgaagagaggaggaaaaaguaagcggcguggucggggauccacagauggugcucucugcuccccauccuggacuguccgaggcucacaauccagccggccauauguga

SEQ ID NO: 63626 - RNA, 2322 nt, Artificial Sequence
  derived and/or modified sequence opt3 from TCF4__Homo_sapiens__NP_001230155
auguucagcaagagacuggagaaaaucccccaggugccucuccuuuuuccauucauuuuuauaauccugaccaacuacuccaagauggaaggcgccgucgagucucaaccgucauucuuuaaaacaagucaggacauuguuacuugcacguggguggaaaauuguuauagcuccuucucuaggcggcccuuggagcagauguuuugcaagcaccagucgaaaaacaucauuucauggaccgggaugguagcucauacauguaauccuagcacuuuaggaggucaaggccugugcgauuucgcaaagaugcaccaucagcagcgcauggccgcgcuagggaccgacaaggaacucagugaucugcuugacuuuuccgcuauguucucuccacccgugagcuccggcaaaaacggaccuacaucacuggccaguggucacuuuaccgggagcaaugucgaggaucgaucuuccucaggaagcuggggcaacggcgggcauccaagucccucucguaauuacggagacgguacuccuuaugaucacaugacauccagagacuugggcagccacgauaaccucucgccaccguucgugaauagcaggauccaguccaagaccgagcgggggucauacaguagcuauggacgcgaauccaaccugcaaggcugucaucagcagucucugcucgguggggacauggauaugggaaaucccggcacguuaagcccuacuaaaccaggcucacaguacuaucaauacaguuccaacaaucccagaaggcggccucugcacagcucugcaauggagguucagaccaagaaagugcgcaaggucccacccgggcuuccgucaaguguguacgccccuagcgcuuccacagcagacuauaaccgagauucucccggauacccaucgagcaagccugccacuuccaccuuucccucaaguuucuucaugcaggacggucaucacucuagcgacccaugguccucaagcucuggcaugaaucaacccggguaugcuggaauguugggcaacuccagucacauaccucagucuucuuccuacugcucacugcauccacacgaaagacuaaguuauccgagccauucguccgccgauaucaacucuagccugcccccuaugucaacauuucacaggagugguaccaaucauuacuccacgucuagcuguacuccacccgcgaacgggacagacuccauuauggcaaaucggggcucaggagccgcuggcagcagucagaccggggaugcccucggaaaagcacuugcuucuaucuauuccccugaccacacuaacaauagcuucucgucaaacccaucuacacccguagguaguccgccuucccugagcgccggcaccgcgguuuggucucguaaugggggacaggccagcuccucaccaaacuacgagggccccuugcacagucuccaaagccgcauugaggauagacuggaaagguuagacgaugcaauccaugugcugcggaaucacgcugucgguccuucuacggccaugcccgggggccauggagacaugcacggcauaauugggccaucccacaacggagcuauggguggccucgggucaggauacggcaccggucuucugagugccaaucgacauagcuugaugguggggacacaccgcgaggauggcguggcacuaagaggaucccauucucugcucccuaaccagguccccguuccacagcugccggugcagucggccacuagcccugaccuuaaucccccacaagaucccuauaggggcaugccuccagggcugcagggacagucaguauccaguggcucuagcgaaaucaaguccgacgacgagggugaugaaaacuugcaggacaccaaaucaucugaggauaagaaacucgacgaugacaagaaagauauuaagagcaucacacggagucgcuccagcaauaacgacgaugaggaccugacucccgaacaaaaggcugagagagaaaaagagaggcguauggcgaacaaugcacgggaacgauuaagagugagggauaucaacgaggccuuuaaggagcuggggcgcaugguccagcuacaccucaaaucugacaagccucagaccaaacugcuuauuuugcaucaggcuguggccguuauacugucacucgaacaacaggugcgggagagaaaucugaacccgaaggcagccugccuuaagaggcgcgaagaggaaaaagucuccagugagccacccccucugagcuuggcuggaccacaccccggcaugggugaugccucgaaucacaugggccagauguga

SEQ ID NO: 63627 - RNA, 810 nt, Artificial Sequence
  derived and/or modified sequence opt3 from TCF7__Homo_sapiens__NP_001128323
auguacaaggagaccguguauagcgccuucaaccugcucaugcacuaucccccuccauccggcgcugggcagcauccgcaaccccagccuccacuucacaaagcaaaucagcccccucauggagucccacagcugucuuuguacgaacacuuuaacucaccccauccuacaccagccccggcggacaucagucaaaagcagguucacagacccuuacagacuccugaucugagcgguuucuacucccuaacgucuggcucgauggggcagcucccacacaccgugucaugguuuacacaucccagccugaugcuuggaaguggcguaccuggucacccagcugccauuccccauccggcaauagugccucccuccgggaaacaagagcugcagccauucgacaggaauuugaagacucaggccgaaucuaaagcugagaaggaagcaaagaaaccuaccaucaagaaaccccucaacgccuuuaugcuguauaugaaggagaugcgggcuaaagucauugccgagugcacacugaaggaaagcgcggcaaucaaucagauucucggacgccgauggcacgccuuaucccgugaggaacaagcuaaguacuaugagcuggccagaaaagagaggcagcuucacaugcaguuguacccaggcuggucagcacgggauaacuacggcaagaaaaagcgcagaaguagggaaaaacaucaagagagcaccacugaaacaaauuggccccgggagcugaaggacgggaacggacaggaaucucuauccaugucaagcaguucuuccccugcuuga

SEQ ID NO: 63628 - RNA, 1767 nt, Artificial Sequence
  derived and/or modified sequence opt3 from TCF7L1__Homo_sapiens__NP_112573
augccccagcugggcgggggagguggcgggggaggcggugggagcggaggcggcgggggauccucugccggugcugcaggcgggggagacgaucucggcgccaacgacgagcuuaucccuuuccaagaugaagguggggaggaacaggagccaucaagugacagcgcguccgcucagagagaucuggacgaagugaagucuucguuggucaaugagucagagaaccagagcaguuccucugauagcgaagccgagaggcggccgcaacccguucgcgacaccuuucagaaaccucgagauuacuucgcagaagugcguagaccacaggacuccgccuuuuucaagggacccccuuauccaggcuaccccuuuuuaaugauuccugaucugucaaguccauaucuaagcaauggcccgcucucucccgggggagcuaggacauaccugcagaugaaauggccucuucuggacguaccauccucagcaacugugaaggauacgcggagccccaguccugcccacuugucuaacaaagucccagugguucaacauccccaccauaugcacccgcucaccccucugauaacauauuccaaugaccauuucagccccgguucgccaccuacucaccugucucccgagaucgacccaaagaccggcauuccccgcccuccacacccguccgagcucucacccuacuauccuuuaaguccaggggcugugggacagaucccccauccucugggcuggcuugucccacagcagggucaacccauguacagcuugccgccugggggcuuuagacacccauaccccgcccuggcgaugaacgcauccaugucuagccuagugucaaguagguucuccccucauaugguagcccccgcucacccaggacucccuacaagcggcauuccccacccagccaucguuucuccgauagugaagcaggaaccugcacccccaucacugagucccgcugucagcgugaaauccccugugaccgucaagaaagaggaagagaagaaaccacauguuaagaagccccuuaaugccuuuaugcuguauaugaaagaaaugcgggcgaaggugguagccgagugcacuuugaaagagucugcagcuaucaaccagauucucgggcgcaaguggcacaaucugucgcgagaggaacaagccaaauacuaugaauuagcuagaaaggagaggcagcugcauagccagcucuacccuacaugguccgcccgggauaacuaugguaaaaagaagaaacguaagcgcgaaaaacagcuuucacaaacccagagucagcagcaagugcaggaggcagagggagcccuggcuucuaagagcaaaaagccguguguccaguacuugccacccgaaaagccuugcgacuccccagcgucaagccacggcucuaugcuagauucccccgcaacgccuagugccgcucuggccagcccggcagcccccgcugccacucauucugagcaggcacaaccacucucccugaccacaaaaccugaaacuagagcgcagcuugcucugcacucagccgcauucuugagugccaaggcugccgcaagcucguccgggcagaugggaucucagcccccacuccugagcaggccuuuaccccugggcucaaugccaaccgcucuacucgccaguccgccuuccuuucccgcgacacugcacgcccaucaagcacuuccaguguugcaggcucagccccugucucucguuaccaaaagcgcccacuga

SEQ ID NO: 63629 - RNA, 1809 nt, Artificial Sequence
  derived and/or modified sequence opt3 from TCF7L2__Homo_sapiens__NP_001139746
augccccagcugaacggcgggggaggugacgaucucggcgccaaugacgagcuuaucagcuucaaggaugaaggggagcaagaagagaaauccucugaaaacucaagugcugagagagaccuggcagaugugaagucguccuuggucaaugagucugaaaccaaccagaauagcucaagcgacagugaggccgaaaggcggccuccaccgcgcuccgagucuuuucgagauaaaagccgugaguccuuagaagaggcggcuaagagacaggacggaggccuguucaaaggucccccuuacccaggguaucccuuuauuaugauaccugaucuaacaucaccauaccuccccaacggaagucugagcccuacugccaggacgcuucacuuccagucuggcuccacccauuauucagcauacaagacaaucgaacaccaaauugccguucaguaucugcagaugaaguggccauugcucgacgugcaggcuggcagccugcaaagucggcaggcacugaaagaugcccgcucuccgucccccgcucauaucguaagcaauaaggugccugucgugcagcacccacaucacguucacccccucacuccuuuaauuaccuacucgaacgagcauuuuacaccagggaaucccccgccucaccuucccgccgacguggauccaaaaaccggaaucccuagacccccacaucccccugacauaucuccauauuacccgcugucccccgguacugucggccagaucccucacccauugggguggcuggugccccaacagggacagccuguauacccaauuacaaccggcgguuucaggcaccccuauccgacggcgcuaacuguuaacgcaucaaugagucgguuuccuccacauauggugcccccucaccauacccuccacacaacugggaucccccauccagccauugucaccccuacagugaagcaagaaagcucccagucugacgugggaagccugcacucaaguaaacaccaggauuccaagaaggaggaggagaaaaagaaaccccauaucaagaaaccacuuaaugcuuucaugcuguacaugaaggagaugcgcgccaaagucguugcagaaugcaccuugaaggagagcgcugccauaaaccagauucucggccgaagauggcacgcgcugucuagggaagaacaagccaaguauuacgaguuagcacggaaagaacgucagcugcauaugcagcucuauccgggcuggucagcucgcgacaauuacgggaagaaaaagaaaagaaagagggauaagcagccuggagagacgaacgacgccaauacucccaaaaagugucgggcucuuuuuggucuggaucgacaaacauuguggugcaaaccaugucgcagaaagaaaaagugcgugagguauauccagggcgaagggaguugucuaucucccccuuccucugacggaucgcugcucgauagcccacccccuuccccgaaccugcuuggcucaccaccccgggacgccaagagucagaccgagcagacucaaccucugucuuugagccucaaaccagauccccuggcacacuuauccaugaugccuccgcccccagcccugcuacucgcugaagcgacacacaaggcaucagcccugugcccuaacggugcucuugacuugcccccagccgcacugcagccugccgcucccagcagcuccauugcccagccaaguaccagcucucuccauucccacucaagucuggcagggacgcagccgcaaccucuuagccugguaaccaaaucguuggaguga

SEQ ID NO: 63630 - RNA, 1503 nt, Artificial Sequence
  derived and/or modified sequence opt3 from TCFL5__Homo_sapiens__NP_006593
augagcggccccgggccuagagagccaccgcccgaagccggagcugcagggggcgaggccgcgguggaaggggcuggaggcggugacgccgcacugggggagccuggacucuccuucaccacaacugaucuuucucuggucgaaaugacggagguugaguacacccaguugcaacacaucuuaugcucacauauggaagccgcugcagacggcgagcuggaaacaaggcuaaacagugcccuccuggcugccgcgggcccaggggcaggagccgguggcuuugcugccgggggacagggcggugcagcucccguguauccuguacuuuguccaagcgcccuggcggccgaugcacccugcuuggggcacauugacuuccaggagcuccggaugaugcugcuguccgaggcuggagccgcugaaaagacuucuggcggcggggauggagcccgcgcacgagccgacggugcugcgaaagagggcgcaggggccgcugccgcagccgcuggaccugauggcgccccagaagcacgugcgaagccggcugugagagucaggcucgaggaccgguuuaauucgauacccgccgaaccuccacccgcaccucgcgguccagagcccccggagccugggggcgccuuaaacaaucuggugacccuuaucagacaucccucagaauugaugaacguuccacugcagcaacagaauaaauguacagcucuagugaagaacaaaaccgccgcaacuacaaccgcucuccaguucacguacccucuguuuacuaccaaugccugcagcacaaguggaaacuccaaucuuucucagacucaaagcuccucaaacaguuguagcguccuggaggcggccaagcaccaggauauuggcuugcccagggcuuucucuuuuugcuaucagcaggaaaucgaguccaccaagcaaacacucgggucacggaauaaagugcugccagaacagguauggauuaagguuggagaggcagccuuauguaaacaggcucugaagcgcaaccgaagcagaaugaggcaacucgacaccaauguggagcggcgugcccuuggugaaauccagaacgucggcgagggggcaacggcgacucagggagccuggcagaguucugaauccagccaagcuaaucugggcgagcaggcccagucggguccccaggguggccgcucucaaagaagggaacggcauaaccgaauggagcgcgauagaaggcggcgcauaagaaucugcugugacgaguugaaccuacuggugccuuucugcaaugcagaaacagauaaagcuaccacucuccaguggacaaccgccuuucugaaguacauucaggagaggcacggagacucccuuaagaaagaguucgaaucaguguuuuguggcaagacggggcgucggcugaaauugacccgaccagacagucucgucacaugcccggcacagggaagccugcaauccucucccagcauggagaucaaguga

SEQ ID NO: 63631 - RNA, 5832 nt, Artificial Sequence
  derived and/or modified sequence opt3 from TCHH__Homo_sapiens__NP_009044
augagcccccugcucagauccaucugcgacauuaccgagauauucaaccaguacgugucucacgauugugacggcgccgcucuuacaaagaaagaucugaagaauuuguuagaaagggaguuuggggcaguccugcggcgcccucaugacccaaaaacuguugauuugauccucgaacugcuugaccuggauucaaacggacgaguggacuucaaugaguuucuacucuucauuuuuaagguagcccaagcgugcuauuacgcucugggucaggccacgggccuggaugaagagaaacgugcaagaugugacgggaaggagagucucuuacaggauaggcggcaggaagaggaccaacgcagauucgaaccgagggaucggcagcuggaggaggaacccggacagcgccgaagacagaagaggcaagagcaggaacgggagcuugccgaaggcgaggagcagagcgaaaaacaggagcguuuggaacaacgcgacagacagaggcgggacgaggaacuguggcgacagcgccaagaguggcaggagagagaagagaggcgggcugaagaggaacagcuacaguccugcaagggucacgagaccgaggaauuuccugaugaggaacaacuccgcagaagggagcugcuugagcugcgucggaaagggcgagaagagaagcagcagcagagaagggaacgccaagaccggguguuccaggaggaagaggagaaagaauggagaaagagggagacagucuugcgcaaggaagaggaaaaacuccaggaggaggaaccacagcgacaacgggagcugcaggaagaggaggaacaguuacguaagcuggagagacaggaacucaggcgcgagcggcaagaagaggagcagcagcaacagagacuuaggcgagaacagcagcugcgccggaaacaagaggaagagagaagggaacagcaggaggagcgucgcgaacagcaagagcggagagaacagcaggaggaaaggcgagagcagcaauugcggcgcgagcaggaagagagaagggaacagcaacuacggcgagagcaggaagaggagagacgcgaacagcagcugaggcgugagcaagaagaggagcggagagaacagcagcucaggcgcgagcagcaacugcgaagagaacagcagcuucggagggagcagcaacugcgccgugaacagcaguugagacgggagcagcaacucaggcgcgagcagcagcugcgaagagaacaacaguuacggagggagcagcagcugcgcagagaacaagaggaagagaggcaugagcagaagcacgaacaggagcggcgugaacagcgccuaaaacgagagcaagaagagagaagggauuggcucaagcgggaggaagagacugaacgccaugagcaggagagaaggaaacagcagcugaagcgggaccaagaagaggaacgaagagagcgcuggcuuaaguuggaagaggaggaaaggcgggagcagcaggaacguagagagcaacagcugaggcgcgaacaggaggagcggcgagaacagagacucaaaaggcaagaggaagaggaacgccugcagcagcggcuuagaucugagcagcaacugcguagggagcaggaagaacggcgcgaacaguugcucaagcgagaggaggagaaaagacuggagcaggaaaggcgggagcaacgcuuaaagagagaacaggaggagaggcgagaucagcugcuaaaacgggaagaggaacguagacagcaacgccucaagagggagcaggaagaacggcuggagcagagacuuaagcgcgaagagguggaaagguuggagcaagaggaacgacgggagcagagacugaaaagggaggaacccgaagaggagcgccgucagcagcuccugaagucggaggaacaagaggaacggagacagcagcaguuaaggcgcgaacaacaggagcgacgggagcagagacugaaaagggaagaggaagaggaacgccuugagcagagauugaagcgggagcacgaagaggaaaggcgugagcaagaacucgcagaggaggaacaggagcaggcccgagaacgcaucaaaucaaggauuccuaaguggcaauggcagcuggagagcgaggcugacgcccggcagaguaagguuuauuccaggccacgcaaacaggaaggacaaagacggaggcaggagcaggaagagaagcgacguagacgcgaaucugagcuacaguggcaagaggaggaacgggcgcacaggcagcagcaggaagaggaacaaagacgcgauuuuaccuggcaguggcaggcagaggagaaaagcgaacggggcaggcaacgacuguccgccagacccccucuccgggagcagagggaacgccagcugcgugcugaggaaagacagcaacgagagcagagguuccuuccagaggaagaggaaaaggagcagcggcgcagacagaggcgggagcgcgaaaaagaguugcaauuucuggaagaggaggaacaguuacagagacgagagagggcccagcaacuccaggaagaggaagacggccugcaggaggaucaggaacggcgucgcucacaagagcagagaagggaccagaaguggcgguggcaacuugaggaagagagaaagcgccgaaggcauacacuguacgcaaaaccggcuuugcaggaacagcuccggaaggagcagcaacugcuacaggaagaggaggaggaacugcagagagaggaacgugagaaacgcaggcggcaggaacaagagagacaguaucgagaagaggaacagcuccagcaagaggaggaacagcugcuuagggaggaacgcgagaagcggagaaggcaggaacgcgagcgucaauaccggaaagauaagaaauugcagcagaaggaggaacagcuguuaggggaggaacccgagaagagacgaaggcaagaacgcgagaaaaaguaucgggaggaagaggaacuccagcaggaggaggaacagcugcuuagagaggaaagggagaaacgcagacggcaagaaugggagcgacaguacaggaagaaagacgagcugcagcaggaagaggaacaacuacuccgugaggaaagagagaagcggcgccugcaggagagggaacgacaguacagagaggaagaggaauugcagcaagaggaggaacagcuguuaggagaggaacgggagacccgcaggagacaggagcucgaacggcaauaucguaaggaggaggaacugcagcaggaagaggagcagcuucugcgcgaggaaccugagaaaagacgaagacaagagcgggaaaggcagugucgcgaggaggaagaguugcagcaggaagaggaacaacuccugagagaggagcgggaaaagaggcgccgacaggagcuagaaagacaguaccgugaggaggaagaggugcagcaagaagaggaacagcugcuucgggaggagccagagaaaaggcgcagacaggagcucgaacggcaauauagggaggaagaggagcugcagcaggaagaggaacaguugcugcgagaggaacaagagaagagacgccaggagcgggaaaggcaguaccgugaggaagaggaguuacagagacaaaaacgcaagcagagguaucgggacgaagaucagcgaagugaccucaaguggcagugggagcccgaaaaagagaacgccgucagagauaauaagguguacugcaaaggucgcgaaaacgagcaauucaggcagcuggaggacagccagcuucgggauagacaaucucagcaggaccugcagcacuugcucggcgaacaacaggagcgugaucgcgaacaggagaggcggcgauggcagcaaagagacaggcauuuuccugaagaggagcagcuggaacgcgaggaacagaaggaggcgaaacggagagaucgaaagucccaggaagagaagcaacuacugagggaggaacgggaggaaaaacgcagacgucaggagacugacaggaaguuccgggaggaggaacagcuucuccaggaaagagaggaacaaccacugcgcaggcaggagcgagaucggaaauucagagaggaagaguugcgccaccaggaacaagggaggaaguuuuuagaggaggaacagcgucugagacggcaggagcgcgaaaggaaauuccucaaggaggaacagcaacugcgaugucaggagagagaacagcagcuucggcaagaccgcgauaggaaauuuagagaggaggaacagcagcugucacggcaggagcgugaccgaaaguucagggaagaggagcaacagguacgcagacaggaacgggagaggaaguuuuuggaagaggaacaacagcuacgccaggagagacaccggaaauuccgagaggaggaacagcugcuccaagaaagggaggaacagcagcugcauagacaggagcgcgaccguaaguuucuugaggaggaacaacaguuacggaggcaggaaagagaucgcaaauuccgggagcaggaacugcgaagccaagagcccgagaggaaguuucucgaagaggaacagcaguugcacagacagcaacgccagcggaaauuccugcaggaggagcaacagcucaggcgucaggaaagaggacagcaacgacgccaggaccgggauaggaaguuuagagaggaggaacagcugcggcaggaacgcgaggagcaacagcuuaguaggcaggaaagagaccgaaaguuccgucuggaggaacagaaaguucggaggcaagagcaggaacgcaaguuuauggaggaugagcagcaauugagaaggcaggaaggccagcagcaacuacggcaggagagagaccgcaaauuccgagaagaugagcagcugcuccaggaaagggaggagcaacaguuacaucggcaggaaagagaccgcaaguuccuggaggaggaaccgcagcuucguaggcaagagcgggaacagcagcugagacacgaucgagaccgcaaauuuagggaggaggaacagcucuugcaagaaggugaggagcagcagcugcggagacaagaacgcgauaggaaguuccgugaggaggaacagcagcucagacggcaggaacgagagcgcaaguuucugcaagaggaacagcagcuuaggagacaggagcuagaacggaaauucagggaggaggaacaacugcgccaggagacagaacaggagcaguugagacggcaagaacgauaucguaagaucuuagaggaggaacagcugaggccugagcgcgaggaacagcaacucagacggcaggaaagggacagaaaauuucgagaggaggaacagcugcgccaggagcgggaagaacaacagcuuaggucucaggaauccgauagaaaguuccgcgaggaggaacagcugcggcaagagcgugaggaacagcagcucaggccccagcaaagagacgggaaauaccgaugggaggaggaacaguugcagcuggaggagcaagaacagcggcuacgccaggagagggacagacaguaccgggccgaggaacaauuugcaacccaggaaaagagccgcagggaggaacaggaacuguggcaggaggaggaacaaaagcgaagacaggagcgugaacggaaacuccgcgaggaacauauaaggagacagcagaaggaggagcaacggcaccgacaggugggagaaaucaaaucgcaggagggcaagggccacgggaggcuucuggaaccaggaacgcaucaguucgcuucugucccugugcgcuccucacccuuauaugaguacauucaagagcagagaagucaguaucggccauga

SEQ ID NO: 63632 - RNA, 1497 nt, Artificial Sequence
  derived and/or modified sequence opt3 from TCHP__Homo_sapiens__XP_011537139
auggcccugcccacccucccuagcuacuggugcucccagcaaagacuuaaccagcagcuggcuaggcagcgggagcaagaagcacgcuugcgacagcagugggagcagaauagccguuauuucagaaugucagacaucuguaguagcaagcaagccgaaugguccucuaaaacaucguaccagaggucaaugcacgcguaucagcgggagaagaugaaagaagagaagcgcagaucuuuagaggcuaggcgggaaaaacugcgccagcuaaugcaagaggaacaggaucuccuggcccgagagcuugaggaacugagauugaguaugaaccuccaggagaggcggauucgugaacaacauggcaagcugaaguccgcaaaagaggaacagcgcaagcugauagccgagcagcucuuauacgagcacuggaaaaagaauaacccaaaacugagagaaauggagcuugacuugcaucagaagcacguggucaauucuugggaaaugcaaaaggaggagaaaaagcagcaggaagcuacugcagagcaggaaaacaaaagguaugagaaugaauacgagcgggcccgacgcgaagcucuggagagaaugaaggccgaggaagagaggcggcaacuagaagauaaacuccaggcggaggcacugcuucagcagauggaggaacugaaguugaaagagguugaagccacgaagcucaagaaagagcaagaaaaccuguuaaagcagcgcugggagcuggagagacucgaagaggaaaggaaacagauggaggcuuuucgucagaaggccgaacuugggcgguuccugcgacaucaauauaaugcacaguugagcagaaggacccagcaaauccaggaggagcuagaagcugaccgccggauucugcaggcccuccuggagaaagaagaugagucccagagacuucaccuggcgaggcgcgaacaagugauggccgacguagcauggaugaagcaggcuaucgaggagcaguugcagcucgaacgagcccgggaggcugaacugcaaauguuacugcgugaggaggccaaggaaaugugggagaaaagagaagcagagugggccagggaacgcucagcucgggauagacuaaugagugaggugcucacaggaaggcagcagcagauucaagagaagaucgaacagaaccgacgcgcgcaggaggaaagccugaaacaccgggagcaacuuauaagaaauuuggaagaggucagggagcuggcacgucgcgaaaaggaggaaucugagaaacucaaguccgcccggaagcaggaacuggaggcucagguggccgagagaaggcuucaggcaugggaagccgaccaacaggaggaagaggaggaagaggaagcucgacggguugagcagcugucagaugccuugcuccagcaagaagcagagacuauggcggagcaggguuaccgcccgaaacccuacggccauccuaagaucgcuuggaacuga

SEQ ID NO: 63633 - RNA, 1845 nt, Artificial Sequence
  derived and/or modified sequence opt3 from TCIRG1__Homo_sapiens__NP_006044
augaccuuccugaucagcuacuggggcgagcagauugggcaaaagauaagaaaaaucacagacugcuuucacugucauguguuccccuuucuccagcaggaagaggccaggcuuggagcucugcagcaauugcagcagcagucccaagaauuacaggagguccugggugaaacugagcgguuccuaucucagguucucggccgcgugcugcagcuucugccuccagggcaaguacaggugcacaagaugaaagcagucuauuuggcccucaaccagugcucagugaguacgacccauaagugucugauugcggaggcuuggugcagcguucgagaucugccggcccuccaagaagcauuacgugacuccucuauggaggaaggagugucggccgucgcucacagaauccccuguagggauaugccuccaacacugauucggacuaaucgcuuuaccgcaucauuccagggcaucguggacgccuacgguguagggagauaucaggagguuaaccccgcuccuuacacaauaaucaccuuuccauuccuuuuugccgugauguucggagaugucggccauggcuugcugauguuucuauucgcgcucgcaauggugcuggccgagaauaggcccgcugugaaagccgcacagaacgaaauuuggcaaacauuuuuccgggggcgcuaucuucuguugcucaugggacuguucagcaucuacacugguuuuauuuauaaugagugcuucagucgagcuaccuccaucuuuccuucuggcuggagcgucgccgcgauggccaaccaguccggguggucagacgcauucuuagcucagcacacgaugcugacucucgauccaaauguuaccggaguguuucuuggcccguaccccuucgguauagacccuauuuggagucuggccgcuaaccacuugagcuuucuaaauucuuucaagaugaagauguccguaauccugggggugguccauauggccuuuggagugguucucggcguguucaaccacguccauuuuggccagagacacaggcugcuucuggaaacauugccagagcucacuuuccuguuagggcuguuuggauaccuaguguuccucguaauuuauaaauggcuguguguuugggcagcccgggcugcgucagcacccagcauccuuauccacuucauuaauauguuuuuguucagucauucuccuuccaaccgucugcucuacccacgccaagaagugguccaggccacccuggugguccuugcucuggccauggugcccauauugcuccuggguacaccguuacaucugcuacacagacacaggcggcgacuccgcagaaggccugcagaucggcaggaggagaauaaggccggccugcuugacuugcccgaugcuagcguuaacggguggucgucugacgaagagaaagccggaggccuggaugacgaagaggaagcagagcucgugccauccgagguacugaugcaucaggcgauccacaccauugaauuuugcuuagguugugucucaaauacggcuaguuaucugcgccuuugggccuugagccucgcacacgcccaacuguccgaggugcuaugggcuaugguuaugagaaucgggcugggccucggaagggaagugggcgucgccgcagugguacuggugccuauauucgcugccuuugcgguuaugacugucgccauucuuuuggugauggaggggcugucugcuuucuuacaugcacuccgucugcacuggguggaauuucagaacaaguucuacagcggaacagguuauaaacuuucacccuuuaccuucgccgcuacugacgauuga

SEQ ID NO: 63634 - RNA, 345 nt, Artificial Sequence
  derived and/or modified sequence opt3 from TCL1A__Homo_sapiens__NP_001092195
auggccgagugccccacccugggcgaagcugugacagaccacccugauagacucugggcaugggagaaguucgucuaccuugacgaaaaacagcaugccuggcugccauugacuaucgagauuaaggauagguuacaacugcggguucuacuccgccgagaagacgugguacuggggcguccgaugacgcccacccagauaggaccuagccuucugccaaucauguggcaguuguaucccgaugguagauacagguccucugacucaaguuuuuggcggcucguguaucacauuaaaaucgauggcgucgaggacaugcugcuggagcucuuaccugaugacuga

SEQ ID NO: 63635 - RNA, 387 nt, Artificial Sequence
  derived and/or modified sequence opt3 from TCL1B__Homo_sapiens__NP_004909
auggccagcgaggcuuccgugagacugggcguucccccugggaggcucuggauccagcggccaggaauuuacgaagacgaggaaggucgcaccugggucacagugguagugcgauucaacccgucucguagagagugggcaagggccucacaaggcagucgguaugaacccagcauaacuguccaccuuuggcagauggcggugcauacgcgcgagcuguuguccucugggcagaugccuuuuucgcaguuaccagcuguuuggcaacuguaccccggaagaaaguauagggccgcagauagcucauucugggagaucgccgaccacggccagauugauaguauggaacagcuagugcucaccuaccagccugagcggaaagacuga

SEQ ID NO: 63636 - RNA, 1302 nt, Artificial Sequence
  derived and/or modified sequence opt3 from TCN1__Homo_sapiens__NP_001053
augagacagagccaccaacugccccucgugggccuucuguuguucuccuuuaucccuucucaguuaugcgagauuugugaagucucagaggaaaacuacauaaggcugaagccacuacucaauaccaugauccagaguaacuauaaucgggggacaagcgccguuaacgugguacugucccuuaaacugguggguauucagauccaaacuuugaugcagaagaugauucagcagaucaaauacaaugucaagucucgccucucggacgugucaagcggagagcuggcucugauaauccucgcauuaggcguuugccgaaacgccgaagagaaucugauuuaugauuaccaucuuaucgacaaauuggagaacaaguuccaagcggaaauugagaauauggaagcucacaacgggacgccgcugaccaauuauuaccagcuaagucucgaugugcuggcccuuugucuguuuaacggaaauuauuccacagcagaggucgugaaccauuucacucccgagaauaagaacuacuacuuuggcucucaguucagcguagacaccggugccauggcuguuuuggcacucacaugcgugaaaaagucccugaucaacgggcagauaaaagccgaugaaggaucauuaaagaauauuaguaucuauaccaaaagccuggucgagaagauucucucugaaaagaaagagaacggccuuaucggcaauacuuuuuccacaggggaagcuaugcaagcccuguucgugucaagcgacuacuauaacgagaaugauuggaacugucagcagaccuugaauacggugcuaacugagaucagucaaggagcguuuucuaacccuaaugcagccgcucagguccugccagcccucauggguaagaccuuccuggacauuaacaaagauuccagcugcguuucggcaucuggcaauuuuaacauauccgcugacgaacccaucacagugacuccuccagauucacagaguuacauuagcguaaauuauuccgugcguaucaacgagaccuacuucacaaaugucaccgugcuuaacgggucuguuuuucugagcgugauggaaaaggcccagaaaaugaacgacacgauauucggauucacuauggaggaaagaucauggggccccuauauuacauguauccaagguuugugcgcgaauaacaaugauaggaccuacugggagcuccugagugggggagagccuuuaucccagggcgccggcagcuacgucgugcggaacggggaaaaucuggagguacgcuggucuaaguauuga

SEQ ID NO: 63637 - RNA, 1284 nt, Artificial Sequence
  derived and/or modified sequence opt3 from TCN2__Homo_sapiens__NP_000346
augagacaccugggcgccuuccucuuucuucuggggguguugggagcuuuaaccgagaugugcgaaauccccgagauggacagccaucuggucgaaaagcuaggucagcaccuccugccuuggauggauaggcuuucccuggagcauuugaacccaucuauuuacguuggccuccggcugucaagucugcaagcagggacaaaagaagaccucuauuuacacagccugaagcugggauaccagcaguguuugcugggcuccgccuucucugaggaugacggugauugccaggggaaaccgucgaugggacaacuagcgcucuaucugcuugcucugcgcgccaauugugaguuugugcgaggccauaagggcgaccguuugguaucacagcucaaaugguuccuggaagaugagaagagagcaauagggcacgaccacaagggacauccccacacuagcuacuaucaguacgguuuaggcauccuggcccucugccuucaucagaaaagggugcacgauagugucguggacaagcuguuguaugcuguugaaccuuuucaccaagggcaucacuccguggauacggcagccauggcuggacuagccuucaccugucugaaacggucuaacuuuaauccaggccgcagacagaggauuacaauggcgauccggacuguccgcgaggagauucucaaggcacagacccccgaaggucauuucgggaacguguacagcacaccucuggcccuucaguuucugaugaccuccccaaugcgaggagcugaguugggcacugccugccucaaagcaagaguagcucuguuagccucacugcaagacggcgcguuccagaaugcccuaaugaucagucagcuccugcccguucuuaaccacaagacauacauagauuugaucuuuccugacugucuggcaccaagggugaugcucgaaccggcugccgagaccauuccccaaacgcaggaaaucauuagcgucacucuucaggugcuuucucuguugccuccauaucggcaguccaucucagugcucgcugggagcaccgucgaggacguucugaagaaagcccaugaguuaggagguuucacauacgaaacucaagcaagucugucuggccccuaucuaaccuccgugauggggaaggccgcuggagagcgugaauuuuggcagcuccugcgcgauccuaauacaccacuuuugcagggcauagcggacuacagacccaaagauggugagaccauugaacugaggcucguaagcugguga

SEQ ID NO: 63638 - RNA, 4236 nt, Artificial Sequence
  derived and/or modified sequence opt3 from TCOF1__Homo_sapiens__NP_000347
auggccgaggcuagaaagaggcgggaacugcucccccuuaucuaccaccaucuguugcgcgcaggcuaugugcgagccgcgcgugaggucaaagaacagagcgggcaaaagugcuucuuagcucagccuguuacccugcuagacauuuacacacacuggcagcagacuuccgagcucggaagaaaaaggaaggccgaagaggaugcagcccugcaagcuaaaaagacgcgggugucugacccaauaucaaccagugagagcuccgaagaggaagaggaggcagaagccgagacagcuaaggccacuccgcgccuugcgucuaccaacucgucaguacugggugcagauuugcccagcaguaugaaagaaaaggccaaagcugagacagaaaaggccggcaaaaccgggaauagcaugccucauccagcaacuggaaagacaguggcuaaccuccugucuggcaagagccccagaaaauccgccgagccuucagcgaauaccacgcuggucagugagacugaagaggaagguagcgugccagccuuuggggcagcugccaagcccggaaugguuucugcuggccaggccgacuccucaagcgaggauaccaguucuuccagcgacgaaacagauguggaggucaaagcaucggagaagauccuccaggugagggccgcuucugcgccugcaaaaggcacuccagggaagggagccaccccggcucccccugguaaagccggcgcaguagccucccagacaaaggcugggaagccagaagaggacucagaaaguagcuccgaggaaucuagcgauucagaggaggaaacccccgccgcaaaagcguuacugcaagcuaaggccaguggaaaaacgucccagguuggcgcagccagcgcuccugccaaggagucuccacggaaaggugcagcucccgccccgccugggaagacuggacccgcgguggccaaggcucaggcaggcaaacgcgaagaggacucacagaguagcuccgaggaaucugauucggaggaagaggccccagcucaagccaagccuagcggcaaagcaccccagguccgagcggccuccgcuccagccaaggaaucacccagaaaaggggcagcuccugccccaccgaggaagacaggacccgcagccgcucaggugcaaguggguaagcaggaggaggacagucggucuagcuccgaagagucagauagcgaccgugaagcgcuugccgcaaugaacgcugcccaggucaaaccuuugggcaagucuccacagguuaaacccgccuccaccauggggaugggaccucugggcaagggugcugggccagugcccccgggcaaaguaggaccugcaacuccaagugcccaagugggcaagugggaggaagacagcgagucuuccucagaggaaaguagcgauucguccgacggggagguccccacagcgguggcuccugcccaggaaaagucucuaggaaauauucuccaggcaaaacccaccagcucaccagccaaggguccuccccagaaagcuggcccaguugcagugcaagucaaggccgagaaaccgauggauaacagugaauccucugaggagagcuccgacucagcggauagcgaagaggcuccugccgcaaugacggccgcucaggccaagcccgcacugaaaaucccacagaccaaggcuugucccaagaaaacaaauacuaccgccagugcgaagguggccccuguacgcguugggacacaggcaccaagaaaagcuggaacugccaccucucccgcuggcuccagcccugcaguggccggugggacacaaaggccggccgaagacucgucaucuagugaggaguccgauagcgaagaggaaaagaccggccuugcugucacugugggacaggcgaaaucugucggcaaggggcuucaggugaaggcagccagcguuccagugaaaggauccuugggucagggcacggcucccguacucccugggaagacaggaccaaccgucacucaagugaaagccgagaagcaggaagacucagagaguagcgaggaagagucugauuccgaagaggcagccgcuucacccgcgcagguuaaaaccagugugaagaagacacaagccaaagcaaacccugcugccgcacgggccccgagcgcuaagggcaccauuuccgcccccgguaaagucgugacugcggcagcccaggcuaagcagcgaucuccaucgaaaguaaagccucccgugcgcaauccacagaacagcacaguucuggccagagggccugcuucaguccccuccgugggcaaggcaguggccacggcugcccaagcacagaccggaccagaagaggacaguggcucuagcgaggaagaguccgauucagaagaggaagcggagacuuuagcccaggucaaaccgucugggaagacacaccagaucagggcugcccuggcacccgcuaaagagagcccccggaagggagccgcaccaaccccuccuggcaaaacagguccaagugccgcucaagcggggaagcaggacgacuccggauccucuucagaagaguccgauagugacggcgaagcccccgcagcuguuacuagcgcccaggugauaaaaccuccgcucaucuucguggauccaaaucgcucgcccgccgguccugcagcuacccccgcccaggcgcaagcugccucuacgccaagaaaggcaagggccuccgagagcaccgcucguucaaguucuuccgagagcgaagacgaggauguaauuccugcaacacagugccuuacucccggcauccggaccaacgucgugacaaugccaacugcccauccucgaauugcgccgaaggcuucaauggccggggcaaguagcuccaaagaaucuagcagaaucuccgacggaaagaaacaggagggccccgccacccaaguuucaaagaaaaauccagcuucucugccuuugacgcaggccgcacuaaaggugcuggcucagaaggccagugaagcgcagcccccagucgccaggacacaaccuucgagcgggguggauuccgcaguuggaacccuccccgcuacuucuccgcagucaacaagcgugcaggccaaaggcaccaacaagcugcgcaaaccaaagcugccugagguacagcaagcaacuaaagcucccgaguccagugacgauucugaagacagcucagauuccaguagcgguucugaggaagacggggagggaccacagggcgccaaguccgcccacacccugggucccacaccuucacggacggaaaccuuggucgaggagacugcggcugaaagcucggaggaugacgugguggcaccgucucagagucuccuguccggcuauaugacacccggguuaaccccagccaauagccaggcuucaaaggccacaccuaaacuggacuccucucccagcgucaguuccacucuagcagccaaggaugacccugauggaaaacaagaagcuaagccacagcaggcggccggcaugcucagccccaaaaccgggggaaaggaggcagcuucuggcacgacaccucagaagucaagaaaaccaaagaaaggugccgggaacccccaagcaaguacccuggcccuucaguccaacauaacucaguguuugcugggacaaccguggccucucaaugaagcucagguucaggccagcgugguaaaggugcugaccgagcuucuggagcaggaaaggaaaaaggucguggacacaacuaaggagucuucgcgcaaaggcugggaaucacgaaagcggaaauugagcggugaucaaccagcggcacguacccccagauccaagaaaaagaaaaagcucggcgccggggagggaggcgaggcuaguguuucuccugaaaagacaagcacgaccuccaaagggaaggccaaaagggacaaggcaucaggagaugugaaagagaagaagggcaaagguagucuggggucucagggagcuaaggacgaaccagaggaagaguuacagaaaggcaugggcacugucgaagggggagaucagagcaaccccaaguccaaaaaggagaagaaaaagucagacaaacgcaagaaagauaaggagaagaaagaaaagaaaaagaaagccaagaaagcuagcacaaaggacucugaguccccgagucaaaagaaaaagaaaaagaaaaagaagaccgccgaacagacuguguga

SEQ ID NO: 63639 - RNA, 981 nt, Artificial Sequence
  derived and/or modified sequence opt3 from TCP10__Homo_sapiens__NP_004601
auggagaagacccccgccgcugcagaagugccuagagaggacagcaacgccggcgaaaugccaucccugcagcaacagaucacaucucuccaccaggagcuugggaggcagcaaucacugugggcggauauucaucggaaauugcagagucacauggacgcuuuacgcaagcagaaccgagaacugcgugaggagcuaagaggacuccagaggcaacagugggaagccgguaaaaagccggcagccagcccccaugcuggccgggagucccacacucuggcacuugaaccugccuucgggaaaauaucucaucugucggcugaugaggacacgaccccaaaguacgccggacgcaagucacagagcgcgacauugcucggccagagauggaguuccaaccaccuggcacccccuaaaccaaugucucugaagacugagaggaucaauagcgguaaaacacccccucaagaagaucgggagaaguccccaccggggcgccgacaggacagaucacccgccccuaccggaaggccaacccccggcgcugaacggcguggcgucagugaggaugggaaaauuaugcacccuagcucucgcuccccacagaacucaggagguagaaagagccccguucaagccagucaggcaacuacacuccaggaacagaccgcugccgcgaggggcgccgaccggucuuccagcguguuagggucgucugagggaggcuuucugucccgaguacaagcagaugaguucgcuucaagugccccggacagcgcugaacgccagaaucuuccugugaaucccccauccucuuuggagaucgcccaggcaauggauacgaagaugaaaaaggaagagguccaggaagagaaaagacauccuaaggguaaagccgacgauugcaggcggagcggguuucccucagaguucccaggagcucugcacgcggcacccagucgccaagacaugggcccuuga

SEQ ID NO: 63640 - RNA, 1062 nt, Artificial Sequence
  derived and/or modified sequence opt3 from TCP10L2__Homo_sapiens__NP_001138593
augcuggaaggccagcucgaagccagagagcccaaggaagggacccacccugaggacccaugcccgggagcuggugcagccauggaaaagacacccgcggcugccgaggugccuagggaggauagcaacgcaggcgaaaugccaucccuucaacagcagaucacuucucugcaucaggaguuggggcggcaacagucauuaugggccgacauucaccgcaagcugcagagucauauggaugcucuacgaaaacagaaucgugaacucagagaggagcugaggggacuucaacggcagcagugggaagcaggcaagaaacccgccgcuagcccucacgccggucgcgagucccauacgcuggcguuggaaccagcauucgggaagauaucuccccucucggccgacgaggaaaccacaccuaaguacgcuggaagaaaaucacagagcgccacucugcugggccaaagguggaguuccaaccaccucgcaccaccgaagcccaugucuuuaaaaaccgagcggaucaauagcggcaagacaccuccacaggaggaucgcgaaaaaucacccccugggcgaagacaggacagguccccagcucccaccggacggccgacuccuggugccgagcgucgcgaagucagugaggauggcaagauuaugcaccccagcucuagaucccugcaaaacucagggggaaggaaaagcccaguucaggcgagucaggccgcaacacuucaggaacaaaccgcugccgcuggcguggccgaccggucuuccagcguauuggguucgucugaagggggauuucugucccgagugcaggcagaggaguucgccucaaguagcccugauuccgcugagcgccagaaucuacccgucaacccacccucuagccucgaaaucgcgcaggcaauggacacgaaaaugaagaaagaggaagugcaagaggagaagagacauccuaauggcaaagccgaugacuguaggcggucaggcuuuccaagugaguucccgggggcucugcacgccgcacccucccgccaggauaugggaccuuga

SEQ ID NO: 63641 - RNA, 1530 nt, Artificial Sequence
  derived and/or modified sequence opt3 from TCP11L1__Homo_sapiens__NP_060863
augagcgagaaccuggacaaguccaaugugaacgaagccggcaaaucuaagucaaaugauagugaggaagggcucgaggacgcugucgaaggagcagaugaggcccuucagaaagcgaucaagagcgacuccucuucgccccaaagaguucagaggccucacucaagcccaccgcgguucgugaccguagaggaacuguuggagacagcucgcggugugacuaacauggccuuagcacaugaaauugucgugaauggcgauuuucagauaaaacccguugagcugccugagaacagucuaaagaagcgagugaaagaaaucguccacaaggccuucugggacugccucuccgugcagcugucugaggauccacccgcuuacgaccaugcaauuaaacuuguaggggaaaucaaggagacgcuguugagcuuucuccugccuggacacacccgucugagaaaucaaauuacagaaguucucgauuuagaccugaucaaacaggaggccgagaacggcgcucuugauauauccaaguuggccgaauuuaucauugguaugauggggacucugugugcgccagcaagggacgaggaagugaagaaacuaaaggauaucaaagagauugucccccucuuucgggaaaucuucucagugcuggaccuuaugaagguggacauggccaauuuugcuauaaguagcauucgcccucaucugaugcagcagucugucgaguaugagaggaaaaaguuccaagaaaucuuggagagacagccaaacucccucgauuuuguuacccaguggcuggaagaggccucagaagacuuaaugacacagaaauacaagcacgcacugccggugggaggcauggcugccggcagcggggauaugccccggcucaguccuguagcggugcaaaauuaugccuaccuuaagcuguugaaaugggaccaccuacagcgcccauuccccgagaccguccugauggaucagucucgauuucaugagcuccaacugcagcuugaacagcugacuauuuugggagcagugcuccugguuacauucuccauggcugccccugguaucagcucgcaggcugacuuugccgagaaguuaaaaaugaucgugaagauucugcuaaccgauaugcaccucccaucuuuccaucugaaagacguccuuacgacuauaggcgaaaaggugugcuuggagguauccucaugucugagucucugcgggagcucccccuucaccacagauaaggagacuguucugaaaggacaaauccaggcaguggccucuccggacgauccuauuagaaggaucauggaaagccggauacuuaccuuucuggagacauauuuggcuucaggccaccagaagccccucccaaccgucccuggugggcugagucccgugcagcgugaauuagaggaagucgcgauuaaauucgcacgccuggugaacuacaauaagaugguuuucuguccauauuacgacgccauccuauccaaaauccucgugagaagcuga

SEQ ID NO: 63642 - RNA, 1206 nt, Artificial Sequence
  derived and/or modified sequence opt3 from TCP1__Homo_sapiens__NP_001008897
augagcuccaagaucauuggcauaaacggggacuucuuugccaauaugguggucgaugcuguucuggcaaucaaauacaccgacauuagaggacagcccagguauccugugaacucuguaaauauccucaaggcccacggucggucacaaauggagaguaugcuuauuagcggcuacgcgcugaacugcguggucgggucccagggaaugccaaaacgcaucgugaaugcuaagauagccuguuuggauuucucuuuacagaaaacaaagaugaagcugggcguucagguggucaucacugacccggaaaaacuagaucaaauucgacagcgugagucggacaucacgaaggaaaggauucagaaaauccucgcaaccggugccaacgugauacugacaacugggggaauugaugacaugugccuuaaguauuuuguagaggcuggcgcaauggccguuagacgggugcugaaacgcgauuugaagagaaucgcuaaggccucaggcgcgaccauucucagcacacuggcaaaucuggaaggggaggagaccuucgaagccgcuaugcucggacaggccgaggaagucgugcaagagaggaucugugacgaugaguuaauccugauuaaaaacacuaaggcacggacaagugcuuccauaauccuucgcggugccaaugacuuuaugugcgaugaaauggagcgaucuuugcaugacgcgcuguguguggucaaaagaguucuagaaagcaaguccgugguacccggcgggggagccguggaggcagcucucucaauuuaccuggaaaacuaugccaccaguaugggcagcagggagcagcuugcuaucgccgaguucgcacggucucuguuggucauaccuaauacgcucgccgugaacgcugcgcaggacuccacugaucugguugcaaaauuacgugccuuucacaaugaagcucaggugaacccagagcgcaagaaucugaaauggauuggucucgaccuuucaaacgggaagcccagagauaacaagcaagccggagucuucgaaccuaccaucgugaaaguaaagagccugaaauuugcaacagaggccgcuaucacuauuuugaggaucgacgaucuaauuaagcugcauccagaaaguaaagacgauaagcacggcucuuacgaggacgccguucauuccggcgcacucaaugauuga

SEQ ID NO: 63643 - RNA, 312 nt, Artificial Sequence
  derived and/or modified sequence opt3 from TCTA__Homo_sapiens__NP_071503
auggccgagagcugguccggccaggcucugcaagcacuccccgccaccgugcuuggggcgcugggaucugaguucuugagagaaugggaagcucaggacaugagggucacauuauuuaagcugcuacuccuguggcuuguucugucauugcucgguauccagcuggccuggggcuucuacgggaacacugugacgggacuguaucaccggccuggccucggugggcagaauggaaguaccccagauggcagcacacauuuuccguccugggagauggcagccaacgaacccuuaaaaacucaccgcgaguga

SEQ ID NO: 63644 - RNA, 1506 nt, Artificial Sequence
  derived and/or modified sequence opt3 from TCTE1__Homo_sapiens__XP_011512640
augcaggacaccgugacaacuagcgcccugcucgaucccucccacucuucagucaguacgcaagacaacagcuccaccggcgggcauacaucuucgacuucaccucagcuuagcaagccaaguaucaccccgguucccgcuaaauccagaaauccucacccaagggcaaacauucggcgcaugcgacguauaaucgccgaggaucccgaauggucucuggcgauugugccuuuguuaacagagcugugcauccagcauauuaucagaaauuuccagaagaacccaauacuaaaacaaaugcuccccgaacaccagcagaagguacugaaucaucuuagcccugaccugccauuggcugugaccgccaaccucaucgauuccgagaauuacuggcugagguguugcaugcaccgguggccggucugucacguggcacaucacggagguucauggaaacgcauguuuuucgaaagacaucuggagaaccucuuaaagcacuuuauucccggcacuacagacccugccguuauccuggaucuuuugccacugugcaggaauuaugugcggcgcguccacguggaccaguuccuacccccuguacaacucccagcucagcugcgacccggggaucagagugacagcggaucugagggcgaaauggaggaaccgaccguugaucauuaccagcuuggugaccugguggcaggguugucccaccucgaggagcuggauuuagucuaugacgugaaggacuguggaaugaacuuugaauggaaucuguuccucuuuacguacagagauugccuuucacuggccgcugccauuaaagcgugucauacuuugaagaucuucaaacuaaccaggagcaagguggacgaugacaaagcacggauaauuauccguagucugcucgaucacccuguccuggaggaacuugaccugucucaaaacuugauuggcgaucgcggcgccagaggggcugccaagcuccugucccauagcagguuacggguucugaaucuagcaaacaaucaggugcgagcucccggagcccagucgcucgcgcacgcccuggcacacaacacaaaccuuaucucuuugaaucugcgccucaacugcaucgaggacgaagguggccaagcucuggcccaugcccuucagacuaauaagugucugaccacauugcaccucgggggaaacgagcuguccgagccaaccgcuacguuacugucacagguacuagcaauuaauacuacacucaccaguauaaaccugagcugcaaucauaucggccuugauggugggaaacaguugcuggaaggaauguccgacaacaagacucuccuggaguuugauuuaagacugucugacguggcccaagaaagcgaguaucuuauuggccaggcuuuguacgcgaauagggaagcagcccggcagcgcgcucucaacccuucacacuucaugaguacaaucaccgccaauggccccgagaacuccgucggguga

SEQ ID NO: 63645 - RNA, 1764 nt, Artificial Sequence
  derived and/or modified sequence opt3 from TCTN1__Homo_sapiens__NP_001076006
augagacccaggggccugccuccacuccuugugguccuguuggggugcugggccagcguuuccgcucagaccgacgcaacaccggccgugacuacggagggauuaaacucuaccgaagcggcucuggccacauucgguacuuuucccucaacccggccuccaggcacaccccgcgcaccugggccaaguagcggaccccgaccuaccccaguaacugauguggccguccuaugugugugcgaccucuccccggcucaaugugauaucaauugcuguugcgaccccgauuguucuucgguugacuucucaguguuuagcgcaugcagugucccugugguaacaggcgauucccaguucuguucucagaaggccguuauuuacagccugaacuuuaccgcuaauccaccccagcguguguucgagcuugucgaccaaauaaacccuuccaucuuuugcauucacaucacgaauuauaaaccagcccugucauucauuaaccccgaagugccggaugagaauaacuuugacacuuugaugaagaccagugaugguuucacacucaaugcggaaagcuacgugucuuuuacuaccaaacuggacaucccuacagcagccaaguaugaguacggggucccccugcagaccuccgauucauuccucagauuuccaagcaguuuaacgucuucccuguguacugacaacaauccugcugccuuccuuguuaaccaggcagugaaaugcacaaggaagauaaauuuggagcagugcgaagagaucgaagcucugagcauggccuucuauucgucucccgagauucuacggguaccagacucccgcaagaaagugcccaucaccguccaaucaauugugauccagagucucaacaagacucugacaagaagggaggauaccgacguucuucagccuacgcuggugaaugcgggacauuuuagcuugugugucaacgugguacucgaaguuaaauacucccugaccuauacagaugccggcgaggugacuaaggcagacuuaucuuucguccugggcaccgugagcucagucgugguuccacuccagcaaaaauuugaaauacacuuccuucaggagaacacacagccggugccccugagugggaauccuggauacguagucgguuugccacuagcugccggcuuucaaccccauaagggguccggaauuauccagacuaccaaccgguacggccagcugacaauucuccacagcaccacugaacaggauugccuggcucuugagggugugcgcacgccuguucuguucggguauacaaugcaaucuggauguaaguugcgacucaccggcgcccugccaugccaguuaguggcacagaaagucaagucacugcuauggggccagggguuucccgacuacguggccccguucggaaauagucaagcucaggauaugcucgacuggguaccuauccauuuuaucacucagagcuucaacagaaaagauuccugucagcugccaggugcgcuugugauugagguuaaguggaccaaauauggcucuuugcugaauccccaagcaaagauagucaacgugacagccaaucucaucucgagcuccuuuccugaagcuaacucagggaaugagaggaccauucugaucaguacugccgugacauucgucgacguuucugcacccgccgaagcuggauuucgggccccuccagcaauaaacgcgcgucuucccuucaauuucuuuuucccauuuguguga

SEQ ID NO: 63646 - RNA, 2091 nt, Artificial Sequence
  derived and/or modified sequence opt3 from TCTN2__Homo_sapiens__NP_001137322
augggcuuccagcccccugccgcucugcuccuuagacuguuuuuguuacaagggauccugaggcuacucuggggagaccuggcauucauuccaccguuuauacggaugagcggucccgccguguccgcgucucuugucggcgauaccgaggggguuacagugucacuggcuguauugcaggacgaagccggaauccucccuauuccaacuugcggcgugcugaacaaugagacggaagauuggagugucaccgugauccccggugcaguucuggaggugacaguccgcuggaagcgagggcucgacugguguagcuccaacgaaacugauucuuucucggagucaccuugcauuuuacagacccugcuugugagcgccagucacaauuccucuuguagcgcucauuugcugauccagguagagauauacgcaaacuccucacuaacacacaaugccagugaaaacguuaccgugaucccaaaucaagucuaucagccccucggaccuugcccauguaaccugacugcuggcgccugcgacgugcguuguugcugugaucaggagugcagcucuaaucuuacaacccuguuuagaagguccuguuucacgggcguguuugggggagacgucaacccgcccuucgaucaguugugcucagcggguacuaccacacggggcguuccugacugguuuccauuccucugcgugcaaagcccccuggcaaauacuccauuuuuaggguacuucuaucauggagccguaaguccuaaacaggauucuuccuuugaaguguacgucgacaccgaugcuaaggacuucgccgacuucggcuauaaacagggugaucccauuaugacagugaagaaagcauacuuuaccaucccgcagguuagccuggcugggcaauguaugcagaacgccccuguggcguuccuccacaauuuugacgucaagugcgugacgaaccuugagcuguaucaggagcgcgauggaauuaucaaugccaagauuaaaaacguagcauugggcggcauaguuacucccaaggugaucuacgaagaggcuacagaccuagauaaauucauuaccaacacugaaacaccacugaauaacgggucgaccccuagaaucgucaauguggaggaacauuacaucuuuaaguggaacaauaacacgauuucugagauaaaugucaaaaucuucagggccgagauuaacgcucaccaaaagggaaucaugacccagcgguuugugguuaaguuccucuccuauaauucagguaacgaagaggaacugaguggcaaucccggguaccagcuuggaaaaccagugcgcgcccugaacauaaaucgaaugaacaauguaacaacuuugcaccucuggcagagcgcaggcagaggucuguguaccuccgccacauuuaagcccauuuuauucggggagaacguccugucuggcugccuacucgaagugggaaucaacgagaauuguacucaacugagggagaacgcuguugaacggcuugacagcuugauccaggcgacccauguggcaaugcguggcaauucagauuaugccgaccugagugauggguggcucgagauuauccgcgucgacgcuccugauccaggagccgacccgcuggcauccagcgugaacgguaugugccuugacauucccgcccaccugucuauaagaaucuugauuucagaugcuggcgccguagaagggaucacacagcaggagauccucggaguggaaaccagguuuaguagcguuaauuggcaauaccaguguggccugacuugcgagcauaaagcagacuuacugccuauuuccgcgucuguccaguucauaaagaucccagcucagcuaccccacccucucacgcgguuucaaauuaacuauacagaguacgauuguaaucgaaacgaagugugcuggccacagcugcuuuaucccuggacccaguacuaccagggugaguugcacucgcaauguguggccaaagggcugcuccuguuacuguuccuuacuuuggcacucuuccugagcaauccguggacccgcaucugcaaggccuauuccuga

SEQ ID NO: 63647 - RNA, 1380 nt, Artificial Sequence
  derived and/or modified sequence opt3 from TCTN3__Homo_sapiens__NP_001137445
augagaacaccccagcuggcccuccuucaaguguucuuucuggucuucccugauggcguuaggccacagccgagcuccucucccucaggggcugugccuaccaguuuggaguuacagcggggaacugaugguggcacgcugcagagcccauccgaagcaaccgccacacgccccgcgguaccugggcuaccaacugugguccccacccucgugacaccuucugcuccaggaaaccgaaccguugaccuguuuccggugcuucccaucugcgucugugaucugacuccuggcgccugcgacauuaauuguugcugugaucgugacugcuacuugcuccacccaagaacaguguucucguuuugucugcccgguucaguaaggagcaguuccuggguuugcguggauaacucugucauauuccggagcaauuccccuuuuccaucacgcguguucauggacaguaacgggaucagacaauuuugugugcaugucaauaacugcuuccuggagagcaagucuaccacguguacuagguuuuucaaaaaucucgcauccucaugcaccuuagauagcgcccugaacgcugcaaguuauuacaauuuuacaguucuuaaggugccccggucuaugacugacccgcagaacauggaagccuuccagcaguccaccgcugccagcuugacaucgccucgcucuggaaaucccggcuauauuguaggcaaaccacugcuagcgcucaccgaugacaucuccuacucaaugacgcugcuucaaagucaggggaacggaagcugcuccgugaagcgacacgagguccaguucggugugaaugcaauuucuggcuguaaacugagauugaagaaggccgauugcagccaucuccagcaagaaaucuaucagacucugcacgggaggccucggcccgaguacguugcuauauuuggaaacgccgacccagcacagaaaggcgguuggacacguaucuuaaaucgccauuguucaauuagugcuaucaacugcaccuccuguugccugauucccgugagccucgagauccaaguccuuugggccuauguggggcuguugucuaacccucaggcgcacguaucaggaguuagauuccuauaccagugucagaguauacaagacagccagcagguuacugaagucucccugacaacccucgugaauuuugucgauauuacgcagaagccacaaccgcccaggggccagccuaaaauggacuggaaguggccauucgacuuuuuccccuuuaaaguggccuucucucggggcguguuuucgcagaagugcagcguguccccuauccugauucuuugucuguugcuccuggggguauuaaaccuggagaccauguga

SEQ ID NO: 63648 - RNA, 519 nt, Artificial Sequence
  derived and/or modified sequence opt3 from TDGF1__Homo_sapiens__NP_001167607
auggccaucagcaagguguucgagcugggccucgucgcugggcuuggacaccaggaauuugcaagacccuccagggguuaccuggccuuccgggacgauucuauuuggccucaagaggaaccagcgauacgcccgcgaucaagucagcguguucccccuaugggcauccagcauagcaaagaguugaacagaaccugcuguuuaaaugggggaacaugcaugcugggcuccuuuugugcuugcccacccucuuucuaugguaggaacugugaacacgacgugcggaaggagaauugcgggucgguaccucaugauacuuggcuacccaaaaaguguucacucugcaaauguuggcacggacagcugcgcugcuuuccacaagccuuccuuccuggcugugacggccuggugauggaugagcauuuggucgcaagcagaacgccagaacucccgcccagugccaggaccacaacuuuuaugcugguggggauuugccuguccauccagucuuacuauuga

SEQ ID NO: 63649 - RNA, 1233 nt, Artificial Sequence
  derived and/or modified sequence opt3 from TDG__Homo_sapiens__NP_003202
auggaggccgaaaacgcuggcagcuacucccugcagcaagcacaggccuucuauaccuuucccuuccagcagcucauggcggaggcuccuaauauggccguggucaacgaacaacagaugccagaggaaguuccggcacccgccccugcucaggagccagugcaggaggcacccaaggggagaaaaaggaagccucggacaacugaaccaaaacaacccguagagccuaagaaaccaguggaaucuaagaagucaggaaaaagugccaagagcaaagagaagcaggagaaaaucacggacaccuuuaaggucaagcgcaaaguggaucgauucaaugguguuuccgaagcugagcuucugacaaagacuuugccggacauuuuaaccuuuaaccuggauauagugaucauuggcaucaaucccgggcuaauggccgcguacaaaggacaccauuauccuggcccagguaaccacuucuggaagugccucuuuaugucugggcugucggaaguccagcuuaaucauauggacgaucacacacugcccggaaaauacggcauuggcuucaccaacaugguggagcguacuacaccugggucaaaggacuugagcaguaaagaauuuagagagggagguaggauccucguacagaagcugcaaaaguaucagccacggauagcaguuuucaauggcaaauguaucuacgagaucuuuuccaaggaaguguucggggucaaagugaagaaccuggaguuuggacuccagccccauaaaauuccggauaccgaaacguuaugcuaugugaugccuucuagcuccgcccgcugugcucaauuccccagagcccaggacaagguccacuacuacauuaagcugaaagaucuuagggaccaguugaagggcaucgagcggaauauggauguucaggaagugcaauauacuuucgaccugcagcuagcacaggaggaugcuaaaaagauggccguaaaagaggaaaaguacgacccagguuaugaggcggccuacgggggagcauauggcgaaaacccuugcucaagugagcccuguggcuuuagcucuaaugggcucauagaauccguggagcugcgcggagagucagcuuucagcgguauuccaaacggccaguggaugacccaaaguuuuacagaccagauccccucuuucuccaaucacugcgggacucaggaacaggaggaagagagccaugccuga

SEQ ID NO: 63650 - RNA, 1221 nt, Artificial Sequence
  derived and/or modified sequence opt3 from TDO2__Homo_sapiens__NP_005642
augagcggcugccccuuccuggggaacaauuuuggauacaccuucaagaaacucccuguggaggguuccgaagaggacaagucucagacaggcgucaacagagccucaaaagggggacuuaucuauggcaauuaccugcacuuggaaaagguuuuaaacgcucaagagcugcagagugaaacuaaagguaauaagauucaugaugagcaccuauuuauaaucacgcaucaggcauaugagcucugguucaagcagauucugugggaacuugacagcgugagggagaucuuucaaaacgggcacguacgggaugaacgcaauaugcugaaaguggucucccgaaugcaucgugugucuguuauuuugaagcuccuggugcagcaguucucgauccuggagaccaugacagcccucgacuuuaacgauuucagagaguacuuaucaccagcgagcggauuucagagucugcaauucaggcuuuuggaaaauaaaauaggcguccugcagaacaugcgggugccguauaaucgcagacacuacagggacaacuuuaagggcgaggaaaaugagcuacuccugaaauccgaacaggagaagacucuucuggaguugguagaggcuuggcucgagcggacccccgggcuggaaccucacggauucaacuuuugggguaaguuagagaaaaauaucacacgcggccuggaagaggaguucauucgaauccaggccaaggaagagucugaagagaaagaagaacaaguugcagaguuccagaagcagaaagaagugcuccuuagccuguuugaugagaagagacaugaacacuugcuauccaaaggggagaggcggcugucauaucgugcccuccaaggagcucugaugauuuacuucuaccgcgaggaaccaagauuucagguccccuuccagcuucugaccaguuugauggacaucgauagccucaugacuaaguggagguauaaccauguguguauggugcaccggaugcugggcucuaaggcagguacagggggauccucaggcuaccacuauuuacgaagcaccgucagugaccgcuacaaaguuuuuguggaucuguucaaccuaucuacguaucucauaccuagacauuggauuccaaagaugaaucccacuauccacaaauuucuguacaccgccgaguauugcgacuccagcuacuucucgucugaugaauccgacuga

SEQ ID NO: 63651 - RNA, 1032 nt, Artificial Sequence
  derived and/or modified sequence opt3 from TDP1__Homo_sapiens__XP_006720263
augaugcugcuccuuuacgaggaaggccugagaguggucauccacaccagcaacuugauucaugccgacuggcaccagaagacacaagggauaugguuaucuccccuguauccuaggaucgcugauggaacucauaaauccggugagucaccaacgcacuucaaggcagaccuaauuaguuaccucauggccuauaaugcgccgagccugaaagaauggaucgauguuauucauaagcacgaccuuuccgagaccaacguguaccugaucggcucuacacccgggcgguuucagggaucgcagaaagauaauuggggccacuuccgcuugaagaagcuccugaaagaccaugcuucaagcaugccuaacgccgaaaguuggccaguagugggucaguuuuccucugucgggagccugggagcagaugaguccaaguggcucugcucagaguucaaagaaaguauguuaacucugggcaaggagagcaaaacccccggcaagucuuccgugccucuuuauuugauauacccaucaguugaaaaugugcgaacaagccuggagggguaucccgccggagguagucuaccuuacucuauccaaaccgcugagaagcagaacuggcuccacuccuacuuucauaaauggagcgcagaaacuucgggccguucuaaugccaugccacacauuaagacauauaugagaccgucccccgacuucucaaaaaucgcuugguuucuggucaccagugccaaccuuagcaaggcggcauggggagcccuggagaaaaaugggacgcaguugaugauuagguccuacgaacucggcgugcuguucuuaccuucugcuuuuggucuggauagcuucaagguaaaacagaaguuuuucgccgggucacaagagccaauggcaacuuuucccguuccuuaugaccucccacccgaacuuuacggaaguaaggaucggccguggaucuggaacauaccuuaugugaaagcucccgacacccacggcaauaugugggucccauccuga

SEQ ID NO: 63652 - RNA, 1089 nt, Artificial Sequence
  derived and/or modified sequence opt3 from TDP2__Homo_sapiens__NP_057698
auggagcugggcagcugccucgaagggggaagagaggccgcugaagaggaaggugagcccgaggugaagaaaaggcggcuucugugugucgaauuugcauccguugccucuugcgacgcggcuguggcccaguguuucuuggcagagaacgauugggaaauggagcgcgccuuaaauucauacuucgagccuccaguagaagagagugcucuggaacgacguccggagaccaucagcgaacccaagacauauguggaccuaacuaacgaggagacgaccgauuccacaacuucuaaaauuucgccuucagaagacacccaacaggagaauggcagcauguuuagucucauaacauggaacaucgaugggcuggaccuuaauaaccuguccgaaagagcaaggggagucugcucuuacuuggcccucuauagcccagaugugauuuuccugcaggagguuauucccccuuacuauuccuaccugaagaaacggucaaguaauuaugaaaucaucaccggccacgaggaggguuacuuuacugcuauaaugcucaagaagucccgcgugaaauuaaagucucaggaaaucauuccauuccccuccacaaaaaugaugagaaaccugcuuuguguccaugugaauguaucagggaacgaguugugccugaugaccagccaccuagaaaguacgaggggacaugccgcggagcggaugaaucaacucaagaugguucugaaaaagaugcaggaagcaccugagucugccacugugaucuuugcuggcgacaccaaccuucgcgaucgagaggucacaagauguggcgggcugccaaauaacauuguggacgugugggaguucuugggaaagccgaaacacugccaguacacuugggauacccagaugaauagcaaccucgguaucacagccgcauguaagcugagguuugaccggauauucuuucgugcugccgcggaagaaggccauauuaucccccgcagcuuagaucugcucgggcuugagaaacuggacugcggaagauucccuucggaccacuggggcuugcuauguaaccuggauauuauccucuga

SEQ ID NO: 63653 - RNA, 3570 nt, Artificial Sequence
  derived and/or modified sequence opt3 from TDRD1__Homo_sapiens__NP_942090
augagcgugaagucccccuucaacgucaugucuagaaauaaccuggaggccccuccaugcaaaaugaccgaaccguuuaauuucgagaagaacgaaaauaaacugcccccucacgagucacuuaggaguccaggcacacugcccaaccauccuaauuuucggcuuaagagcuccgaaaacgggaauaaaaagaacaauuucuuacugugugagcagacuaagcaauaccuagcuucucaggaggacaacucgguuucaagcaauccaaacggaaucaauggugaagugguaggcaguaaaggggaucgcaagaaacuccccgcaggaaacuccgugucuccuccaagcgccgaguccaacucaccgcccaaggaagucaauauuaaaccuggcaacaaugugcgaccagcgaagaguaagaaacugaacaaacuuguugagaauagccugucuauauccaaccccgguuuguuuacgucacucgggccuccacugcguagcaccacaugccacagauguggacuguucggcagucucaggugcucucaguguaaacagacuuauuacugcuccaccgcuugucaacggcgcgacuggagcgcccauucgaucgugugcagacccguccagccgaauuuucacaaguuagagaacaaaucuuccauugaaacaaaggauguggagguaaauaacaaaucagacuguccucugggcguuaccaaggaaaucgcaauuugggccgagaggaucauguucagugaucuucggagcuugcagcugaagaaaacuauggaaauaaaggggacagugaccgaguuuaaacaucccggagacuucuauguccagcuauacuccucugaggugcucgaauauaugaaucaacugagcgcuucacuuaaggagacguacgcaaacgugcacgaaaaagauuauaucccagucaagggugagguuugcauugccaaguacacuguggaccagaccuggaaucgcgcuaucauucagaacguagaugugcagcaaaagaaggcccacguccuguacaucgacuauggcaaugaagagauaauuccuuugaaccgaaucuaccaucucaacagaaauauugaucuguuucccccaugugcgaucaaaugcuucguggcaaacguuauccccgccgaggggaauuggaguuccgacugcauuaaggcuacaaaaccuuuacugauggaacaguauuguagcauaaagaucguggauauucucgaggaagaggucgugacuuuugccguagaaguugagcuuccaaacucuggaaagcuguuggaccacgugcuaaucgagaugggcuacggucugaaaccgucagggcaggacaguaagaaagaaaaugcagaucaaagcgaccccgaggaugucggaaagaugaccacagaaaacaauauaguggucgacaaauccgaucucauuccuaaggugcugacccuuaacguuggcgacgaguucugcggcgugguagcucauauccagacgccagaggauuucuuuugucagcagcugcaaucugggaggaaguuggccgaacuccaggcgucgcugagcaaauauugcgaccaguuacccccucgguccgauuucuacccagccaucggagacauuuguugcgcacaguuuucagaggaugaccaaugguaucgugcuaguguccuggccuacgcuucugaagagagcgugcuaguugguuacguggacuauggcaauuucgaaauccucucccugaugcgccuuugucccauuauaccgaaguugcuggagcucccuaugcaggccaucaaaugcguccuggcaggggugaagccaucacuuggaauuuggacucccgaggccaucugucugaugaaaaaguugguacagaacaaaaucauuacagugaagguugucgauaagcucgaaaauagcucucugguggaguuaauagacaaauccgaaaccccucacgugagugucagcaagguucugcuagaugcuggcuuugcggugggugagcagucuauggugacugacaaacccuccgauguaaaggaaacaucagucccacucgggguggagggcaaaguuaacccucuggaguggaccuggguggaacuuggagucgaccaaacgguggauguugugguaugcgucaucuacagucccggcgaguucuauugucacguguugaaggaagacgcacugaagaaacucaaugaucugaacaagagcuuagccgagcauugccagcagaaacugccaaauggguuuaaggcugaaauuggacagccgugcugugccuucuuugccggugacggcucgugguacagagcacuugugaaagagaucuugccuaacgggcacgucaagguucauuucguggauuauggaaacauugaggaaguaaccgcugacgagcucaggaugaucuccucuacauuucugaaucuacccuuccaaggcauacggugccagcuggccgauauccagagccgaaacaagcacuggucagaagaggcaauuacucgcuuucaaauguguguggcggguaucaaacuccaggcuagagucguggagguuaccgaaaaugggauuggcguggagcugacagaccuuaguacuugcuacccaaggaucauauccgacgucuugauugaugaacaucugguguuaaagucugccagcccccacaaagaccucccuaacgaucggcugguuaauaagcacgagcuucaggugcauguccagggacugcaagcaaccuccucagccgaacaguggaaaacaaucgaguugccaguagacaagaccauucaggcuaacgugcucgagaucauaagccccaaucuguucuaugcccuaccuaagggcaugccggaaaaccaggagaaacuguguaugcucacugcagaacugcuugaguacugcaaugcuccaaagaguagacccccuuaccgcccaaggaucggggaugccuguugcgcgaaauauacgucugacgauuucugguaccgugccguuguguugggaacauccgacaccgaugucgaagugcuguaugcugacuacgguaacauugagacuuuaccccucugucggguacaaccuaucaccagcucgcaccuggcacuuccguuucagauuauccgaugcucacuggagggccuaauggaacucaaugggucuaguucccagcugauaauuauguugcugaagaacuucauguuaaaucagaacgugaugcucagcgucaaaggaaucacaaagaauguucauaccgugucuguggagaaauguagcgaaaacggcacugucgauguggccgacaagcugguuacauuuggucuugcuaagaacaucacgccccaaagacaguccgcccugaauaccgagaaaauguauaggaugaacugcugcuguacugaauugcagaagcaaguagagaaacacgagcacauucuccuguuccuacugaauaacucaacaaaucagaacaaguuuaucgaaaugaaaaaguugcucaagaaaaccgcaagucucgggggcaagccauuguga

SEQ ID NO: 63654 - RNA, 2235 nt, Artificial Sequence
  derived and/or modified sequence opt3 from TDRD3__Homo_sapiens__NP_001139542
auggcccagguggcuggcgcagcccugagccaagcggggugguaccucuccgacgagggaaucgaggcuugcaccucuucacccgauaaggucaacguuaaugacauuauacuuaucgcccugaacacagauuugagaacuauugguaaaaaguucuuaccuagugacaucaauagcggcaaaguggagaagcuggaagggccauguguacuacagauucagaaaaucaggaacguggcagccccgaaggauaaugaggaaucccaggcugcaccccggaugcuccgccugcaaaugacggacggacacauaucuugcaccgccgucgaguuuucguauaugucaaagaucagccuuaacacaccuccaggcacuaaagugaagcugagugguauuguugauaucaaaaauggguucuugcuccugaacgacuccaauaccacagugcugggaggcgaggucgaacaucucauugagaagugggaauuacagcgaucucugagcaaacacaaccguuccaauaucggcaccgaagggggacccccuccauuugugcccuucggucagaaguguguaucacauguucagguggauaguagagagcuugacaggcggaagacuuugcaagucacaaugccugugaaaccaaccaacgauaaugacgaauuugagaagcagcgcacggcugccauagcggaaguggcaaaaagcaaggagacuaaaaccuucggcgggggaggcgguggggccagaucuaaccugaauaugaacgcugccggaaacaggaaucgggaaguccuacagaaggagaaauccacaaagucagagggcaagcacgaaggcguuuaccgcgagcucguggaugaaaaagcacugaagcauauuacugagaugggguuuagcaaagaagcuagucgacaggcccuuauggacaacggaaauaaccuggaggcggccuugaauguacuccugaccucuaacaagcaaaaaccggugaugggucccccuuuaagaggcagggggaagggacggggccguauccgcuccgaggacgaagaggaucuggguaaugcaagaccaagcgcucccucgacacucuucgacuuucuugaaucuaagauggggacccugaacgucgaggaaccuaaaucccagccacagcaauugcaccagggccaguauaggucaaguaauacggagcagaacggagugaaggauaauaaccaccuacggcaucccccgcgaaaugacacucgccaaccuagaaacgagaaacccccaagguuccagcgggauagccagaauaguaagucuguucuggaaggcagcgggcucccucgcaacagaggaucagagaggcccaguacauccagcgugucugaagucugggccgaggaccguauuaaaugcgaucggccauacucacgauaugacagaaccaaggauacuuccuacccccuggguagccagcacuccgacggcgcuuuuaagaaaagggauaacucuaugcaaucgcgcagcgggaagggaccuuccuucgccgaggcaaaagaaaauccacuuccgcagggcucaguggacuauaacaaucagaagcgggguaaaagagagagucagacaucuauccccgacuacuuuuacgaucgcaagagccaaaccaucaacaaugaagccuucuccgggauuaagauagagaaacauuucaacguaaauacggacuaucagaacccuguuaggucaaauagcuuuaucggcgugccaaacggagaagucgagaugccccugaagggccgacggauugggccuaucaaaccagcuggacccgugaccgcggucccgugugaugacaagauauucuacaauucugguccuaaacguagauccggcccaauuaagcccgagaaaaucuuggaaaguagcaucccuauggaguaugcaaagauguggaagcccggggaugaaugcuuugcccucuacugggaggacaacaaauucuauagggcugaaguggaggcccugcacucuuccggaaugacagcaguugugaaguuuauugauuacggcaauuaugaggaaguauuacugucaaacaucaaaccaauucagacugaggccugggaagaggaagguaccuacgaccagacacuagaguuccgccggggcggggauggacaaccuagaaggaguacucgacccacccagcaguuuuaccaaccaccgcgcgcucggaauuga

SEQ ID NO: 63655 - RNA, 2946 nt, Artificial Sequence
  derived and/or modified sequence opt3 from TDRD5__Homo_sapiens__NP_001186020
augagcgagcaggaaagaauccaagagugccugaggaaggaaauucggucccuccuuauaucuaccaaagacggccugucaccccaggaguuggaaaaggaguacuuacugaugguggggaaccaccuaccucuccgcauccugggauaucgaaguacaauggagcuuguccuggauaugccagacguugugcguguauguccgggugccggcgggacugugauuuugaaagcuauccccgaugaaagcacgaagggaauugcaucccucgucgccaaacagagaucuucgcauaagcugaggaacucaaugcacaagggccggccuagcaucuacagugguccacgcucccauagaagggugcccuaucgggggcgcguugcgccuauacugccagcuguggucaaaucugagcucaaggacuuacuggcccuuagccccguguugcuguccgauuucgaaaaagcauuugccaagcgauucggaagaucauuucaguacaugcaauauggcuuccuaaguauguuugagguacucaaugcugcaagcgacguuaucucuguggagcagaccagggccggcucccugcuuaugcugaaaaagucagucacagaagagaagccucgggggugcccagcuggaaaaauuuucacucagccguuucguaugaagcaggguagcuacaguaccggcuuccccguggccaaaccuuguuuuucucaaccaacauccaauauggaacccccuaagcagaucaugagcauggagaaaaccucgaaguugaacguggucgaaacuucucgccucaaucacacagagaaacugaaccaguuagagaauaccuucaaguccguuauugcgcagaucgggccaggaggcacgauaucaagugaacugaagcauaaaauuaaguuugugguaagcaaauuccccgagggucucuuuaucuccaagcuccugggggaauaugaggugauuuucaaagaacaauugucuccgaagaagcuaggauuccugaacgucacugagcucgugggcgcacugagcgauauccuucacguugaguuuagaaaaggccaccaggaccuguugguguucgaugccgacaagaaaccucuucccccaguccagucagauaagaaaaucgaagcuaaggccugcgugaguuccccucccaggaauagccugucuaccgcagcuguaaaggagacaguuuggaacuguccaucaaagaagcaaaaagaaccccagcagaagauuugcaaaaagccuaauuuaguggucaagccacugcagcuacaaguggagacuaacaaaagugaacucaaucuggccauggcgaaccaugacauaccgcccgaugccgucccuaauaagaaacuuugucgguugccaccccuggacaccagcucccucaucgggguguuuguugaguacauuaucucuccuucgcaguucuacauacgaauuuauagccgcgacuccucagagcugcuugaagauaugaugaucgagaugagaaggugcuacaguaaccagcuggugucugaccgguauguaaugccagaauguuuuauccagcccggacacuugugcuguguccgcauuagcgaggauaaguggugguacagagugaucauucauaggguucucgagaaacaagaaguggaggucuucuauccggacuuugguaacauaggcaucgugcagaaguccucacugcguuucuuaaaaugcugcuacacaaagcugccugcacaggcuauuccauguagccuagccuggguacggcccguggaggaacacuggaccucuaaggcuauccuccaguuucaaaaacugugcgggcuuaagccuuugguuggagucguggaugaauauguggacggcauccugaauauuuuccucugugauacguccaguaacgaggacgucuacuuucaccauguucugcgaacugagggucacgccauagugugcagagaaaauaucagcucuaaaggguucuccgaguuaaacccccuggcacuuuacacaaccucaaguggcggaccagaagauauuguguugacugagcucggcuauccuagccagcagcauuacuuuaaugaagacaggaagaucucgccccaguccaaagagucugagcugcgcauucuagaugaaaucccaacagggaugccgugucuggagagcguaaccauaggagacgacaucugggaugaaaacuggcucccucugcaagccaagauggguaagggcggggacgcugcgucacaccuuuucacggcaaguuugggaggcaaaaaucaguauuccucuugcaaggagaugccccagaaagauugguguuucagcaccccaaaggacacaugggaugacuccuggcaacccucaggucuggucaacgggacuaaaguggaaguucauaagccugagguguuaggcgcccaggagaagaauaccggaacaaaccggacucagaaacagcucgauauuaauggcagcagugacucuuccacccugccaaaacuugaagaguuuugcacaagccugacccaaucggaacagucagcugaugggucucagagugagcccaacaauucccagacucaaccuaaacagauccaguugagcacggccgcaccguguucuacaaccgccgucgacgauagcgcugagaagccauccggaucaguggaaaguagccccgagauucucaaaaacgaagacuucucuuccucaagagccaucacucuguacaaggauaagaggcaggagaguguugaccaacuaagccugauacucuccuaugaaugccagauuucucagaaacuguacaucccucgcucgaccgcaacagcggcucuuggugccgcagcccgauuggcuaccagccggucacuguuacacugguauccauccgugaagcguauggaggccuga

SEQ ID NO: 63656 - RNA, 6291 nt, Artificial Sequence
  derived and/or modified sequence opt3 from TDRD6__Homo_sapiens__NP_001010870
augugcagcacccccggcaugccugccccaggggcuucccuggcacucagagugucuuucgucgacguucacccggaugugauccccguacagcuuuggggacuggugggugagaggcggggcgaauacuugcgcuuaucacgagagauucaagaagccgcggcuacacgugggcagugggcccugggaagugcaagcgccuccccuggcgagcuaugucucguccaggugggucugcuuuggcauagaugcaggguugugucucggcaggcucaagaaucgcgcgucuuucuguuggacgaggggagaacuauaacggcaggagccggcucacucgcuccaggcaggcgggaguucuuuaaccugcccagcgaagugcugggguguguacucgccggauuaguuccugcggguugcggcgcagggaguggagagccaccccagcacuggccugccgaugcuguggacuuccuguccaaucuucagggcaaggaaguccaugguuguguguuggaugugcugcuacuccaccgccugguccuucuggagguuccagacguguuucagcaaaugcgagaguuggggcucgccagaaggguaccggauucucuguuccggagcuuacuggaacguuaucucaccgcagcuacagccuccgugggaucaggcguccccgugcuuagucgcguuccucugaaacagaagcagccaggcuuggacuacuuuuauccccagcuacaacugggggugacugaggcggucgugaucacccagguaugccauccucacagaauucacugucagcucaggagcguuucucaagaaauccaucggcuguccgagucaauggcccagguguaccgaggaagcacagguaccggcgaugaaaacaguacuucugcaacaugggaggagcgcgaagaguccccagacaaacccgggagcccgugcgcuucguguggacuugauggccacugguauagagcccuguugcucgaaaccuucaggccucagcggugcgcucagguccugcauguggacuacggucgcaaggaguuagucucuuguuccucacugagauaucuacuccccgaauacuuuaggaugccagugguuacguacccuugcgcccuguaugggcuuugggauggcggacguggcuggagucggagccaagugggggacuugaaaacucugauucucggaaaggcaguaaaugccaagaucgaguucuacugcuccuuugagcacgucuauuacgugucucuguauggugaagacggcauaaaccuuaaucgaguuuucggggugcagagcuguugccuggcugauagagucuugcagucacaggcgaccgaggaagaggaacccgagacaagucaaucccagagcccagcagaggaaguggacgaggaaaucucucuccccgcccugaggucaauucgcuuaaaaaugaacgcuuuuuacgaugcccagguagaguucgugaagaauccuagugaguucuggauccggcugagaaaacacaacguuacuuuuagcaagcuaaugaggcgcauguguggauucuauuccucugcaucgaaacucgacggcgucgugcugaagccagaaccggaugaccuuugcugugugaaguggaaagagaaugguuacuaccgagccauugucaccaaguuggaugacaaaagcguugauguguuucugguggaccgggggaacuccgaaaauguagauugguaugacguccguaugcuccugccccaguucagacaauuaccuauccuggcugugaagugcacacuugccgacauauggccauugggcaaaaccuggucacaggaggcaguuaguuuuuucaagaaaacggugcuccauaaggaacuggucauucacauccuagauaagcaggaccaucaguacgugauugagauccuggaugagucuaggacuggagaagagaacaucagcaaaguuauugcgcaagcuggcuaugccaaguaccaggaauuugagacaaaagaaaauauacucgugaacgcacacucccccgggcauguaucaaaucacuucaccacugagagcaacaagaucccuuuugccaaaacaggagagggugaacagaaggcuaagcgcgagaacaaaaccacgucugucuccaaggcccugagugacaccacaguggugacuaauggcagcaccgaacuugucguucaagagaaagugaagcgggcaucuguauauuucccauugaugcagaacugucuggaaauuaaacccggguccucaaguaagggagaguuagaggugggcagcacagucgaagugagaguuucguacguggagaauccggguuauuuuuggugccagcucacuaggaacauccaggggcugaagacccuuauguccgauauacaauacuacuguaaaaauacagcugccccucaccagcgaaacacccuggcgugcuuggccaagcgcacugucaaucggcaguggucuagagcucucauuagcggcauccagucaguggaacauguuaacgugacguucgucgacuauggagauagggagaugguaagugugaaaaauaucuacuccauuucugaggaauuucugaagguuaaagcacaagccuuccguuguagccuauauaaccugauccagccagugggccagaaucccuucgucugggacgugaaggcuauucaggccuuuaacgaguucauagauaaugcauggcaaaagaaccucgaacugaaaugcacaaucuuugcgcuugccuccauuaaugaggaauuguucaacaucguagaccuguuaaccccuuuucagucagcuugccacuuccucguggagaagcgccuggcccggcccgucaaacuucagaagccacuggagagcaguguucaacuacauucuuacuuuuauuccacucacgauaugaaaaucgggagcgaagagcucguguacauuacccacauagacgauccuuggacauucuauugucagcuggcaagaaacgcuaauaucuuggaacagcugucgugcucaauuacccaguuaucuaaggugcuccugaaccuuaaaacuaguccccugaauccaggaacauugugucucgccaaguacacggacggcaacugguacagggguaucgucauugagaaggaaccgaaaaagguguuuuucguugacuuugggaauaucuauguagugaccuccgaugaccugcuaccuauacccagcgaugcauacgacguccugcuucucccaaugcaagccgugcgaugcucucugagcgauauccccgaccauauuccugaggagguuguggucugguuccaggaaacuaucuuggauaaaucccugaaggcuuuagugguagcgaaagacccagauggaacacucauuaucgagcuguauggcgacaacauacagauuucagccaguaucaauaagaagcuuggucuguugagcuacaaagaucggauucgcaagaaagaaucugagguccucuguuccaccacagaaacucuggaggagaagaacgaaaauaugaaacuacccugcaccgaguaucugucaaagagugugggcuacaagcuuccuaacaaagaaauccucgaggagagcuauaagccgcagauaaauuccucuuacaaagaacugaaguuguuacaaucgcugacgaaaaccaaccucguuacacaguaccaggacagcguggggaauaagaacucacaggucuuuccacugacuaccgagaagaaagaagagaucuccgcagaaacaccccuuaagacugcuagaguggaggccacccugagugagaggaaaauuggagauucuugugacaaggacuugccucuaaaauucugcgaauucccacaaaagacgaucaugcccggcuuuaaaacaaccguuuaugugagccacauuaaugaucuguccgacuucuacguccagcucaucgaggaugaagccgagauaucacaucugucugaacggcuuaacagcgugaagacucgaccugaguauuacguagggccgcccuuacagagaggagacaugauuugugcuguguuuccagaggauaaccugugguaucgcgcaguuaucaaggaacagcaaccuaaugaccucuugaguguccaguucaucgauuacggcaacguguccgugguccacacaaauaaaauugguaggcuggaccucguaaacgccauccugcccgggcuuugcauucauuguagccugcagggauuugaggugccagauaauaagaacucuaaaaagaugaugcacuauuucucacaacguaccuccgaagcggcuauacggugcgaguuuguuaaauuccaggacagaugggaagugaucuuggccgaugagcacggcauuaucgcagacgacaugauuaguagguacgcccuaagcgagaagucgcaggucgaacugucuacucaggugaucaaguccgcuagcucaaaaaguguuaauaagucugauauagacaccuccguguuucucaacugguacaauccugagaaaaagaugauccgcgcauaugccacagucauugauggucccgaauacuucuggugccaauuugcggacacggagaaauuacagugucuggagguggaaguacagaccgcuggcgagcagguggccgaucgaagaaacugcaucccauguccguauauuggggacccuugcaucguucgguacagggaagauggacauuauuaccgcgcacuuauaacuaauauuugugaggacuaucuggucagcgugcgucucguggauuucggcaacaucgaagacugcgucgaucccaaggccuugugggcuaucccaucagagcugcucaguguucccaugcaagccuucccuuguugccugagcggguuuaauauuuccgagggacuuuguucucaggaaggcaacgacuacuucuacgagauaaucacagaagaugugcuagagauuaccauccuggaaauuagacgggacguaugcgacaucccauuggcaauaguggauuuaaagagcaaagguaaguccaucaaugagaaaauggagaaguauucaaaaacagggauuaagucugcucugcccuacgaaaacaucgacagugagauuaagcagacucucggaucguauaaccuggaugucggccuuaaaaagcugagcaauaaagccgugcagaacaagaucuacauggaacaacagaccgacgagcucgcggaaauaacggagaaagauguuaauauuaucgguacaaagccuuccaacuuuagggacccgaagaccgauaauaucugugagggcuucgaaaacccaugcaaagacaagauugauacugaggaauuggagggggagcuggaaugccaccuaguggacaaagccgaguuugaugacaaguaucugaucaccggauucaauacacuccuuccccaugcaaacgaaacuaaagagauacuggaauuaaauucuuuggaggucccucugucacccgaugacgagagcaaggaauuucucgagcuggaauccauugagcuucagaacagucugguaguggacgaagagaaaggcgagcucucuccaguuccucccaaugugccauugagccaagaaugugucaccaagggggcuauggagcuguucacauuacagcuaccucugucaugcgaagccgagaagcagccggaacucgagcuucccacggcucagcugccauuggaugacaaaauggauccucugucccucggagugagucaaaaggcacaggagagcauguguaccgaagacaugcgcaaaucuuccugcgucgagucauuugaugaccagcgaagaaugagccugcaccuucauggcgccgauugugaccccaagacucagaacgaaaugaauaucugcgaggaggaauucguggaguacaaaaaccgggaugccauuucggcucucaugccacuguuuucugaagaggaaaguuccgacgguagcaagcacaauaacggguugccugaucacaucucagcgcaacugcagaauacauauaccuuaaaggcauucacuguuggauccaaaugugugguauggucuagccuaaggaacacauggaguaagugcgagauacuggagaccgccgaagagggcacgcgcgugcucaaccuuuccaauggcauggaagagauugucaaccccgaaaauguuuggaacgggaucccgaaacuggacaagagcccaccugagaaaagaggauuggaggugauggaaaucuga

SEQ ID NO: 63657 - RNA, 3075 nt, Artificial Sequence
  derived and/or modified sequence opt3 from TDRD7__Homo_sapiens__NP_001289813
auggccugcaccgagacagcuagaaucgcacagcugguggccaggcaacggagcuccaagcgcaaaacuggccgacaggucaacugucagaugcguguuaagaaaacgaugcccuucuuucucgaagggaagccuaaagcgacccuuagacagccaggauucgcuucuaauuuuucaguggguaagaagccgaaccccgccccucugagggacaaaggcaauaguguaggggugaagccagaugcagagaugagccccuacauguugcacacaacuuuaggaaacgaagccuucaaagacauuccuguccaacggcaugugaccauguccacaaauaaccgcuuuucuccaaaggcuucgcugcagcccccucuacagaugcaccucucaagaaccagcacuaaagagaugagugauaaucugaaccagacaguugaaaagccaaaugugaagccgcccgcauccuauaccuacaaaauggacgagguccaaaacaggauaaaggagauccuuaauaaacauaacaauggcauuuggaucucuaagcugccucacuucuauaaagaauuguacaaggaggaucucaaccaggguauucugcagcaguuugaacauuggccacacaucugcacgguggagaaacccuguagcgggggacaagaccugcucuuauauccugccaagcggaagcagcugcuucgcuccgaguuggauacugaaaaaguaccacugucaccccuaccgggcccuaagcagacucccccacucaaaggcugcccuacaguuauggcuggggacuucaaggagaaaguggccgaucugcuugucaaguacaccaguggacugugggcgagcgcauugcccaaggccuuugaagagauguauaaagugaaguucccagaagacgcucucaaaaaucuggccucuuuauccgauguguguucaauagacuacaucagcgguaacccccaaaaggcaauucuguacgcuaaacucccucuuccaaccgauaagauccagaaggacgccggccaggcgcacggggacaacgauauuaaagccauggucgagcaggaguaucugcaaguugaagagaguaucgcagaaucugcuaauacauuuauggaggacauaaccgugccgcccuugaugauuccuacggaagccuccccaagcgugcuaguagucgagcugucgaacacuaaugaggugguuauccgauacgugggaaaggauuauucugcugcccaggaacucauggaggacgaaaugaaagaguacuauuccaagaaccccaaaauuacaccuguccaggcagugaauguaggccagcugcuugccguuaacgcugaagaggaugcguggcugagagcacaagugaucucaaccgaggaaaauaagaucaaggucugcuacguggacuaugguuucagugagaacgucgaaaagagcaaggccuacaaauugaauccaaaguuuuguucccucucuuuccaggcuacuaaaugcaagcuggccggguuagaggugcugagcgaugaccccgaucuaguuaaagugguagagucacucacauguggaaagauuuucgcagucgaaauacuggacaaggccgauaucccgcuugugguuuuguacgacaccaguggcgaggacgauauuaacaucaaugcuacgugccugaaagccauaugugacaagucccucgaagugcaucugcaggucgaugcaauguauaccaacgugaaaguaacaaauauuugcagcgacggcacucuuuacugccaggugccuuguaaggggcugaacaaauugucugaucuccugaggaagaucgaggacuauuuucacugcaagcauaugaccucagaauguuucguuaguuuaccauuuugcggaaaaaucugucuguuccacugcaaggguaaauggcuacgggucgagauuacaaaugugcacagcucccgugcgcucgaugugcaauuucuggacucuggcacugucaccucgguuaaggugagcgagcuucgcgaaaucccaccuagauucuugcaggagaugauugcuauacccccacaggccaucaaauguugccuggcagaucucccucaguccauugggauguggacacccgacgccgugcugugguuaagggauucaguacugaacuguagugacugcucuaucaaggucaccaagguggaugaaacucggggaaucgcucauguuuaccuuuuuacgcccaaaaacuucccggacccucaccgaagcauuaaucgccaaauaacaaacgccgacuuguggaagcaucagaaagauguguuucucuccgcaaucucaagcggcgcugacucucccaauuccaagaacgguaauaugccaaugagugggaacaccggcgagaauuucaggaaaaaccugacugaugucauuaaaaagagcaugguggaccacaccucugccuuuuccacagaggaacuacccccuccaguucaucugucaaaacccggagagcacauggauguguauguaccugucgcgugucacccgggcuacuucgugauccagccauggcaagaaauucauaagcucgaggugcugauggaagagaugauccuuuauuacagugucagcgaagagagacacauagccguugagaaagaccagguguacgcugcaaagguagaaaauaaauggcaucggguguugcugaaggggaucuuaaccaacggacucgucucgguguaugagcuggauuacgguaaacacgaacuuguuaauauucgcaaggugcagccccuggucgacauguuuagaaaguugccuuuccaggccgugacugcucaacucgccggcguuaaaugcaaccagugguccgaggaggcaucuaugguguucaggaaucacgucgaaaagaaaccacugguagcgcuagugcagacaguuaucgagaacgccaaucccugggaucguaagguggucguguaucugguagacacgagccucccugauaccgacacuuggauucaugauuuuaugucagaauaccugaucgagcuuaguaaagugaacuga

SEQ ID NO: 63658 - RNA, 4149 nt, Artificial Sequence
  derived and/or modified sequence opt3 from TDRD9__Homo_sapiens__NP_694591
augcugagaaagcucaccaucgagcagauuaacgacugguucacaauaggcaaaacugugacgaaugucgaacuucugggggcucccccugcuuuuccagcaggagccgcgagggaggaaguucaacggcaggauguggcuccgggugccggccccgcagcccaggcuccugcauuggcccaggcuccagcccgccccgcggcagccuucgagcguagcuuaucccaacgaucuucagaaguagaguacaucaacaaguauagacagcuggaggcucaggaacuagacgugugcaggaguguccagccuaccagcgggccaggaccccggccuucccucgccaaacugucuucggugacauguauuccaggcacuaccuacaaguauccggaucuucccaucucacgcuacaaagaggaaguugugagccugauugagaguaauuccgucgugaucauacacggugcaacagggucuggaaagagcacccaauugccucaguauauccucgaccauuacguacagagauccgcuuauugcucaauuguugugacucagccaaggaagaucggcgccaguagcauugcgcgguggaucucuaaagagcgcgccuggacacugggcggggucgugggauaccaagugggucuggaaaagauagcaaccgaggauacgcgacucauuuacaugacuaccggcgucuuacugcagaaaaucguuuccgcuaagucacuuauggaauuuacacacauuaucaucgacgaggugcaugaaagaacugaggagauggauuucuugcugcuaguagugaggaaacuccugcggaccaacagccguuuugucaaggugguucuuaugagugccacaauuucuuguaaggaguucgcugacuauuuugccgugcccguccagaauaaaaugaacccugcauacauauucgagguggaagggaagccacacuccguagaggaauauuaccugaaugauuuggagcauauccaccacagcaaacucucgccccaucuguuagaggaaccgguuauuaccaaggacaucuaugagguggccgucucucugauacaaauguuugaugaccucgauaugaaagaauccggaaacaaggcuuggucaggcgcgcaguucgugcuugagcgcaguagcguccugguguuuuugccuggucuaggggaaauuaauuacaugcacgagcugcucacgucccugguucauaaaagacuucagguguauccccugcacucuagcguagcauuggaggaacagaacaaugucuuccucucaccagugccuggauacaggaagaucauccugaguacuaacauugccgaguccagcguuacagugcccgacgucaaguacgugaucgacuuuugcuuaacccggacucugguaugugaugaagacacaaauuaucaaucucuacgacucucaugggcuaguaaaaccagcugcaaccagcgcaagggcagagccggcagggugucccggggguacuguuaucgccugguucacaaagauuucugggacaauucuauuccagaucaugucgugcccgagaugcuuagaugcccuuugggaucgacgauacugaaggugaaacuccuggacaugggugagccaagggcacuucuggccaccgcuuugagcccgcccggccucuccgauaucgaacguacaauucuguuacugaaggaggucggggcccuagcaguuucaggacagcgggaagacgagaacccucacgauggcgaacucacuuuccugggucgagugcuugcgcaguugccagugaaccaacagcuggggaagcucaucguacugggccaugucuuuggauguuuagacgagugccugaucauugcugccgcacuuaguuugaaaaauuucuuugccaugcccuucagacagcaccucgauggcuacaggaacaaggugaauuuuucugggagcuccaaaucagacuguauagcucugguugaggccuucaagaccuggaaagcaugccgccagacaggagaacuacgguauccuaaggacgagcugaacugggguagacucaauuacauccaaauuaagaggauccgcgaaguggcugagcuguaugaagaacuuaaaacucgaauuagccaguuuaacaugcaugucgauucucggcguccagugauggaccaggaguacaucuacaagcagagauucauauugcaaguugugcuggccggcgcguuuuaucccaauuacuucaccuuugggcagccggaugaagagauggccguaagggaauuagcuggaaaagacccuaagacaaccgucgugcucaaacacaucccacccuauggcuuccuguacuauaagcagcuucaaucccuguuucgccagugcggucaggugaagaguauugucuucgauggggcaaaagccuucguugaguuuagccggaacccuacugaaagauucaagacguugcccgcuguguacauggccaucaaaaugucucagcucaagguaucccuggagcuaucagugcacagugcagaggaaauugagggcaaaguccaaggaaugaaugugagcaagcugaggaacacacgaguuaauguggacuuucagaaacagaccgucgauccaaugcaagugucguucaacacuuccgaccgcucucagaccguuacagaucuccugcuuaccaucgacgugacugaagucguagaggugggccauuuuuggggguaucggauagaugagaauaacagcgaaauuuugaagaagcugacagcggagaucaaucaguuaacgcucguuccucugcccacccacccacauccggaccuugugugucuggccccuuucgcugauuuugacaaacagagauacuucagggcccagguccuauacgugucaggaaacagugcagaaguauuuuucguggacuaugguaacaagucccacgucgaucuccaccuguugauggagauucccugccaauuucuggaauuaccauuccaggcucucgaguuuaaaaucuguaagaugcgucccucugccaaaagccugguuugcggcaagcauugguccgacggggcaucacagugguucgccagccuugugaguggauguacucuguuggugaaggucuucucugugguucacuccguacuccauguggaugucuaccaauauagcggcgugcaggacgcuauaaauauccgcgauguucugauucagcaggguuacgcggagcuaacagaagagucguaugaaucaaaacaaucucacgaggugcugaaggggcuuuuuaguaaauccgucgaaaacaugaccgacggcagcgugccuuucccaaugaaggaugacgagaaauaccucauccggauucuguuggagucuuuuagcacaaauaagcugggaacucccaacugcaaggccgaauuacauggcccuuucaauccguaugagcucaaaugucacucccugaccagaaucucaaaguuuaggugcguauggauagaaaaagagaguauuaacagcgucaucaucucugaugcaccagaagaccuucaccagcgaaugcugguggcugccuccuugucaauuaaugccacggggaguaccaugcuccugcgggagacaagccuaaugccccauaucccuggacugccagcccuucucuccaugcuguucgcacccguuauugaguugcgcauagaucagaacggcaaguacuacacugguguguuaugugggcugggauggaauccugccaccggcgcgucuauccucccggaacacgacauggagcuggcuuuugauguccaguucucgguggaagacguuguggaggucaacauucuuagagccgcaaucaauaaacuggugugcgacggucccaacggcuguaagugcuuggggccagagaggguagcccaacuacaggauauugcucggcagaagcugcucggacuguuuugccagagcaaaccucgagaaaagaucgugcccaaauggcaugagaagccauaugaauggaaucaaguugacccuaaacuugucauggagcaggcagauagagaaucaucccgcggcaagaacacauucuuauaccagcugcacaaacucgugguguuggggacuuga

SEQ ID NO: 63659 - RNA, 1551 nt, Artificial Sequence
  derived and/or modified sequence opt3 from TDRKH__Homo_sapiens__NP_001077433
augagcaccgagagaacauccuggacuucucugucaacgauccagaagauugcccucggccuugggauacccgcuagugcaaccguggccuacauccuguauaggcgguaccgcgaaagccgagaggaacguuugacauucgucggagaggacgauauugaaaucgagaugagaguuccucaagaggcggugaaauuaauuaucgguaggcagggcgcuaacauaaagcagcugcggaaacagacuggggcccgcaucgacguagauaccgaagacgugggagaugagagaguccuacucauuuccggcuuuccagugcaagcaucuggugccaagaucacaugcgacaaagaaucggaggggacccugcuucugucaagguugauuaagaucagcggaacucagaaggagguugcugcagccaaacaccucauacuggaaaaggugagugaggaugaggaacugcggaaacgcauugcucauuccgccgaaacacgagucccgagaaagcagcccaucucugugaggcgggaggacaugaccgagccuggcggcgcgggggaaccagcacucuggaaaaauacgagcuccucaauggagcccacugccccuuuaguaaccccacccccuaagggagguggcgauauggcuguuguggucaguaaggaagggagcugggagaaaccaucugacgauuccuuccagaagucagaagcccaagcaauuccggagaugcccauguuugagaucccuagcccagacuucaguuuucacgcugaugaauaucuggagguguacgugucugccuccgaacaucccaaccacuucuggauccagauugucggaagccguucgcuucaguuggacaaacugguuaaugagaugacacagcauuaugaaaacucugugccugaggaccuaacuguacacgugggcgauauagucgcggccccacuccccaccaaugguuccugguaccgcgcaagagugcuggggacacuugagaacggaaaucuggacuuguauuuuguugauuucggcgacaacggcgauuguccgcucaaggaccugagggcuuuacggucagauuuucugagucucccuuuccaagccaucgaaugcagccuugcucgaauugcccccuccggggaccagugggaggaagaggcacuggaugaguuugaccgcuugacccacugugccgauuggaaaccucuaguggcuaagaucucuagcuacguccagacgggaauaucaacuuggccaaaaauuuaccuguaugacacaaguaaugguaagaagcucgacaucggccuggaacuugugcauaaaggguacgcgaucgagcugcccgaagauauugaggaaaacagagcaguaccagacauguugaaggauauggccaccgagacugacgcuucccucagcacacuguuaaccgagacgaaaaagucuucaggagaaaucacccacacacugaguugccuaagccucuccgaggccgcaucuaugucgggcgaugacaaucuggaagaugacuaucuuuuguga

SEQ ID NO: 63660 - RNA, 597 nt, Artificial Sequence
  derived and/or modified sequence opt3 from TDRP__Homo_sapiens__NP_001243042
auguggaagcugggcagagggagggugcuccuugacgagcccccugaagaggaagauggacugcgggguggcccaccgcccgccgcugcagccgcggcucaggcccaaguccagggggccagcuuccgcggauggaaagagguuaccuccuuguuuaacaaggacgaugaacagcacuuacuggagcgaugcaaaucuccuaagucaaaaggcacaaaucuacgucucaaggaggaacugaaggcagagaaaaagagugguuucugggacaaccuugugcugaaacagaauauccaaagcaagaaaccagaugaaauugaggggugggagcccccuaaguuggcucucgaagacauauccgcagauccagaggacacuguaggaggccaucccucuuggucgggcugggaagaugacgccaaggggucaacgaaauacaccagccuggcuaguuccgccaacucuagcagauggucccugagggcggcaggacggcucaucaaggagguguggauuaauuuuucacaguuaaucauuaguuuccgcaaacacugucuggcccauuauagagaacuuagguugugcaucaaguacuga

SEQ ID NO: 63661 - RNA, 1281 nt, Artificial Sequence
  derived and/or modified sequence opt3 from TEAD1__Homo_sapiens__NP_068780
auggagcccagcuccuggucuggcucagaaaguccugccgagaacauggaaagaaugagcgacuccgcugauaagccaaucgacaaugaugcagaggggguguggucuccggacauugaacagucguuccaagaggcccuggcgauauaucccccuugcggaaggcggaaaaucauucucucagaugaggguaagauguacggccgcaacgaacuuaucgcucgauacauuaaacugcguaccgggaagacaagaacuaggaaacaggucagcagucacauccagguuuuggcccggcgcaaguccagagacuuucauucuaaguuaaaagaucagacggcaaaggacaaagcccugcaacacauggcugcaaugagcuccgcccagauagugucagcuaccgccauccauaauaagcuaggacucccaggcauucccaggccuacauucccaggugcgcccggguuuuggccuggaaugauccagacuggccagccaggcaguagccaagauguaaaaccguucgugcagcaggcauaucccauucagccugccgucaccgcuccaauccccggguuugagccugccucugcaccagcucccuccgugccggccuggcaaggacggucaauagguacaaccaagcugcgccuuguugaguucagcgcguuucuggagcagcagcgagacccugauaguuacaacaagcacuuguucgugcauauuggccacgccaaucacucuuauuccgacccccuccuggagagcgucgauaucagacaaauuuacgacaaauuuccagaaaagaaagggggacugaaggaacucuucggcaaagguccucagaacgcauuuuucuuagugaaguuuugggcugaccugaauuguaacauccaggaugacgccggggcuuucuauggaguaacuucgcaguacgaaucuuccgagaauaugacaguuaccugcucaacgaaaguguguaguuucggcaagcaagucguggaaaagguggagacugaguacgccagguuugaaaacggccgguucgucuaucguaucaaucgcagccccaugugcgaguacaugauuaacuuuauacauaaacuuaagcacuugccagaaaaauauaugaugaacuccguucuggagaauuucaccauccuacucgugguaacaaauagagauacucaggaaacccugcuuuguauggcaugcguguuugaggucucuaacagcgagcauggggcccagcaccacauuuacaggcuggugaaggacuga

SEQ ID NO: 63662 - RNA, 1353 nt, Artificial Sequence
  derived and/or modified sequence opt3 from TEAD2__Homo_sapiens__NP_001243587
augggcgagcccagagccggggcugcacuggacgauggaagcgguuggaccggcuccgaagaggggucugaagagggaacaggcgguucagaaggggccggaggcgacggcgggccugaugcggagggaguguggaguccagacaucgagcagagcuuccaagaagcucucgccauuuacccgcccugcgguaggcggaagauaauccuuuccgaugagggcaaaauguaugggcgcaacgaacugauugcacgauacaucaaguugcguacuggaaaaacgagaaccaggaagcaggucucuucgcacauucagguuuuagcccggcgcaaaucaagagagauccagagcaagcugaaggaccaagugaguaaagauaaggcuuuucagacaauggcaacuauguccucugcccagcuaauaagcgcuccuucccuccaggccaaacugggcccaaccgguccccaaguagugcaggcgucagagcuuuuccaguuuuggagugggggaagcggcccuccauggaauguccccgacgugaagccuuucucucagacaccauuuacccuguccuugacuccgcccucaacagaucucccuggcuaugaaccaccccaagcacugagcccucugccacccccgaccccuagucccccagccuggcaggcuagggggcucggaacggcccgguuacagcugguugaguucucugcauuuguggaaccucccgacgcugucgauuccuaccaacgccaucuuuucgugcacaucagccagcauuguccaucgcccggugccccuccauuggagucuguagacguucgacagauuuaugauaaauuuccggaaaagaagggcgggcugagagagcuauacgacaggggacccccucacgcguucuuucucgugaaauucugggccgaccugaacuggggcccauccggugaggaagcaggggcuggcggaucaaucaguagcggcggguuuuauggagucuccucucaguacgagagccuugaacauaugacucugaccugcucaaguaagguguguuccuucgguaaacaaguggucgagaagguugaaacagagcgggcccaguuggaggauggccguuucguguaccgccuccugagaagccccaugugcgaauauuuaguaaauuuucugcacaaacucaggcagcuuccugagcgguacaugaugaacucugugcuggaaaauuucacuauuuugcaggucgugaccaaccgagacacacaagagcuacugcucuguaccgcuuauguuuuugaagugucaacgagugagcgcggggcccagcaccauaucuacagacuggucagggauuga

SEQ ID NO: 63663 - RNA, 1308 nt, Artificial Sequence
  derived and/or modified sequence opt3 from TEAD3__Homo_sapiens__NP_003205
auggccagcaacuccuggaaugcuucuucaagucccggcgaggcaagagaagacgggccugagggacuggauaagggucucgacaacgaugccgaaggcguguggagcccagacaucgagcaguccuuccaagaagcgcuugcuauuuacccgcccugcgggaggcggaaaauaauccugucugaugagggaaagauguauggccgcaaugaguugauugcccgauacaucaaauuacguaccgguaagacaagaacuaggaaacaggucucgucacacauucagguucuggcacggaagaaggugcgcgaauaucagguagggaucaaagccaugaaccuagaccaagugagcaaggauaaagcucuccagaguauggcauccaugucuagcgcccagauagucuccgcuucagugcugcagaauaaguuuaguccuccaagcccccuuccucaagccguuuucucuacguccucaagauuuuggagcaguccaccccuguugggacagcagccuggcccaucucaggacaucaaaccguucgcgcaacccgcauacccuauucagccaccccucccuccaacccuguccagcuaugagccccuggccccgcucccuucggcugccgcaucugugcccgucuggcaggauaggacaaucgcuuccucacgguuacgccugcuugaauacagugccuuuauggaggugcaacgagacccagauacuuauagcaagcauuuguucguacacauuggccagaccaacccugcguuuuccgaucccccacuggaggccguugacgugagacagaucuacgacaaguuccccgaaaagaaagggggacuaaaagagcucuacgaaaaggguccuccaaaugcauuuuuccuggucaaauuuugggcugaccuuaacucuacaauacaggagggcccgggggccuucuauggagugagcucacaauacaguuccgcugauagcaugaccauuucugugucaacuaaggucuguaguuuuggcaaacagguuguggaaaagguagagacagaguaugccaggcuggaaaauggucgguucguguaccguauccaucgcagccccaugugcgaguauaugauuaacuucauccacaaguugaaacaucucccugaaaaguacaugaugaacuccguccuggagaauuuuaccaucuuacaggugguuacgucuagagacucgcaggaaacucugcucgugauugcauucgucuuugaggugagcaccuccgagcacggggcccaacaccauguauauaaacuuguuaaggauuga

SEQ ID NO: 63664 - RNA, 1305 nt, Artificial Sequence
  derived and/or modified sequence opt3 from TEAD4__Homo_sapiens__NP_003204
auggagggcaccgccgggacaaucacuagcaacgaaugguccucucccacgucaccugagggaaguaccgcuagcgguggcucccaggcacuggacaagccaauugauaaugacgccgaagggguguggucuccggauauagagcaaucguuccaggaagcgcucgcuaucuaucccccuugcggaagaaggaaaauuauccuuucagacgagggcaagauguacggucggaacgagcugauugcccgcuacaucaaauugcgaacagggaagacucguaccagaaaacaggucagcagucacauacagguuuuagcaaggcggaaggcccgcgaaauccaagcuaagcugaaagaucaggcagccaaggacaaagcucuacaguccauggccgcgaugucuagcgcacagauuaucuccgccacagcuuuucauucaaguauggcccucgcaagaggaccaggcaggcccgcugugagcggcuucuggcaaggggcccugccuggacaggcggguaccucucacgauguaaagccauuuucccagcagacuuaugccgugcaacccccucuuccacugccgggcuucgagucacccgcagggccugcuccaagccccagugccccuccagcucccccguggcagggacggucugucgccuccagcaaauuguggaugcucgaauuuucggcauuccuggagcagcaacaggacccugauacauacaauaagcaucuguuugugcacauuggccagucuucccccucauauagugacccauaccucgaggccguugauauccgccagauauaugacaaguucccugagaaaaaggguggguuaaaagaucuguuugaacgaggacccagcaacgcuuucuuucuugugaaguucugggcggacuugaauaccaacauugaagacgagggcuccucuuuuuacggcgucagcucacaauacgaaaguccagagaauaugaucauuacguguuccacuaaagugugcagcuucgggaagcagguaguugagaaaguggaaaccgaguaugcaagauacgaaaacggacauuauucuuacaggauccaccggucaccccugugugaguauaugaucaauuucauucacaagcuaaagcaucucccugaaaaauacaugaugaacaguguccuggagaauuuuacaauacuucagguggugacuaaccgugauacccaggagacacuguugugcaucgccuaugucuucgaaguuagcgcuuccgagcacggugcccaacaucacauuuaccgccucgugaaggaauga

SEQ ID NO: 63665 - RNA, 1896 nt, Artificial Sequence
  derived and/or modified sequence opt3 from TEC__Homo_sapiens__XP_011512038
augaacuucaauaccauccuggaggaaauucucauaaagagaagccagcagaaaaagaaaacauccccacuuaacuacaaggagaggcuguuuguguugacuaaaucuauguuaacguauuacgaaggccgggccgagaagaaguaucgcaaaggguucaucgacgucucaaagauuaaaugcguugaaaucgugaagaaugaugacggaguaauuccuugucaaaacaaauacccauuucaggugguccacgaugcuaauacccuguauaucuucgcaccgaguccccagagccgagaccuaugggugaagaagcucaaagaggagauaaagaacaauaacaauaucaugauuaaauaccauccuaaguuuuggacagaugguuccuaucaaugcugucgucagacugaaaaacuggccccaggcugcgagaaguacaaccuuuucgaaucuucgaucagaaaagcgcugcccccugcuccagagaccaagaagaggcggcccccuccaccgauucccuuggaggaagaggacaauucagaagagaucguuguggccauguacgauuuucaggcagccgaagggcacgaccuccgccuggagagaggacaggaguaucugauacucgagaaaaacgauguccauugguggagggcucgggacaaguacggcaaugaagguuauauuccuagcaacuacgugacagggaaaaagaguaauaacuuagaucaauaugaaugguacugucgcaacaugaaucgauccaaagcagagcagcugcuuagaucugaagacaaggagggaggcuucaugguaagggauagcucccagccaggcuuguauaccguuucacuguacacuaaguuugggggagaggguaguagcggcuuccggcacuaccauaucaaagaaacaaccacgucucccaagaaauauuaccuagccgagaagcacgcuuuuggguccauuccugaaaucaucgaguaucacaaacauaacgccgcgggacucgugacucgucugcgcuacccagucucagugaagggcaagaaugcacccaccacagccgguuucagcuaugaaaaaugggagauuaacccgagugagcuuacuuuuaugagagaacuggggucuggauuguucggcguggucaggcucggcaaguggcgggcucaguacaaaguugccauaaaggcaauccgagagggggcuaugugcgaagaggacuucauugaggaagccaaagugaugaugaagcugacccacccuaaguuaguacaacuguauggaguguguacacagcagaaacccaucuacauagucaccgaguuuauggaacgcgguugccuccuuaauuuccugagacaaaggcagggccauuuuucccgggacguguugcuaagcaugugucaggauguuugcgaggggauggaauaccuggagcgcaacucguucauucacagagaccucgcggccaggaauugucuggugucugaggcaggagucgugaagguauccgauuuuggcauggcucguuauguucuugacgaucaguacacgucaaguagcggugccaaauucccagugaaguggugcccucccgaagucuuuaacuauucccgguucucuagcaaaucagacguguggaguuuugggguccugaugugggagguguucacugaaggccgaaugccauuugagaaguacacaaauuaugaaguugugaccaugguaacuagaggacacagguuguaccaacccaaacucgcuuccaacuaugucuacgaggugaugcugcgcugcuggcaggagaagccugaaggccggcccagcuucgaggauuuacugagaacaaucgacgagcuaguugaaugugaagagaccuuugggagguga

SEQ ID NO: 63666 - RNA, 3804 nt, Artificial Sequence
  derived and/or modified sequence opt3 from TECPR2__Homo_sapiens__NP_001166102
auggccagcaucuccgagcccgugaccuucagagaauuuugcccucuguacuaucuccuuaacgcuauuccaacaaagauacagaaaggcuucaggucuaucgucguuuaccugacugcauuggacacgaauggggauuauauugccgugggaucaaguaucgguauguuauaccuguauugucggcaccuaaaccaaaugcgcaaguacaauuuugagggcaaaaccgaaagcauuacaguagugaagcuccuguccugcuucgacgaucuugucgcggcugggacugccucuggacgaguggcaguuuuucagcuggugucgucauugccgggccguaacaaacagcucagaagguucgacgucaccgguauccauaagaauagcauaacagcccuggcuuggagucccaacgggaugaagcuguuuuccggagaugacaaaggcaagaucguguauucuagccucgauuuagaccagggccuguguaauucccaacuuguauuggaggaaccuucaaguauuguucagcuggauuacagccagaaagugcuacucgucucuacccugcagcggucccuucuguucuacacugaggagaagucagugcgccaaaucgggacacagccaagaaaaagcaccggaaaguuuggugcaugcuucauucccggcuuguguaagcagagugaccucacgcuguaugccucuaggccuggguuacggcuguggaaagcugaugugcacggaacuguccaggccaccuuuauccucaaggacgcguucgcaggcgguguuaaaccauuugaacuucauccccgccuggaguccccuaacagcgggucgugcucuuugccagaacgacaccuaggacugguguccuguuucuuccaagagggcuggguacucucauggaaugaguacaguauauaucugcuugauacagugaaccaggccacugucgcuggccuggaagggagcggagacauuguguccguuucuugcaccgagaaugaaaucuuuuucuugaagggugacagaaacauuaucaggaucagcucacggccggagggccucacaaguaccgugcgugaugggcuggaaauguccggauguagcgagcgcguccaugugcagcaagccgagaaauuacccggcgcaacgguaucugaaacuagacugagggguucaaguauggcuagcuccguugccucugagccucggucgcgaagcuccucacuaaauaguacagacucugggagcggccuccugccacccggacuucaggcgaccccugaauugggcaaggggucccagccacugucacagcgcuuuaacgccauuagcucugaggauuucgaccaagaacucguggucaaacccauaaaggugaagagaaagaagaaaaagaaaaagacugagggagguuccaggaguacaugccacagcucucuggaguccaccccguguucagaauuuccuggcgauaguccccagagccuuaauacggaccuguugucgaugaccuccucuguccucgggagcucaguggaucagcugagugcagaguccccagaccaggaaucuagcuucaacggagagguuaacggcgugccucaagaaaauacagaucccgagacuuuuaacguauuagaggucuccgguucaaugccagacagccuggcugaagaggaugacauccggaccgaaaugccccacugccaucacgcccaugggcgcgagcuacucaauggcgcuagagaggacgugggaggcagugauguuacagggcugggagacgaaccuugcccagccgaugacgguccgaacucuacucagcuucccuuccaggagcaggauuccagcccuggcgcacacgacggggaagauauucaaccaaucggaccccagucgaccuuuugugaggugccuuugcucaauucacugacagucccaucuagucuguccugggcccccagcgcugaacagugguuaccgggcaccagggcggacgaggguucuccuguggagccaagccaggaacaagauauacugacuuccauggaggcaucagggcaccuuaguacgaacuuguggcaugccguaacagacgaugacaccggccagaaggaaauucccaucagcgagcgugugcucggaucuguuggcgggcagcugacuccugucuccgcucuagccgcaucaacccacaaacccuggcuggaacaaccaccucgggaucagacacucaccaguagcgacgaggaggacaucuacgcccauggacugcccuccucuucgagcgaaacuucagugacagagcuuggcccauccugcagucagcaggauuugucucgacugggugcugaagacgccggguuacucaagccggaucaauucgcagagagcuggaugggauauuccggcccugguuacggcauucugucacuuguggucucugaaaaauauaucuggugucuggacuacaaagggggauuguuuugcagcgcgcuccccggcgcugggcugagauggcagaaauucgaggaugccguucagcagguagcagugaguccauccggagcccuacuguggaagauugagcaaaagagcaauagggcuuuugccuguggcaaagugacgauaaaggguaaacgccacugguacgaagcacucccccaggcugucuucguggcccugucugacgauaccgcguggaucauucggacuucaggggaccuuuauuugcagacaggacuguccguugauagaccuugcgccagggcugugaaggucgacuguccauaccccuuaagucagaucaccgcacgcaacaaugugguuugggcccucacagagcaacgagcucugcuuuaucgggaaggcgugagcucguucugcccugagggugagcaguggaaaugugauaucguaucugaacgucaggcccuggagccggucugcauuacucuaggcgaccaacagacccucugggcacuggauauacaugggaacuugugguuuagaacgggaaucauuuccaagaagccacagggcgacgacgaucacugguggcaagugagcaucaccgacuacguggucuucgaucaguguucacuguuucagacaauuauccacgcgacucauaguguugccaccgcugcccaggcacccguggaaaaaguagcugacaaguuaaggauggccuucuggucucagcaacuccagugccagccuucccugcuuggggugaauaacagcggagucuggauaucaaguggcaaaaaugaguuucacguggcaaaggguagccugaucgggacauauuggaaccauguugugccacgcggaacugccuccgcuaccaaaugggcguucgucuuggccucugcagcucccacgaaggaaggcagcuuucucuggcugugccaguccucaaaagaucuauguucugugagugcccaaucggcccagagccggccuuccacaguucagcugccgcccgaggcugagaugagagcauacgccgcgugccaggacgcucuuugggcccucgauucucugggucaaguguucauuaggaccuugucaaagagcuguccaacuggcaugcacuggacacgacuggacuuaucccagcucggggcagucaagcugaccagucuugccugcggaaaucagcacaucugggcuugugauucucgcggcgggguauauuuucgggugggaacucaaccucugaaccccagcuugaugcucccagcauggauuaugaucgaaccucccguucaggugucaagauccuga

SEQ ID NO: 63667 - RNA, 927 nt, Artificial Sequence
  derived and/or modified sequence opt3 from TECR__Homo_sapiens__NP_612510
augaagcacuacgagguggaaauccuggacgccaaaaccagagagaagcucugcuuccuugauaaagucgaaccccaugcuacaauugcagagauaaagaaccuguuuacuaaaacgcacccucagugguauccagccaggcagagcuugcgguuagacccgaagggcaagucccugaaagaugaagacguucuacaaaagcuccccguggggaccacagcgacucuguacuuccgcgaucuuggagcucagaucucuuggguaaccguguuucugacagaguaugccgguccuuuguucauuuaccuccuguuuuauuuccgagucccauuuaucuacggccauaaauaugacuucaccucaagucgucacacugugguucaucuggcauguauuugccacagcuuucacuacaucaagagacucuuagagacacuguucgugcauagguuuucccacgggaccaugccccuucggaauauauucaaaaacuguacguacuauuggggauuugccgcuuggauggcauacuauaucaaucauccuuuguacacuccacccaccuauggcgcccagcaagucaagcuggcucuagccauuuucgugaucugccagcucgguaacuucucuauucacauggcgcugcgcgaucuuagaccugcagggucgaagacaaggaaaaucccauacccgacuaagaaucccuuuaccuggcuguucuugcucguaucauguccuaacuauacauacgaaguuggaagcuggauaggcuuugccauuaugacccagugccugccaguggcuuuauucagucuggucggcuuuacgcagaugacuaucugggccaaagggaagcaccgguccuaccucaaagaguuccgcgacuaucccccucuucgaaugccaauuauccccuuucuguuguga

SEQ ID NO: 63668 - RNA, 1092 nt, Artificial Sequence
  derived and/or modified sequence opt3 from TECRL__Homo_sapiens__NP_001010874
auguucaagagacacaaaagccuggccuccgagaggaagcgggcucuccuuucucagcgcgcaacccgauuuauccugaaagacgauaugcguaacuuccacuuuuugucaaaguuagugcugagugccggcccccuaagaccuacaccagcggucaaacauagcaagacuacgcauuucgaaauugagauauuugacgcucaaaccaggaagcagaucugcauucucgauaaaguuacacaguccucuacuauccacgacgugaagcagaaauuccauaaggccuguccgaaaugguaccccucgcggguagggcugcaacuugaaugcggagguccuuuucugaaggauuauauuaccauccagucaauagcagccagcaguaucgugacauuguacgcuaccgaccucggccagcaggucuccuggacuacaguguuccuggcagaguauaccgggccacugcucauuuacuuacuguuuuaucuucgcauccccuguauuuacgauggaaaggaaucugccagaagguugcggcacccuguugugcaccuggcuugcuucugucauugcauccacuauauacgcuaccuacucgagacgcuguuuguccauaaagugagcgccggccacacuccacuuaagaaucugauuauguccugugcguucuacugggguuuuaccucauggaucgcauauuacauuaaccaccccuuguauacaccuccaaguuucgggaaucgacaaaucacuguaagcgccaucaacuuccucauuugcgaggcuggaaaucauuuuauaaacguuaugcugucucacccgaaucauaccggcaacaaugccuguuuccccuccccuaacuacaauccauuuacauggauguucuuuuuagugucaugccccaacuauaccuacgaaaucggcagcuggauuaguuucacggucaugacucagacacugccuguggggaucuuuacccuccuuaugucuauacagaugucccugugggcacagaaaaagcacaaaauuuauuugagaaaguucaauagcuacauccauaggaaaucggcuaugaucccauuuauucuauga

SEQ ID NO: 63669 - RNA, 6468 nt, Artificial Sequence
  derived and/or modified sequence opt3 from TECTA__Homo_sapiens__NP_005413
augaacuacagcuccuuccugagaaucugggugucuuuuauuuucgcccucguccagcaccaagcucagcccagggagcuuauguauccuuuuuggcagaaugacaccaagacaccaaaaguugaugacggcucaaguagcgaaauaaagcuggcaaucccgguguucuuuuucgggguacccuaccggacuguguaugucaacaauaacggagugguuuccuuuaauguguuggucucucaguucacgccugagucguuuccauuaaccgauggucgcgccuucguggcgcccuuuugggcugacguacauaacggcauucgaggggaaaucuacuaucgugagacaauggaaccugccauucugaaaagagcaacuaaggauaucaggaaauacuucaaggacauggccaccuuuucagcuacauggguuuucauagugaccugggaggaggucacuuucuauggaggcagcaguacaaccccagugaauacguuucaagcagugcuagucuccgaugguucuuacacuuucacccucuuuaacuacuaugaaaucaauuggacaacugggaccgccagcggaggcgacccccugacaggccuugggggaguuauggcucaggccgguuucaacggcgggaaucugaccaacuuuuucuccuugccuggaucacggacgccagagauugugaauauccaggaaacuacaaacguaaaugugccgggccgcugggcguuuaaggucgaugguaaagagauugaccccgcaaacgggugcaccaguagaggacaguuccucaggcggggcgagguguuuugggaugaccugaacuguacuguuaagugccgcugucuggauuucaauaacgaaaucuacugccaagaggccagcuguucuccuuaugaagugugcgagccaaaaggcaaguuuuucuacuguuccgcugucgaaacaucaaccugcgugguauuuggggagccccacuaucauacguucgacggauuccucuuucacuuccaggguagcugugccuacuuacuggcacgacagugccuucagaccaguucuuugccuuuuuucuccguugaggcuaaaaaugaacauagaaggggcagcgccgugucgugggucaaggagcugucuguggaagucaacggguauaagauacuaauuccaaaaggauccuacggccgggugaagguuaaugaccucgugacaucacugcccguaacucuugaucuggguaccgucaaaaucuaccaaagugggauuagcacagcgguggagacugacuuuggcuugcucguuaccuucgauggacagcacuaugccuccaucucugugccgggcagcuacaucaacucaacaugugggcugugcggaaauuauaacaagaauccuuuagacgauuuucugcgucccgacggucgcccagcaaugaguguccucgaucuuggcgaauccuggagaguguaccacgcugacuggaaaugcgauagcggguguguagacaacugcacccagugugaugccgcuacugaggcccuguauuucggaucugacuacugcggcuuuuugaauaagacggacgguccucuaugggagugugggacagugguugaucccaccgcauucguccauucaugcguguaugaccuguguagugugagggauaacggcacucuccugugccaagccauucaggcuuacgcgcuugucugucaggcacugggaauaccaaucggcgacuggcggacccagacagggugcguuagcaccgugcaaugucccuccuuuucucacuacucggugugcacuagcuccugcccugauacauguucagacuugacggccagucgaaauugcgcuaccccauguacugaaggaugcgaguguaaccaggguuucguacucucuacaagccagugcgucccgcugcauaaauguggcugcgauuuugacgggcacuauuacaccaugggagaauucuucugggccacagcaaauuguacugugcagugcuuaugugaggaaggcggugauguuuauugcuuuaacaagaccugcggguccggcgaggugugugccgucgaggacggauaccaaggcugcuuccccaagcgcgaaacggugugucugcuaucacagaaccagguucuccacaccuuugauggggcuagcuaugccuucccuucugaguuuuccuacacacugcuuaaaacuugcccagaaagacccgaguauuuggagauugacaucaauaagaaaaagccugaugcaggaccagcguggcugaggggccuccggauacugguggcugaccaggaaguaaaaauuggugggaucggagccagugaggucaagcuuaacggccaagaaguggagcugcccuucuuucauccgagcgguaaguuggaaaucuaccgcaauaaaaacucuaccacaguggaguccaagggcgucguuacugugcaguacucagacauugggcuccuguauaucagauuaaguaccacguacuucaauuguacaggaggccugugcggguuuuauaacgcaaaugccagcgaugaguucugucuaccuaacggaaaaugcaccgacaaucucgcuguauuucuggaaucguggacuacauucgaggaaauuuguaacggcgagugcggugaucuuuugaaggccuguaauaacgacuccgaacugcucaaauucuacaggucucguagccggugcgggauaaucaaugauccaucaaacaguuccuuucuggagugccacggaguggucaaugugaccgcauauuaccgaacuuguuuauucagacugugccagucuggcgguaacgagagcgaacuuugugacuccguugcuagguaugccucagcgugcaagaacgccgauguggaggucggccccuggcgcaccuacgacuuuuguccuuuggaaugccccgagaauagccauuucgaagaguguauuacaugcacggagaccugugaaacucucacacuggggccaaucugcguggauaguuguucugagggaugccagugcgacgaaggcuacgcucuacuggggucccaauguguuacccggagcgagugcggauguaacuuugagggccaccagcucgcaacaaaugaaacuuucuggguggaucuggacugccagaucuuuuguuauugcucggguaccgauaacagaguccauugugagacgauuccuugcaaggacgacgaauacuguauggaggaagggggacuuuauuacugccaagccaggacagaugcuucauguauaguaucuggcuauggucacuacuugaccuucgacggcuuucccuucgauuuucagacuaguugcccacugaucuuaugcaccacagggucccgcccgagcucugacagcuucccuaaauuugugguuacugccaagaaugaggaucgagaccccucccucgcacugugggugaaacaggucgaugugaccguauucggauauucaauugugauccaccgggcguacaagcauacaguccuuguuaacagugagcgucuguacuugccacucaaacugggccaggggaagauuaauaucuucagcuuuggauuccacgugguggucgaaacggacuuuggccuaaaggugguuuaugauuggaaaaccuuccugucuauaacuguacccagauccaugcaaaacucaacauacggucucugugggagguauaauggaaacccugacgaugaccuggagaugccaaugggccuuuuggccaguagcgugaaugaauuuggccaguccugggucaagcgcgacaccuucugccaggugggguguggagaucggugccccucuugugcuaaaguugaggguuuuucgaaggugcagcaacugugcagcuuaaucccuaaccagaaugccgcauucucaaaaugucauuccaaggucaacccgacuuuuuucuacaaaaauugccucuuugacaguuguauugauggcggggcugugcagacagccugcucuuggcugcagaacuaugcaagcaccugucaaacgcagggaaucacuguaaccggcuggagaaacuacacauccugcaccgucacuuguccacccaauucacacuaugaaucuugcgugagcguuugccagccuaggugugccgcuauucgacuuaagagugacugcucccacuacuguguggaggguugccauugugaugcgggguacguccugaacggaaagagcugcauccuaccacacucuuguggcugcuauucagacggcaaauacuaugagcccaagcaacucuucuggaauuccgauuguacacgccggugcagauguuuuaggcguaacgugauacagugcgacccucgccagugcaaaagugaugaagagugugcccugcggaaugggguuagaggaugcuucagcaccaagacaucguacuguuuggcagcugguggcgggguguucaggacuuuugacggagccuuccugcgauuuccggccaacugcgcuuucgucuuaucuaccauuugucagaaacuccccgauaucuccuuucaacugauuaucaauuucgacaaguggagcgcaccaaaccuuacgauaaucucaccuguguauuuuuacauuaaugaagagcagauccugauuaacgaucggaauacaguaaaggugaacggcacccagguuaauguccccuucaucacugguuuggccaccaaaauauauaguucugaaggguuucucgugauugacacauccccagacauccagaucuacuacaacggauucaaugugauuaagaucagcauuucagagcgccugcaaaacaaagucugcggccuauguggcaauuuuaacggggaucugacugacgauuauguaacccuuagaggaaagccugugguuaguagcgugguccucgcgcaguccuggaaaacgaacgguaugcagaagaggccccuggcuccaucuugcaaugaguugcaguucagccaauacgccgcaaugugugacaacgugcauauacagaagaugcagggcgauggguauugccugaaauuaacagacaugaagggauuuuuccagccguguuacggccuccuggauccucuucccuucuaugaauccugcuaccuggacgguugcuauucacacaaaaaguuucaauugugugggucucucgccgcuuacggagaggcaugccggaguuucggcauccugucgaccgaauggauugagaaagagaauuguagcggcguuguggaagauccaugcgucggggccgacugucccaaccgaacuugcgagcuaggaaaugguagagaacuguguggcugcaucgagccuccacccuacgggaacaauucccaugauauuaucgacgcggaagugacauguaaggcugcccagauggagguaucuauaucaaagugcaaacuuuuucagcucggauucgagcgcgaaggcgugaggaucaacgaucgucaauguaccgguauugagggggaagacuuuaucagcuuccagauuaauaacacuaagggaaauugcggcaacaucguucaguccaauggcacacacauaauguauaaaaacacccuguggauugagagugcaaauaacacggggaacaucaucacucgggacagaaccauuaaugucgaauuuucuugcgccuacgaguuggauauaaagaucagcuuagacucaguggugaaaccuaugcuguccgucauuaaccucacaguuccgacccaggagggaaguuucaucacaaagauggcucuguauaaaaaugccagcuacaagcacccauauaggcaaggugaagugguacuuacuacccgcgaugugcuguacgucggcguguuuguugugggggcagacgcuacgcauuugauucuaacacugaacaaguguuaugccacucccacccgagauucuaaugacaaacucagauacuucaucauagagggaggcugccagaaccugaaggauaauacaaucgguauugaagagaacgcggucucccuuaccugucgguuucacguaacuguguucaaauuuaucggggacuacgaugaaguucauuuacacugcgccgugucacugugugacagcgagaaguauucgugcaaaauuaccuguccucauaauucuaggaucgcaacagauuacacgaaggagcccaaggaacagauaauuagugucggcccaauccgccguaaaagacucgacuggugcgaggacaacggaggcugugaacagaucugcacuucccggguggaugggccuuuguguagcugcgucaccggaacacugcaagaggacgguaagucaugcagggcuuccaauucuagcauggagcuccagguguggacccugcuucugauuaugauccagauaaguuuguggcacuucguuuauaaauccggcacuacaagcuga

SEQ ID NO: 63670 - RNA, 822 nt, Artificial Sequence
  derived and/or modified sequence opt3 from TEF__Homo_sapiens__NP_001138870
auggacaugcccgaggugcucaagagccugcuugaacacucccugccuuggccagagaaaagaaccgauaaggaaaaaggcaaggagaaauuggaagaggacgaggccgcugcagccucuacaauggcggucucagcuaguuuaaugccgcccaucugggauaagacuauuccuuacgacggggagagcuuccaucuggaauauauggaucuagacgaauuucuccuggagaacggaauaccagccucccccacgcaccuugcacauaaucuguugcucccuguugccgagcuggaagguaaggagucugcuucgucaagcaccgcaaguccacccuccucuagcacagccaucuuccagccuuccgaaacugugucaaguaccgagagcucucuggaaaaagagagggagacaccauccccgauugaucccaacugcguagaaguggacgucaauuuuaacccugauccagcugaccucguguuaucaagcguucccggcggggagcuguucaauccucggaagcacaaauuugccgaagaggaucuuaagccacaacccaugaucaaaaaggcgaagaaaguguucgucccggacgaacagaaggaugagaaauacuggacccgccgaaagaaaaacaauguggcagccaagcguaguagagacgcuaggcgguugaaagagaaccagauuacuauccgcgccgcauuucuggaaaaggagaauacagcucuaagaaccgaaguagccgagcucaggaaggaaguuggaaaauguaagacgauagugucuaaauaugagacuaaguacggcccucuguga

SEQ ID NO: 63671 - RNA, 1083 nt, Artificial Sequence
  derived and/or modified sequence opt3 from TEFM__Homo_sapiens__NP_078959
augagcggcuccgugcuguucaccgccggggagagauggaggugcuuucucacacccucucggucaagucuuuacugggcucugcacaacuucuguugccgcaagaaaagcacuacgccuaagaaaaucaccccaaaugucacauuuugugacgaaaacgcaaaggagccggaaaaugccuuggauaaauuauucuccucugagcagcaagcgucgauucugcauguucuaaacacugcuucaaccaaggaacucgaggccuuucgacugcuucguggaagaaggagcauaaauaucguggagcaccgggaaaacuucggucccuuucagaaucuggagaguuugaugaacguaccucucuucaaguauaaauccacagugcaggucugcaauucuauucuguguccaaagaccggccgcgagaaaagaaagagccccgaaaacagguuucugcggaaacucuuaaagccugacaucgagcgcgaacgacugaaggcaguuaauuccauuaucucaauaguguucgggacuagaaggaucgccugggcucaucuugaucggaaauugacagugcuggacuggcagcaaagugaucguuggagccuaaugcgcggaauuuacucuuccucagucuaucucgaggaaaucagcaguauuaucucuaagaugccaaaagcagacuuuuacgugcuggagaagaccggccuuuccauacagaacagcucgcuguuccccauuuugcuccacuuucauaucauggaagccaugcuguaugcuuuacugaauaaaacguucgcccaggauggucagcaccaaguacucucuaugaacagaaaugcgguugggaagcacuucgagcuuaugauuggagacuccaggacuucaggcaaagagcuggugaagcaguuuuuguucgauaguauccuaaaggcagacccucgggucuuuuucccaagcgauaaaaucgugcauuaccgacagauguuucuguccaccgaacuccagcgcguggaggaacuguaugacucucuucugcaagccauugcuuucuacgaguuggccgucuuugauagccagccguga

SEQ ID NO: 63672 - RNA, 3375 nt, Artificial Sequence
  derived and/or modified sequence opt3 from TEK__Homo_sapiens__NP_000450
auggacagccuggccucccucgugcuuugcggcgucucucuguuguuaucagggaccguugagggagcuauggaucugauccuaauuaacagucucccccuggugagcgacgcagaaacaucccuuacuuguauagccucugguuggagaccucacgagccaaucacgauuggcagggauuucgaagcgcugaugaaucagcaucaagacccguuggagguaacccaggaugugacacgggaaugggcuaagaaagucguguggaagcgcgagaaagccucgaagaucaacggggcauacuuuugcgagggacgaguucguggcgaagccauuagaaucaggacuaugaaaaugcggcagcaggcuucauuccuccccgcaacccugacaaugaccguggacaagggugauaaugucaacaucagcuuuaagaaagugcugauaaaggaggaagacgccguaauuuauaaaaaugggaguuucauccacuccguuccucgccaugaggugccagauauucucgagguccacuuaccccaugcucaaccucaggacgccggaguguacucugcgagauauaucggcggcaaccuguuuacuagcgcauucacaaggcuuauagugcggcgcugugaagcccagaagugggggccagagugcaaucacuuguguaccgcuugcaugaacaauggagucugucacgaagauacgggugagugcauuugucccccuggcuuuauggggcgaacuugcgaaaaagccugugagcugcauaccuucggaagaacaugcaaggagaggugcuccggccaggaagguuguaagucauacguguuuugccuaccagacccguauggguguaguugcgcaacuggauggaaaggccuccaauguaacgaggcuugccaccccggcuucuacgggccugauuguaagcugcggugcagcuguaauaacggagaaaugugcgaccguuuucaggguugucuuugcucuccaggcuggcaggggcugcagugcgagcgcgaaggaauccccagaaugaccccuaaaauuguugacuugccagaucauaucgagguaaauuccggcaaguucaaccccaucuguaaagccucagguuggccgcucccuacaaaugaggaaaugacccuggugaagcccgacgggacggucuuacacccaaaagauuuuaaccacacugaccauuucagcguggcgauuuucacaauacacaggauccugccucccgauaguggcguuugggugugcucugucaacaccguggccggaaugguagagaagccauuuaauauuuccguuaaggugcuccccaaaccucuuaacgcaccaaaugucaucgacacuggccauaacuucgcugugauaaauauuagcucggaaccguauuuuggggauggacccaucaagucuaaaaagcuguuguacaaaccugucaaccacuacgaggccuggcaacauauccaggugacaaaugaaauuguuacccuaaacuaucuggagccacggacggaguacgaacucugugugcagcugguacgacgcggugagggcggggaaggacaccccggcccugucagaagguucaccacagcuuccaucggucuuccacccccgcgggggcugaauuugcucccuaagucacaaacuacccugaacuuaacauggcagccaauuuuucccaguagcgaggacgauuucuauguggagguugaacgcagauccgugcagaagucugaccagcaaaauauaaaagucccuggcaaccugacuagcgugcuacucaauaaccugcaccccagggagcaguacguagugcgugcccggguuaauaccaaggcacagggagaauggucagaggaucuuacagccuggaccuugagugacauccugccaccucagcccgaaaacauuaaaaucuccaacaucacucauagcucugcugucauuucauggacgauacucgacggcuauaguaucagcuccauuacaauccgauacaaggugcaagggaaaaaugaggaucagcacguggacgucaagauuaagaacgcgaccaucacucaguaucagcugaaaggacuugagccagaaaccgcauaccaaguugauauauuugccgagaauaacaucgguucuucgaauccggcuuucagccaugaacuggugacauugccugagucccaggcccccgcagaccucggcgggggaaagaugcuguuaauugccauccugggcucagcugguaugaccugccuaacugugcuccuggccuuucuuauuaucuugcagcugaaaagagcaaacguacagaggcgcauggcgcaggcuuuccaaaauguccgggaagaaccagccgugcaguuuaacagugggacacucgcacugaauagaaagguuaaaaacaaucccgauccuacgauauacccaguguuagacuggaacgauauuaaguuccaagacgucaucggcgagggaaauuuuggccaggugcugaaggccaggauuaaaaaggaugggcuucgcauggacgcugccaucaaacgaaugaaggaauaugcaucuaaagaugaccaccgggauuucgcuggagaguuggaaguucucuguaagcugggccaccaucccaacauaaucaaucuacugggugccugcgagcaccguggguaccucuaucuggcgauugaauacgccccucauggaaaccuuuuggacuuccugagaaaaagcaggguguuagagaccgacccggcuuuugcaaucgccaacuccacugcuucaacacucagcucucagcagcugcuucacuucgccgcagauguagcgcgcggcauggacuaucugucccaaaagcaguuuauucaucgggauuuggccgcuagaaauauccucgucggugagaacuacguggccaagauagcagacuucggccugaguagggggcaggaaguguaugucaaaaagaccaugggacgacuaccaguucgcuggauggcuauugagagccugaauuacucuguguacacaacuaacuccgauguauggucauauggcgugcuccugugggaaaucgucagucuugggggaacccccuacuguggcaugacgugcgccgaguuguaugagaaacugccucaggguuaccgguuagaaaagccacucaauugugacgaugagguguaugaccugaugagacaaugcuggagggaaaaacccuacgagcguccuagcuuugcacagauccuuguuucgcugaaccgcaugcuagaggagcggaagaccuaugugaauacaacucucuacgagaaguucaccuacgccgggauugauuguuccgcugaagaggcggccuga

SEQ ID NO: 63673 - RNA, 1257 nt, Artificial Sequence
  derived and/or modified sequence opt3 from TEKT1__Homo_sapiens__NP_444515
auggccaagcugcuccagcccccuccaaaauuccuuccgagcgaguggcacaucgcuaacaagaaucaauaccauagagcagacgcccagaggucccggucugaacgccugguggcggagucacagcgauuggucgaugaaauugagaaaaccacacguaagagucagagcgacguuaacaaaaaguuagaacaaagacuggaggaggugcaguuuuggaagaaagaacuagaugacaagcucgagcagcugguaaaugugacugaugaccuucugauauauaaaaucagguuggaaaaggcucucgagacgcugaaagagccccugcacauuaccgaaacaugccucgccuaccgggagaagcgcaucggcauugauuuaguccaugacacuguggaacacgagcugaucaaggaagcagagauaauccaggggauuauggcccuuuugaccagaacacuggaggaggcuuccgaacaaaucaggaugaaccggucugcaaaauauaaucuagaaaaggaucucaaagacaaguucguugcccugaccauugaugacaucuguuuuucgcuuaacaauaacucaccuaauauacgcuacagcgagaacgcugugcgaauugaaccaaauagugucucccuggaggauugguuggacuucucuagcacuaacguggagaaagccgacaagcagagaaauaacucccucaugcugaaagcguuaguagauaggauccugucacagacagcaaaugaccuccggaagcagugcgauguuguggacaccgccuuuaagaacggacuuaaagauacgaaggacgcucgugauaaacuggccgaccauuuggcaaaggucauggaagagauugcuagucaagagaaaaacaucacugcccuagaaaaggcgauccuggaucaggaaggucccgccaagguggcacacacccgccucgagacaagaacucacaggccuaauguggagcugugucgggacgucgcucaguaucgacuuaugaaagaaguucaagagauuacccauaacguggcccgccugaaggaaacauuggcucaggcccaggcagagcucaaaggccugcacagaaggcaguuagcccugcaagaggaaauacagguaaaggagaauaccaucuacauugaugaagugcuaugcaugcagaugcggaaaagcaucccacuccgcgacggggaggaccauggagucugggcuggcggucugagacccgaugcgguguguuga

SEQ ID NO: 63674 - RNA, 1458 nt, Artificial Sequence
  derived and/or modified sequence opt3 from TEKT5__Homo_sapiens__NP_653275
auggaguuccugggcaccacacagacugccagcuacugcgggcccaagaaauguugcggacucacgucccuuccugcugugcaagcaccagucauccaggaauguuaucagccguacuaucugcccgguuacagauauuugaacucuuggaggccuucauuauuuuacaagauugccaauguucagaccugcccagacgagaguacaagcacucugcggcccccuaccauacuaccaacacuccgcuccgcgcuguucucucgauauucgccccacgauugggaccaaucaaaccagcuucaggugcguggcgcugaagccagcagacugugggcaaguagguugaccgaugacuccaugcggcuccugcaggauaaagaccaacugacucaucagaugcaggaggggacaugucgcaaucucggacagagauuaucugauaucggcuuuuggaagucugaacuguccuacgagcuugacagguugcugaccgagaaccaaaaucuagaaacgguaaaacggcgccucgagugcgccgcuaacgaagugaauuguccucugcaggucgcacuugagugccuguaccaccgagagaagagaauugguaucgauuuggugcaugacaacguugaaaagaaucucauuagggagguggaucuguuaaaauguugccaggaacaaaugcggaagcuggcccagcguaucgacauacagaugcgcgauaacagagacgcucagcacguccucgagagggaccuugaagauaaaucaagugcccaauguaucgacgagaagugcuucaaucugcggaacacuagcgauugcauuagcuuuuuccaugggauggagaaaaucgacggaaccauuuccgugccagaaacaugggcgaaguuuucaaaugauaacaucaagcacagccagaauaugcgagcaaacaguauacaguugcgcgaggaagccgagcaccuauucgaaacucugucugaccagauguggagacaauuuaccgauacaaaccucgcuuucaaugccaggauuuccgagguaaccgacguuaaaaacaagcugcagacgcagcuugcaaaaacucugcaggagaucuuucaagcugaaaauacaauuauguugcucgagcggagcaucauggccaaggaaggcccgcugaaaguggcgcagacccgcuuagaguguagaacuaggcgucccaacauggaacugugccgggauaucccucagcuaaagcucgucaaugagguguucacaauugacgauacccugcagacgcuuaaauugcgacugagagagacccaagacacacuccagcugcuugugaugacuaaguguaggcuggaacaugaguuggccauaaaggcaaacacccucugcaucgacaaagaaaaguguaugggcaugcgcaaaacauuuccaugcacuccccggcuggucgggcacaccuga

SEQ ID NO: 63675 - RNA, 2514 nt, Artificial Sequence
  derived and/or modified sequence opt3 from TELO2__Homo_sapiens__NP_057195
auggagcccgccccuagcgaagugagacuggcugucagggaggcaauccacgcccucuccucuucagaagacggcgggcauauuuucugcacccuugagagucugaagcgguacuugggagaaauggagccaccggcguuaccccgcgagaaagaagaguuugcuagcgcccacuucuccccuguucugcgaugucuagcaucucgucucucgccagccuggcuggaacuucugccccaugguagauuggaggagcucugggcuucauuuuuccuggaaggcccugcagaucaggccuuucuggugcucauggagacaauagaaggggcugccggacccagcuucagguuaaugaagauggcgcggcugcuugcacgcuuuuugagagagggcaggcuggccguacuaauggaagcucaaugccggcagcagacucagccagguuucauccuccugcgcgagacgcuucuggggaaaguggucgccuugccugaccaccucggaaaccgacugcaacaggagaauuuagcagaauuuuucccacagaacuauuuuagacugcucggcgaggaagugguuagggugcuucaggcugucguggauagucugcaaggcggguuggacuccucuguuagcuucguaucccaggugcuaggaaaggccuguguccauggucggcagcaggagauucugggcgugcucgugccgcgucuggcggcccuuacccaagggucauaccugcaccagcgcgucugcuggagauugguugaacaggugcccgauagggcaauggaggcuguacucacaggacugguggaggccgcuuuaggcccugaaguccugagucggcuacucgguaaucuggugguuaaaaacaagaaggcccaauuugugaugacucagaaacuuuuguuccugcagagccgacucaccacaccaaugcugcagucucuucuggggcacuuggcaauggacucccaacgcagaccccuccuguuacagguccugaaggagcuacucgaaaccuggggaucaagcagugccaucaggcauacuccucugccacagcagcggcacgugucuaaagcuguacuuauuuguuuggcgcaacugggcgagcccgaacuccgcgauuccagagacgagcuguuagcaagcaugauggccggcguuaagugcaggcuggauucgucucuuccgccugugcgucgguuggggaugaucgucgcugagguggucuccgcccgaauacaucccgaaggaccaccucucaaauuccaguaugaggaagacgagcugucacuagagcugcucgcacuggccaguccccagccagcuggugauggcgccagcgaagcagggacaucccuugugcccgcgaccgcugagccuccagccgaaacgccggcagagaucguugacggaggcgugccccaggcccaauuggcugguucugauagcgaccuggacucagaugacgaauuuguaccuuacgauaugaguggggacagagaguuaaaguccagcaaggccccagcauaugucagggauuguguggaggcucucacuaccucugaagacauugagcgcugggaagccgcgcugcgggcccuugagggccugguuuacagaucacccacagcuacuagggaagugagugucgaguuggcaaaagugcuccugcaccuagaggaaaagaccugcguagugggauucgccggccugcgccagcgagcucucguugccgucacagugaccgauccugcaccaguggcggacuaucugacgagccaguuuuacgcccuuaauuacuccuugcggcagcguauggauauccuggacgucuuaacucucgcugcccaagagcugucuagacccgggugucuuggaaggacaccgcagccugguucgccaagccccaacaccccuugccugcccgaagcagcuguuucccagccaggcucagccguggcaagugauuggcgcgugguagucgaggaacggauuagaucuaaaacucaaaggcuaagcaaagggggaccucgacagggccccgccgguuccccaucacgcuucaauagcguggcugggcacuuuuucuuuccgcuccugcagcgguucgacagaccuuugguuacauuugaccuguuaggcgaggaucagcucgugcugggaaggcuugcgcauacccugggcgccuugaugugucucgcagucaacacgaccguggcuguugccauggggaaggcccugcuagaguucgugugggcucugcguuuucacaucgacgcauauguacgccaaggacuucucucugccgucuccagugugcuguugagccugcccgcggcucgguuacucgaagaucugauggacgagcuucuggaagccagaucuugguuggcagauguggccgagaaggacccagaugaggacugcaggacacucgcucugcgagcacuacugcuucuccagcggcugaaaaaucgcuuguuacccccugccuccccauga

SEQ ID NO: 63676 - RNA, 8178 nt, Artificial Sequence
  derived and/or modified sequence opt3 from TENM1__Homo_sapiens__NP_055068
auggagcagaccgacugcaagcccuaccaaccucugccaaaagugaagcacgaaauggaucucgccuauacaagcuccucugacgagucagaagauggcagaaaaccgaggcagaguuacaacagccgggagacucuucaugaauauaaucaggagcugcgcaugaacuacaauucccagucucgaaagcguaaagaggucgaaaagucgacgcaagagauggaauucugugagaccucacacacauugugcagcggguaucagacugacaugcauaguguuuccagacacggauaccaguuagagauggguucugauguggacaccgaaacagagggcgcugcaagccccgaucaugcccugaggauguggauccgggggaugaaguccgaacacucaaguugucuaagcucucgcgcgaacuccgcucucucacugaccgacacugaucacgagagaaaaagcgacggagaaaauggcuuuaaguucaguccuguaugcugugauauggaggcccaggcagguucuacacaagacgugcaguccagcccacauaaccaguuuaccuucaggccccuuccuccacccccuccaccgccccacgccugcacgugugcucggaaaccuccacccgcagccgauucgcugcagcgccgaucuaugacuaccagaucccaaccuucaccagcugcccccgcgccgccuacaaguacucaggacagcguccauuugcacaauuccugggugcucaacucuaauauuccccuggagaccaggcacuuucuguucaagcaugggagcggaucaagugcaauauuuuccgccgcuagccagaacuauccacucacaucuaauaccguuuacucaccucccccacggcccuuaccucguaguacguucagccgcccagccuuuacuuucaacaaaccguacagaugcuguaauuggaagugcacagcacuguccgcuaccgccaucacugugacacuugcguugcugcuagccuaugucauugcagugcaccucuuuggccugaccuggcaacuucagcccguagaaggcgagcuguacgcuaacgggguuucuaagggaaauagggguacggaaucgauggacaccacauauagcccuaucggcgggaaaguguccgauaagucagagaaaaaggucuuccagaaaggacgggccauugacacuggcgaaguggauaucggugcucaggugaugcaaaccauaccacccggguuguuuuggcgauuccagaucacaauucaucacccuaucuaccucaaguucaacauuagucuggccaaagacucuuuacugggaaucuauggccgcagaaacauaccacccacucauacccaguuugauuucgucaagcucauggacggcaagcagcuuguuaaacaagauagcaagggguccgacgauacacagcacucaccgaggaaucugauuuugaccagccuacaggagacuggauuuaucgaguacauggaccaggguccuugguaucuggcauucuacaacgauggcaaaaagauggaacaaguguuuguacucacgacagccauugagaucauggacgacuguucuaccaauugcaacgggaauggagaaugcaucuccggccacugucauugcuucccagguuuucuggggcccgauugugcucgggacaguugcccugugcuuuguggcggaaacggcgaguacgaaaaagggcacugcgucugucgccauggauggaagggucccgagugcgaugugccagaggaacaguguauugacccuacuugcuucggccacgggaccuguauaaugggaguuugcaucugcgugcccggcuauaagggugagauuugugaagaggaggauugccuggacccaauguguagcaaucacgggaucugcgucaaaggcgaaugucauugcucuacaggauggggcggggugaacugugagaccccguugccuguaugccaggaacaguguuccggacacgguacuuuucuccuggaugcgggcguuugcucaugugaccccaaguggacagggagugauugcagcacggaguuaugcaccauggaauguggaucgcauggcgugugcuccagagguauaugucaaugcgaggaggggugggucggcccaacuugugaagagaggucuugccacagccauuguacagaacacggacagugcaaagacggcaagugugagugcucacccgggugggaaggagaucacuguaccauugcacauuaccuggacgccgugcgugauggcugcccuggucuaugcuucgggaauggacgguguacacucgaccagaacggcuggcacugcgucugucaaguggguuggaguggcacugggugcaauguugugauggagaugcuguguggagacaaccuugauaaugacggcgauggguugaccgacugcguagauccagacuguugccagcaguccaacuguuauaucucuccccugugccagggaagcccugauccgcucgaccugauccaacagucccagacgcuuuuuucacagcauaccagccgacuguucuacgauagaauuaaauuuuugaucggcaaggacaguacacacgucauuccacccgaggugucuuucgauuccaggcgcgcuuguguuauacggggucaaguggucgccaucgacgggacuccucucgugggaguaaaugugagcuuccugcaucacucggauuauggcuuuaccauuucaagacaggacgguucuuucgacuuaguugcaaucggcgggaucagugucauucugauauuugauagguccccauuccuacccgaaaagcgcacacucuggcugccuuggaaccaguuuaucgugguggagaaagucacuaugcagcgaguugugagcgacccgcccucuugcgauauuagcaacuucaucuccccaaauccuauugugcuucccucaccauugaccaguuuuggaggcagcugcccugaacgggggacgaucguacccgagcugcaagucgugcaggaagagauaccaaucccgucuuccuucguucgucucucauaccugaguagcagaacaccuggauauaagaccuuacugaggauucuuuugacucacuccacaauccccgugggcaugauuaaaguccaucucaccguggccguugagggucgccugacucagaagugguuuccagcugccaucaaccuaguguacaccuucgcauggaauaaaacagacauauacgggcaaaagguauggggacuggcggaagcucucgucucugugggcuaugaguacgaaacgugucccgauuuuauucugugggagcagcggaccgugguccuucaggguuucgagauggacgccucgaacuugggcggguggagccugaauaagcaccauaucuuaaacccucagucaggaauuauccacaaaggcaauggggaaaacauguuuauaucccaacagccacccguuaucaguacuauuaugggaaauggccaccagagaucuguggcaugcacaaacuguaaugguccugcccauaacaauaagcucuucgcuccgguagcccuggcaagcgggccagauggauccguguaugucggcgacuucaacuuugugaggcgaaucuuccccucaggcaauucuguuagcauucuugagcugaguaccuccccugcucacaaauacuauuuggccauggaucccgugagcgaaucucucuaccugucagacacaaacacucgcaaggucuauaaacuaaagucccugguggagaccaaagaucucaguaagaacuuugaaguuguggcggggacgggagaccagugccugccauucgaccaaagccauuguggugauggcgggcgggccucggaggcuucucuuaauuccccuagaggaaucacagucgacaggcacggcuuuauauacuucguagaugguaccaugauucguaagaucgacgagaacgcagugaucacuaccguuauugggagcaauggauugacaucaacucagccccugaguugcgauucuggcauggacaucacccaggugcgcuuagaauggccaacagaucucgccgucaacccuauggacaauucccuguacgugcuugauaacaauauuguacugcagauaagcgagaaccggagagugaggaucauugcuggccgaccgauccauugucaaguccccgggauugaccacuuucuaguuucaaaaguggccauccacaguacgcucgaaagcgcacgggcgauauccgugucucauagcggacuguuguucaucgccgagaccgaugaacgcaaggucaauagaauucagcaggugacuacaaacggugagaucuauauuaucgcuggcgccccaaccgacugcgauuguaaaauagacccuaauugcgacuguuuuuccggggauggaggcuacgcaaaggacgcuaaaaugaaggcccccucaucucuggcaguuaguccagaugguacuuuauauguagccgaccucgggaacgugaggauucggacaaucucgcgaaaucaggcucaccugaacgauaugaauaucuacgagauugcgagcccugccgaccaagaacuuuaucaguucaccgucaacggaacgcaucugcacacuuugaaccucauaaccagagauuacguguauaauuuuacauacaacuccgagggcgaccugggcgcaaucaccucuucaaaugggaacagcguucacauucgcagggaugcuggagguaugccccuauggcugguggucccgggcgggcagguguacuggcuuacuaucuccaguaauggaguacucaagcgugucucugcccaaggcuauaaccuggccuugaugacauacccagguaauaccgggcuguuagcuacaaaaagcaacgaaaauggauggacuaccguguaugaguacgacccugaaggccaucucacgaacgcaacauuccccaccggcgagguuucauccuuccacagugaucuggagaagcuuacuaaaguggaacuggacaccagcaaucgggagaacgucuugaugucuacaaaucucacugccaccuccacgauuuauauccugaagcaggaaaacacacagucaaccuacagagugaauccagaugggagccuaaggguuacuuuugcgucgggaauggagauaggucugucuagugagccccauauccuugcuggcgccgugaacccuacacucgggaaaugcaauauuucccugccgggagaacacaacgcaaacuugaucgaguggcgccagcgaaaggaacaaaauaagggcaacgucagcgccuucgagagacgguuaagggcucauaaucgcaaccugcucucaauugacuuugaccacaucacccguacugguaaaauauaugaugaccacagaaaguucacacugcggauucuuuacgaucagaccgggaggcccauccugugguccccagugucucgcuacaaugaaguaaacaucacguauagcccuaguggauuggugacuuuuauucagcgaggcaccuggaaugagaaaauggaguacgaccaguccggcaagaucauaagcagaacaugggcagaugggaaaauuuggucuuauaccuaccuagaaaagucaguuaugcugcuccugcauagucaacggagguauaucuucgaguacgaccagcccgauugccuuuuauccgucacaaugccuagcauggugcgccacucucugcagacuaugcucucggugggauauuacagaaacauuuacaccccacccgacucaagcacguccuuuauccaggauuauaguagggacggucgguugcugcaaacacuccaucugggcacugggcgucgcguccuuuacaaguauaccaaacaggcccgacugucugaaguauuguacgauacaacccaggugacucuaaccuaugaggaaagcuccggaguuauaaagacaauucaccugaugcacgacggcuucaucuguacgaucagauacaggcaaacugguccucucauugggcggcagaucuuucgcuucucagaggagggcuuagugaaugcgagauuugacuauaguuacaacaauuucagggucaccucuaugcaggcugugauuaacgaaacaccacugcccauagaucuuuaccgguauguugacgugagcggacgaaccgagcaguuuggcaaauucuccgucaucaauuacgaucugaaccaagugauuacuacaaccguaaugaagcauacgaaaaucuucucagccaaugggcaggugaucgaaguucaguaugagauucucaaggcaauagccuacuggaugacuauccaguaugacaacgucggaagaauggugauuugcgauauccgcgugggugucgacgcuaacauuacaagguacuuuuaugaauacgaugccgacggccaauugcagaccguuagcgugaaugauaaaacccaguggcgguacucuuaugaccugaacgggaauaucaaccuccugucccacggaaagagugcacgucuuacuccgcuaagauacgaucugagggaccgcauaacacgguugggcgagauccaguauaagauggaugaggacgguuucuuacgacaaagagggaaugacauuuuugaauacaacagcaauggccugcuccagaaagcuuauaacaaggccucgggauggaccguacaguacuauuacgauggccuggggaggcgcguggcguccaaaucuucacuuggacagcaucugcaauucuuuuacgccgaccucacaaauccuauccgggucacucacuuguauaaccauacgagcagugagauuaccucccuguacuaugaucuacagggucaccugaucgcaauggaacucucuagcggcgaggaguacuauguggcuugugacaauacagggacuccacuugccguuuucucauccagaggacaggugauaaaggaaauucuguacacccccuauggcgauaucuaccacgacacauacccugauuuucaagucauuaucgguuuccaugggggcuuauaugacuuuuugaccaaacugguacaccucggacagcgugauuacgacgugguugcuggcagguggacuacgccaaaccaucacauauggaagcagcugaaucuucugcccaagccguucaaccucuauaguuuugagaauaacuacccuguggggaaaauccaggaugucgcaaaguauaccacagacauucggagcugguuggaacuguucggauuucaauuacauaacgugcuacccggcuucccaaaaccugagcuggaaaaucucgagcuuacuuacgagcuguugcgccugcagaccaagacacaggaaugggaccccgguaaaaccauccucgggauucagugcgagcugcaaaagcagcuucgaaacuucaucucucucgaucagcugccaaugacucccagauauaaugacggaagguguuuggaaggcgguaagcagccucgguuugccgccgucccaucaguguucggcaaagggauaaaguuugcuauuaaagauggaaucguuacagcggacaucauuggcguggcaaacgaggauucccgcagacuggccgcuaucuuaaauaacgcccacuaccuagaaaaucugcacuucacgauagaggggagggacacccauuacuuuauuaagcucggaagccuugaggaagaucugguauugaucggcaacacuggugggcgacggauucuggagaauggagugaacgucacaguuucucaaaugaccagugugcucaauggccguaccagacgcuucgcagacauccagcugcagcacggugcccuuugcuuuaacauaagguauggcacaacugucgaagaggaaaaaaaucauguguuagagaucgcucggcaaagagcgguagcccaggcauggacgaaggagcagcgcaggcugcaggaaggggaggaaggaauucgagcuuggaccgagggcgagaagcaacagcucuugucgacagggcgggugcagggauacgauggcuauuucguucuguccguggaacaguaccuagagcugagcgacucagccaacaauauccacuuuaugagacaaucugaaauugguaggcgcuga

SEQ ID NO: 63677 - RNA, 8298 nt, Artificial Sequence
  derived and/or modified sequence opt3 from TENM2__Homo_sapiens__NP_001116151
auggacgugaaggauagaaggcaccggagccugacccgcggccgaugcgggaaggaaugucguuacacuuccucuucacucgacagugaagauugcagaguccccacucagaagucauauuccucuucggagacgcuuaaagccuacgaccaugauucaaggaugcacuauggaaaccggguuaccgaccugauccaucgcgaaagcgaugaguucccuagacaagguacuaauuuuacuuuggcugaauuaggcauuugugagccaaguccgcacagguccggguacugcucugacaugggaauacugcaucagggcuauagccuauccaccgguucagaugcagacagugauacggaaggcgggaugagccccgaacacgccauccggcucugggggcgcggcauuaagucucgaagauccucagggcugagcaguagggagaacucugcgcuuacccugacugacuccgauaaugaaaacaaaagcgacgacgagaauggacggccuaucccacccacaucgucuccuuccuugcucccaucagcucagcugcccaguagccacaacccuccaccgguguccugucagaugccccugcucgauucuaauaccagccaucaaauuauggacacgaacccugaugaggaguucucaccaaauaguuacuuacugcgugccugcuccgguccccagcaggcaucgucuucaggcccuccaaaccaccauagucagagcacucuucgcccaccguugccucccccacacaaucacacccugucccaucaccauucuucggccaacagccuaaauagaaacucccucacaaauaggcggucacaaauccacgcuccugcacccgccccaaacgaccuggcuacuacccccgagaguguacagcuucaggauucuugggugcugaacagcaaugucccuuuggaaacacgacauuuucucuucaagaccuccucagggagcacgccacuguuuucuuccaguagcccgggauaucccuuaacuucuggcacaguguacaccccuccaccccgccugcucccuagaaacacuuucuccaggaaggccuuuaaacuuaagaaaccaucaaaguacuguaguuggaaaugcgcggcacugagcgccauagcugccgcauugcuacuggcuauccuccuggccuauuucauugcgaugcaccuucuggguuugaauuggcagcuccaacccgccgacgggcacacauuuaacaauggaauccggaccggccugccgggcaacgaugacguugcaacgaugccuagcgggggaaaggugccaugguccuuaaagaacucuagcauugauucaggugaggcugaagucggccgcagagugacccaggagguacccccugggguuuucuggaggagucagauccauauaucccaaccccaguuucugaaauucaacauuucucuaggaaaggacgcccucuuuggcguguacauccgucggggucugccaccuagccacgcucaguaugauuucauggagcgacuugacgggaaagaaaagugguccgucguggagucacccagagaaaggcgcagcauucagacauuggugcaaaaugaggccgucuucguucaguaccuggacgugggccucuggcaucuggcauuuuauaacgauggaaaagacaaggaaaugguaaguuucaauacugugguccuugauucugugcaggacuguccacggaacugccacggcaauggggaguguguuuccggagugugccacugcuuuccggguuuccugggcgccgauugugcuaaagcggcaugcccugucuuguguagcgggaacggacaguacucgaagggaaccugccaauguuauucagguuggaagggggccgagugcgacgugcccaugaaucaguguaucgauccaucuugcggcggacauggcaguuguaucgacgggaacugcguauguuccgcuggauacaaaggugaacacugcgaggaaguugauugccucgaccccacauguagcucucauggcgugugcgucaacggggagugucugugcagcccuggauggggcgguuuaaauugugaacuggccagagugcagugcccagaucaguguuccgggcacggcacuuaccuacccgacaccggacucugcucaugugauccuaacuggaugggcccggacugcagugucgagguguguagcguugacugcgggacacauggagugugcauuggcggugcauguaggugcgaggaaggguggaccggagccgcuugugaucaacgcguaugccacccacgauguauagagcacggcacuugcaaggacgguaaaugugaaugccgggagggcuggaauggggagcauuguacgaucgauggaugccccgaccuguguaacggcaaugggcguugcacacuuggacagaacucuuggcagugcgucugucagaccggcuggagagguccugggugcaauguggccauggaaacuuccugugcagauaacaaggacaaugagggagauggcuugguugacugccuggauccagacuguugccuccaaucagcgugucagaacagucuguuaugcagggguagccgcgauccccuggacauuauccagcaaggccagaccgauuggccugcugugaaauccuuuuaugaccggauaaaacuuuuggccgggaaggacucuacacacauuaucccgggagaaaaucccuucaacucgagccucgucucacugaucagaggccaggugguaaccacugaugggacaccccuagugggaguuaaugucuccuuugugaaauacccuaaguauggcuacacgauuaccaggcaggacgguacuuucgaucugaucgcaaacgggggagccagucucacacugcauuuugagcgagcucccuucaugucucaagaacgcaccguguggcuuccauggaauagcuuuuaugccauggacacauuggucaugaaaacugaggagaacuccauuccuucaugugaucugucuggcuucguucggcccgacccaauaaucauuagcaguccguuauccaccuuuuucagcgcagcuccuggucagaaccccaucgugccagaaacacaggugcuccacgaggaaaucgagcugcccggcucuaauguaaaacuuagauaccugucauccaggaccgccggguauaaaaguuugcucaagauuacaaugacucagagcaccgucccucugaaccuaauacgugugcaucugaugguugcgguggaaggacaccucuuccaaaagucguuucaggccucuccaaaucuggcuuacacauucaucugggauaaaacugacgcauacggccagcgcgucuaugggcuuuccgaugccgugguuagcgugggauuugaguacgagaccugccccucauugauucugugggaaaagcggacggcuuuacuccagggcuucgagcuggacccuaguaaccuugguggguggucucuggauaaacaccauauccuaaauguaaaguccggcauucuccacaaaggcacaggcgaaaaccaauuucugacccagcagccggccaucauaacuagcaucauggggaauggaagaaggcgaucaauuaguuguccaagcugcaacgguuuggcagagggcaauaagcuguuagcgcccgucgcccucgcuguggggaucgacggaucccuguaugugggcgacuucaacuacauucggcgcaucuuuccuucuagaaaugucacaagcauacuugaacugaggaacaaggaguucaaacauuccaauaaccccgcccacaaguauuacuuggcaguugauccagugucagguucucucuauguaagugacaccaauucgcggcgaauuuacagagugaaaagccuguccgggacuaaggaucuagcuggaaacucugaggucguggccggcaccggcgaacaaugccugccuuuugacgaggcacgcuguggggauggagguaaagccaucgacgcuacacuuaugucacccaggggcauugcgguugauaagaacgggcucauguacuucguggacgccacgaugauccguaaagucgaucagaauggaauaaucagcacccuguugggcuccaacgaccugacugcagugcggccauuaaguugcgauucuagcauggacguugcucaggugagacucgaauggccuacagaucuggccgucaauccgauggacaacucacuuuauguacuggagaauaacgugauuuugaggaucaccgagaaucaccagguuuccauuaucgccggucgccccaugcauugucaagugccagggauagacuacagucucagcaagcuggcuauucacucugcacuagaauccgccucagcgaucgcuaucagccauacaggaguccuguauauuacugagaccgaugaaaagaaaaucaaccgacuuagacaggugacgacaaauggcgagauuugccuccuggccggcgcagccucggacugugauugcaagaacgacguaaauuguaacugcuacucuggggaugacgcuuaugcaaccgaugccauauugaauaguccuuccagcuuagcgguggcucccgacggaacuaucuacauugccgaucuggguaacauccggauuagggcagucagcaagaauaagccaguucucaacgccuuuaaucaguaugaagcugccuccccuggcgagcaggagcuguacguguucaacgcagacgggauccaccaauacaccgugucucuugucacaggagaauaucuguacaacuuuacuuauagcaccgauaaugacgugacagaguugauagauaacaauggcaacagucuaaaaauccgccgugacuccagcgguaugcccagacaucugcucaugccggacaaucagauuaucacgcugaccguugggacuaacggaggccuuaagguagugucuacacagaauuuagaacugggccucaugaccuacgaugggaacacuggauugcuggcuacaaagucagacgagaccgguuggacgacuuucuaugauuacgaccacgaaggccggcucaccaaugucacaaggccaaccggggugguuacaagucugcaccgcgagauggagaaauccauuacaaucgauauagaaaacagcaaucgagacgaugacgugaccgucauuacaaaccuuucuucgguggaggccucauauacuguaguccaggaucaagugagaaauagcuaccagcuguguaacaauggaaccuugcggguuauguacgcgaacggcauggguaucuccuuccauagugaaccucacgugcuagccgggacgaucacacccaccauuggaaggugcaacauaucucugccaauggagaauggccucaacagcaucgaauggcgcuuaagaaaggagcagauuaaaggcaaggucacuaucuuugggaggaaacugcgggugcauggacguaaucuucuguccauugacuaugaucgcaacauccgaaccgagaagauauacgacgaccacagaaaguucacacucaggaucauuuaugaucagguuggucggcccuuuuuguggcugccuucaaguggccucgcagcugugaaugucucuuacuucuuuaacgggcgccuggccggacuucaaagaggcgcuaugagcgaaaggacugacaucgauaaacagggucggauugugucccgaauguucgcagacgggaagguauggucauauagcuaccuagauaaaucuauggugcuguuguuacagucccaaagacaguauaucuuugaguacgacaguagcgaucgccugcucgccguuaccaugccgucggucgccaggcacuccaugucuacgcauacaucaauaggcuacauucggaauaucuauaaucccccagaaagcaaugcuagugugaucuucgacuacuccgaugacggacguauucugaagaccucuuuucuuggcacugggagacagguguucuauaaauacggaaagcugagcaagcucucagagaucgucuaugauuccacagcgguaaccuuugguuacgacgagacuacaggcguguugaaaaugguuaaccugcagagugggggauucagcuguaccauaagguaucgcaagauuggcccucuaguggauaaacaaaucuaccgguucucugaagaggguauggucaaugcacgauuugacuacacguaucacgacaacucauucagaauugccuccaucaagcccgugauaagcgaaacuccucugccaguugaucucuacagguaugacgagauuucugggaaaguggaacauuuuggcaaguucggagucaucuacuaugauaucaaucagauuaucaccacagcugugaugacccuuaguaaacacuuugacacacauggccgcauuaaggagguacaguacgagauguuccggucgcugauguauuggaugacugugcaguacgauuccauggggagaguuauaaagcgugaauuaaaauugggacccuacgccaacaccacgaaguauacauacgacuaugauggugacggccaacugcagagcgucgcagugaaugauaggccuacuuggcgguacucauaugaccucaacgggaaccugcaccuucugaauccaggaaacucugugcgccucaugcccuugcgauacgaucugagagacaggaucacccgguuaggcgacguccaguauaaaauugaugacgaugguuaccuaugccagcgcgggagcgacaucuuugaguacaauuccaagggccugcucacaagagccuauaacaaagcuaguggauggucaguucaauacagguaugauggcguggggcgacgggcgucuuacaagaccaaucuuggacaccaucugcaguauuucuacagcgacuugcacaacccgacucguaucacccauguauauaaucacuccaacagugaaauuacaagccuguacuacgaucuccagggccaccuguuugccauggaguccucuucaggugaagaguauuacguggcaagcgacaauacggggacuccucuugcugucuucucgauaaacggacucaugaucaagcaacugcaguauaccgccuacggcgagauuuauuacgauuccaauccagacuuucagauggugaucgguuuccauggcggguuguaugauccccugacaaaauuaguucacuuuacccagagagacuacgaugugcuagcaggacgcuggacaaguccugacuacacaauguggaagaacgucggcaaagaaccagcccccuucaaucuguauauguucaagucuaacaauccgcucagcucagagcuugaccugaaaaacuacguaaccgaugugaaguccugguugguuauguuuggguuccaacugucuaacauuaucccuggauuucccagggcuaagauguauuucgugccaccucccuacgaacucagugagagccaggccuccgaaaauggccagcugauaacggguguccagcaaacuacagagcggcauaaccaggcguuuauggcacuugagggacaggugaucaccaaaaaguuacacgccucaauuagagaaaaagcuggacauugguucgccaccacuacaccaaucauuggcaaggguaucauguuugcuauaaaagagggccgcgucaccacaggggugagcucuauugcaagugaagacuccaggaagguugccagcgugcugaauaacgcuuauuaccucgauaagaugcacuauucaaucgagggaaaagacacucacuacuucguaaagauuggcucugccgauggggacuuggugacgcugggaaccacaaucggccgaaaaguccuagaguccgguguuaaugugacugucucgcagcccacccugcucgugaacgggcggacaagaagguuuaccaauauagaguuccaauacagcacucuucuguugaguauccgcuauggacugacgccugauacccucgacgaggaaaaggcacguguacuggaucaggcgcggcagagagccuuaggcacagcuugggccaaagagcagcaaaaggcaagggacggccgcgaagggucucgacuuuggacugagggagagaagcagcagcugcucuccaccggucgggugcaaggcuacgaaggguauuacguucuaccaguggagcaguauccggaacuggcugauagcucaaguaacauucaguuuuugagacagaaugagaugggaaaaagguga

SEQ ID NO: 63678 - RNA, 8100 nt, Artificial Sequence
  derived and/or modified sequence opt3 from TENM3__Homo_sapiens__NP_001073946
auggacgugaaagaaagaaggcccuacugcagccugacaaaaucccggcgcgaaaaggagcgacguuauacaaacucuucagccgauaaugaagaguguagagucccuacucagaaaaguuacagcuccucugaaacgcucaaggcuuucgaccacgauucgucaaggcuucuguauggaaaccggguuaaagacuuggugcaucgcgaggcggaugaguuuaccagacaagggcagaauuucacauuaaggcagcugggaguaugcgaaccagccacucggcgcggucuagcguuuugugcugagaugggacucccgcaccgaggguacagcaucagugccggauccgacgcagauaccgaaaacgaggccgugaugucucccgagcaugcuaugagacuguggggcaggggugucaagagcgggcgguccucaugccuuaguagccguucuaauuccgcacugacauugaccgacacugaacacgagaacaagucagauagcgaaaaugagcagccugccaguaaccaaggacagucuacacuccagccacugcccccuucccauaaacagcacagcgcucaacaccauccaucgauuaccucucugaaucgcaacucccucacgaauagaaggaaccagucacccgccccuccagcggcauuaccggccgaacugcagacuacccccgagagugugcagcuucaagacagcuggguuuugggcuccaaugugccucuggagucucggcacuuccuauuuaagacaggcacugggaccacaccacucuucagcaccgcuacgcccggauauacuauggccucagguagugucuacuccccuccaacacgaccccugccgcgcaacacccuuagcagaucugcauuuaaauucaagaaaucaaguaaguauuguagcuggaagugcacugcucugugugccgugggcguauccguuuugcucgcgauacuguuaucuuacuuuaucgccaugcaucuguucgggcucaauuggcagcuucagcaaacagaaaacgauaccuuugagaacggaaaagugaacucggacacgaugccuaccaacacagucagccugcccuccggcgauaaugguaagcuaggcggguucacucaggaaaacaauaccauugacucaggggagcuagacaucggcaggcgggcaauucaggaaaucccaccugggauauuuuggcgcagucagcuguucaucgaucaaccccaguuccucaaauuuaacauuucucugcagaaggacgcucuuaucggaguguacgguagaaaaggccugccacccagccacacacaguaugauuucguggaguugcucgacggguccaggcugauugcccgugagcaacggucauuacuggaaacugagcgagcuggaagacaggccaggagcgucucucuacacgaagcaggcuuuauccaguaccucgauuccgguauauggcaucuggccuucuauaaugacgggaagaacgcugagcagguuaguuuuaauaccauugugaucgaaagcguaguggagugcccucgcaacugucacggcaauggagagugcgucucuggcacaugucauugcuucccaggguuucuuggaccggauugcucccgggcggcaugucccguguugugcucagguaacggccaauacaguaaagggagaugucugugcuucagcggauggaagggcaccgaaugugacguuccuacuacgcagugcauugauccacaguguggugggaggggcaucugcaucaugggaucgugugccugcaauuccggcuauaagggggagucuugugaagaggcugacugcauugaucccggaugcagcaaccacgguguguguauacauggcgagugccacuguucaccuggguggggaggcaguaauugcgaaauccucaaaacaauguguccagaccagugcuccggucacgggaccuaccugcaagagucuggcagcuguacuugcgaccccaacuggaccggaccggauuguuccaacgaaauuugcucagucgacuguggcagccauggggugugcaugggaggcacaugccgcugugaggaagguuggaccgggccugccugcaaucagcgagcaugucacccacggugcgccgagcauggaacuuguaaggauggcaaaugcgaguguagucaggguuggaacggcgaacacugcacaaucgaggggugucccggacuuugcaauucuaacggccguuguacgcuggaccaaaauggguggcacugcguaugccagccuggauggagaggcgcugguugugauguugccauggaaaccuugugcacugacuccaaggauaacgagggggacggacucauagauuguauggaccccgauugcugucugcagagcucgugccagaaucaaccauauuguaggggcuuaccugacccccaggauauuaucucacagucucugcagaguccaucccaacaggcagcuaagagcuuuuacgaccgcaucucuuuccuaauugguagcgacuccacacaugugaucccgggcgaaucaccuuuuaacaagagucucgcgagcgucauucggggacaggugcugaccgccgauggaacaccccuuauaggcgucaaugugucuuucuuucacuacccagaguauggguacacuaucaccagacaggacggaauguucgauuugguugcaaacggcggugccucccugacgcucguguucgagaggucacccuuucugacccaauaucauacaguauggauuccuuggaaugucuucuacgugauggacacuuuaguuaugaagaaagaagagaacgauaucccaaguugcgaccugagcggguuugugcgacccaauccuaucauugucuccucuccgcuuucgaccuucuuucgcagcucaccagaagauucccccauaaucccugagacacagguguugcacgaagagacuaccauuccaggaacggaccucaagcugaguuaucuaucuagccgggcugccggcuacaaauccguacugaagaucacaaugacccagucaauuauccccuucaaccucaugaaagugcaucugaugguugcagucguggguagacuuuuucaaaagugguucccugcuucuccgaauuuggccuauacuuuuauaugggauaagacagacgcguacaaccagaaaguguacggccugagcgaggccgucguuagugugggguaugaauacgaguccuguuuagaucucacccugugggaaaagaggacugcuauccuucagggauaugagcuggacgcaagcaacaugggcggguggaccuuggauaaacaccacgugcucgacguacagaauggcauucuguacaagggcaacggugagaaucaauucaucucucagcagcccccagucgugucauccauuauggggaacggacgucgccggaguaucagcugcccuucguguaauggccaggccgacggcaacaaacuacuggcucccguugcccucgcaugcgggauagauggaucucuguaugugggugacuuuaauuacgucagaaggauuuucccauccggcaacgugacaagcguucuugaauugucaaguaauccugcgcaucgauauuaccuggccacggaucccgugaccggggacuuauacguaucugauacuaacacacggcgcaucuauagaccaaagucccucaccggagcuaaggaccugaccaaaaaugccgaggucguggcaggcacuggugaacaaugccuuccguuugaugaggcuagguguggggacggaggcaaggccguggaagcaacccugaugagcccuaaaggcauggccgucgauaagaacgggcuaauuuacuucguugacggaacgaugauccggaaaguggaucagaaugguauaaucucaacacuccugggcaguaacgacuugaccagcgcucgaccccugacuugcgacaccuccaugcacauuucucagguaagauuagaguggccaacagaucucgcgaucaaucccauggacaacagcauuuaugugcuggauaacaaugucgugcuucagaucacugagaaccgccaaguuaggauagccgcagggcguccuaugcauugucaggugccaggagucgaauaccccgugggcaagcacgcuguucagaccacacuggaguccgccacggccauugcugugucauauucuggugucuuguacaucaccgaaacugacgagaaaaagaucaaucggauuagacagguaacaaccgauggggaaaucagucucguggcaggcauuccuucggagugcgacuguaagaacgaugccaauugcgacuguuaucaaagcggcgauggcuacgcgaaagacgcuaagcuguccgccccgucuucacuagcagccagcccagaugggacucuguacauagcugaccuuggaaacaucaggauucgcgcaguuuccaaaaauaagccccuccugaacaguaugaauuucuaugagguggccucuccuacagaucaggaauuguacaucuuugacauuaacgguacccaucaguauacggucagccuggugacuggcgacuacuuauauaauuucucauacuccaacgauaaugacaucaccgcgguaacagauaguaacgggaauacccuccgaauaagacgggaccccaacaggaugccagugcgcgucguuagcccugauaaucaagugaucuggcugacuauuggaacaaacggcugccuuaaaucuaugaccgcucagggucuggaguuggugcucuuuacauaucacgggaacuccggacugcuagccacuaagucagacgaaaccggcuggacgacauucuuugauuacgacagcgagggccgucugaccaaugucacuuuccccaccggggugguuacaaaccuucacggagauauggacaaggcaaucacuguagauauugaaucgucuaguagagaggaggacguguccaucaccagcaaucucucauccauagauucuuuuuacacgaugguccaggaccagcugcggaacagcuaucaaauugguuacgacggcaguuugaggaucaucuaugccuccggguuagauagccauuaccagacagaaccacacgugcuggcuggaaccgccaauccuacuguugcaaaacgcaacaugacacucccgggcgagaauggucagaaccugguggaauggcgauucagaaaggagcaggcucaagggaaagucaauguguuuggacggaaacuuaggguaaacggccgcaaucuguugucugucgacuucgauagaaccacuaaaacagagaagauuuaugacgaucauaggaaguuucuacugcggauagccuacgacaccucaggccaccccacgcucuggcugccaaguuccaaacuuauggcggugaacguuacuuauagcucuaccgggcagaucgccucgauucagcguggaacaaccucagaaaagguggauuacgacggucagggccgcaucgucagccgaguguucgcagaugggaaaacaugguccuacacuuauuuagagaagaguaugguucugcucuugcacucucaaagacaguacauuuucgaauaugacaugugggauaggcugagcgcuaucaccaugccuuccguggcccggcauacgaugcagacaauacgcucaaucggauacuauagaaauauuuacaaucccccagagaguaaugcuucuaucauuacugacuauaacgaagagggccuccugcuucaaaccgcauuucuggguacaagcaggcgggucuuguucaaauaccgaagacagacccgccuauccgagauccuguacgacucaacuagggugagcuuuaccuaugaugaaacagccgggguacucaagacggugaacuuacagucugacggcuucauauguacuauucgguaccgucagaucggaccucugaucgauagacaaauuuuuagguucuccgaggacggcaugguuaaugcccgcuuugauuauaguuacgacaacagcuuccgggucaccucgaugcagggggugaucaaugaaacaccccuuccgauagaucuguaucaguuugacgauauuuccggaaagguggagcaguucgguaaauuuggcgucaucuacuaugacauuaaccaaaucauaucuaccgcuguaaugacuuacacaaagcacuucgaugcgcaugggcgaauuaaagaaauccaguacgagaucuuuagaucacucauguauuggauuaccauccaguacgacaauaugggaagggugacgaagcgcgagauuaaaauaggcccauucgcaaacacuacaaaguaugccuacgaauaugauguugacggucaguugcaaaccguguaccugaaugagaaaaucauguggcgguauaacuacgaccucaaugggaaccugcaccuucuaaauccuagcaacagugcuagacugacccccuugcguuacgauuuaagggaccggauuacucgccugggcgauguccaguaucgacucgacgaagauggauuccugagacagaggggcacagagaucuuugaauacuccucuaaggggcuucugacccggguguauagcaagggaucagguuggacaguuaucuaccgcuaugacggccucgggagaaggguguccaguaaaacuagcuugggacagcaucugcaauucuuuuacgccgaucuaacguauccaacccgaauuacacacgucuacaaucacucuucauccgagauaacuagccuguacuaugaccuccagggccaucuuuucgcaauggagaucucuaguggugaugaauuuuacauugccucggacaacaccgggacaccccuggcuguguucuccagcaauggcuuaauguugaagcagauccaauauaccgcguacggagagauuuauuuugauucaaacaucgacuuccagcugguaauaggcuuucacgggggacucuacgacccucugacuaaacuuauccauuucggcgaacgggauuaugacauucuggccggucguuggacgaccccggauaucgagauuuggaagagaaucgggaaagaccccgcaccauuuaaccucuacauguuccgcaauaacaauccugcuucuaagauacacgaugugaaggacuacauuacagauguuaacagcugguuggucacuuuuggauuccaucugcacaaugccauccccggcuucccugugccaaaauuugacuuaaccgagcccuccuaugaguuggugaagagucagcagugggaugacauuccuccaaucuucgguguccaacagcagguugcaaggcaggccaaggcuuuucugucacucggcaagauggccgaggugcaaguaucucggagacgcgcagggggagcacagagcuggcuuugguucgccacagugaaaucccugauaggcaagggggucauguuggcugugagucagggaaggguucagaccaacgugcugaauaucgccaacgaagauugcauuaaggucgcugcaguacucaauaacgccuuuuaccuggagaaucuucacuucacuaucgaaggcaaagacacacauuauuuuauuaagacgaccacucccgagagcgaucucgguacacugcgauugaccuccgggcggaaagcucuggagaacggaaucaaugugaccguuucucaaucaacaacuguggucaacggcagaacgaggcgcuucgccgacguggaaaugcaguuuggugcauuagcgcuacacguccguuacggcaugacccuggacgaggaaaaggcccggauacucgagcaggcuagacaaagggcccuugcacgcgcuugggcccgagaacagcagcgggugagagauggggaggagggagcaaggcuguggacagaaggcgagaaacgccaguugcugagcgccgggaagguucaaggauaugacggcuacuaugugcucucgguagaacaguacccggagcuggcugauuccgcgaauaacauucaguuccuuagacagagugaaaucggucggagguga

SEQ ID NO: 63679 - RNA, 8310 nt, Artificial Sequence
  derived and/or modified sequence opt3 from TENM4__Homo_sapiens__NP_001092286
auggacgugaaggagagaaaacccuacaggagccugacccggcgccgagaugccgaacguagauauaccuccucuucagcugacagugaggaaggcaaggcaccucagaaaagcuacuccucuucggagacucucaaggccuaugaucaagacgcgaggcuugcuuacgggucacgggucaaagauauaguuccacaggaagccgaggaguucugccgcacgggggcaaacuuuacccugagagaauuggguuuagaggaagugacaccgccccacggcacucuguauaggaccgacauuggguuaccucauuguggauacagcaugggcgccgguagugaugcugacauggaggcagauacaguccucuccccagagcaccccgugcggcugugggggcgcucuacccgaagcggaagauccucaugccuuaguagcagggccaauucuaaccugacuuugacagacaccgaacaugagaauacggaaacugaucacccuggcggccuccagaaccaugcucggcugcguaccccacccccuccacugucccacgcccacacaccgaaucagcaucacgcggcaucaauaaacagccucaaucgcgggaacuucacucccagaaguaauccuucuccagcccccaccgaccauuccuuaagcggagagccuccagcugguggcgcccaagaacccgcacacgcucaggagaacuggcugcuuaauucgaacaucccguuggagacaaggaaucuggggaagcagccuuuucucggaacccuccaggauaaccugauugaaauggacauccuuggcgccucucggcacgacggugcguauuccgaugggcauuuccuguuuaagcccggaggcacgucaccauuguucuguacuacaaguccuggcuacccccucaccagcuccacugucuacucuccacccccucgaccacugccgcgcagcacauuugccagacccgcauucaaucugaaaaagccuucaaaauauugcaacuggaagugugcugcccuaagugcuauugugaucuccgccacccucguuauacuucuggcauacuuuguggccaugcacuuguucgggcuaaacuggcaucugcaaccaauggagggacagauguaugaaaucacggaggacaccgcuagcucuuggcccgucccuacagaugugucacucuacccaagugguggcacugggcuggaaacccccgacaggaaaggaaagggcacaacugaggguaagccgagcuccuuuuucccugaggauucuuuuauugacucgggggaaaucgauguaggccggcgcgcgagccagaaaauuccacccggaaccuucuggagaucccagguuuucaucgaccacccugugcaucuuaaguuuaaugucucacugggcaaagcagccuugguggggauauauggaaggaagggucuacccccaagucacacacaauucgauuuuguggagcuguuagacggccgucggcugcuaacccaggaagcucgaucucucgaggggacuccuagacagagcaggggaacgguacccccauccucacacgaaacaggcuucauucaauaccuggauagcgguaucuggcaucuugccuuuuauaacgacgggaaagagucugagguuguguccuucuugaccacugcaauugaaaguguagacaauugcccgagcaacuguuacggcaauggagauugcaucucuggcaccugucacugcuuucugggguuccucggaccugacuguggucgcgccuccugccccgugcugugcucaggcaacgggcaguacaugaagggacggugucuuugccauaguggcuggaaaggugcugagugugaugucccaacaaaucagugcaucgacguggccuguagcaaccacgggaccugcauuacuggcacauguauaugcaaucccggauauaagggcgaaucgugugaggagguugauugcauggacccuacguguuccgggagaggagugugcgucaggggcgaaugccacuguucuguggguuggggagguaccaacugcgagacuccacgcgcaacaugucuggaucagugcagcggccaugguaccuuuuugcccgacacaggccucuguucaugcgauccuaguuggacugggcacgacuguuccaucgaaauuugcgcggcugauuguggaggccaugggguaugcguuggaggcaccugucgaugcgaggacgguuggaugggggccgcaugcgaucaacgggccugucacccgcguugcgcugaacauggaacguguagagacggcaagugcgaguguucuccagguuggaauggcgagcacugcaccaucgcccacuaccuggacaggguggucaaagaagggugucccggauuaugcaacggcaaugggcgcuguacacuggaucuaaacggauggcauugcgugugucagcucggcuggcggggugcagggugcgacacuagcauggagaccgcuugcggagauuccaaggacaaugauggcgacggucuggucgauuguauggacccugauugcugucuucagccauugugccacauaaacccccugugucucggcucaccuaacccgcuggacauuauccaggaaacacaagugcccguuagccagcagaauuuacauaguuucuaugauagaaucaaauuucugguggggagggacucuacucacauuaucccaggagagaacccuuucgauggcgggcaugccugcguaauucgaggacaggucaugaccuccgacggcacgccccuuguggguguuaauaucagcuuugugaacaauccauuguucggguacacaaucucgcgccaagacggaucauucgaucucgucaccaacggcggcauuucuaucauccugcgguuugaaagagcgccuuucauuacucaggagcacacacuauggcugcccugggacagguuuuucgugauggagaccauaaucaugcgucacgaagagaaugaaauuccaaguugugaucucuccaacuuugcccgcccgaauccuguagugagccccucuccacugacuagcuucgcuuccucaugcgcagagaaggggcccaucguuccugaaauucaggcccuucaggaggagaucaguauaagcggauguaaaaugcgguugucuuaucuguccucaagaaccccagguuacaagagugucuuaaggaucagccucacacaucccacgauuccuuuuaaccugaugaaggugcaccuuaugguggcugucgaaggccgacuguuccggaaaugguuugccgcagcgccggacuuguccuauuacuucaucugggauaagaccgacguuuacaaucaaaaaguguuugggcucucugaggccuucgugucgguaggauaugaauacgagagcugcccagaucugauucuaugggagaagcgcacuacaguccugcagggcuaugaaaucgacgcuucaaaacucgguggguggucccuggauaagcaucacgcccuuaacauacagaguggaauuuugcacaagggcaauggcgagaaccaauuugugucucagcagcccccuguuaucgggagcauuaugggaaaugguagaaggcgguccaucucaugucccucuugcaacggccuggcagacgggaacaaauuacucgcuccaguggcccugaccugcggaagcgauggcagucuuuacgucggugacuucaauuauauacgaagaaucuucccuuccgggaacgugacaaauauucuggaacuacgcaacaaggacuuuaggcauagccacucucccgcacauaaauacuaucucgccacugauccaaugucaggagcuguuuuccuguccgacaguaauagccgucggguguuuaagaucaaaucgaccguagucgugaaggauuuggugaagaacucugaggucguugcgggcacgggcgaccagugucugccuuucgaugacacaagaugcggggauggagguaaagccaccgaagcaacuuuaaccaauccgaggggcauuacaguggacaaguuugggcucaucuacuucguagauggaacuaugauacgccgaauugaccaaaacggcaucaucuccacccugcuugguagcaaugaucugacaucagcuagacccuugaguugugacucugugauggauauuucccagguccaccucgaguggccaacggaccuggccaucaacccuauggacaauagccuauacgugcuggauaacaauguugugcuucagauuucagagaaccaucagguccggauaguggccgggaggcccaugcacugccaaguuccaggaaucgaccacuuucuccugaguaaaguggcuauucaugcaaccuuggaaagcgccacugcgcuggcugucucccacaauggcguauuauauaucgccgagacagaugaaaagaaaauuaaccgcauccgucaggugaccacuucuggcgagauaagccucguugcaggggccccuuccggaugugacugcaagaacgaugcuaauugugacugcuucucaggugaugacggcuacgcaaaagaugccaagcugaacacacccucuagucuugcggugugugcugacggggaacuguaugucgccgauuugggaaauauccggauuagauuuaucaggaagaacaaaccguuccucaauacccagaacauguacgagcugucgagcccaauugaccaggagcuauaucuguuugauacgacuggcaagcaucuuuacacccaaucccucccuacaggugacuaucuguacaauuucaccuacacuggggacggagauaucacauugauaaccgacaacaauggcaacauggugaauguacgccgagauucuacaggcaugcccuuauggcugguggucccagacgggcagguuuauugggugacuaugggaaccaacucagcacucaaaagcgugacgacacagggucacgaacuggccaugaugaccuaccacggcaauuccgggcuucuggcuacuaagaguaacgagaauggauggaccacauucuaugaauacgauucuuuuggcagauugacuaacgucaccuuccccacgggucaagugagcucauuucgguccgacacagauaguagcguucauguacagguggagaccucuuccaaagacgaugucacuauuacaaccaaucuaucagccagcggggcauucuauacucugcuccaggaccaggugaggaacucguacuauaucggcgcugauggaucucugcgccuuuuacuggccaacggcauggaaguugcgcuccaaacagagccucacuugcuggccgggaccgugaauccgacggucggaaagagaaacgugacucuccccaucgacaauggucugaaccuuguagaguggaggcagcggaaggaacaggcacguggccaggucaccguguuugggcgccgacugagaguucauaauaggaacuugcuaagucuggacuucgaucgggugacacgcaccgagaaaauuuacgacgaucacagaaaguuuacacucaggauauuauacgaccaagcuggacggccaucccuguggagcccuucaucccgacuuaauggcgucaacgugacuuauucucccgguggguacaucgccggcauucagagaggaaucaugagcgaacgcauggaguaugaucaggcuggcaggauuaccagucggaucuucgcagacgggaaaacgugguccuacacauaucuggaaaagagcaugguucucuugcugcauucucagcgucaauacauauuugaguucgauaaaaaugacagacucucaagugugacuaugccuaacgucgccaggcagacccuggagacaauccgcuccgugggauauuaccggaauauuuaccagccacccgaagguaacgccagcguaauccaggauuuuaccgaggacggccaccuucuacacacuuucuaucuggggaccggacgaagagugauuuacaaguauggcaaguugucuaaauuagcugaaacacuguacgauacgacuaagguuucguuuaccuaugacgagacagcggguaugcucaaaaccaucaaucugcaaaacgagggguucacuugcacaauaagguaccgccagauuggcccucuuaucgaucggcagaucuucagauuuaccgaagagggaauggucaaugcacguuucgacuauaacuacgacaacucauuuagggugacgagcaugcaagccgugauuaaugaaacuccacugcccaucgaucucuaccgguaugacgaugucuccggcaagacagagcaguucgggaaauuuggaguaauauacuaugacauuaaccagaucauuaccaccgcugugaugacucauacaaagcacuucgaugccuacggccgcaugaaggaaguucaguaugagaucuuucgaaguuugauguacuggaugaccgugcaauaugacaauauggguagagucgugaaaaaggagcugaaaguugggccguacgcaaacacaacuagguacucuuaugaauacgaugccgacggacagcuacagacggugagcauaaaugauaagccucuguggcgguauuccuacgaccucaacggcaaucuucaucuguuaucaccagguaacagugcucgcuugacaccccugagauaugauauuagggaccgaaucacacggcucggcgacguccaguacaaaauggaugaggacggguuccugcgucaaagaggaggcgauaucuuugaauauaauucugcggggcuucugauuaaggccuacaaccgcgcaggaagcugguccgugagguaccgguaugacggccucgguagacgcguaucaagcaaaucuucccacagucaccauuugcaguucuuuuacgcugaucugacuaauccuaccaaggugacacacuuauauaaccauagcucguccgagaucaccucucuauacuaugaccugcaggggcaccucuucgccauggaacuuucaagcggagaugaguuuuacauugcaugugacaauauaggcacuccacuggccguuuucagugguacgggcuugaugaucaagcagauucuguauaccgcuuacggggagaucuacauggauacaaaccccaauuuccaaaucauuauaggauaucauggcgggcucuacgacccgcugacuaaacuuguccacaugggaaggcgagauuaugacgugcucgccggccgguggaccuccccugaucacgaacuguggaagcauuugucuagcucaaacgugaugcccuuuaaccuguacauguucaaaaauaacaauccaaucuccaacagucaggacauuaagugcuuuaugacagacgucaauagcugguuacuaaccuucgguuuucagcugcacaacguuaucccuggguaucccaaaccagauauggacgcgauggagcccucuuacgaacucauucauacucaaaugaagacacaggagugggauaauucaaaguccauccuuggagugcagugcgagguacagaaacaacugaaggcauucgugacguuggaaagauuugaccagcuguauggcagcaccauaacuucuugucagcaggccccuaaaacaaagaaauucgcuaguucgggcuccgucuuugggaagggagugaaguucgcccucaaagaugguaggguuaccaccgacaucauuagcguggcuaacgaggauggccgccgugucgcagccauccugaaucacgcucauuaccuugaaaacuuacacuuuacaauugacgggguagauacucacuacuucgugaagccaggaccgucagagggcgaccuggccauccucgguuugucugggggacggagaacgcuggaaaauggcguuaacgugaccgucagccaaauaaauacagugcuaaacggcaggacucgccgauauaccgauauucagcugcaguacggggcacucugccuuaauacacgguauggaaccacucuggacgaggagaaagcgagagucuuggaacuggccaggcagcgcgcugugagacaagccugggcacgggagcagcagaggcuccgugaaggugaggaaggccugcgagcuuggacggagggggagaagcagcaaguuuuauccacaggacgcgugcagggcuacgauggauuuuucguaaucaguguggaacaguaucccgagcuuucagacucugccaacaacauucauuucaugagacaaagcgaaauggggcggagguga

SEQ ID NO: 63680 - RNA, 7884 nt, Artificial Sequence
  derived and/or modified sequence opt3 from TEP1__Homo_sapiens__XP_005268084
auggagaagcugcacggccaugugagcgcccaccccgacauccucucccuugaaaacagaugccuggcuauguugccugauuuacagccacuggagaaacugcaucagcacgucucuacccauucagacauucucagucugaagaaucagugucuugccacucugccggauuugaaaacuauggaaaagccccacggguacguuagcgcccacccugacauacucucccuggagaaccagugccuggcgacgcucucugauuuaaaaaccauggaaaagccacauggacacgugucggcucaucccgacauccugucacuugagaauagauguuuggccacacugagcagucuaaaguccacugugucugcaagcccucucuuccagucccugcaaauuucacacaugacccaggccgaucuuuaucgggugaacaauaguaacugccuguugagcgagccacccucuuggcgcgcucagcacuuuuccaaaggucucgaccugucaacauguccuaucgcauuaaagagcauuagugccaccgaaacugcucaggaggccacacugggccgaugguucgauucugaagagaaaaagggggcggagacccaaaugccauccuacagccucucgcuuggagaagaggaagaggucgaagaccuggcagugaaauugacgucuggcgauuccgagucacauccggagcccacugaccacguucuacaggaaaagaagauggcccugcucagucugcuuugcagcacccugguguccgaggucaauaugaacaauacaucugauccuacuuuggcugccaucuuugaaauaugucgugagcucgcacuguuagaaccagaguucauccugaaagcuagccuauaugccagacagcagcucaacgugaggaauguggcgaacaauauucuggccaucgcagcuuuucuucccgccugccggccucauuugcgcagauacuucugugcuauuguucaacugccaucagacuggauccagguggccgagcucuaucagagucuggcagaaggugacaagaacaaacuugucccccugccggccugcuugaggaccgcuaugacagauaaguuugcgcaauucgacgaguaccagcucgcaaaauauaauccucggaagcaccgcgccaaacgacaucccagaaggccaccucggucccccgggauggaaccacccuuuagccaccguuguuucccucgcuacauaggauuucugagagaggaacagaggaaguucgagaaggcuggcgauaccgugucugagaaaaagaacccaccgcgguuuacgcuaaagaaacuggugcagcgacuacacauucauaaacccgcccaacacguccaggcacuccugggcuaccgcuauccuucaaaccuucaguuguucaguagaagcaggcugccagggcccugggacuccucucgggccggaaagcgcaugaagcucucgagaccugaaacuugggagagggaacugagcuuacgugguaauaaggcuuccguuugggaggagcugaucgaaaacggcaaacuuccauucauggccauguugcggaaucucugcaaccugcuacgaguggggauuucaaguagacaucacgagcugauccuccagaggcugcaacacgcaaaaucuguaauccauagccgccaguuucccuuccgguuucuuaaugcgcacgaugcuauugacgccuuggaagcacagcugagaaaccaggccuuaccguucccuuccaauauaacacucaugaggcgcauccugacccgaaacgagaagaaucggccacguagaagguuucuuugccaucugucacgccaacaguugcggauggcuaugaggauuccagugcucuacgaacagcugaaaagagagaagcuacgaguccacaaggcccgccaguggaaauaugauggagagaugcugaaccgguacagacaagcacucgaaacugcugugaaucugagcguuaagcauucucuuccuuugcugcccggcaggacaguguuagucuaucucaccgacgccaacgcggaucgucuguguccaaaauccaauccucagggucccccacuuaacuacgcccugcuacucaucgggaugaugauaacgcgcgcugaacaaguggacguaguucugugcggaggcgauaccuugaagacagcagugcugaaagccgaagagggcauuuuaaagacugcuaucaagcuccaagcccagguccaggaguucgacgagaaugacggguggagucugaacaccuuuggaaaauaucuucugagcuuggcaggucagcgggugccggucgauagagugauccuccugggccaaucuauggacgaugggaugauuaacguugcgaagcagcuauacuggcagaggguaaauuccaaaugucuguucguaggaauccuucuccgacggguccaguaccugucaacagacuugaacccuaaugaugugacucugaguggcugcaccgacgccauuuuaaaguuuauagcugagcacggugccagccaccuccuggaacauguugggcaaauggauaaaaucuucaagauucccccacccccuggcaaaacaggagugcagucgcuucgcccacuggaggaagacacccccuccccuuuggcaccggucucucagcagggcuggagaagcaucaggcucuuuaucucaaguacuuuccgggauaugcacggggagcgagaccugcuacugagauccgugcuuccagcucuccaagcccgcgcagcaccccacaggauuucucugcacggaauagauuugcguugggguguaacggaagaggagacacggagaaacaggcaguuagaagugugucugggcgagguugaaaaugcucagcucuuugucgggauccugggaagccgcuauggcuacauuccuccauccuauaaccuucccgaccauccucacuuccacugggcgcaacaguacccgucaggucgaagcgugaccgagauggaggugaugcaguuccugaauagaaaccagcgguugcaacccagugcccaggcacuaaucuauuuuagggauucuuccuuccugagcucggucccagacgcuuggaagucagacuuuguuucugaaagugaggaagccgcccgccguauuuccgagcucaagagcuaccugucuagacagaaagggaucacuugccggagguauccuugugaauggggcggaguggcugcaggccgccccuacguagggggacuugaggaguucggucaguuaguacugcaagaugucuggaauaugauacagaagcucuacuugcagccaggcgcccugcucgaacagccugugagcauccccgacgaugaccugguucaagcgaccuuucagcagcuucagaaaccaccguccccugcucgacccagacuguugcaagauacagugcagcggcuaaugcugccacaugggaggcucucauuagucaccggacagaguggccaagguaagacugccuuccuggcaagccuugugucugcccugcaggcucccgacggggcaaaaguugccucccucguguuuuuccacuuuucaggcgcgcgcccugaucagggauuggcucugacacuccugagaaggcuuugcacguaucuacggggccagcugaaggagccaggggccuugcccaguaccuaccguagcuuaguaugggaacugcaacagcgccuccugccuaaguccgcagagucucuucauccgggacagacucagguccugauuaucgacggcgccgaucgacucguggaccaaaacggucaguugauuucggauuggauccccaaaaagcugcccagaugugugcaccuaguccugagcguuucauccgacgcugggcucggagaaacacuugagcagagucagggcgcccacgugcuggcauuagguccuuuggaggcuucugccagggcgcggcugguacgcgaggaacucgcccuguauggcaaaagacuugaagagagccccuucaauaaccaaaugaggcugcucuuggugaagcgggaauccgggcgaccacuguacuuaagguuagucaccgaucaucugcgccucuuuacacuuuaugaacaggugucagagaggcugcggacuuugccugcaaccguuccccugcuccugcagcacauacuuucuacgcucgaaaaagagcauggaccagacgugcugccucaggcuuugaccgcccuggaagucacacguagcggcuuaacuguggaccagcuacacgggguucugaguguguggagaacccucccgaagggaacaaaguccugggaggaggcugucgcagccggcaauagcggugaucccuacccaauggggccuuucgccugccuuguacagucucugaggucauugcugggagaaggcccccucgagcgcccaggugcucggcugugucuuccugacggccccuuacgaacugcggcaaaaagaugcuaugggaagaggccgggacuggaagauaccgcccauauucucaucgcugcccaguuguggaaaacgugcgacgcagaugccuccggcacauuucgcaguuguccaccugaggcucugggggaccuacccuaccaucugcuccaaagcggaaaccggggccuucugucgaaguucuugaccaaucugcacgugguugcggcccaucucgaacuggguuuagugucuagacuucuggaggcacacgcucucuacgccuccagcgucccaaaagaggaacagaagcuacccgaggcagauguggccguauuccguacuuuucugaggcagcaggcuucaauuuugagucaauauccucggcugcucccgcagcaggccgcgaaccagccccuugacucuccacugugccaucaagcauccuugcugagccgccgauggcaccuccagcacacauuaagauggcugaacaagccuaggaccaugaaaaaucagcagucaaguagccuuucccuggccgugucuagcucccccacugcugucgccuucucaaccaacgggcaacgggcugcaguuggaacagccaauggcacgguguaccuacucgaucugcgcaccuggcaggaagagaagucuguggucagugguugugacggcaucucggcuugcuuguuucugagcgaugacacucucuuccuuacagccuuugacgggcuguuagaacugugggauuugcagcauggauguagagugcuccaaaccaaagcacaccaguaucagauaacaggcugcugucuguccccugacugcaggcuacuugcgacuguuugucuagggggaugccucaagcugugggauaccguacgaggccaguuggccuuccaacauacguacccaaaaucucugaacuguguggcuuuucaccccgagggucaggucaucgccacagggucaugggcaggaagcauuuccuucuuucagguggacggccucaagguuaccaaagaucuuggcgcuccuggggccaguauccggacucuggcauucaaugugccaggaggugucguggccguaggccguuuagacucuauggucgagcugugggcuuggagagaaggggcgcgcuuggccgcauuucccgcucaucacggauucguggccgccgcacucuuccugcacgcuggcugccagcuacuuaccgccggugaggaugggaagguucaaguguggagcggaucacugggcaggccgcggggccaucucgggucccugaguuugagcccugcguuaucugucgcucuguccccagacggagauagaguggccguugguuaucgcgcagacggcauuaggaucuacaagauaucaagcgggucgcagggagcccagggccaggcucucgauguggcagucucugcccuugcguggcugagucccaaagugcuaguauccggugcugaagacgggagccugcaaggaugggcccucaaggagugcucauugcagucccuguggcuucugucucgauuucagaaaccugugcucggcuuagcaacaagccaagaacuguuggccagugcuuccgaggauuucacuguucagcuguggccacggcagcuccuuaccagaccccacaaggccgaggacuuuccguguggcacagaacugagggggcaugagggaccugucagcugcuguucuuucucaacggacgguggcagucuagcaaccgggggacgcgaucguucccugcucugcugggacgugcggacucccaaaacaccaguguugauucacagcuuuccugcuugucacagagauugggucaccggcugcgccuggacuaaggacaaccugcuuaucucuuguucgucagaugguagcguagggcugugggaccccgaauccggacagagguuaggccaauuccucggccaucagagugcggugucugccguugcagcuguggaggagcacgucgugagcguuucccgcgaugggacacugaaggugugggaccaucagggagucgaauugaccucaaucccagcccacaguggucccauuucucauugcgcagcugccauggagccucgagccgcgggccagccagggagcgaacugcucgugguaacggugggacuugauggcgcuacucggcuguggcacccgcuacugguuugucaaacccacacacucuugggucauuccgggcccgucagagcagccgcugugucagagaccagcggacugauguuaacugccucugaagacggcuccgugaggcuuuggcaggucccuaaagaggcagaugacacaugcaucccacgcaguagcgccgcuguuaccgcgguggccugggcacccgauggcucgauggcuguauccgggaaucaggccggagagcugauucucuggcaggaagcaaaggccguggcuacagcccaagcgccuggucacauaggcgcacugaucuggucuucagcccauacauuuuucgucuugagcgcugacgagaaaauuagugaauggcaagugaagcugagaaaaggguccgccccaggaaaccucucucuucaccugaaucggauccuacaggaggaccugggcguuuuaaccagccucgauugggcacccgacggucauuuucugauuuuggcuaaggccgaucuuaagcugcucuguaugaaaccuggggacgcuccgucagaaaucugguccaguuauacggagaacccaaugauacugagcacacacaaggaguacggcaucuucguguugcaacccaaagauccuggaguccugucuuuucuaaggcagaaggaaucaggcgaguucgaggagcgucucaauuuugacauuaaccuugaaaaucccucccgaacccugaucagcauuacucaggccaaaccagagucugagaguucguucuuaugcgcauccagcgaugggauccuguggaaccucgcgaagugcucaccugaaggagaguggaccacagguaauauguggcagaagaaagccaacacucccgaaacccaaacgccaggcacagacccgucuaccugucgcgagagcgaugcuuccauggacagugaugccucaauggacucugagccuacuccccaccugaagacaagacagcggaggaaaauacauagcggguccguaaccgcauugcacgugcuuccagaacugcucguuacugcuaguaaggaccgcgaugugaaacugugggagagacccagcaugcagcuauugggacuguuccggugcgaaggcuccgucucuugucucgagccuuggcuuggugccaacucaacacugcaguuagcagugggggacguccaaggcaauguguacuuucugaacugggaauga

SEQ ID NO: 63681 - RNA, 897 nt, Artificial Sequence
  derived and/or modified sequence opt3 from TEPP__Homo_sapiens__NP_950247
augggcaucgugugcgcccaguguagcuucauucugcuccuuuccauaaucagagcuaggcccccuccauuucuguucugcccguugucuucacaacggaccgagagucccuacaagccuguccacuuagggcugggaccaacagacaaaguugcagccauugcgauggcucgcaucauugaucuagugcccugggacgaugguagcacucauguauaugccuccccugcaauccuccugccaauggaacgacagcguaaccagcuugccggcgugaagcagcaacuguaccaccccgcuuugccuacgcucagacauauggacagggauaccgucaaagcaugucugccagacgagcacugccagucuacaacuuauugucggaaggaugaauuugacaaugcccauuucacccugcucggggugccgaacaaacccuuacagugccuggauauaacagcuaccggacagaaacuucgcaauagauaccacgagggcaaguuggccccuaucgcgccagguauuaacaggguugacuggcccuguuuuacucgggcaaucgaagauuggucgcacuucgugucaagcgccggggaguuuaagcugccuugccuacgcaagcgagcugagggacucaguggcuaugccgucagauaccugaaaccagacgugacacaaaccuggaggcaggaagcacuuuguggcgcuugggccgggcggcccugcuccccggauucuccucgucccuauccauguugcccuccccaguacugccugagccagaauccauccuuggaccgcuacggacaaaagccccucccuuucgacucacugaacacguuuagaaguuucgguagcucuuauuccaggguaaauuacuuaacuccauggcauuga

SEQ ID NO: 63682 - RNA, 1260 nt, Artificial Sequence
  derived and/or modified sequence opt3 from TERF1__Homo_sapiens__NP_003209
auggccgaggacgugagcuccgcugcacccucuccuagaggcugcgccgaugggagggacgcggauccaaccgaagaacagauggcugaaacagagcggaacgacgaggagcaauucgagugucaggaacugcucgagugccagguccagguuggagccccggaagaggaggaagaggaagaggaagaugcaggucuuguggccgaggcugaggcaguagccgcuggcuggaugcuggacuuuuuguguuuaucacugugccgcgccuuccgagaugggcguagugaagacuuuagaaggacucggaauagcgcggaggcaaucauucacggacuauccucucucacggccugucaacugcgcaccauauacaucugccaguuccuuacaagaauugcugccggcaagacucuggaugcacaguuugaaaacgacgagaggaucacccccuuggaaucggcucucaugauuugggguucaaucgagaaagagcaugauaagcugcacgaagagauacagaaucugaucaaaauucaagccaucgcgguguguauggaaaacgggaauuucaaggaggccgaagaggucuuugagcggauuuucggagacccuaacagccauaugccauuuaaaaguaagcucuuaaugaucauaucccagaaggauacauuccacagcuuuuuccagcauuuuucuuauaaucacaugauggaaaagauuaaauccuacgugaacuauguucugucagagaaaaguagcaccuuccuuaugaaggcagcugccaaaguggucgaaucuaagcgcacucgaacaaucaccucccaggacaagcccucaggcaaugacguggagauggagacggaagcuaacuuggauacuagaaaaaggagccacaagaaucuguuccuaaguaaacuccaacauggcacccagcagcaagaccugaacaagaaagagcggcguguagggacaccucagucuacuaagaaaaagaaggaaucccgcagagccaccgagagcaggauuccaguuucgaaaucucagcccgugacaccugaaaagcaccgggcacgaaaacgccaggccuggcuuugggaggaggauaagaaucugagauccggagucaggaaauacggugaaggcaacuggucaaagaucuugcuccauuauaaguuuaauaaccggaccagugugaugcugaaagaccgcuggagaacgaugaagaaauuaaagcugaucagcuccgauucugaggacuga

SEQ ID NO: 63683 - RNA, 1629 nt, Artificial Sequence
  derived and/or modified sequence opt3 from TERF2__Homo_sapiens__NP_005643
auggccgcuggcgcagggaccgccggacccgcgagcgguccuggcguggucagagacccagcugccucccagccgaggaagcggcccgggcgcgagggaggcgaaggugcacgacguucugauacaauggccgggggaggcggcucaagugacgggagcggacgcgcugcagguaggcgggccuccagaucuucgggcagagcuaggcgggggcgccacgagccuggacugggcgguccagccgaacgaggggcgggagaggcaagacucgaagaggccguuaacaggugggugcuuaaauucuacuuucaugaggcucugcgggccuuccguggcucacgcuauggcgauuuuagacaaaucagggacauuaugcaggcauuguuaguacggccccuggggaaggaacacacugugagccgacuacuccgcgucaugcagugccugaguagaauagaggaaggagagaaucuugauuguuccuucgacauggaggcugaacugacgccuuuggagucugccaucaacgugcucgaaaugauuaaaaccgaguuuacacugacugaagcgguuguggagagcuccaggaagcuggucaaagaggccgcagugaucauuugcaucaagaauaaggaguucgaaaaggcuucaaaaauacucaaaaagcauaugaguaaagauccaaccacacagaaguuacggaacgaccugcuuaauaucauucgcgaaaagaacuuggcccaccccguaauccaaaauuuuagcuacgagaccuuccagcagaaaaugcugagauuucuagaaucucaucucgaugacgcugagccuuaucugcuuacuauggccaagaaagcacugaaguccgagucagccgcuagcaguacagguaaagaagauaagcagccagcgccgggccccguugagaaaccuccaagggaacccgcacgucaauugcggaacccuccaaccacgauugggaugaugacucucaaggccgcuuucaagacccugucuggagcccaggacuccgaggcagccuuugcuaaauuagaucagaaggaccuggugcuccccacacaggcccuuccggcaagcccugcgcugaaaaauaagcgacccagaaaagacgaaaacgagucgucugcuccagccgauggcgaggguggguccgaauugcaaccuaagaauaagaggaugacuaucucacgccuaguccuggaggaagacagucagagcaccgagcccuccgcaggccucaacucuagccaggaggccgcuucagccccacccaguaaaccuacagugcugaaucaaccacuuccgggagaaaagaaccccaaagugccuaagggcaaauggaacuccagcaauggggucgaggaaaaggagaccuggguugaagaggaugagcuguuccaggugcaggcagcuccagacgaagauucuacgacuaacauaacaaagaaacagaaguggaccguagaggaaucagagugggugaaagccggaguccaaaaguacggugaaggcaauugggcggccauuaguaaaaacuaucccuuugugaaucggacugcuguuaugaucaaggacagauggaggacaaugaagcgcuuggggaugaacuga

SEQ ID NO: 63684 - RNA, 1200 nt, Artificial Sequence
  derived and/or modified sequence opt3 from TERF2IP__Homo_sapiens__NP_061848
auggccgaagcuauggaccugggcaaggaucccaacgggccuacccacagcuccacacucuucgugagagacgauggaucuucaaugaguuuuuacgucaggccaagcccggcaaaacggcgccuuuccacucugaucuugcaugguggcgggacgguuugccgagugcaggaacccggagccguauuacuggcgcaaccuggcgaggcucuagccgaagcaucuggugacuucauuucgacccaguauauacucgauuguguggagcguaaugaaagacuggagcuugaggccuacaggcuggggccagcuucagcagccgacacaggaagcgaagcuaagcccggcgccuuggcggagggcgcagccgaaccugagccacagcggcacgcugggcgcaucgccuuuacugaugcagacgaugucgcuauucucaccuaugugaaagagaacgccagaagucccuccucuguuacaggaaaugcgcuguggaaggccauggagaaaagcucccugacccagcauucauggcaaagucucaaggacagguacuuaaagcaucugcggggucaggaacacaaauaucuuuugggcgaugcaccugugagcccaucuucccagaagcugaaacgcaaggcugaagaggacccggaagccgcugauucaggggagccccagaacaaacgaacuccugaccuaccagaggaagaguacgucaaggaagagauccaagaaaaugaggaggccgugaagaaaaugcucguagaagcaacaagagaguucgaagagguuguggucgacgaaagucccccugauuuugagauucacaucaccaugugcgacgaugacccacccacgccggaggaagauagcgagacucagccugacgaagaggaggaagaggaagaggaaaaggugucucagcccgaggugggagccgcuauaaaaaucauuaggcagcugauggagaaguucaaccuugaucuguccaccgucacacaagcguuuuugaaaaauagcggcgaacucgaggcaacuucggccuuccuggcuucuggucagcgggccgacggguauccaaucuggucccgucaggaugacauugauuuacaaaaggacgacgaagauacccgcgaggcacugguuaaaaaguuuggagcccagaacguggcuagaaggaucgaguuccggaagaaauga

SEQ ID NO: 63685 - RNA, 3210 nt, Artificial Sequence
  derived and/or modified sequence opt3 from TERT__Homo_sapiens__NP_001180305
augcccagagccccuaggugccgggcugugcgcagccugcuccgaucccacuaccgugagguccuuccacuggcaaccuucguuagaagguugggcccgcagggguggcgguuagugcaacgcggagaccccgccgcguuuagagcucugguagcccagugucuagugugcgucccuugggaugcaaggccacccccugccgcuccaucuuuccgccaggugucaugucucaaggaacugguugcacgggugcuucagcgacugugcgagagaggugccaaaaacgucuuggcuuuuggcuucgcccuccuggacggggcgaggggaggucccccugaagcauuuacaacuagcgugcggagcuaucugccaaauacgguaaccgaugcccuccguggcuccggggcuuggggauuacugcuucgcagaguuggcgacgauguguugguccaucugcuagccaggugugcacucuucgugcugguggcuccgucuugcgccuaccaagucugugggcccccucuuuaucagcugggcgcggccacacaggcacggccacccccucacgcuucgggaccacgacgcagauuggguugcgagagggccuggaaccauucaguucgggaagcuggcgugccccucgggcugccggccccuggagcacgcagaaggggcgguagcgccagucguuccuuaccccugccaaagcggccucgaagaggggcugcgcccgagccagagaggacucccguaggacagggcucuugggcacacccuggccgcacccgggggccaagcgacagaggauuuuguguggucuccccggccaggcccgcugaagaggccacaucacucgaaggugcacuuaguggcacccgccauagccacccuucuguggggcgacaacaccaugccggaccacccuccacuucacggccuccacgucccugggauacaccgugcccuccaguuuacgcugagaccaaacacuuccuguauagcaguggcgacaaggagcaguugagacccucuuuucuacuguccagccucaggccuucgcugacgggugcccgccggcuuguggaaacuaucuuccuggggucuagacccuggaugccaggcaccccuaggcgauugccccgccucccacagcgguacuggcagaugagaccgcuguuuuuagagcugcuaggaaaucaugcacaauguccuuauggcguccuccugaaaacacacugcccccuuagggcggcugugacuccagccgcagggguaugcgcccgugaaaagccccagggauccguugcugccccugaggaagaggauaccgacccacgccgguuggugcagcugcucagacaacacucaagucccuggcaggucuacgguuucgugagggcaugucugcgacggcuugucccuccgggccugugggggagccgccauaacgagagaagguuuuugcggaauacaaagaaauucauuucccucggaaagcacgcuaaacugucuuuacaggaacugaccuggaagaugagcgugcgagauugcgccuggcuaagacgcucaccaggcguugguugugugcccgcggccgagcauaggcuccgugaagagauacuggcuaaauuccuucacugguugaugaguguauacgucguggaacugcuccgguccuuuuucuauguuacggagacuacauuucagaagaacagacuguucuuuuacaggaagaguguguggucuaaauuacaaucaaucgggauucgccagcaucugaagcgaguccagcuuagagaguugagugaagcagaggugcggcagcacagggaagcccgcccugcucuccugaccagccgucuaagauucaucccaaaacccgacggccugcggccuauuguaaauauggauuaugugguuggagccaggacuuuucgccgagagaagagagcagaacggcucacauccagggucaaagcgcuguucucugugcuuaacuacgagcgcgccagaaggccgggcuugcugggggcuucgguguuaggacucgacgacauccaccgggccuggcguaccuuuguccugcgcguucgagcacaagaucccccaccugagcuuuauuucgugaagguggacguaacgggugcuuacgauaccauaccccaggacagacugacagaagucaucgccagcauuaucaaaccacagaauacuuauugcgugaggcgguacgcaguugugcagaaggccgcucauggccacguccgcaaggcguuuaaaucccaugugucaaccuugacagaucuccaaccuuacaugagacaguucguugcccaccuccaggagaccaguccccuaagggacgcagugguaauugaacagucuagcucccugaacgaggcuucaagcgggcucuuugaugucuuccugcgguucaugugucaccaugccgugcgaaucagaggaaagucuuaugugcaaugccagggcauaccacaggguuccauucuuaguacuuugcuguguagcuuaugcuacggggacauggagaauaaacucuuugccggcauccgcagggauggacugcuucugcggcuagucgacgauuuccuccugguuacaccgcacuugacccaugcuaagacuuuucugucuuaugcacguacguccauuagagccucauuaacauucaacaggggcuuuaaagcggggcgcaauaugcggcgaaagcuguucggagugcugagacuuaagugucacagucuguuuuuggaccuccaaguaaacagccugcagaccgugugcacuaauaucuacaaaauccuacugcuucaggcuuauagguuccaugccuguguccuccagcugccuuuucaccaacagguguggaagaaccccaccuucuuuuugcgcguuauuucggacacagcaucccugugcuacucuauauuaaaagccaagaacgcuggcaugagccucggugcaaaaggggccgcgggaccacugcccucagaagcugugcaguggcuuugccaccaggccuuccuguugaagcucacccggcauagagucacuuaugugccucugcuaggcagucugcguacagcacaaacgcagcuuuccaggaagcucccagguaccacucugacagccuuggaggcugccgcaaaucccgcuuuaccuucugauuuuaaaaccauccuggacuga

SEQ ID NO: 63686 - RNA, 564 nt, Artificial Sequence
  derived and/or modified sequence opt3 from TESC__Homo_sapiens__NP_001161797
augggcgccgcucacagcgcauccgaggaagugagagagcuggaagggaagaccggauucucuucagaccagaucgagcaacuccauaggcgguuuaaacagcuuaguggugaucagcccacaauucgcaaccugcgaaagggcccuagcggguuggccgacgaaauaaauuucgaggauuuucuuacuaucauguccuacuuccguccaauugacacgaccauggaugaggaacaggucgagcugucuagaaaagaaaagcuaagguuucucuuccacauguaugacucggauucagacggacggaucacacuggaggaguaccgcaacguuguggaagaguuacugagcggcaauccgcauauugaaaaagagagugcgagauccaucgcugauggugccaugauggaagcagccucuguaugcauggggcaaauggagcccgaccagguguaugagggaauaacuuuugaagauuucuugaagaucuggcagggcauugacaucgagaccaagaugcacgucagguuucucaacauggaaacaauggcucugugucauuga

SEQ ID NO: 63687 - RNA, 1266 nt, Artificial Sequence
  derived and/or modified sequence opt3 from TES__Homo_sapiens__NP_056456
auggaccuggagaacaaggugaaaaagaugggccucgggcacgaacagggauucggugcccccugccuuaaauguaaggagaaaugcgaaggcuuugagcugcauuucuggagaaagaucuguaggaauugcaagugugggcaagaggaacacgaugucuuguuaagcaacgaggaagaccggaaaguuggaaagcuguuugaggauaccaaauacacaacucuaauugcuaagcucaaauccgacggcauaccuauguauaagcgcaaugugaugauccugacgaacccaguagcagccaagaaaaaugugucuauuaacaccgucacauacgaaugggcgccgcccgugcagaaucaggcucuugcccgacaguauaugcaaaugcugccuaaggagaaacagccaguugcagguucagagggggcccaguaccguaagaaacaguuggcuaagcaacuccccgcacaugaucaggacccuaguaaaugccacgaacugagcccaagagaggugaaggaaauggagcaguucgucaagaaauauaaguccgaagcccugggagugggcgauguaaaacuccccugugagauggacgcucagggcccuaagcaaaugaacaucccagggggagauaggucuacuccggccgcgguuggugcaauggaggacaaaucggccgaacauaagcggacccaguacucaugcuauuguugcaaguuaagcaugaaagagggcgaucccgcuauuuacgccgaacgcgcaggguacgacaagcuguggcacccugcuuguuuugugugcaguacaugccacgagcuuuuggucgauaugaucuauuucuggaaaaaugaaaagcuguacuguggaagacauuauugcgacuccgagaaaccaaggugugccggcugcgacgagcuaauauuuucuaacgaauacacccaggcggagaaucaaaacuggcaccucaagcauuucuguugcuuugauugugacagcauccuggccggugaaauuuaugugauggugaaugauaagcccgucugcaaaccuuguuacguuaagaaccacgcagugguaugccaggggugucacaaugcuaucgacccagaggugcagcgggucacuuauaacaacuucuccuggcaugccucaacagaaugcuuucuuugcaguuguugcagcaaaugucugauuggacagaaguucaugcccguggagggcaugguguuuugcucuguugaguguaaaaagcgcauguccuga

SEQ ID NO: 63688 - RNA, 1566 nt, Artificial Sequence
  derived and/or modified sequence opt3 from TESPA1__Homo_sapiens__NP_001129502
auggaggccagcgugcugucccccaccucuugggaaaagagaagggcuuggcuccggcagucacgcaacuggcaaacacagguccuugaggaagaggcagccgcggcucugcaggacguuccugauccagaaccgaguagcuuggacgauguguuccaggagggcaaucccaucaacaaaauugaggacugguuacaagauugcggguacuccgaagagggauuuucugaagaggccggucaguucauauauaauggcuuuuguucgcacgggacuucauucgaggacgaucugacgcuaggagcagaagccacccuccuggcugcaaacggcaaacuuuuuagccgaaguuuccuggagacagcccguccuugccaguugcucgaccuggguuguucccuggcuucuagcuccaugacugggggaaccaauaaaacaucaaguagcaucucugaaauucucgauaagguacaggaggacgccgaagauguguuauuuucccugggcuucggccaagaggaccauaaagauaccucaagaaucccagcgagguuuuucacuacacccagccaggcaaaggggauugacuuucagcuuuucuugaagagucagguccggcgcaucgagauggaagacccuugccugaugcuagccucuagauuuaaacaagugcagacccucgcuguuacggccgaugcauucuucugucuguacuccuaugugagcaagacuccaguccagaaauuuacccccucgcacauguucuggaacugcaaucauccuacagacgugccaucuauaaggauccuuucccgggagccggaaccccaaucaccucgcgaucgacugagaaaggcuauuaguaaaauguguuuguacacuugcccaagggaccggcccccuccaccccacaacaccccgaagcguaauagccucgaucagguaguucuggaggugauggacaaggucaaagaagagaagcaguuuuuacagcaagauuccgaccugggacaguucucucaggaggauccugugcccccagccgaagguaaaaagcucccuacaagccccuauccauguguguuuugcugugaggaagagacccagcaacgcaugucaacgguccuugcgcccagucagacucuggacuccaacccuaaaguuccaugcugcacacauagcuugccgaucgaagauccccaguggucuaccgacccugcccagauuagaagggagcuauguucacugccagcaacuaauacagagacccaccccgcuaaggacgaaacguucuggaaacggaagagucgagcccgcaagagccucuuucaaaagaaccugaugggcagaaaggugaaaucccuugaucugucuaucacccagcagaaguggaaacagucgguagacaggccugaguugcggcgcagccucucccaacagccacaggauacauucgaccuggaagaggugcaaucaaauagugaggaggaacagucucagagcagauggcccuccaggccgcgucacccucaucaccaucagacuuuugcugggaaggauucauga

SEQ ID NO: 63689 - RNA, 6411 nt, Artificial Sequence
  derived and/or modified sequence opt3 from TET1__Homo_sapiens__NP_085128
augagcagauccagacacgcccggcccucucgccuggugcgaaaggaggacgucaacaagaagaagaaaaauucacagcuccguaaaaccaccaaaggcgcuaacaagaauguugcaagcgugaaaacucuuagcccugggaagcugaaacaguugauccaggaaagagaugugaagaaaaagacggagccaaagccgcccgugccugucagguccuuacugacccgggccggagcggcucgcaugaaccuggacagaacagaaguacucuuccagaauccagagucucugacuugcaacgguuuuaccauggcccuuaggucgacaucacugagccggcgcuugagucagcccccucucguuguggcaaaauccaagaaagucccacugucuaagggccuggaaaaacaacaugauugugacuacaagauucuccccgccuuaggggugaaacacagcgagaaugauuccguaccuaugcaggacacccagguucugccagauauagagacucuuaucggagugcagaacccgucauugcugaagggcaagagucaagaaacaacccaguucuggagccagcgagucgaggacucuaaaauuaauauccccacgcauuccgguccugcugcagaaauucuaccagggccccucgagggaacuagaugcggcgagggccuguuuucagaagagacccuuaacgauacaagcgggaguccuaagauguucgcccaggacacugugugugcuccauuuccccaaagggccaccccgaaagugacaucucagggaaauccuuccauccagcuggaagaguuggguagccgggucgaaucgcucaagcugucugauuccuauuuagaccccauaaaaucagagcacgauugcuacccaaccaguagccugaacaagguuaucccugaccucaaucuucguaacugucuggcguugggcggguccacgucucccacuagcgugauuaaguuccuacuggcaggaucaaaacaagccacacucggcgcuaagccagaccaucaggaggccuuugaagcaaccgcuaaucagcaggagguaagugauacuacauccuuccugggucaagccuuuggggcgaucccccaccagugggaacuuccuggagccgacccagugcacggcgaggcacugggcgaaaccccggauuugcccgagauuccuggggcuaucccaguccagggagagguguucgguacgauacucgaccagcaagaaacccugggcaugagcgggucuguugugcccgauuuaccugucuuucugccagugcccccgaacccuauugccacauucaacgcuccaucaaaauggcccgagccucagaguacuguaagcuauggacuagccguucagggcgcaauccagauucucccccuggguuccgggcauaccccacaaucuucgagcaauuccgaaaagaacucacuuccucccgugauggccaucaguaaugucgagaacgaaaaacaggugcacaucucuuucuugccagcuaauacacagggcuucccgcuggcgccugagcgcggacucuuccaugcaagccugggcauugcccagcuuucccaagcugggcccucaaagagcgacagaggaucuucccaggucagugugacuagcaccguucacgugguaaacacaaccgucgugacuaugccaguucccauggugucuacguccucaaguagcuacacaacccuguugccuacucucgagaagaaaaagaggaaacggugcggugucugugaaccaugccagcaaaagaccaauuguggcgagugcacauauuguaaaaaccgcaaaaauucgcaccagauaugcaagaaacgaaagugcgaggaacugaaaaagaaacccuccgugguagugccuuuagagguuaucaaggaaaacaaaagaccgcagagggagaagaagccaaaaguccugaaggccgauuuugacaauaaacccgugaacgggccuaagucugaaagcauggauuacucacgguguggacauggcgaggaacagaaacuagagcucaauccacacaccguggagaacgucacuaagaaugaagacaguaugacagguauugagguugaaaaguggacgcaaaacaaaaagucccagcugaccgaucaugugaaaggggacuucucugcaaacgugcccgaggccgaaaagagcaaaaauuccgagguagacaagaagcgcacuaaaucaccuaaacuuuuuguccagacagugagaaacggcaucaaacacguucauugcuugccggcugagaccaaugugagcuucaagaaauuuaacauagaagaguucggaaagacacuggaaaauaacaguuauaaguuucucaaagauacugccaaucacaagaacgcaaugucuuccgucgcgaccgacaugagcugugaucaccugaaaggcaggucgaauguguuaguuuuccagcaacccggguuuaacugcucaucuauuccacauaguucccacagcaucaucaaucaucacgcuucuauucacaacgagggagaccagccuaagacgcccgaaaauaucccaagcaaagagccuaaggaugguucccccgugcagccaucacugcuuaguuugaugaaagaccgucggcucacccuggagcagguagucgccauugaagcacuaacacaacugagcgaggccccgucugaaaacuccucaccuaguaagagcgagaaggaugaggaauccgagcagcgaacugcuucucuccuaaauucguguaaagccauacuuuacaccgugagaaaggacuugcaggaucccaaccugcaaggcgaaccacccaaauuaaaccauugcccuagccucgagaagcagucauccuguaauacaguggucuucaacgggcagacuaccacgcugaguaauucucacaucaacagcgcaacaaaucaggcuuccaccaaaucacaugaauacucuaagguuacuaacagccuuagucuguuuauuccaaaguccaauagcucuaaaaucgacacaaacaagucaaucgcccaaggaauuauaaccuuggauaauugcuccaacgaccuccaccagcugcccccuaggaauaacgagguggaguauuguaaucagcuacuggauaguagcaaaaagcucgacucggacgaucugucuugccaggacgcgacucauacccaaaucgaagaggauguagccacacagcuuacgcaguuggcuuccauuaucaaaauuaacuacaucaagccggaagacaagaaaguggagagcaccccaacuucacuggucacauguaaugugcagcaaaaguauaaccaggaaaaaggcaccauacagcagaagcccccuaguucuguucacaacaaucacgguuccagcuuaacaaaacaaaagaaccccacucagaagaaaaccaagucaacgccaagucgcgaucggaggaagaagaaaccuacaguggucagcuaccaggagaaugacaggcaaaagugggagaagcucuccuauauguacgggaccaucugcgauauuuggaucgcaucuaaauuccagaacuuuggccaguucugcccccaugacuucccaacuguguuuggaaagauuagcuccucaaccaaaaucuggaagccucuggcccagacacgcucuauaaugcaaccgaaaacuguuuuuccaccacuuacccagauuaagcugcagcgauauccugaaagugcugaggaaaaagugaaggucgagccccuagauucgcucagccuguuucacuugaagacagaauccaauggcaaagccuucacggacaaggcauacaacucucagguacaacugaccgugaaugcgaaccagaaagcccauccauuaacucagccuucaagucccccgaaucagugugcuaacguuauggccggggaugaccaaauccgguuucaacagguggucaaggagcaacucaugcaccagcgucugccaacacuuccuggaauuucccaugagacaccccugccagaaagugcauugacucucagaaaugugaacguagugugcucuggcgguaucacagucguuagcaccaaaucagaggaagagguguguuccaguagcuucgggacgucugaguuuuccacuguggauucagcucagaagaauuucaacgacuacgccaugaacuuuuucaccaaccccacaaagaaucuggucagcauaaccaaagacucggaacuaccuacuugcucuugucuggauagggugauccagaaggacaaaggaccguauuacacacaccuuggcgcaggucccaguguugccgcuguacgcgagauuauggaaaaccgguauggccaaaaggggaacgcgaucagaauugagaucguggucuacaccggaaaagaaggcaaguccagccacgggugcccaauagccaagugggugcucaggcgaucauccgaugaggagaaaguucuguguuuggugcgccagcggacaggacaucacugcccuacugcagucauggugguacugauuauggucugggacggcauccccuuaccuauggcugauagacucuauaccgaacugacggagaaucuuaagucuuacaacggucauccaacagacaggcguuguacccugaaugaaaaccgcacuugcaccugucaggggaucgaucccgagacaugcggagccagcuuuaguuucggcugcuccuggagcauguauuuuaaugguuguaaauucggccggucuccuucaccaagaagguuccgaauugaccccaguuccccguugcacgaaaagaaccucgaggauaaucugcagagccuagccacucggcuggcuccuaucuacaaacaauacgcaccaguggccuaucagaaccagguugaguacgaaaauguggcgcgcgagugcagacuugggucuaaggaaggaaggcccuuuucgggcgucaccgcuugucucgacuucugcgcccacccucaucgggauauucacaacaugaauaacgggucaacggugguuuguacacugacccgagaggacaaucgcagcuugggagugauaccacaggacgaacaauuacauguccugccccucuauaagcuguccgauacugacgaguuuggcaguaaagaggguauggaagcaaagaucaaaucuggggccauugaggugcuugcuccgcgaaggaagaaacguacaugcuucacccagccuguaccccggagcggaaagaaaagagcagccaugaugacugaagugcuggcgcacaagaucagggcuguugagaagaaaccaauuccucgcaucaagagaaagaauaauuccacaaccacgaacaacucaaagcccaguucuuugccaacucuaggcagcaauaccgagacaguccagcccgaagugaaauccgagaccgaaccucauuuuauacugaagucaagcgauaacacaaagacuuacucucucaugccauccgccccgcaccccgugaaagaggcaaguccugguuucagcuggucgccaaagaccgccuccgcuacgcccgccccucugaaaaaugacgcaacagcuucuuguggcuuuucagaaagaagcaguacuccacacugcaccaugcccuccgggcggcuuucuggagccaacgcggccgcagcugauggcccugggaucagccaguuaggagaggucgccccgcugccaacacucucagcucccguaauggagccuuugauuaauuccgaacccaguaccggcgugacugagccacugaccccucaucaacccaaccaccagcccagcuuccucacaucuccgcaggaccuggcaucauccccuauggaagaggaugaacaacauagcgaggccgacgagcccccaucugaugaaccccuuagugacgauccucugucgccagccgaggaaaaguugccccacaucgacgaguauugguccgauagcgaacacauuuuucuagacgcuaauaucggugggguugcgauagccccugcacauggaucagugcugauugagugugcuaggcgcgagcuccacgccacgacuccggucgaacauccaaaccguaaucaccccaccagauuaucucugguguucuaccagcauaaaaaccuuaauaagccucagcacggcuuugagcugaacaagaucaaauucgaagcaaaggaggccaaaaauaagaaaaugaaggcuagcgagcagaaggaccaagcggccaacgaaggcccagagcaguccagugaaguuaaugagcucaaccagauccccucacacaaagcauugacacugacccaugauaacguggucacugugucuccuuaugcucucacacacguagccgggcccuacaaucauuggguguga

SEQ ID NO: 63690 - RNA, 6009 nt, Artificial Sequence
  derived and/or modified sequence opt3 from TET2__Homo_sapiens__NP_001120680
auggagcaggacagaaccaaccacguggaaggcaauaggcugagccccuuccucaucccuuccccaccgauuugccaaacagagccccuugccacuaagcugcagaacgggucuccuuugccagaacgggcucaucccgaggucaauggagauacgaaauggcacucauuuaagaguuacuaugguauaccuuguaugaaaggcagccagaacucccgcguuucuccagacuucacccaggaaucgcgaggguacucaaagugcuuacaaaauggaggcaucaaacguacagugagcgagcccagucuguccggucuacuccagauuaagaagcugaaacaggaucagaaggcaaacggggagagaaggaauuuuggaguaucucaagaacggaacccuggcgagagcucccagccaaaugugucagaccuuagugauaaaaaggaaagcgucucuuccguggcccaggagaacgcgguuaaagacuucacuucauuuagcacccauaauuguaguggcccggagaaccccgaacugcagaucuugaaugagcaagaagggaagucugcuaacuaucacgauaagaauauugugcuccugaaaaacaaggccguccugaugccuaacggagcaacaguguccgccagcucgguagagcauacccacggugaacucuuagagaaaacucugucucaguacuauccagacugcguuuccaucgcugugcagaagacaaccucacacauaaaugcaaucaacagucaagccacgaaugagcuuagcugugaaauuacucaucccucccacaccucuggccagaucaacagcgcucagacaucaaauagugaguugccuccaaaacccgccgcggucguguccgaagcaugcgaugccgacgaugcugacaacgccagcaagcuggcagcuaugcuaaauacuuguucuuuccagaaaccggagcaacuccagcagcagaagucaguguuugaaauuugcccuagucccgccgagaacaauauccaagggaccacaaagcuggcgagcggagaggaauucuguuccggcucuucgagcaaccuucaggccccagguggguccucagagcgcuaccugaaacagaaugaaaugaacggagcauauuuuaagcagaguucugucuucaccaaagauagcuuuuccgcuacgacuacaccucccccacccucacaauugcuccugagcccuccaccgcccuuaccucagguuccacagcugcccucugagggcaaguccacccucaauggcggggugcuugaagagcaucaccacuacccuaaccagaguaauacuacacuguugagagagguaaaaauagaaggaaagccagaggcccccccgagccaaucuccuaacccauccacccaugugugcucacccaguccuaugcuaagcgaaaggccccagaacaauugugucaaccggaaugacauucagacggcugguaccaugacagugccacugugcucggagaagacucgcccuauguccgagcaccucaaacauaaccccccaaucuucggcucuagcggggaacugcaagacaauugccagcagcuuaugcgaaacaaggagcaggaaauucugaaaggaagagauaaggagcaaaccagggacuugguuccgccuacacagcacuaccucaaacccggcuggaucgaacugaaggccccacgguuucaucaggcagagucacacuuaaagcguaaugaggccagucugcccuccauccuacaguaucaaccuaaccucucuaaucagaugacuagcaaacaguacaccgguaacuccaauaugccagggggccugccccgccaggcuuauacacaaaagaccacucagcuugaacacaaaucacagauguaccaaguggagaugaaccagggacagagccagggcacggucgaucaacauuugcaguuccagaagccuagucaccaggugcauuucucuaaaacagaccaccugccgaaggcgcacguacaaucccucugugggaccagauuucauuuccagcagagggcagauagccagacugaaaagcugaugucgccaguucuuaaacaacaccugaaucagcaggccucagagaccgaacccuuuucuaacagucauuugcuccagcacaagccucauaaacaagcugcccagacacagccaucccaaagcucucaccugccccagaaucagcagcaacagcagaaguuacagauuaaaaacaaggaggagauacugcaaaccuucccucacccgcagagcaacaaugaccagcagcgggaaggauccuuuuucggucaaacuaaaguggaggaaugcuuucauggcgagaaccaguauucaaagaguagcgaauucgagacacacaauguccagauggggcuagaggaagugcaaaacaucaaucgacgcaacucucccuacucccagacgaugaagucaagugcauguaaaauucaggucagcugcuccaauaacacccaucucgugucugagaauaaggaacagacuacacacccagagcuguuugccggaaacaaaacccaaaaucuucaucacaugcaguauuucccuaacaauguuauccccaagcaggauuugcugcacagauguuuucaggagcaagaacagaaaucgcagcaggcuagcgugcuccaaggcuacaagaacaggaaucaggacaugucaggucagcaggccgcacaacuggcgcagcagcgguacuuaauacauaaccacgcuaacguauucccagucccugaucaagggggcucccauacacagacucccccacagaaggacacccagaaacacgccgcacugcgcuggcaccuuuugcaaaagcaggagcagcagcaaacgcagcagccgcagaccgaaaguugccauucucaaaugcacagaccuauuaaaguggagcccggauguaagccacaugccugcaugcacacagcucccccugaaaauaaaacuuggaagaagguuaccaaacaggagaacccacccgccagcugugauaaugugcagcaaaaguccaucaucgagacaauggaacagcaucucaaacaguuucacgcaaagucacuguucgaccacaaagcucuaacucugaagucucagaagcaagucaaaguggagaugagcggcccuguaaccgugcucacgaggcagacaaccgccgcggaacuggacagucauacuccggcccuugagcagcagacaaccuccagcgaaaagacuccaaccaaacguacagcugcaucuguuuugaacaauuucauugagucacccuccaagcuguuagauacgccuaucaaaaaccuccuggacacccccgucaagacucaauaugauuuuccaaguugccgguguguggagcagauuauagaaaaagacgaggggccuuucuacacacaccuuggagccggucccaauguggcugccauccgagaaauuauggaggaaagauuuggccagaaggggaaggcaaucaggaucgagcgcgucauuuauaccggaaaagagggcaagagcucgcaggguugcccaauagcgaaauggguugugcggagaucuuccagcgaagagaagcuguugugccucgugagggaacgcgccgggcauacaugugaggcugccguaaucgucauucugauccuagugugggagggcauuccucugucacucgcagauaaacuguacagugaacuuacugagaccuugcgaaaguauggaacgcugacaaaccggcguugcgcuuuaaaugaagagagaaccugugccugccaaggccucgacccggaaacuuguggggcaucuuucuccuuuggaugcagcuggucaauguacuauaacggcuguaaguucgccaggaguaaaaucccccgcaaguuuaaacugcuuggugaugacccaaaggaggaggaaaaacuggagagccaccuacagaaucucuccacccugauggcuccuacauacaagaaguuggcgcccgaugccuacaacaaucagauagaauaugagcaccgggcaccagaaugcagacugggguuaaaagagggaaggccuuucucuggcguuacugcuugucucgacuuuugcgcccaugcccaccgagaucugcauaacaugcaaaaugguagcacccuuguguguacacugacgcgcgaggacaaccgggaauucggcgggaagcccgaggaugaacaguugcacguccucccgcuguacaaaguguccgacguugacgaguuuggaucaguggaagcucaggaggagaagaaaagaucuggcgcaauccagguacuaaguucguucaggcguaagguccgcaugcuggccgaaccagugaagaccugccggcaaagaaaacuugaggcgaagaaagcugccgcagaaaagcucagcucccuggagaauucuucaaacaaaaacgagaaggaaaagagcgccccuuccaggacuaaacagacagagaaugcuagucaggcaaagcaguuggccgaacuguuacgacucucugggcccgugaugcaacagagccagcagccacaaccccugcagaaacagccuccgcagccccaacagcagcaacggccacagcagcagcaaccucaucacccccagaccgagucagucaacuccuauagugcgagcggaucuacuaauccuuacaugcgcagaccaaaccccguuuccccuuauccaaauucaagccacacaucggauauuuacggcucuaccagucccaugaacuuuuauuccacgagcucacaggcugccgguuccuaccuuaauucuagcaacccgaugaauccuuacccagggcuguugaaccagaauacucaauaucccaguuaccagugcaacggaaaucucuccguggacaacuguagcccuuaucugggcucuuacucaccacagagucagcccauggaucuauauagguacccgucccaagacccucugagcaagcuuucucuccccccaauccauacccuguaucagccucgguucgguaauucgcagucauucacaagcaaauacuugggcuacgggaaccaaaacaugcagggagauggcuuuuccaguugcaccauucgacccaauguacaccauguggggaaguuaccacccuauccuacucacgaaauggacggacacuucaugggcgcaacaucuagacugccaccgaaccucagcaaucccaacauggauuacaaaaauggugagcaucacuccccuucacauaucauacacaacuauagugccgcuccagggauguuuaauucuagccugcaugcccuucaccugcagaacaaggagaaugacauguugucccacaccgcaaacggacuaucaaagaugcugcccgcucucaaucaugaucgcacagccuguguccagggcggucugcacaaacuuagcgacgcgaacggccaagaaaagcagccuuuagcccuggugcaggggguugcaucuggagcugaggauaaugacgaagugugguccgauagugagcagagcuuccucgacccagacauuggcggggucgccguggcucccacucauggaucgaucuugauugaaugcgcaaaaagggagcugcacgccaccacgccucucaagaacccgaaucguaaccauccaacacggaucucccugguuuuuuaccaacacaaaucuaugaacgagcccaagcacggccuugcccugugggaagcuaagauggcggagaaagcaagagaaaaggaggaagagugugagaaauaugguccugauuacgugccccagaagucacaugggaaaaaggucaagagggaaccagccgagccucacgaaaccagcgagcccacuuauuugcgcuucauaaaaagucuagcugagcgaaccauguccguaacaacugacucuaccgugacgacaagcccauacgccuuuaccagaguuacuggaccguacaaucgguauaucuga

SEQ ID NO: 63691 - RNA, 5388 nt, Artificial Sequence
  derived and/or modified sequence opt3 from TET3__Homo_sapiens__XP_005264244
augagccaauuccaagugccccuggccguccagccugaccucccaggccuuuacgauuuuccgcagagacagguuauggugggguccuuccccggaucuggucugucaauggcuggcagugagagccaauugagagggggaggcgacggucggaagaaacgcaagcgaugcgggaccugugaaccuugccguagguuagagaacuguggagcaugcacuuccuguacuaacaggcggacgcaccagaucugcaaacugcgcaagugugaaguacucaaaaagaaagugggccuccugaaagaggucgaaauuaaggccggcgagggggcgggaccauggggucagggcgcugccgugaaaaccgggucugagcuuucgcccguugauggaccugugccaggccagauggacucaggucccgucuaucauggggauagcagacaacugagugcauccggagugccuguaaacggcgccagggaaccagcuggcccgucuuugcucgggacaggaggucccuggcggguugaccagaagccugauugggaggcagccccaggccccgcucacacugcccgccuggaagacgcgcaugaucugguggcauuuagcgccgucgcugaggccguguccucauacggggcacucaguacccgauuauaugagacauucaauagagaaaugagcagggaggcuggaaacaauucucggggcccucguccaggucccgaagggugcuccgccggcucagaggaccuggauacccuucagacugcguuggcccuggcacgccacggaaugaaaccgccuaacuguaauugcgacggccccgaauguccagauuaccuagaguggcucgaggggaagauaaagagcguggucauggaaggaggugaggaaagaccuaggcugcccggcccacuucccccuggggaggcuggacugccagccccgaguacacggcccuugcucucuuccgaaguuccucagaucagcccacaagagggccugcccuuaucgcagucugcucuguccauugccaaagagaagaacaucucacuccagaccgcaauugccaucgaagcucuuacgcaacugaguagcgcguugccucagccaucccauucuacuccccaggcaagcugcccgcuaccugaggcccugucaccacccgcuccuuuucgaaguccccaguccuaucuccgcgccccaagcuggccugugguacccccagaagaacacucuucauucgcaccggacaguagcgccuuuccucccgcuaccccaagaacagaguuccccgaggccugggguacugacaccccuccagcaacacccagguccucuuggccuaugccgcggccaucgcccgauccuauggcggagcuggaacaacuucuggggagcgcuuccgacuacauacagucaguguuuaaacgcccagaggccuugcccaccaagccuaaagucaagguggaagcaccgaguucuagccccgccccagcuccuucccccguucuccagagagaggccccaacgccuucaagcgagcccgauacucaccagaaagcacaaacagcucugcagcagcauuuacaccauaagaggucucuguuccuagaacaggugcacgacaccuccuuuccagccccgagugagccuagcgcgcccggcugguggccacccccuucuuccccagucccccgucucccugaucggccgccaaaggagaaaaagaaaaagcugcccacuccugccggaggccccguggggacagagaaagcugcaccaggaaucaagccuucaguacgaaagcccauucaaaucaaaaagaguagaccaagggaagcccagccucuuuucccgcccguucgccagauuguguuggagggucugcggagcccagcuucgcaggagguccaagcccacccucccgcaccacucccugcgucccagggcucugccgugccccugccgccagaaccuagccuugcucuguuugcccccucaccaaguagagacuccuugcuacccccuacccaggagaugaggucuccgagccccaugacggcacugcaaccaggguccaccggaccuuuacccccugcugaugacaaacuggaagaacuaauccgccaguucgaagccgaguucggcgauucauuuggucucccagggcccccuagcgucccaauacaggaccccgagaaucagcaaacaugccugccggcaccugaaaguccauucgccacucgaucucccaagcagauuaaaaucgaguccagcggcgcugugaccguucuuucgacaacuuguuuucauucagaagagggaggccaggaagcgaccccuacaaaggccgagaacccauugacccccacucugucuggguuccucgagaguccgcugaaguauuuagauacgccuacaaaaucccugcuugacacccccgcaaagcgggcucaggccgaauuuccaacuugcgacuguguggagcaaauuguagaaaaagaugagggaccuuacuacacccacuugggcagcggucccacagucgccucuauccgugagcucauggaagagagauauggggaaaagggaaaagcuaucaggauugagaaggugauauacaccggcaaggaagguaaaagcucccgcggcugcccaaucgcaaaguggguuauucggagacauacucuggaggagaaacuacugugucucgugaggcaccgagccgggcaucacugccagaaugcggucaucgugauacugauucuugcuugggaaggaaucccccgcucauugggcgacacacuguaucaggaguuaacggauacccuccggaaguacgggaacccuacaaguagaagguguggacugaaugacgaucguacaugcgccugucagggcaaagacccaaauaccugcggugccagcuucucuuuuggguguuccuggucaauguauuucaauggaugcaaguacgcccgcaguaaaacaccgcggaaguuuagacuugcuggcgauaaccccaaggaagaggaaguacugcgaaagagcuuccaagacuuggcaacugagguggccccucucuauaagaggcuggcgccacaggcuuaccagaaccaaguuaccaaugaggaaaucgccauugauugccggcuaggucugaaagagggccgccccuuugcaggggucacggccuguauggacuucugcgcucacgcccauaaggaucagcacaaccucuacaauggauguaccguggugugcacacugacuaaagaagacaacagaugugucggcaagaucccugaggaugaacagcuucauguuuugccacuguauaagauggcaaauaccgacgaguuuggguccgaggaaaaccagaaugcuaaagugggaucuggcgccauucaaguguuaacagcguuccccagggagguacggcgacucccugaaccggccaagucgugcagacagcgccagcuggaggcaaggaaagcugccgcugagaagaaaaagauacagaaggaaaaacuuagcacuccagagaagaucaaacaagaagcacuggagcuagccgguauuaccucagaccccgggcucucccugaagggaggcuugagucagcagggucugaaaccuucuuuaaaggucgaaccccagaaccacuucagcuccuuuaaguacucaggcaaugccgugguugagucuuauagcgugcucgggaacugucguccaagugauccuuacuccaugaauagcgucuauucuuaccacucauauuacgcucaacccucccugacgagugugaacggauuccauagcaaauacgcgcuuccaucguuuucuuauuacggcuucccguccagcaauccuguuuuucccucacaguuccuggggccaggagcauggggccacagugguucuuccgggagcuuugagaagaaacccgacuugcaugcccuccacaacucacugaguccugcuuauggaggcgccgaguucgcagagcuaccaagccaggccgugcccacagaugcucaucacccuaccccgcaccaucagcaaccagcguaccccggcccuaaggaauaucugcuuccaaaagcaccccuccugcacuccguaucucgggacccuagccccuuugcacaguccucaaauugcuacaacagaucuaucaagcaggagccagucgauccguugacucaagcugaaccugugcccagggacgccgggaaaaugggaaagacaccacugagugaggugucgcagaacgguggcccuagccauuuaugggggcaguauuccggaggccccucuaugucaccaaagcgcaccaauggugucgggggaagcuggggcguuuucuccaguggcgagucuccugcaaucgugcccgauaaacucagcucauuuggggccuccugucuggcuccgagucacuucacugacggacaguggggucuuuuuccaggcgaagggcaacaggccgcgagccauucuggaggccgacugagagguaagccuuggucccccugcaaauucgggaacucaaccagcgcauuggccggaccaucgcucacagagaagcccugggcucugggcgccggcgauuucaauucugcucuaaaagggaguccuggauuucaggacaagcuguggaacccgaugaagggugaagagggccggauuccagcagccggggcuucccagcuugauagggccuggcagagcuucggacucccccugggcucauccgaaaaauuguuuggugcauuaaagucugaggagaaacugugggacccuuucagccucgaagaggggcccgcggaagaaccaccuaguaagggagccguaaaagaggaaaagggcggcgggggagcugaggaagaggaagaggagcugugguccgauagcgaacacaauuuucuugacgagaacauagguggcguggccgucgcacccgcucacgggucuauccugauugaaugugcccgccgugaguugcaugcaacgaccccacuaaagaaaccuaauagaugccacccgacucggaucucacugguguucuaccagcauaagaaccucaaucagcccaaccacggacuggcccuuugggaagcuaaaaugaagcaguuagcggagagggcccgcgcacgacaagaggaagcugccagacugggccucggucagcaggaggccaaauuguacgggaagaagcggaaauggggaggcacaguuguggcagaaccacaacagaaggagaaaaagggcgucgugccuaccaggcaggcucuggccguucccacagacagugcggugacugucuccagcuaugcuuacaccaaaguaacggggccauauucucgcuggauuuga

SEQ ID NO: 63692 - RNA, 750 nt, Artificial Sequence
  derived and/or modified sequence opt3 from TEX101__Homo_sapiens__NP_001123483
augggcacccccagaauccagcacuuacucauucuucugguguugggggccagcuuacugacauccggacuagagcucuacugccaaaagggucugucuaugacugucgaagcugacccugcaaacauguucaauuggacgaccgaggaaguugagacaugugauaaaggcgcccuuugccaggaaacuauacugaucauuaaggcggggaccgagacagcuaucuuggccaccaaaggauguauuccagagggcgaagaggcaaucacuauagugcagcauucaaguccgcccggucucaucguaacaagcuauuccaacuacugcgaagacucuuuuuguaaugauaaggacucgcugucacaguucugggaguuuagcgagaccacggccaguacuguguccaccacacugcacugcccuacuugugucgcucucgggaccugcuucucugcaccaagccugcccuguccuaacggaacaaccaggugcuaucaaggcaaacuggaaauuacgggcgggggaaucgaguccucaguggaaguuaaggguuguacugccaugauuggcugccggcuuaugagugggaucuuggcugugggaccaauguuuguccgcgaggccugcccccaucagcugcuaacacagccucgaaagaccgaaaauggcgcgacuugucucccaauaccgguguggggucugcagcuucuguugccccuccuguuaccuagcuucauucacuuuucuuga

SEQ ID NO: 63693 - RNA, 2823 nt, Artificial Sequence
  derived and/or modified sequence opt3 from TEX11__Homo_sapiens__NP_001003811
augaucagcgcccacugcaaccugagacuccuuuguuccucugacucaagugcuagcgcaucccagguggccggcaccacagaggucguugaaaaucuggugacuaacgauaauucucccaacauuccugaggcgauagacagguuguucucggauaucgcuaauauuaaccgggaaucaauggccgagaucacggacauucaaaucgaagagauggcaguaaauuuauggaacugggcccugaccauagggggagguuggcuagugaaugaggaacagaagauccgccuccauuacgucgcuugcaaacugcuuagcaugugugaggcaaguuuugccuccgaacagucuauucagcgacugaucaugaugaacaugcguauuggcaaggagugguuggaugcugggaauuuccucaucgccgacgagugcuuucaagcggcaguggccagccuggaacagcuguauguuaaacucauacagagauccucaccagaggcugauuuaacaauggaaaagauuacuguggagagugaccacuucaggguccugagcuaccaggccgaaucugcaguggcucaaggagauuuucagcgggccuccauguguguacuucagugcaaagacauguugaugcgccugccgcagaugaccucaagccuacaucaccucuguuauaacuucggcguugagacacaaaagaauaacaaguacgaggaaaguucuuuuuggcugucccagagcuaugauaucgguaaaauggacaagaaaucgaccgggcccgagaugcuugcgaaggugcugagauugcucgccacuaauuaccuggauugggacgacacaaaauauuacgauaaggcauuaaacgcugucaaccuggccaauaaggaacaucucucuuccccuggacuuuuccugaaaaugaagauuuugcuaaaaggcgagaccucaaacgaagaacugcucgaggcugugauggaaauccugcaccuugacaugccacuggauuuuugcuugaauaucgccaagcuccugauggaccacgagagggaaagugugggcuuccauuucuuaacgauuauacacgagcgguucaaaagcuccgaaaacaucgggaagguccugauucuacauacugauaugcuccugcagcgcaaagaggagcuuuuggcaaaggaaaagaucgaggaaauauuucuggcccaccaaaccggacgacagcucacagcugagucuaugaauuggcugcacaacauucuuuggagacaggcggcaagcucauucgagguucagaauuacacugacgcccugcaaugguauuacuauaguuugagguucuacuccaccgaugaaauggaccucgauuuuacaaaacugcagcggaacauggcuuguugcuauuuaaaucugcagcagcuagacaaggccaaagaggcaguggccgaagcugagcgucaugauccccgcaacguauucacccaauuuuacaucuucaagaucgccgugauugaagguaauagcgagagagcacuccaggcgaucauuacgcuggagaacauacuuacugacgaagagucugaagacaaugauuuggucgcugagaggggcucaccuacaaugcugcucagucuggccgcacaguuugccuuagaaaacgggcagcaaaucguggcugagaaagcccuggaguaucuugcacagcacagcgaagaccaggagcagguuuugaccgcugugaagugucuccugcgguuccuacugccaaagauugccgaaaugcccgaguccgaagauaaaaagaaagagauggaccgacuccugacuugccuuaaucgcgcguuugucaaguugucucaaccuuucggagaggaagcccugucguuagagagcagagcuaacgaagcacagugguuuaggaaaacagccuggaaccucgcugugcagugcgauaaggacccaguaaugaugcgggaguucuuuauccuguccuacaagaugucacaauucuguccgagugaucagguuauccuuauugcccgcaaaaccugccuguugauggcaguggcggucgaccucgagcagggcagaaaggccucuacggcuuuugaacagaccauguuccugagcagggcccuagaggaaauacaaacauguaaugauauccauaacuuccugaaacagacugguaccuuuuccaaugacucaugcgagaagcuccugcuuuuguacgaauuugaggugcgugcaaaacugaacgaucccuuacucgagagcuuucuggaaucugucugggagcuuccucaccuggaaacaaagacuuucgagaccauugcuaucauugccauggaaaagccagcacauuauccccuaaucgcccucaaagcucugaagaaagcguugcuguuauacaagaaagaggagccuauagacaucucccaguauaguaaguguaugcacaaucucgugaaccugagcguuccagauggggccucuaauguggaacuuugcccccuggaggaaguauggggauacuuugaggacgcauugucccacauuucacggacaaaagacuauccggaaauggagauccucuggcugauggucaagaguuggaacaccggcgugcuaauguucagccgaucgaaguacgcuuccgccgagaaaugguguggccuggcccuuagauuucucaaucaucugacuucuuucaaggaaagcuaugagacgcagaugaacauguuguacucacaacugguugaggcuuuaaguaauaacaaagggccuguguuucacgagcauggauacugguccaagucugauuga

SEQ ID NO: 63694 - RNA, 4494 nt, Artificial Sequence
  derived and/or modified sequence opt3 from TEX14__Homo_sapiens__NP_001188386
augagcagagccgugaggcugcccgucccuugcccaguucagcucggcacccuucggaacgacucccuggaggcucaauugcacgaauacgugaagcaggggaauuauguaaaagugaagaaaaucuuaaagaaaggaauuuacgucgaugcagugaacucucugggucagacagcccuauucguugcggcucuccugggccuucgcaaguuuguggacguccugguggauuaugggucagacccgaaucaucgauguuucgauggaaguacucccguacacgccgcagccuuuagcggcaaccaguggauauuguccaagcuccuggacgcugguggggaucugcgucuccaugacgagagaggacaaaauccuaaaacgugggcauuaaccgccggcaaggaaaggucuacacagaucguugaguucaugcagcggugcgcuucgcacaugcaggccauuauccaaggcuuuucauacgaucugcuuaaaaagauugacagcccacagcgcuugguguauagucccuccuggugugggggacugguccaggguaacccuaauggcucuccaaacagacuacucaaagcgggggugaucagcgcacagaauauauacuccuucggauuuggcaaggccaugcccugguuccaauuuuaucugacuggugcuacccagauggccuaccuugggucacugccugugaucggagaaaaggaggucauucaggcagaugacgagccaacauucucauuuuucagcggcccguacaugguuaugaccaacuugguguggaauggcucuaggguaacugugaaagaacucaaccugcccacacauccucacugcucccgguuacgccuggcugaucuccuuaucgccgagcaagaacacucaagcaagcugcgacauccauauuugcuacagcugauggcggucugucucagucaggaccuggagaaaaccagacuuguguacgagaggauuacgaucgggacucuguuuucuguuuugcacgaacggcguucccaguuccccgugcuccauauggaggucauagugcaccuguuacugcaaauuagcgacgcccuacgcuaucuccacuuccagggauuuauccauagaucgcugucuuccuacgcaguacacauuaucucaccuggugaagcuaggcuuaccaauuuggaguauaugcuggaaagugaggaucggggcguucagcgagaccucacacgcgugccacugcccacucagcuuuacaacugggccgcuccggaggucauccugcaaaaggccgcaaccgugaaaagcgauauuuauuccuucucuaugauaaugcaggaaaucuugacagacgauauuccuuggaaggggcucgacggaagcgucgugaaaaaggccguugugucaggcaauuaccuggaggcugauguaagauuacccaagccauacuaugacaucgucaaaagugguauacaugugaagcagaaagauaggaccaugaaccugcaggacauucgguacauccuaaagaacgaucucaaagacuuuacgggggcgcaacgcacucagccuacagaaucccccagaguucagagguauggccugcacccagacgugaaugucuaccuuggauugaccagcgagcauccccgugaaacuccugauauggagaucauugagcugaaggaaaugggcucucagccacacucaccgcgggugcacagucucuucacagaggggacccuggacccccaagcaccugauccaugcuuaauggcccgagaaacgcagaaccaggacgcucccuguccugccccauuuauggcagaggaagccagcucccccucuaccggacaaccgucgcugugcagcuucgagaucaaugagauuuauuccgguugucuuauauuggaagaugacaucgaggaaccuccaggcgcugccucaagucucgaggcagaugggcccaaccagguagacgagcugaagucuauggaagaggaacuagauaaaauggagagagaagcgugcuguuuuggaagcgaggacgaguccucaagcaaggcugaaacagaguacucuuucgaugacugggauuggcagaauggcucccugaguagccucucucugccugaauccacuagggaggccaaaucaaaccuuaauaacaugaguaccacagaagaguauuugauuagcaagugcgugcuggacuuaaaaaucaugcagacuaucaugcaugagaaugacgaucgccuccggaacauugaacaaauacuggacgagguugaaaugaagcagaaggagcaggaagagagaaugucgcuuugggcaaccuccagggaguuuacaaaugccuacaaacugcccuuggcugucgguccaccuucucucaacuacauucccccagugcugcagcuaagcgggggccaaaagccggauaccucaggaaauuauccuacucugccccgcuucccacgaaugcuccccacgcugugcgacccuggcaaacagaacacagaugaacaguuucaguguacccaaggggccaaggacagucuugagacuucccggauccagaauaccucuagccagggacguccaagagaauccacagcacaagcuaaagccacccaguucaacucagcguuguuuacucugagcagucacaggcagggucccucugccuccccuagcugccauugggauucgacacgcaugucaguggagccggucucuagugagaucuacaacgcugaaucccggaauaaggacgauggcaagguucacuuaaaauggaagauggaggugaaagaaauggcaaagaaagccgcuacggggcagcucaccgugccacccuggcacccucaaagcucucugacucuugagagcgaagccgagaacgagccagacgcacugcuacagcccccuauuagauccccggaaaauacagauuggcagaggguaaucgaguaucaucgagaaaacgacgagccccgcggaaauggcaaguucgauaaaaccgguaacaaugacugugacucagaucagcacgggcggcaaccaagacucggcaguuucacaagcauaaggcauccuucuccccgucagaaggaacagccagagcacuccgaggcguuucaggccucaagugacacucuggucgcuguggaaaagagcuacucccaucaaucuaugcagucgaccugcagcccugagucauccgaagauaucacggacgaguucuugacccccgauggagaauauuuuuacaguucuacagcccaggagaaccuggcauuagagacuagcuccccaauugaagaggacuucgaaggcauccagggggcuuuugcccaaccgcagguuucaggagaggagaaauuccagaugcgcaagauucucggcaaaaaugcagaaauccugccucggucucaauuucagcccgugagaagcaccgaggaugaacaggaggaaacaaguaaggaguccccaaaagagcuuaaggaaaaggacauaagccugacugauauucaggacuugucuucaaucuccuaugagcccgauaguagcuucaaagaagccucguguaagaccccuaaaauuaaccacgcuccaacgucugucuccacaccccucagcccugguucagugaguucugcggccucccaauacaaggacugccuggagagcaucaccuuucagguuaaaacugaguucgcaucauguuggaauagucaggaauuuauacagacacuaagcgacgauuucaucuccgugagggagcgagcuaagaagcuggacucucuucucaccagcuccgaaacuccgccaucacggcugaccggguugaaacgccugucuaguuuuauuggagccggcucgcccagcuuaguaaaggccugcgauuccucuccuccccacgcuacacaaagaaggucacucccaaaagucgaggcauucagccagcaucacaucgacgaacugccucccccaucccaggagcuucuggaugacauugaauugcucaagcagcaacaggguaguucuacggugcugcaugagaacaccgccagcgauggcgggggaacugcgaaugaccagcggcaccuagaggaacaagagacagauaguaaaaaggaagacuccaguaugcugcuuagcaaggagaccgaggaucucggcgaagacacagagcgagcucauucuacucuggaugaagacuuggagagaugguuacagccuccggaagaguccguggagcugcaggaccuccccaaagggucagaacgcgagaccaacaucaaggaucagaaagucggagaagagaagaggaaacgugaagacagcauaacgccagagcggagaaagucggagggcguucuggguacaucugaagaggaugaacuuaaaaguuguuucuggaagaggcuggggugguccgagagcucacgcauuaucguguuggaccaauccgaucuaucugacuga

SEQ ID NO: 63695 - RNA, 8370 nt, Artificial Sequence
  derived and/or modified sequence opt3 from TEX15__Homo_sapiens__NP_112561
augcccagcgacgccaaggauuccgugaacggcgaccugcuccuuaauuggaccucucugaaaaacaucuugucaggguuaaaugcuaguuucccucugcacaacaauacuggaagcuccacuguaacgaccucuaagucgauuaaagauccaagacuaaugagacgggaagaaucaaugggugagcagagcaguacagcaggccucaacgaaguucugcaauuugagaaguccucugacaaugugaacagcgaaauaaaauccacuccgucaaauagugccaguucuuccgagguagugcccggggauugugcgguccuuaccaacggacuggacacaccuuguuucaagaccucagugaaugauagccagaguugggcucauaacaugggcucugaggacuacgauugcaucccacccaauaagguuacuauggccggucaguguaaagaccaggggaacuuuuccuucccuauuagcgugucgaaugucgugucugaaguagagaaccaaaaccacuccgaagagaaggcacagcgcgcccagcaggagucaggaaaugcuuauacaaaagaauacaguagccauaucuuucaagauucccagucuagcgacuugaagaccauuuaucagacgggcugccagacuucaaccguuuucccacucaaaaagaaggugaguaucgaugaguaccugcaaaacacaggcaaaaugaagaauuuugcagaccuggaagacuccagcaaacacgaggaaaagcagacuucuuggaaagagauagauaacgacuucaccaaugagacaaagaucucacccauugauaacuauaucguccuccaucaggaauacaaagagagugaaagccacaauuccuuugggaagucuugugacaagauuuuaaucacccaagagcuggaaauaacgaaaucgagcacuuccacaauuaaggauaaagacgagcuugaucacuuggcccuggaguggcagaucaccccuucauucgaaagucuaucucagaagcauccacagcacagcguggaguaugaaggaaacauucauacuucccucgcuaucgcccaaaaacugauggagcuuaagcuggguaagaucaaucagaacuacgcgucaauuauaacagaagcauuuccgaaacccaaggacaucccucaggccaaagagauguucauugauaccgugaucagcucuuacaauauagagacggcucacgacuccaguaacugcagcauuacccgagaacacaucuguguccaucguaagaaugagaacgaaccaguuucuuuggagaauauccagagagauuauaaagagacagccuacguggaagacaggggccaagaccacaaccucuuuugcaacucccagcugucaaaugauauuugguuaaacguaaauuucaagaagcagacugaccgggagaaccagaaugaagcaaaagagaacagugcuagcuguguggaaaauaacaucgagaauauuuauggggauaagaaacaagacucgcauaccaacgagaauuucuccaacauagaugaaaaggaggacaaaaauuaccacaacaucgaaauucugucuagcgaggaauuuucaacaaaguucaaucucaucugccgcgaggauaacgccgucagugcggccacugcacuucuggaguccgaagaggacaccaucucugcugugaagcagaaagauacagaaaacaccggaagaagcguugagcauuuggccuccacuacguuucccaagacagcuucaagcagugugugugucgccucuaaugcagccauucagauagcuuccgcgaccaugccugcacuaagccugaacaaugacgaucaccagaucuaucaauucaaagaaacuugcucgucagagucuccagacuuuggccuccuggugaagcacaggguaagugauugcgagauugacaccgacaaaaacaagucccaggagagcuuccaucagucuaucaaugagaaccuuguucugcaaagcauugaauuggaguccgagaucgaaauagagcucgaagauugugacgaugccuuuaucuuccagcaggacacacacucacaugagaauaugcugugcgaagaguuugugaccaguuacaaggcuuuaaagagccggauuucuugggagggucugcuagcccucgauaacggggaaauggagguccuggaauccacuacaggacgcgaaaauucagaccagcacuauaguaaggaaagcaacuacuucuacuccucuacgcaaaauaacgagaccgagcuuacuucgcccaucuugcugccggaucuccagauuaaaaucacaaauauauuucgaccuggcuucagccccaccgcagacucacuggcccuuaaggauuccuuuuguacacacgugacugaagcuaccaaaccagagauuaacaaggaagacggcgagauccugggguucgauauuuauagucagccuuucggagaaaaugccgacuaccccugcgaggauaaagucgacaacaucagacaggagucugguccagugagcaacuccgaaauaucauugucuuuugaccucagcaggaauacggauguuaaccauaccagugagaaucaaaacuccgaaagccuguucacagagcccucuaaugugacuaccaucgacgauggcucacggugcuuuuucacaaaguccaagacugacuauaacgauaccaaaaauaagaaagagguagaaagucguauuagcaagcgcaaauuacacaucucgucuagagaccagaacauuccucauaaggaucugaggcggcacaagaucuacgggcgaaaacgcagacuaacgucccaggacagcucagagugcuuuaguucucucucccagggaaggauaaagacauucagccaaucagaaaaacauauuaagaguguccugaauauccuuagcgaugaggcauccuuguguaaaucuaagugccugagccggaagcucgacaaagcggugguucaccugaagaaagcucaccgcagagugcauaccuccuuacagcugaucacuaaggucggcgaagagaggaaagguccacuuccgaagucauaugccauuaucuguaacaauuuuugggagucuugcgauuugcagggguacaguucggugagccaacguaaauauuacuccacaaagcacuucucuucaaagcggaaauacgacaagcgaaggaagaaaagggcacccaaagccgacauuagcaagucccucacccauguaaguaagcacaaaucuuauaagacuagcggcgagaagaagugucugucacgcaaauccauggcuaguagcgugucuaagucccauccuaccacaucacacaugggagaguuuugcaaccaggaacacccagagagccagcuacccguuucgucuacgagucaguccaccagccaaucagucuacuauaauuccucugugagcaacccuagucuguccgaagaacaucagccauucagcggcaagacugccuaccucuuuucucccgaucacucagacgagaaacugauagaaaaggagaaucagaucgauacagcauuccuuaguuccaccagcaaauaugaaaaguuggagaaacauucugcuaaccacaaugugaaggacgccacaaaggaaaacucgugcgaugcgaacgaggucauuaaugagucaaacagcguuucccugaguuguaucaaagaaaauauuaacucuagcacugggaaugacugcgaugccaccuguaucggacacacgaaggcuaaaacagacguguuaauauccgugcucgauucaaacguaaagcauuuucugaaugaccuuuaccagcaagguaaccugaucuugagugauugcaaacggaaucucgaggucaaguggaccgacccgauugaaagaccuaagcagaacaucauuacuggcaauuuccugauggggccacuaaaccugacccucaucgcaucuaaaaaguauagcauaccccagcuguccgccgcugccgugacagauucagagggagagagcucuaaauccuaccuugacaagcagaggauuuugacuguugacaguuucgcagcgagcucgaccgugccucacugugaacaauccugccgcgagaaagaacuguuaaagacagagcaguguucuucaggcaauugccuccauacggaugguaacgaaaccaaugucacugagaacuacgagcuggacguggccagcgggacagaagaggauaaaaguuauggcgaaaacaucguugagcuuuccucuagcgacucaucccugcuacucaaggauaaugugaagggaaguagcucugaaaccuguaucgucaaaaaggacacugaggaucgaauuacauggaaagucaagcaggcugagaaagccaaggacucaguguacaagcgguccaugaccgaaggcagcacggugaacacugaguauaaaaaucagaagaaccaaauaucugaagagaguugccugaaugagaaaauaauuaccacaaacuugaucgauucgcaccuguccaccaagaauacuacaaccgagagcgucccccucaaaaacacaguuucaaauccacuaaacaagcgugagaagaaaggggaaauuaaggugucuaaagacagccaguccgaucugacucuucauagugagaucgcauacauaucaaagccuggaauccuggguguaaaucacacccccauuuugccagcucacucugaaacguguaaagugccgacacuccugaagaagccugccagcuaugucuccgacuuuaaagagaagcauugcagugcaaaccacaccgcccuaaucgcuaaucugagccagauucuucaaagagcggaugaggccuccucucuccagauccugcaggaagagacuaaagugugcuugaacauacugcccuuauucguugaagcauuugagaggaagcaggaauguucaguggagcaaauucucaucagccgcgagcugcuugucgaccagaaucuguggaacaacugcaaacauaccuugaagccaugugcuguggacacacucguugaacugcagaugaugauggagacuauccaguucauugaaaauaaaaagcggcaccuagagggcgaacccacccugagaucgcuucucugguacgaugagacgcuguaugccgaguuguuagggaagccuaggggauuucaacagcaguccaacuucuacccaggcuuucagggucgacugaaauacaaugccuucugcgaacuccaaacauaucacgaccagcugguggagcuucuggaagagaccaagcgcgagaaaaacaguuacuaugucuuuuugaaguacaaacggcagguaaaugagugugaggcuaucauggaacauugcucugauuguuucgacuuuagccuaucagugcccuucacuugcgggguuaacuucggcgauucccuggaggaccucgaaauacugagaaagucuacacuuaaguuaauuaauguguguggagauaguccuaaaguccacagcuauccgggcaagcaagaccaucuguggaucauuaucgagaugauauccucaaaagugaacuuuauuaagaauaacgaggcaguaagggugaaaaucagccucuacggguuggaacacaucuucuuugaugccgcgaagaaucuggucuggaaggagcguacccagucuuucaguaaaaaguauucccagaaaaaggacgaagaacgccuccugcggguuaacaaaugcgcuuuuagcaaacuucagaagauuuacgauacucugucaaaagacuugaauaacgaaccaaucucucccauuggacuagaggaggacacaauaaucgccuccagaaagucggaucauccuauuaaugaagcaaccaucagcaucgagaacaguaaauucaacucuaaucugcucgcccacccagacauuuguugcauauccgaaaucuuagaucaagcugaguuugcagaccugaagaaacuucaggaucugacgcucaggugcacugaccacuuggaaauucugaagaaauacuuccagaugcuccaggauaacaauauggacaacaucuuuauuaccgaggagaaugugcuggauguggucaucaaccauagccacgaagccauaauccuuaagcccgaggcgauugaaauguauaucgagauugugaugguuucagaaacaauccauuuccuaaagaauaguauagcuaaaaagcuggacaaacaacgauuucggggcauguugugguucgauuuaucccugcucccugagcugguacagugucaggagaagauggccagcuuuucuuuccuuaaagacaacucaaccgaugugugccuguggaaggucauugaaacagcagugagcgagcucaagaaagacuuggacaucauuuguaaguacaaugaagccguuaacugcuccuaugcuauccaccuguuaucucgcgagcugcaggagcucagugaaaucaagaaacuucugaagaaaucgaaauacuucaucagcacuuauauugauuuugugccguacaucgccuccauuaauuaugguucaaccgucacggaguuagaauacaacuacaaucaauucucuacauugcugaaaaacgugaugagcgcacccagaaaggaccucgggaaaauggcucacaucaggaagguaaugaaaacuauagagcauaugaagaugauuuguaccaagaaugccgaacugacaaucagcuuuuuccuuugccagaugcuguauaaccggcgaaaaauccuccaguugaagagaaaagagaagaugaacauucacaucgucaaaccaggagagaauaacaauaaguuuuccauaucaaccaugcugccucccgugucugaauguauuaacaagaauaucagcaacuccaguaaaaagcgcccaagcacuguugauaaaugcgaggacucucaggaacaacagcaggauaccacagugucauccuguaagaaauuaaaggucgacaugaaagaugugacgaagauuaauagggagaaggcgacuuucaaacauccucguaccacaggcagccaccccaagagugaaaacaaaaucguuccaucuuccugcgacucgcuaaagcggaaucaucugaccccgaaaaagguggagaugcaaagaagccucccugguucacuucugcccuuggagaacccaaaggauacuugugccuccaaaucugaaaguaagauagaccugacagucagcucagaucacuuuuccggccagcaggagaaucucaacagcaugaaaaagaggaaugugaacuucucugcagcugaaaccaaaagugacaagaaggacugcgccgcuuuugcaaucugcgaucagaaauccguacacgggacguucagccccgaccauggaacucugcuucaaaaguuucucaaaaauucaccugauccaacacagaagucuugucugucggacauuaaccccgagaccgaugugagcuugguuccugacgccuccguccugaguaaaccgaucuucugcuuugugaaggaugugcacccagacuuagaaaugaacgauaccgucuucgagcuacaggacaaugauauuguaaacucuucaaucaagaauagcuccuguaugacaagucccgagccuauuugcauccagaacaaaauacccacacugcaaauuaauaagcuccagccaaccgaaacagagucugaagacaaauacaugaaggauacucuuaacccuaauacggugcauaccuucggcgccagcgggcacaucacacugaacguuaaucagggagcugaguauuccuugucagagcagcaaaacgacaaaaauagcaaggugcugaugcagaacgcggcaacuuacuggaaugaacucccccagucugccuguaacccaaccuauaauuccagugagcaucuguuuggcacaucauacccuuauagcgcuuggugcgucuaccaauacucgaacuccaacgguaaugccaucacccagacuuaucaggggauuacgucuuacgaagugcagccgagucccagcggacuuuuaaccacaguugcaucaacugcccaaggcacccacuccaaccugcucuauucucaguacuucacauauuuugcuggugagccacaggcgaauggcuucgugccugucaacggguacuuucagagccaaauacccgccaguaauuuccgccagccaaucuuuucccaguaugcaagccaccagccuuugccccaagcuaccuacccguaccugccaaaccgauucgugccucccgaaguaccauggguguaugcccccuggcaucaggagucuuuucacccuggacauuga

SEQ ID NO: 63696 - RNA, 942 nt, Artificial Sequence
  derived and/or modified sequence opt3 from TEX264__Homo_sapiens__NP_001230655
augagcgaccugcuccuucugggcuugaucgggggauuaacccugcuacuccugcuuacacuguuggccuucgcugguuacuccggccuccuggcagggguggaggucucugccggaucacccccuauuagaaacguuacuguggcguauaaguuucacaugggccuguacggugaaacggggagguuauucaccgagaguugcagcauauccccaaaacuccggucuaucgcuguauauuacgauaauccgcauauggugcccccugacaagugucgcugcgccgucggaucgauucugucagaaggcgaggaaagcccaagucccgagcuuaucgauuuguaucagaaauuuggcuucaagguguuuuccuucccugcaccaucucacguugugacagccacuuuucccuacaccacaauucugagcaucuggcuagcuacccgacguguccauccugcacucgacacuuauauaaaagagagaaagcugugugccuacccaaggcuugaaaucuaccaagaggaucagauucacuucaugugcccgcuggcucggcagggggacuuuuaugugcccgaaaugaaggagacagaguggaaauggcgcggauugguagaagccaucgauacccagguugacgguacgggcgcggauacuauguccgacaccucaagugugagccucgaggucucuccuggguccagagaaacaucagcagccacucugagcccaggagcuaguucuaggggcugggaugacggugauacccgguccgagcauagcuacucggaaucuggggccuccggaucaaguuucgaggaguuagaccuggaaggcgagggcccccucggggaaagccgccuugacccuggaacagagccacuggguaccacgaagugguugugggaacccacugcaccggagaaaggcaaggaguga

SEQ ID NO: 63697 - RNA, 456 nt, Artificial Sequence
  derived and/or modified sequence opt3 from TEX29__Homo_sapiens__NP_689537
auggaguacgugcuggaagucaagaacagccccagacaccuccuuaaacaguucaccguuugcgacgugccucuguaugauaucugugacuacaauguauccagggaucggugccaagaguugggcuguugcuuuuaugaagggguguguuacaagaaagccgucccaauuuauauacauguguucucugcuuuaaucguuauuaucgcaggagccuuugugauuacaaucauauaccgcgucauccaggagucacgaaaggaaaaagcgauuccgguggacguagcucugccccagaagaguagcgagaaggccgagcuagcauccucuucgucaaaacucggucugaagccugccagcccagggcccccuagugcuggcccauccaugaaaucugaugaagacaaggaugacguuacuggaacgaucaccgaggcagaagagacagaggauuga

SEQ ID NO: 63698 - RNA, 561 nt, Artificial Sequence
  derived and/or modified sequence opt3 from TEX30__Homo_sapiens__NP_001273705
augaaccugccccaccucaugagccuugccucccaucuggcuucucacggcuucuuuugcuugagauucaccuguaagggguuaaauaucgugcauaggauuaaagcauacaagucaguccugaacuaucuaaaaacaaguggagaguacaagcucgccgguguuuuucugggcgggcggagcaugggaucccgcgcggcugccucugugaugugccacauagaaccugacgauggcgacgauuucguacgaggucuuaucuguauuucguauccacugcaucacccgaaacagcaacacaaguugcgugacgaggaucucuuuagacugaaggaacccgugcuguucgucucagggagcgcagacgagaugugcgagaaaaaucucuuagaaaagguggcccagaaaaugcaggcuccucauaagauccacuggauugagaaagcaaaccauaguauggccguuaagggaagguccacuaaugauguguuuaaggaaaucaacacgcagauacuguucuggauccaagagauuaccgaaauggacaaaaagugucacuga

SEQ ID NO: 63699 - RNA, 648 nt, Artificial Sequence
  derived and/or modified sequence opt3 from TEX35__Homo_sapiens__NP_001164193
augagcgccaagagagcugagcugaaaaagacccaccucgugaaagaaaggcauugcuggacauccaagaacuacaaagcagucugucuugagcugaagcccgaaccuacuaagacguucgacuauaaagccguuaagcaggagggccgguuuaccaaagcgggggugacacaagauuugaagaaugaauuacgcgagguacgagaggaacugaaagagaagauggaagagaucaagcagauuaaagaccuaauggauaaggacuucgauaaacuccacgaguuuguggaaauaaugaaggagaugcagaaagacauggaugaaaagauggacauccugauuaacacucagaaaaauuacaaacuuccacugcguagagcuccgaaggagcaacaggaauugaggcucaugggaaagacccaucgggagccccagcugcgcccuaagaaaauggauggugccucuggcgucaacggggcaccaugcgcccugcacaagaaaacaauggcuccccagaagaccaagcaaggaucacucgacccuuuacaucacuguggcacuugcugugagaaaugccugcuuugugcauugaagaauaacuauaauagagguaucuacgccgcuguggggcugcuagaucucugguga

SEQ ID NO: 63700 - RNA, 603 nt, Artificial Sequence
  derived and/or modified sequence opt3 from TEX40__Homo_sapiens__NP_001034585
auggaggaaaagcccagcaaagugucccugaagucuucagacagacagggcagugaugaggaaagcguccacuccgacaccagggaucucuggacaacuacgacccuuucucaagcccagcugaacaugccuuugucggagguuugcgaaggguucgacgaggagggacggaauaucucaaaaacacgcgguuggcauagcccaggccgagggaguuuagaugaaggauacaaggcuucccacaaaccggaggaacuggacgagcaugcccuaguggagcucgaacugcaccguggcucuagcauggagauuaaccuuggugaaaaggauacugcaucccagauagaggcggaaaagucaaguagcaugucuucccugaauaucgcuaaacauaugccccacagagccuauugggcagagcagcaaucaagguugccucucccacugauggagcugauggaaaacgaggcccucgaaauuuuaaccaaggcucugcggagcuaccagcuugggaucggacgcgaccacuuuuugacaaaagagcugcagagauauauugaaggccuaaagaaaaggcggaguaagcgccucuacguaaauuga

SEQ ID NO: 63701 - RNA, 645 nt, Artificial Sequence
  derived and/or modified sequence opt3 from TFAM__Homo_sapiens__NP_001257711
auggccuuccugagaagcauguggggcgugcucuccgcucuugggaggucuggagcagagcugugcaccgguuguggcucacgguugcgcagucccuuuagcuucgucuacuuaccucgaugguuuuccucuguucuggccucgugcccaaagaaaccggugucaagcuaucuacguuucaguaaggaacagcuccccaucuuuaaagcgcaaaacccugacgcuaagacaacugagcugauuagaaggauagcccagcgguggcgcgaacuuccagauuccaaaaagaagaucuaccaggacgcauauagagccgaguggcagguauacaaagaagagauuucuagguucaaggagcaacugacgcccagccagaucauguccuuggaaaaagagauuauggauaagcaccucaaacggaaggcuaugaccaagaaaaaggaaaaacugaagacagugaaagagaauuggaagaaccugucagacagugagaaagaacucuauauccagcaugcaaaggaggaugaaacucgcuaccacaaugagaugaaaagcugggaggaacagaugauagaggucgggcgaaaggacuuacugagaaggaccaucaagaaacaacggaaguauggagccgaagaguguuga

SEQ ID NO: 63702 - RNA, 1296 nt, Artificial Sequence
  derived and/or modified sequence opt3 from TFAP2A__Homo_sapiens__NP_001027451
augcuggugcacagcuucuccgccauggacagacaugauggcaccucuaacgggacagcuaggcucccccagcuuggaacugucggucaaucaccuuacacgagugcaccaccgcugagccacacccccaaugccgacuuucagccuccauauuuucccccuccauaccagcccaucuauccucagucccaagauccauacucucauguuaacgacccguauucguugaaucccuuacacgcgcagccucagccacagcaucccggcuggccugggcaacggcagucacaggagagcggacugcuacacacacaccgcggccucccacaucagcugaguggucuugauccccgacgugacuacagaaggcacgaagaucuguugcaugggccgcacgcucucuccucuggacugggcgaccugagcauucacucccucccucaugccauagaggaagugccccacguagaggauccaggcaucaacauuccugaccaaacugugaucaagaaagggcccgucucauuaaguaagagcaauucuaacgcaguguccgccauuccaaucaauaaagauaaccuguucggagguguugugaaucccaacgaagucuucugcucagugccuggccggcuuagcuugcugaguucuaccuccaaguauaaaguaacaguugcugaggugcagcgcagacuaagcccaccggagugucucaaugcaucgcugcuugggggaguccugaggcgggccaagucuaagaacggcggucgcuccuugcgagaaaaacucgacaagauagggcugaauuuacccgcuggaagaaggaaagccgcgaacgugacccugcucacuucacuuguggagggcgaagcaguccaucuggcccgggauuuuggcuacguuugcgagacagaguucccugcuaaggccguggcagaauuuuugaaucgucagcacagugacccaaacgagcaaguaacccgcaaaaacaugcuacuggcuacgaagcagaucuguaaggaguucacugaccuccuggcccaggauagaagcccccuuggaaauuccaggccuaacccaauucuggaacccgggauccagucuugcuugacccauuuuaaucucauuagccacgguuucggcucaccggcggugugugccgcagucacagcucugcaaaacuacuuaacugaagcccugaaagcuauggacaagauguaucuaaguaauaacccuaauucccacaccgauaacaaugccaaaagcucugacaaggaggagaaacaucggaaguga

SEQ ID NO: 63703 - RNA, 1383 nt, Artificial Sequence
  derived and/or modified sequence opt3 from TFAP2B__Homo_sapiens__NP_003212
augcacagucccccuagagaccaggccgcuaucaugcuguggaagcucguggagaacgucaaauacgaagauauuuaugaggacaggcaugauggcguuccaucccacucuucacggcuuagucaacuggggagcgugucccagggaccguacucuucggcacccccuuugucacauaccccaagcagugacuuccagcccccuuauuuuccacccccuuaccagccauuaccguaucaccaaucccaggaucccuacucucauguaaaugacccuuauagccugaacccacuacaccagccccagcaacacccuuggggucagcgccagcgacaggaagugggcuccgaggccgggucacuccugccacaaccccgugcggcccuuccgcagcugaguggauuggauccuagaagggacuaccauagcguccggcgccccgaugugcuccugcacucugcucaucacggccuggacgcagguaugggggauucccucucauuacacggacugggccauccaggcauggaagacguucagagcguggaggaugccaauaacagugggaugaaucuuuuggaccaaucugucauaaagaaagugccuguacccccaaaguccguuacaagccugaugaugaacaaagacggauuccuagguggcaugucggugaauacuggggaggucuuuugcucugugcccggaagacucucccugcuuucaaguacgagcaaguacaaggugaccgucggcgaaguucagaggcggcuguccccuccagaguguuugaacgcuucucuccugggugggguguuacgccgagcaaaaagcaagaauggaggcagaucacugagggaacggcucgagaaaaucggccuuaaccugccggccgggcgucgcaaggcugccaauguaacauugcuaacuagccugguggagggagaagcgguccaccucgcaagagauuucgguuauauuugcgagaccgaauuucccgccaaagcuguguccgaguaccugaacaggcagcauacagacccuagcgaucuucacucucggaagaauaugcuguuggccaccaagcagcucuguaaagaguucacugaccuguuagcacaagaucgaacaccaaucggcaacucacgccccaguccuauucuggaaccagggauccagagcugccuaacccauuuuucccucauaacgcacggauucggcgcucccgccaucugugcggcccugacugcacuucagaauuauuugaccgaggcucugaaggguauggacaaaauguuucucaacaacacaacuaccaauagacacacaucuggggaaggcccgggaucgaagaccggcgauaaagaggaaaagcauaggaaauga

SEQ ID NO: 63704 - RNA, 1353 nt, Artificial Sequence
  derived and/or modified sequence opt3 from TFAP2C__Homo_sapiens__NP_003213
augcuguggaagaucaccgacaacgugaaauacgaggaagauugcgaggacagacacgauggcagcuccaaugggaaccccagggucccucaucucucuucagccggacagcaccuuuauaguccagcuccgccccugagccauacagguguugcagaauaccaaccuccacccuauuucccuccacccuaccagcaguuggccuauucccagucugcggacccuuacucgcacuuaggcgaggcuuaugccgcagccauuaauccacugcaucaaccggcucccacugggucacagcagcaggcauggccuggacggcaaagccaggaaggcgccggucuaccaagucaccacgggcgccccgcuggacuccugccucaucuuuccggccuggaggccggcgcggugucugcacgacgugaugccuacagaaggagcgacuugcuccugccacacgcucaugcccuggaugcagcugggcucgccgagaacuuaggacugcacgacaugccccaccagauggaugaaguacagaauguggacgaucaacaucuuuugcugcacgaccagacggucauacggaaggguccgaucuccaugaccaaaaacccucuaaaucuccccugucagaaggagcuggugggcgcgguuaugaacccaacagaaguguuuugcucagucccugggcgccuuagucuguugagcucuacuuccaaauacaaggugaccguagccgagguucaaagaaggcucucacccccagagugucugaaugcuagcuuacugggaggcgugcuccggcgcgcaaagaguaaaaacggugggcgaucucuuagagaaaagcuggauaaaauuggauugaaucuacccgccggcaggcggaaggcugcccaugucacacugcucaccucccugguggagggcgaagcagugcaccuugcccgugacuucgcuuaugucugcgaggcggaauuuccuagcaaaccaguugcagaguaccugacucgcccgcaucucgggggaagaaacgagauggccgcuaggaagaauauguugcuggccgcacagcaguuauguaaggaguucacagaacugcuaucgcaggaccggacgccccacgguaccucucgacucgccccugugcuggaaacuaacauccaaaauugccuuucccacuuuucauugauuacccauggcuucgggagucaggcuaucugugccgcaguaagcgcgcugcagaacuauauaaaagaggcucucaucgugauugauaaguccuacaugaacccaggagaccagucucccgccgauagcaauaaaacacuggaaaagauggagaaacaccgcaaguga

SEQ ID NO: 63705 - RNA, 1017 nt, Artificial Sequence
  derived and/or modified sequence opt3 from TFAP4__Homo_sapiens__NP_003214
auggaguacuucauggugcccacccagaaggucccuagccugcaacacuuuagaaaaacagaaaaggagguuaucggcgggcucugcucccuugccaacauuccacugacuccggaaacgcagagggaccaggagcggcgcauacgacgugaaaucgcuaauucuaacgagagaaggcggaugcagucaauuaaugcaggauuccaaaguuugaaaaccuuaaucccccauacagauggugagaagcugagcaaagccgcgauucuacagcagacugcugaauauaucuuuucccucgagcaggaaaagacccgccugcuucaacagaacacacagcugaagagauucauacaggaguugucuggcucgucaccuaaaaggcggcgcgccgaggacaaggaugaagggaucggaagcccagacauuugggaggaugaaaaagcagaggaccuccgaagagaaaugaucgagcugaggcaacagcuggauaaggagcggagugugcguaugaugcucgaagaacagguacgcuccuuagaagcccacauguaccccgagaaacugaaggugauugcucaacagguccagcuucagcaacagcaggaacaggugagauugcugcaucaagagaagcuagagagggaacagcagcagcuccggacccaacugcuuccuccacccgcaccuacucaccauccaacaguuaucgugccggcucccccuccacccccuucucaccacauaaaugucgugaccaugggcccaagcuccguaauuaacucaguuaguacgagccgacagaaucuggacacuaucgugcaggccauucagcauaucgaggguacccaagaaaaacaggaguuggaagaggagcagcgcagagccgucaucgugaagcccgugaggucuuguccggaagcgccuacauccgauacugcaucagacagcgaggccagugauucugacgcuauggaucaaucccgggaggagcccagcggggacggagagcucccauga

SEQ ID NO: 63706 - RNA, 1041 nt, Artificial Sequence
  derived and/or modified sequence opt3 from TFB1M__Homo_sapiens__NP_057104
auggccgcuagcggcaagcugucuaccugcagacuucccccucucccaacaaucagggagauuauaaaacuguugcgguuacaggcagccaagcagcugucccagaacuuccuacucgaccugcgccuuacugauaaaaucgugcgaaaggcggggaaucugacgaacgcuuacgucuaugaaguuggaccgggucccggcgggauuacccguucaaucuugaaugccgacguggcagagcuccugguaguggaaaaagauacaagauuuauuccuggacugcagaugcucagugacgccgcuccaggcaaguuaaggaucguccacggugaugugcugacuuucaagguugagaaagcauuuagcgaaucccuuaagcggcccugggaggacgauccuccaaacgugcauauaaucgggaauuugcccuucucugucucgaccccucugauuaucaaauggcuagagaacauuucaugucgcgacggaccauuuguguacggcagaacacagaugacccucacuuuccaaaaggaaguagccgagaggcuggcugccaauacaggcagcaaacagcggagucgccuuuccguuauggcgcaguaucugugcaacgugcgacacaucuuuaccauaccggggcaggcauucguccccaagccugaaguggaugugggagucguucauuuuacgccauugauucaacccaagaucgagcagccuuucaaacucguggagaagguagugcagaaugucuuucaguucagaaggaaauacugucaccggggucugcguauguuauuuccagaagcccaacgccuggagucuacuggcagacuccuugaacuggcugacauugaucccaccuugaggccgcggcagcuaagcaucucccauuucaagucacugugcgacguguaucgaaaaaugugugaugaggacccucaacucuucgccuacaacuuucgcgaggaacugaagagaaggaaaaguaagaaugaggaaaaggaggaagacgaugcagagaacuaucggcuuuga

SEQ ID NO: 63707 - RNA, 1191 nt, Artificial Sequence
  derived and/or modified sequence opt3 from TFB2M__Homo_sapiens__NP_071761
auguggauccccguggucggccugccuagaaggcuccggcuuagcgcccuggcuggggcaggacgcuucugcauuuuggguuccgaggccgcgacccgaaagcacuuaccagcucguaaccauuguggccugucugacucaaguccgcagcuauggcccgaaccugauuuuagaaauccacccaggaaagccagcaaggcaucccucgacuucaaacgguacguuacagaucgcagacuggccgagacucuugcucaaauauaucuggggaagccuucuaggccaccccacuugcuccuggaaugcaacccuggaccaggcauccugacgcaggcacucuuagaggccggugcuaaagugguagcccuggaaucggacaagaccuuuauuccgcaucuugagucauuggggaagaaucuggauggaaaacuacgggugauccacugugacuucuuuaagcucgauccccgcagcggcggcgucauuaaaccuccagcgaugaguucccgagggcuguucaagaaccuuggaaucgaggcagugcccuggacagccgacauaccucugaaaguuguggguauguuuccaucuagaggcgaaaagagggcuuuguggaagcucgccuacgaucuguauagcugcacuuccaucuacaaauucgggcggauugaggucaauauguuuaucggagaaaaggaguuccagaaauuaauggcagaccccggcaacccggaucuguaucaugugcucucaguaauuuggcagcuugcuugugagaucaagguucugcacauggaaccuuggaguagcuuugacauauacacccguaaaggucccuuggagaauccaaagcgcagagaacuacuggaucaacuccagcagaaacuguaucuuauucagaugaucccuaggcaaaaccuguucacaaagaauuugacccccaugaacuacaauaucuuuuuccaccuccugaagcauugcuucgggcggcgaucugccacugugauugaccacuuacgcucccugacaccacuagacgcgagagauauccucaugcagauuggaaaacaggaggacgaaaaggucgugaacaugcauccccaggauuuuaaaacccuguucgagacgauagagaggucaaaggacugugccuacaaauggcuuuaugaugaaacuuuggaggaccgguga

SEQ ID NO: 63708 - RNA, 1353 nt, Artificial Sequence
  derived and/or modified sequence opt3 from TFCP2__Homo_sapiens__NP_001166924
auggccugggcucugaagcucccccuugcagacgaggugaucgaaagcggccugguccaggauuucgacgccuccuugucugggauuggacaagaguuaggugcgggcgcuuacucaaugagugauguucuggcccuaccuauauuuaaacaggaagagagcucccucccaccggacaacgaaaauaagauccugcccuuccaguaugugcuuugcgcagccaccucuccugcuguaaaacugcacgaugagacauugacuuaccucaaccaggggcaaucguaugagauuagaaugcuggacaauaggaagcugggagaacucccagagaucaacggcaaauuagugaagucaauuuuucgggucguguuccaugaucgccgacugcaguacacggaacaccagcagcuugaggguuggcguuggaauagacccggggacaggaucuuggauauagacaucccuaugagcguuggaauuaucgauccacgggcaaaccccacccaacugaauacaguggaguuucuaugggacccugccaagcgcaccagugucuucauucagccaaaaggcgcugauagaaagcagaaaacugacagggaaaagauggagaaacggacaccgcaugaaaaggagaaguaucagcccuccuacgaaaccacuauccucacagaguguucuccuuggccagagauaaccuaugugaacaauagccccuccccuggcuuuaacucaagucacagcucuuucucccugggggaaggaaaugguucaccaaaccaucaacccgagccgccucccccaguaacggacaaucuucugccuacuaccacaccccaggaagcccagcaaugguugcaccgcaaccgauuuagcacuuucaccagacucuuuacaaauuucaguggcgcggaucuguuaaaacugaccagggacgauguuauucagaucugcgggccagcagacggcauucggcucuuuaacgcccuuaagggacguauggugcgccccagacugacgaucuacgucugucaggagucuuugcagcuaagggaacaacagcagcagcaacagcagcagcaacagaaacacgaggauggugacuccaacgggacuuucuucguguaccaugcuaucuaucuggaggaacucacagccguggagcugaccgaaaagauugcacagcuuuuuagcauaucgccuugccagaucucucaaauuuacaaacagggaccaacuggcauccacguccugauauccgaugagaugauucagaauuuccaagaagaggcuuguuuuaucuuggacacaaugaaggagaccaacgauucauaucauaucauucucaaauga

SEQ ID NO: 63709 - RNA, 1233 nt, Artificial Sequence
  derived and/or modified sequence opt3 from TFDP1__Homo_sapiens__XP_005268384
auggccaaggacgcuggccugaucgaggcaaacggggaacucaaaguguucauugaucagaaucuuagccccggaaagggugucguuucccugguggccguacacccuucuaccgugaacccauugggcaaacaauuacugccgaagacauuugggcagucaaaugucaacauagcgcaacaggugguuaucggaacuccccaaagaccugcugccaguaauacgcuaguggucggcagcccacauacccccuccacacacuucgcaucucagaaccagccuucggacucaagcccauggagugccgguaaaaggaaucggaagggggagaagaacggaaaaggccuccgccauuuuuccaugaaggugugcgaaaaaguacagcgaaagggcacuaccucuuacaaugagguugcugaugaacugguggcagaguucagcgccgcugacaaccacauucuucccaaugaguccgccuaugaucagaaaaacauccguagaagggucuacgacgcgcugaauguguugauggcaaugaacauuaucucaaaggaaaagaaagagauaaaguggaucgggcucccuacaaauagugcccaggaaugucagaaccuggagguggagcggcagcgcagacuggaaaggauuaaacaaaagcagagccagcuccaagaguuaauccugcagcagauugcuuuuaaaaaccuuguccagcggaaucgccaugccgaacaacaggcaucucgaccaccgcccccuaacuccguuauccacuugccauucauaauugugaauaccucaaagaaaacuguaaucgauugcagcauuaguaacgacaaguuugaguaucuguucaauuuugauaacacauucgaaauccacgacgauaucgaggugcuaaagagaaugggaauggcuuguggucucgagucuggcuccugcagcgccgaagaccugaaaauggcgaggucgcuuguccccaaggcccuggagccuuacgugaccgaaauggcacaggggacgguuggaggcguguuuauuacuaccgcugguucuacauccaaugggacucgguucucagccagugauuugaccaacggagcugacggcaugcucgccacaagcuccaauggcucucaguauagcgggucacgugucgagaccccagugaguuacguaggagaagacgaugaggaggacgaugacuuuaacgaaaaugaugaggacgauuga

SEQ ID NO: 63710 - RNA, 1161 nt, Artificial Sequence
  derived and/or modified sequence opt3 from TFDP2__Homo_sapiens__NP_001171609
augaucauuagcacaccccagagacugaccuccucuggcucagugcucauagggaguccuuacacuccagccccggcuauggucacgcaaacccacaucgcagaggccacaggauggguucccggugacaggaagcgggcgcgcaaauucauugauagcgacuuuuccgaaucuaagcgaucgaaaaagggcgauaaaaacgggaagggacuucgucauuucucaaugaaggugugcgagaaaguacagagaaagggcacuaccagcuauaaugaaguggcugacgagcuggucagugaauuuacaaacuccaauaaccacuuggccgcagauucucaggccuacgaccagaaaaauaucaggcggcgcguguaugaugcuuuaaacguucugauggcaaugaauauuaucagcaaggagaaaaaggagauaaaguggaucggucuaccuaccaacuccgcccaagaaugucagaaucucgagauugaaaaacagagaaggaucgagcggauuaagcagaaacgcgcucaacugcaggagcuucuguugcagcagaucgccuucaagaaccucgugcaacgaaauagacagaacgaacagcaaaaucaggggccacccgcgcugaacucaacuauacagcugccuuuuauuaucauuaauacaaguaggaaaaccgucaucgacugcagcaucucuuccgauaaguucgaguaccucuuuaacuucgacaacacguuugaaauucaugaugacauagagguguuaaaacggaugggaaugucauucggccuggaaagcggcaaguguagucuugaggauuugaagcuggcaaaaucucuaguaccaaaggcccucgagggguauaucacugacauuuccaccggacccagcuggcugaaucagggucuucuguugaacucgacacaaucuguuuccaaucucgaccugacuaccggcgcuacauuaccucagucaagugugaaccaggggcugugccucgaugccgaagucgcacuugcuaccggacaguuucuggccccaaauagccaccaauccucuagcgcggccucacauuguagugagucccguggcgaaacgccgugcagcuucaacgacgaggaugaagaggacgaugaggaagacucuucaagucccgaguga

SEQ ID NO: 63711 - RNA, 1218 nt, Artificial Sequence
  derived and/or modified sequence opt3 from TFDP3__Homo_sapiens__NP_057605
auggccaaguacgugagccugaccgaggcuaacgaggagcucaaaguccuuauggacgaaaaucagacauccagacccguugcagugcacacuucuacgguaaacccucugggcaagcaauuguuaccaaaaaccuucgggcagucaagugugaauaucgaucagcaggucgugauuggaaugccgcaaaggcccgccgcgagcaacauaccuguuguggguuccccaaaucccccuucuacacauuuugcuucgcagaaccagcacucauauagcaguccacccugggccggccagcauaaucggaagggggagaaaaacggaaugggccugugccgccuauccaugaaggucugggaaacugugcaacgaaaggguaccacaucuugucaggagguaguuggggagcucguggcaaaauuccgugccgcuagcaaucacgcauccccuaacgaaucagccuacgacgucaagaauaucaaaagaaggaccuaugaugcucugaacgugcuuauggccaugaauauuaucagucgggagaagaaaaagauuaaguggaucggacugacuacaaacagcgcgcagaauugccagaacuugcgcguggaaagacagaaaaggcucgagcggauaaagcaaaaacagucugagcugcaacagcugauccuccagcagauugcauuuaagaacuuaguccugcgcaaucaauacguugaagaacaggugucccagcgaccacuuccgaacucaguaauccaugugcccuucauuaucauaagcaguucuaaaaagaccgucauuaauuguuccaucagcgacgauaaaucggaauauuuguuuaaguucaacucuuccuuugagauucacgacgauacggaagugcugauguggaugggcaugacuuucggccuagagucagggaguugcagcgccgaggaccucaagauggcuagaaaucugguuccuaaagcccuugaaccauacgugaccgagauggcacagggaacauuugguggcgucuucacuaccgcuggguccaggucuaacggaacauggcugagcgccucagauuugaccaauaucgcgaucggcaugcucgccacgaguuccggugggagccaauauucuggaucacggguggaaacucccgcaguagaggaagaggaggaagaggacaacaaugaugacgaucugagugaaaacgacgaggacgauuga

SEQ ID NO: 63712 - RNA, 1728 nt, Artificial Sequence
  derived and/or modified sequence opt3 from TFE3__Homo_sapiens__NP_006512
augagccacgccgcugagcccgcaagagacggcguggaagccuccgcggaggggccuagggcugucuucguucugcucgaggaacggcgcccagccgauucugcacagcuucugucauugaacaguuuacugccggaaagcggaaucguggccgacauugagcuagagaauguacucgaucccgacuccuuuuacgaacugaagucucaaccucuuccacugcgaucgucauugcccauaagccuccaggcuaccccugcaacaccagccacucugagugcuuccucuagcgccgguggcucccguacgcccgcgaugucaaguucuagcuccucaagagugcugcucaggcagcaguuaaugcgggcacaagcccaggagcaggaacgcagagagaggcgggagcaggcugccgcagcuccuuucccaagcccggcccccgcgaguccugccaucucugucguggggguuuccgcaggaggccauacccugagccgcccacccccugcucaagugccacgagaaguccuuaaagugcagacacacuuggagaaccccacuagauaucaucugcagcaggccaggcggcaacagguaaagcaguaccuaucgaccacacucgguccgaaacuggcuucucaagcccuuaccccucccccagggccugcauccgcccagccccugccagcucccgaagcggcacacacuacaggaccuaccggcucagccccaaauaguccgauggcuuugcucacgauuggcagcuccucugagaaggaaaucgaugacguuauugaugagaucauaagccuggagucaaguuauaacgacgaaauguuauccuaccugcccgggggaacuaccggucuccagcuuccuagcacacugccagugucuggcaauuugcuagaugucuauucaagucaggggguggccacucccgcaaucaccgugagcaacuccugcccugccgagcugccaaauauuaaacgugaaaucucugagacagaagcuaaggcccuccugaaggagcgccagaaaaaggacaaccauaaucuuauugagagaaggcggcgauuuaacaucaaugaucgcauaaaagaacugggaaccuugauucccaagucgagcgacccggagaugagauggaacaaaggcacgauccucaaggcauccgucgauuacauuaggaagcugcaaaaagaacagcagcggucaaaggacuuagagagucgccaaagaucucuggaacaggcgaauaggagccuacagcuccguauccaggagcuggagcuucaagcucagauccacgguuugccuguuccacccacuccugggcugcucucccuggccacaaccucagcaagcgacucucuuaaacccgaacagcuggauauugaggaagagggacggccaggcgccgcuacuuuccacgugggcgggggaccugcccagaacgcaccccaucaacagccaccggcuccucccuccgacgccuugcucgaucugcacuuuccaagugaccauuuaggugaucugggcgaccccuuccaccuagggcucgaggauauacugauggaagaggaagagggaguagugggcggucuuagcgggggcgcguugucuccucugcgagccgcuuccgacccacuccugucaagugucagccccgcagugucgaaggccuccucuagaaggagcucauuuaguauggaagaggaguccuga

SEQ ID NO: 63713 - RNA, 1473 nt, Artificial Sequence
  derived and/or modified sequence opt3 from TFEB__Homo_sapiens__NP_001161299
augaccgccagcuccggcugggagcccgcuccugcagccacaauggcgucuagaaucgggcugaggaugcagcucaugcgggaacaagcucagcaggaggaacagcgcgagcgaaugcaacagcaggccgugaugcacuacaugcagcaacagcagcagcaacagcagcaacagcuuggagguccaccgacucccgcaauuaacacgccuguccauuuccagucaccacccccuguuccaggcgaagugcugaagguacagaguuauuuggagaaucccaccagcuaccacuuacaacagucccagcaucagaaagugcgugaguaucugucugaaacauacgggaacaaguuugccgcucacauaucgccugcacaaggaucaccaaaaccgcccccugccgcuagcccaggcgucagagccggucaugugcuaaguuccucugcggggaauagcgcacccaacuccccuauggccaugcuccacaucggaucaaauccagagagggaacuggacgauguuauugacaacaucaugcggcuugaugacgugcugggcuauauuaaucccgagaugcagaugccgaacacuuugccucucaguagcucucaccugaaugucuacuccucagauccccaggugaccgcuagccugguaggcguuacaaguucuuccugcccagccgaccucacccagaagcgcgaguuaacugaugcagaaagcagagcucuggccaaagagaggcaaaagaaggacaaccauaaucuuaucgaacggcgccgaagauucaacauaaaugauaggaucaaagaguuggggaugcugauuccuaaggcgaacgaccuagaugugcgguggaauaaaggaacaauccucaaggccucggucgacuauauucgucgcaugcagaaagaucugcagaagucuagagaacuugagaaccacuccaggcggcuggagaugaccaacaagcaguuguggcuccgaauccaagaacuggagaugcaggcacgcgugcaugguuuacccacgacuucaccaaguggcaugaauauggcugaacuggcccagcaaguggucaaacaggagcuccccagcgaagaggggccuggagaggcucuuaugcugggcgccgaaguuccagacccggagcccuugccugcacuaccaccccaggccccucugccacuccccacccagccgccuuccccauuucaccaccuggacuucucucauagccuuucauuuggugggagagaagaugagggacccccuggcuaccccgaaccacuggcuccuggccacgggagucccuucccauccuugagcaagaaagaccucgaucugauguuacuggacgauucucuacucccgcuggcgucagacccucuuuugaguacaaugagccccgaggcauccaaggccucuucgaggcggagcuccuuuucaauggaggaaggagaugugcuguga

SEQ ID NO: 63714 - RNA, 957 nt, Artificial Sequence
  derived and/or modified sequence opt3 from TFEC__Homo_sapiens__NP_001018068
augacccuggaccaccagaucauuaaccccacacucaaguggagccaaccugccgugccauccggcgggccgcuuguccagcaugcucacacuacgcuggauucugacgcaggauugaccgagaaucccuuaacaaaacugcuagccauagguaaggaagaugacaacgcgcaguggcaucucucaggcaguauccuggauguuuacagcggggagcagggaauuuccccuaucaauaugggccuuacuucugcuucgugcccaucaagccugcccaugaaaagagaaauuaccgagacagacaccagggccuuggcaaaggaacggcagaaaaaggauaaccacaaucucaucgagcgccgacguagauauaacauaaauuacaggaucaaggagcuggguacucugauuccuaaaaguaacgacccagauaugcgguggaauaaggggacaauccucaaagccuccguggaauauauuaagugguuacagaaagagcagcagcgcgcuagagaacuggagcauaggcaaaagaaacuugagcaggcaaaccggcgcuugcugcuacgaauccaggaacucgagauacaggccagaacccacggacugcccacgcuugcuucucugggcacuguagacuugggcgcccacgugaccaagcaacagagccauccugaacaaaauuccgucgauuacugucaacagcucacagugucacaggggccaaguccggagcugugcgaccaggcgauugcauucagcgaucccuuaucuuauuuuacugaccuguccuucucagccgcucucaaggaggaacaaaggcuugacggaaugcuguuggaugacaccaucagcccuuuugguacagauccacuacugagugccaccucucccgcaguuuccaaagagagcucgcggcguucuuccuucucaagugacgauggcgacgaacucuga

SEQ ID NO: 63715 - RNA, 255 nt, Artificial Sequence
  derived and/or modified sequence opt3 from TFF1__Homo_sapiens__NP_003216
auggccaccauggagaacaaggugaucugcgcucugguccucguuagcaugcuugcacugggcacauuggccgaagcgcagacugagacguguaccguggcucccagagaaaggcaaaauugcggguucccuggaguaacaccaucccagugugccaacaaagguugcuguuuugacgauacugugcggggcgucccguggugcuucuaccccaauaccauugacgugccuccagaggaagagugugaguuuuga

SEQ ID NO: 63716 - RNA, 390 nt, Artificial Sequence
  derived and/or modified sequence opt3 from TFF2__Homo_sapiens__NP_005414
augggcagaagggacgcccagcugcucgcugcacuucugguguugggguuaugcgcccuggcgggaagcgagaagcccuccccuugucaaugcucucggcuaucaccacacaaccgcaccaauugugguuucccgggcaucacaagugaucagugcuuugacaacggguguugcuucgauagcuccgucacuggaguucccugguguuuucauccucucccaaaacaggaaucugaccagugcgugauggagguaucggaucgacguaauuguggcuaccccgguauuucaccugaagagugcgcuagcagaaaguguugcuucaguaacuuuauauucgaagugccauggugcuuuuuccccaaauccgucgaggacugucacuauuga

SEQ ID NO: 63717 - RNA, 285 nt, Artificial Sequence
  derived and/or modified sequence opt3 from TFF3__Homo_sapiens__NP_003217
augaagagagugcugagcugcguccccgagccuaccguugugauggccgcuagggcacucuguaugcuuggccugguauuggccuuacuguccucuucaagugcggaagaguacguggggcuaagcgcuaaccagugcgccgucccagcaaaagaccggguggauuguggauauccgcacguuacacccaaggaaugcaauaaccgcgguuguugcuucgacucccgaaucccuggcgugccaugguguuuuaaaccccuccaagaggccgaaugcacuuucuga

SEQ ID NO: 63718 - RNA, 1203 nt, Artificial Sequence
  derived and/or modified sequence opt3 from TFG__Homo_sapiens__NP_001007566
augaacggccagcuggaccucagcgggaaacuuaucauuaaggcccaacugggagaggauauaagaaggauccccauucacaaugaagacaucaccuacgaugaguugguguuaaugaugcagcgggucuuccgcgguaagcugcuauccaacgacgaaguuacaauuaaauauaaggaugaggacggcgaucucaucacuauauuugacucuucagaucugaguuucgcuauccagugcagccguauucuuaaacugacguuguuugugaaugggcagccucgaccacucgaauccucucaaguaaaguaccugagaagggagcugaucgagcuccggaacaaggugaaucgcuuacuggacucgcuugaaccgcccggagagccuggcccaucaaccaacauucccgaaaaugauacagucgacgguagagaggagaaaagcgcaagugauuccucugggaagcagagcacucaggugauggccgcguccaugucagcuuucgacccuuugaaaaaccaggacgaaaucaauaagaacguuaugagugccuuuggacugaccgaugaccaagugagcggcccacccucugccccugcagaggauagguccggcacaccagacucaauagcuagcaguucuuccgcagcccauccgcccgggguccagccucagcagccacccuauaccggagcucaaacucaggccggucagauugaaggccaaauguaccagcaguaucagcaacaggcgggguacggagcacagcagccucaagccccaccccagcagccgcagcaauauggcauccaguacagcgcuucguacucucagcagacagguccucaacagccccagcaauuccagggguauggacagcagccaaccucccaagccccugcacccgcuuuuucaggccagccacagcagcuacccgcccaaccuccacagcaguaccaggcgaguaauuauccggcccaaacguacacugcacagaccagccagcccacaaacuauacuguggcuccugccucccaaccaggcauggcucccucucagccuggggccuaccagccacggcccggauucaccagccucccggguucaacaaugaccccuccacccaguggcccuaaucccuaugcacgcaaccgaccaccuuuugggcagggauacacgcaacccggcccagguuacagauga

SEQ ID NO: 63719 - RNA, 2097 nt, Artificial Sequence
  derived and/or modified sequence opt3 from TF__Homo_sapiens__XP_011511402
augagacuggccgugggcgcucuccuugucugcgcaguucugggguuguguuuagccgugcccgacaagaccguaagguggugcgcggugagcgagcacgaagcuacaaaaugucaguccuuccgggaucauaugaagucugucaucccuucagacggaccaaguguggccugcguuaaaaaggcaagcuaccuggauuguauucgcgccauagcugcaaacgaggccgacgcugugacucuagaugccggucucgucuaugacgcguaccuggcaccgaauaaccuuaaacccgugguagccgaauuuuauggcuccaaggaggauccucaaacguucuacuaugcuguugccguggucaagaaagacucuggguuucagaugaaucagcugcgaggaaagaaaucgugccacaccggcuugggucguucagcaggguggaacaucccaauuggacuccuguacugugaucugcccgaaccuagaaagccacucgagaaagcuguggccaauuucuuuagcggcaguugcgcgcccugugccgacggcacagauuucccucaguuaugccaacuguguccagggugcggaugcuccacucuuaaccaguauuuugguuacucuggcgcauucaaguguuugaaggacggggcuggagauguggccuuugucaaacauagcaccaucuucgagaaucuggcuaacaaggccgacagggaccaguacgaacuacucugccuggauaauacacggaaaccgguugacgaguauaaggauugucaccuugcacaggugcccucccauaccguaguggcccgcucaaugggcgguaaagaagaccugauuugggaguugcucaaccaagcucaggagcacuuugggaaggauaaaaguaaggaguuccagcuguuuagcucuccucacggaaaggacuuacuguucaaagauuccgcgcauggcuuccucaaggucccacccagaauggacgcaaaaauguaccuuggcuaugaauacgugacugccaucaggaaucugcgggaagggacaugcccugaggcuccaaccgaugaauguaagcccguuaaauggugcgccuugucacaccaugagcgccuaaagugugacgaguggagcgugaacagugucggaaagauagaaugcgugucugcagagacgacugaagauuguaucgccaaaauuaugaauggugaggcugacgccaugucccuggacggcggguuuguauauaucgcaggaaagugcggccucguuccggugcuggcggaaaacuacaauaaaagcgauaacugugaggacaccccugaggcugguuauuucgccauugcagucgugaagaaaucggccucugaucuuacaugggacaaccugaaggggaagaaauccugccacacugcugucggccgaaccgccggauggaauauccccaugggcuugcucuacaacaagauaaaucacugcagauuugaugaguucuuuucagaagggugugcaccaggaaguaaaaaggacagcucccugugcaaauuauguauggguucuggccugaaccuaugcgaaccuaauaacaaggagggguacuauggauacacaggcgcuuucaggugucucguggaaaagggugauguugccuuugugaaacaucagaccguaccccaaaauacugggggcaagaacccagaccccugggcgaaaaaucugaacgagaaggauuaugagcuuuugugccuggacggaacgcggaaaccugucgaagaguacgccaauugucaccucgcucgugcaccaaaccaugccgugguuacacgcaaggauaaagaggcuugcgugcacaagauucugagacagcagcaacaucuuuucggcagcaaugucaccgacuguucagggaacuuuugccuguucaggagugaaacuaaggauuugcucuuucgggacgacacagugugucuggccaaauuacacgaucgaaauaccuaugagaaguaccugggagaagaguauguaaaagcaguggguaaccuacgcaagugcuccacgagcucucuccuggaagcgugcaccuucagaaggccguga

SEQ ID NO: 63720 - RNA, 2514 nt, Artificial Sequence
  derived and/or modified sequence opt3 from TFIP11__Homo_sapiens__XP_011528381
augagccugucccaccucuacagagacggcgaggggaggaucgaugacgaugacgaugaacgggagaacuucgaaauuaccgacugggaucuucagaaugaguuuaaccccaaucgccaacgacauuggcagacaaaggaagaggccacuuauggagugugggcugagcgugacucugaugacgaaagaccuucauucgguggcaaaagggcacgggauuacagugccccagucaacuuuauaagcgcggggcugaagaaaggagcugccgaggaagcagaguuggaggacuccgaugacgaagagaagccgguuaaacaggacgauuuccccaaggacuuuggcccucgcaaguuaaaaacgggugggaauuucaagccaucucagaaaggauuugccggcggcaccaagucguucauggauuuugggucaugggaaagacacacaaaaggaaucggucaaaagcugcuacagaagaugggcuaugugcccgggaggggacucggcaaaaacgcucaggguauuaucaauccuauugaggcaaagcagcggaaagggaagggagccguaggcgcuuacggcagcgaacgcacuacccaaaguaugcaggacuucccaguggucgauuccgaggaggaagccgaggaagaguuucagaaagaacugucucaguggcgaaaggaccccagcggguccaaaaagaagccuaaauauucauacaagacaguggaggagcuuaaagcgaagggaagaaucaguaaaaagcugaccgcaccacaaaaggaauugagccagguuaaagugauagauaugacugguagggagcagaaggucuauuacucuuacucccaaaucucacauaaacacaacgugccggacgauggccucccccugcagagccagcagcugccucaaagugggaaggaagccaaagcuccaggauucgcccuccccgaguuagaacauaaucugcagcuuuugauugaccugacagagcaggagaucauucagaacgaucggcaacuacaguaugaacgugacaugguaguuaaucucuuucacgagcuggaaaagaugaccgaggugcuugaccacgaggaacgcgucaucucuaaccuguccaagguguuggagaugguggaagagugcgaaagaaggaugcagccugauuguagcaauccacucacgcuggacgagugcgcacggauauucgagacuuuacaggauaaauacuaugaagaguaccgaaugucggaccgcgucgaucuggcuguugccauuguguauccccucaugaaggaauacuucaaagagugggacccgcuuaaggauuguaccuauggcacagaaaucauuucuaaauggaagucccuguuggagaacgaccaacuacugucacauggugggcaggaucucagugcggacgccuuucacagacugaucugggagguauggaugccuuucgugaggaauaucgucacucaguggcagccccggaacugcgauccaaugguggacuuucuugauagcuggguucauauuauaccuguguggauccuggacaacauuuuggaccaacucaucuuccccaagcugcagaaagaagucgagaauuggaacccauuaaccgauacagugcccauacacuccuggauucacccuuggcugccacuaaugcaggcacgccucgaaccgcuguacucucccaucagaagcaaacuuucaagugcuuugcaaaaguggcauccuuccgacagcucugccaagcugauccuccagccauggaaagauguauuuacccccggcucaugggaggcuuucaugguuaagaauauugugccuaaacugggaaugugucuuggcgaacuggucaucaacccacaccagcagcauauggacgccuuuuacugggugauugauugggaggggaugauaagugucagcuccuuggugggacuccuggagaagcacuucuuucccaagugguuacaaguucugugcucuuggcuaucgaauagcccgaacuaugaagagaucacgaaaugguaccucgguuggaaguccauguucucagaccaggugcuggcacauccuaguguaaaagauaaguuuaaugaagcccuugacauuaugaacagggcugucucuagcaaugugggcgcguauaugcagccaggggcacgugagaacaucgccuacuugacucacacagagcggcgaaaagauuuccaguaugaagcuaugcaagagagaagggaagccgagaauauggcacagcgcggaaucggcguugccgcuuccucagugcccaugaacuuuaaggaccugauugaaaccaaggccgaggagcacaauauagucuucaugccugugaucgguaaacggcaugaagggaagcagcucuacacuuucggcagaauuguaaucuauauugauaggggagugguuuuuguccagggcgagaaaacaugggugcccaccagccugcaaucuuuaaucgacauggcaaaguga

SEQ ID NO: 63721 - RNA, 561 nt, Artificial Sequence
  derived and/or modified sequence opt3 from TFPI2__Homo_sapiens__NP_001257933
auggaccccgccagaccucugggccucagcauccuucuguuguucuuaaccgaggcugcacugggggaugccgcgcaggaaccaacaggaaacaaugcugagauuugccuacucccgcuggacuauggucccuguagggcccuucuguugcgguauuacuaugaucgcuacacucaauccugccgacaguuucucuauggcgggugugaaggaaacgcaaauaacuucuacacgugggaggccugcgacgaugcuuguuggcguauagaaaaggugccuaaagucugcagacugcagguuucuguggacgaucagugugagggcucaaccgagaaguacuuuuucaaucugaguagcaugacaugcgaaaaauuuuucuccggugggugucacaggaaccggaucgagaaucgcuuuccagacgaagcaacuugcaugggauucugugcccccaagaaaaacaccgagccuguaaugcucucuccaauuuuagcuguggagggcaugacaaucacccugcuugccggcagaauugcgaauguccaugugcaaaaguuguga

SEQ ID NO: 63722 - RNA, 756 nt, Artificial Sequence
  derived and/or modified sequence opt3 from TFPI__Homo_sapiens__NP_001027452
augaucuacaccaugaagaaagugcacgcccugugggcuagcgucugccuccuucugaacuuggcacccgccccuuuaaaugcggacuccgaggaagaugaggaacauacaauuauaacugacacggagcugccaccgcuaaagcucaugcacucuuucugugcuuuuaaagccgaugacggccccugcaaggcaaucaugaaaagauucuuuuucaacauuuuuaccaggcagugugaagaguucaucuaugggggaugcgaggguaaucaaaaccgguuugaaucacuggaggaauguaagaagaugugcacacgcgauaaugccaaccgaauuaucaaaacuacccuucagcaggagaagccugacuucuguuuucuggaggaagauccaggcauaugccguggguacaucacaagauauuucuacaauaaccagaccaaacaaugugagagguuuaaguauggaggcugcuuggguaauaugaacaauuucgaaacucucgaggaauguaaaaacauuugcgaggacgggcccaauggauuucagguugauaacuacggcacacagcugaaugcugugaacaacagucugaccccucagagcacgaagguaccaucccucuucgugacuaaggagggcaccaaugacggguggaaaaacgcagcccauaucuaucaagucuucuuaaaugcuuuuugcauucacgccucuauguucuuucugggacuugauucgaucucauguuugugcuga

SEQ ID NO: 63723 - RNA, 762 nt, Artificial Sequence
  derived and/or modified sequence opt3 from TFPT__Homo_sapiens__NP_037474
auggagcuggaacagagagagggcaccauggccgcugugggguucgaagaguuuagcgcacccccuggauccgaacucgcccuuccaccgcuguucgguggccacaucuuggagucugaguuagaaacagaggucgaauuuguuucagggggacugggcgguagugggcuaagggagcgggacgaggaagaggaagcggcucgcggacgacguagaaggcaacgggagcucaaccgcagaaaguaccaggcccugggcaggcggugccgcgaaauugaacaggugaaugagcgaguacuuaacagacugcaucaggugcaaaggauaacucggcguuugcagcaggagcgcagauuccucaugaggguccuggauagcuauggcgacgauuaccgggcaucccaguuuacgaucgugcuggaggacgaagggucucaaggaaccgaugcccccacaccugguaaugcugagaacgaaccacccgagaaagagacucucucgccuccacgacgcacccccgcaccuccagaaccgggcucacccgccccuggggagggaccaagcggcagaaagaggcggcgcguucccagagacgguaggcgugcugggaaugccuuaacaccugaacuggcgccagugcagauuaaagucgaggaagauuucggauuugaggcagacgaggcccuugauaguuccugggugucucggggccccgacaaguugcugccguauccuacccuagcuagccccgccuccgauuga

SEQ ID NO: 63724 - RNA, 1893 nt, Artificial Sequence
  derived and/or modified sequence opt3 from TFR2__Homo_sapiens__NP_001193784
auggccgcucugacccaggacaucagagcagcccucagcaggcaaaagcuagaucacguguggacagacacucauuacgucggccugcaguuccccgauccugcgcacccaaacacguugcauuggguugacgaggcugggaaagugggagaacaguuaccgcuggaggaucccgacguauauugcccuuacuccgccauugguaaugugaccggcgaacuugucuaugcacacuacgggcggccagaggaucuccaggaccugcgcgcccgaggaguggaucccguuggccgucuucuguuggugagagucggugugauaucuuuugcucaaaagguaacaaacgcacaggacuucggggcccagggaguucucaucuauccugaaccagcugauuuuucacaggacccuccuaaaccaagucugagcucccaacaggccguguacggccauguccaccugggcacuggggauccguauacccccggauucccuucuuuuaaucagacacaguucccacccguggcgucgucaggucucccuagcauuccagcacaacccaucagugccgacauugcuuccagguuacugcggaaguuaaaaggcccgguggccccucaggaguggcaggggucuuugcugggaagccccuaccaccuaggcccagguccucgccucagacuggucguuaacaaucauaggaccuccacucccaucaacaauauauuuggguguaucgagggacggucagaaccagaccacuacgugguaauuggcgcacaacgcgaugcuuggggccccggggccgcgaagagugccgugggaacagcaauccuucuggaguugguccgaaccuucagcucuaugguguccaacgguuuuagaccuaggcggucacuccuguucauuagcugggacggcggggauuuuggaaguguuggcucuacggaaugguuagaggguuaucuguccgugcuccaucuuaaggcugucguguacguaagccuggacaaugccguuuugggggaugacaaauuccacgcuaagacuucgccacuacugaccucucucaucgaguccgugcugaaacaggucgauucaccgaaccacaguggccagacacuuuaugaacagguggucuuuacuaaucccagcugggacgccgaggugauacguccucugccaauggauuccucugcauacagcuucaccgccuucguuggagugcccgcuguagaauuuucauucauggaggacgaucaagcguaucccuuuuugcauacaaaggaagacaccuacgagaaccuccacaaaguccugcagggccgcuuaccagcaguggcccaggcuguugcccagcuggcagggcaacuacucauuagacugagucaugacaggcuuuugccccuggauuucggacgguauggugacgugguccuccgacacaucggcaaucugaacgaguuuuccggggaucuuaaggcccgcggacugacguugcaguggguguacagcgcuagaggcgacuacauuagggccgcagaaaagcuccggcaggagaucuauucuucagaggaacgcgaugaaagacugacuaggauguacaauguacguaucaugcggguggaguucuauuuucuuagucaguacguuagcccggcggacuccccuuuccgacauauuuuuauggguagaggggaucacacacugggcgcucuacucgaccaccugaggcuuuugcgcucuaacucgagcggaaccccaggcgccacuuccucaacaggguuccaagagagucgguuuagaaggcagcuggcacuccugaccuggacguuacagggagccgcuaacgcccugucuggugaugucuggaauauagacaacaauuucuga

SEQ ID NO: 63725 - RNA, 2283 nt, Artificial Sequence
  derived and/or modified sequence opt3 from TFRC__Homo_sapiens__NP_003225
augauggaccaggccagaagcgcuuucuccaaccuguuuggcggggagccccucucuuacaccagguucucacuugcacggcaaguggauggagacaauagucacgucgaaaugaagcuggccguugaugaggaagagaacgcggacaauaacacaaaagcuaaugugacuaagccuaaacgcugcagcgguuccaucuguuauggcacgauugccguaauaguguuuuucuugaucggguuuaugauuggauacuuaggcuauugcaagggugucgaaccaaaaaccgagugugagcgacuggcagggacagaaucuccggugcgugaggaacccggagaggauuucccugccgcuagaaggcuauacugggacgaucucaagcggaagcugucggagaaacuugacucaacugauuuuaccggcacaaucaagcuguugaacgaaaauagcuauguuccacgcgaggcaggcagucagaaagacgaaaaccucgcccuguacguggagaaucaguucagagaauuuaagcuguccaaagucuggagggaucagcauuucgugaagauucaaguaaaggacucugcucagaacagcguuaucauaguggauaaaaaugggcggcucgucuauuuaguggagaaccccggagguuacguggccuacuccaaggcggcaaccgucacuggcaaacugguucacgccaauuuugggacaaagaaagacuucgaggaccuuuauaccccugugaacggaucaaucguaauugugcgcgcuggcaagaucacguuugccgaaaaagucgcaaaugcugagaguuugaacgccauuggugugcugaucuacauggaucagacuaaguucccaauaguuaacgcggaacuuagcuucuuugggcaugcccaccucggaaccggcgaccccuauacaccuggcuucccaucuuuuaaucauacucaguucccgcccucccgaucaagcgggcugccuaacauuccagugcaaaccaucaguagagcagcugccgagaagcuauuuggaaauauggaaggugauugccccucugacuggaaaacagauuccaccuguaggauggucacgagcgagucgaagaacgugaaacugacuguaucuaauguuuugaaggagauuaaaauccucaacaucuucggcgugauuaagggguuugucgaaccugaccacuacguggucgugggagcucagcgggaugccuggggcccaggugcagccaaguccgggguuggcacagcucuguuacugaaacucgcgcagauguucucagacauggugcuuaaggauggauuucagcccagucguagcauaaucuucgcauccuggucugccggcgacuuugggagcguaggagcuaccgaguggcuggaagguuauuugucaagucuacaccugaaagccuucacuuacauuaaucucgauaaggcaguccugggcacauccaacuuuaaagugagcgccucuccgcuucuguauaccuugaucgagaagacgaugcaaaauguuaagcauccugugaccgggcaguuccucuaccaggacucaaacugggcuaguaaagucgaaaagcugacauuagacaaugccgcauuccccuuucuggcguacagcggaauaccagcuguguccuucugcuuuugugaggauacugacuauccuuaccuaggcaccacaauggauacuuauaaagagcucauugaacgcauccccgagcugaacaagguagccagagcagccgcugaaguggccggucaauucguuaucaaacuuacccacgacgucgaguugaaucuggauuacgagagguauaacucucagcuccugucguuugugcgggaccuuaaucaguaccgagcagauauuaaggaaauggggcugagcuugcaguggcucuauuccgcucgcggcgacuucuuuagagccacaucaaggcugaccacugauuucggaaacgcggagaagacggaccgguuugugaugaaaaaguuaaacgaucgcgucaugagaguugaauaccauuuccugaguccauacgugucucccaaagagagcccuuuuaggcacguguucuggggcuccgggucacacacacuaccagcccuccuggaaaaucuuaaguugcguaaacaaaacaauggagcuuuuaacgagacccuguuccggaaucagcucgcacuggccacuuggaccauccagggugcugccaacgcauuaagcggcgacguaugggauauugacaaugaguucuga

SEQ ID NO: 63726 - RNA, 480 nt, Artificial Sequence
  derived and/or modified sequence opt3 from TGFA__Homo_sapiens__NP_001093161
auggugcccagcgccggccagcuggcucucuucgcacuugggaucguccuggccgcgugccaggcuuuggagaacuccaccucuccuuuaucagacccaccgguugccgcagccgugguaagucacuuuaaugauugucccgacagccauacacaauucugcuuucacggaacuuguagauuccuggugcaggaagauaagccugcuugcgucugucauuccgguuacgugggcgcaaggugcgagcacgccgaccuacucgcuguuguggccgcgucucagaaaaagcaagcaauuacggcccuggucgugguaucgauaguugcucuugccgugcugaucauuaccugugucuugauccauugcugucaggugcggaaacacugcgaauggugucgcgcacucauuugccgacacgagaagccaucagcucugcugaaagggcguacagccugcugucauagcgaaacuguggucuga

SEQ ID NO: 63727 - RNA, 1173 nt, Artificial Sequence
  derived and/or modified sequence opt3 from TGFB1__Homo_sapiens__NP_000651
augcccccuagcggccugagacuccuuccacuguuguuaccgcugcuauggcuccuggugcuuacccccgggaggccugccgcuggacuguccacaugcaagacuaucgacauggaguuggucaaacggaagcgcauugaagcaauacgaggucagauccucucuaaacugcgucuggccucaccacccagucaaggcgagguuccuccagggccccucccugaagcgguguuagcucuguacaacagcacgagagauaggguagccggagaguccgcagaaccagagccggagcccgaagccgacuauuacgcuaaggaggugacccggguccuuaugguggaaacacacaaugagauuuaugauaaauucaagcagucuacucauucgaucuacauguuuuucaacaccucagaguugcgcgaagcaguuccugagccagugcugcuaagcagagccgaacucaggcugcuucggcugaaguugaaagucgagcagcacguggaacucuaucagaaguacaguaauaacuccuggcgcuaucugucuaaucgauuacuggcucccagcgacuccccugaguggcucucauuugauguaacaggcguugugagacaauggcuuaguagggguggggagauugaaggauuccggcugagcgcccauuguucuugcgacucccgugauaacaccuugcaggucgacaucaauggcuuuacuacaggccgcagaggggaucuagcgaccauacacggaaugaacaggccauuccugcuccugauggcaacgccccuugagcgggcccagcaucugcagucaagccgacaccgcagagcuuuggacacuaauuacuguuuuaguucuaccgagaaaaacugcugugugaggcaacucuacaucgauuuccggaaggaccuggguuggaaauggauucacgaaccgaagggcuaucaugccaauuuuugcuuagggccuugucccuacaucuggucccuggauacacaguauagcaaggugcuagcacucuacaaccagcacaauccaggagcuucggccgcgccuugcugugucccccaggcccuggaaccacuucccauuguuuauuacgugggccgcaaaccuaagguagagcaauugucuaacaugaucgugagauccugcaaauguucauga

SEQ ID NO: 63728 - RNA, 1386 nt, Artificial Sequence
  derived and/or modified sequence opt3 from TGFB1I1__Homo_sapiens__NP_001035919
auggaggaccuggaugcccuccuuagcgaccuggaaaccacaacuucccacaugcccagaucuggcgcuccuaaggagaggccagcagaaccguugacgcccccuccaucauacgggcaucagccccaaaccggaaguggugagagcuccggcgccucuggggauaaggaccacuuauauucgacagugugcaagccucggucaccaaaacccgcggcuccugccgcaccaccguucagcaguuccucuggaguccugggcacuggucuaugugaacucgaucgccugcuucaggagcugaacgccacccaguuuaauaucacagacgagauuaugagccaguuccccuccucaaagguugcuaguggggaacaaaaagaggaucagagcgaagacaagaagcgaccuucuuugccauccucacccagcccuggacucccaaaagcaagugccaccucugcuacucuggagcuggaucgucucauggccuccuuaagcgacuuuagagugcagaaccaucugcccgcgucgggcccgacacagccucccguagugucuuccaccaaugagggcucaccaaguccucccgaaccaacggggaagggaagccuugauacuauguugggucugcuacaauccgaccucucuaggcggggcguccccacccaggcaaaagggcugugcggaagcuguaacaagccuauagccggccaggugguuacagcucuuggucgcgccuggcacccagagcauuucgugugcgggggauguucaacugcacugggcggcaguuccuuuuucgaaaaagauggggcuccguuuugccccgaguguuacuucgaaagauuuagcccuaggugcggauucuguaaucagccaauccggcacaagauggucaccgccuuggguacacacuggcaucccgagcacuuuugcugugugucuugcggcgagccuuucggggacgaaggauuucaugagcgcgaaggccgaccauauugcagaagggacuuccuccaacuguucgcgccccggugucaggguugccaggggccgauuuuagauaacuacaucucagcccugagugcacucuggcacccugacuguuuuguaugccgugaguguuucgcuccauuuagcggcggauccuucuuugaacacgagggccgcccccuuugcgagaaucauuuccacgccagaagggggucucugugugcuaccugcggauugccuguuacgggucggugugugucggcccuaggccgacgcuuucaucccgaucacuucacuugcacauuuugucugagaccacucaccaaggggagcuuccaagaaagggcaggaaaaccuuauugccagcccugcuuucugaaacuuuucggcuga

SEQ ID NO: 63729 - RNA, 1329 nt, Artificial Sequence
  derived and/or modified sequence opt3 from TGFB2__Homo_sapiens__NP_001129071
augcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagacagucuguccagugguuacuacccccaguggguccgugggaucuuugugcagccggcagucccagguccucugugguuaccuggacgccaucccuccaacauucuaucgcccguacuuuagaauagugagguucgauguaucagcuauggaaaagaaugcaaguaaccugguuaaggccgaguuucggguguuccgccuccaaaaucccaaagcucgagucccugaacagagaaucgaguuauaccagauucugaaaagcaaagaccuuaccucuccaacucagagguauaucgauuccaagguggugaaaacacgggccgaaggcgagugguugucauuugacgucaccgaugcgguucacgaguggcugcaucacaaggaccguaaccuaggguucaagauuagccuccauugccccuguugcacguuugugccuaguaauaacuacaucauaccaaauaaaucugaggaacuggaagcacgcuucgccggaauugauggcacuuccaccuauacaagcggugaccaaaagacuaucaaaucgaccagaaagaaaaacucugggaagacaccccaccuucuguugaugcuccugccguccuacagguuagagucacagcagaccaaucggcgaaagaagcgcgcucuggacgccgcauauuguuuuagaaacguacaggauaauugcugucucaggccucuuuacauugacuucaagcgggaucugggauggaaauggauccacgaacccaagggcuauaacgcuaauuucugcgccggcgcgugcccauacuuguggaguagcgacacgcaacauucccgcgugcuaucucuguacaacacuaucaauccugaggccagcgcaucacccuguugcgucagucaggaucucgagccacugacaauucuuuauuacauagggaaaacccccaagaucgaacagcuguccaacaugauugugaaaagcuguaagugcucuuga

SEQ ID NO: 63730 - RNA, 1239 nt, Artificial Sequence
  derived and/or modified sequence opt3 from TGFB3__Homo_sapiens__NP_003230
augaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcuga

SEQ ID NO: 63731 - RNA, 2052 nt, Artificial Sequence
  derived and/or modified sequence opt3 from TGFBI__Homo_sapiens__NP_000349
auggcccuguucgugagacuccuugcucuggcauuggccuuagcgcugggccccgcugccacccuagcagggccugccaagagcccauaccagcucguccugcaacacuccaggcuucggggacgccagcaugguccgaacguuugcgcugugcagaaaguaaucggcacaaaucgaaaguauuuuacuaacuguaaacagugguaccaacguaagauuugcgggaaaucuacggugauaucauaugaguguugccccggauacgaaaaggucccuggcgagaaggguuguccagcagcccugcccuugaguaaucucuaugaaacccugggggugguuggaagcacaacuacccagcuguacacagacagaaccgagaaacucaggccugaaauggagggcccaggcuccuucacuaucuuugcucccucuaacgaggccugggcgucguuaccugcagaagugcuggauucacuugucagcaaugugaacauugaguugcugaaugcccuacgguaucacaugguagggcgcagaguucucacagacgaacugaagcauggaaugacccuuacgaguauguaccagaacuccaauauccagauucaccauuacccaaacgguaucgugacugucaauugcgcuaggcuguugaaagccgaucaccacgcaaccaacggcguggugcaucucauagacaaggucaucucuacaauuacuaauaacauccaacagauuaucgagauagaggauaccuucgaaacacugcgggcugccguugcggccagcggguuaaauaccaugcuggagggaaacggccaguauacgcuccuugcaccgacuaacgaagccuuugagaaaauucccuccgaaacacugaaucgcaucuugggugacccugaggcccuacgagaucugcucaacaaucacauucugaagucagcuaugugugccgaggcaaucguggccgggcuuaguguagaaacccuggagggaacuacauuggaagugggcugcagcggcgacaugcucaccaucaacgggaaggcuauuauaucuaauaaagauauccuggcgacgaacggagucauucauuacaucgacgaguuacugauaccagauuccgcaaagacccuauucgaacucgccgcugagucagacgugagcacagccauugaucuguuuagacaggcaggucuuggcaaucacuugagugggucugagaggcugacucuccuggcuccccuuaacuccguuuucaaagacggaaccccuccaaucgacgcucacacacggaaucuguugcguaaccauaucauuaaggaucaacucgccagcaaauaucuguaccacggccagacuuuagaaacccugggugggaagaaacuacgcguguuugucuauagaaauucgcucuguaucgagaacucuugcauugcagcgcaugacaagaggggccgguacggaacacuguucaccauggaucgagugcuuacucccccgaugggcacgguaauggacguuuugaagggggauaaucgcuuuuccaugcugguggcugccauacagucagcaggacucacagaaacccugaacagagagggugucuauacuguguucgccccuaccaaugaggcuuuuagggccuuacccccacgggaacgcaguagacugcuuggcgacgcaaaagaguuggcuaacauccucaaguaccacauuggggaugaaauccuggucagcggaggcaucggugcccuagugaggcugaaaucccuccaaggggacaagcuggagguuucucuuaaaaacaaugugguaagcgucaacaaggaaccuguggcggagcccgauauuauggccacaaauggcguugugcaugucauaaccaacguguugcagccacccgcuaaucguccucaggagcggggagacgaacuggcagauucagccuuagagaucuucaagcaggcuagugccuucucccgagcaagccaaagaucuguaaggcucgcgccaguguaccagaaacugcuugaacgcaugaagcacuga

SEQ ID NO: 63732 - RNA, 1281 nt, Artificial Sequence
  derived and/or modified sequence opt3 from TGFBR1__Homo_sapiens__NP_001124388
auggaggccgcuguggcagcccccagaccuaggcugcuccuucuggucuuggcggcugccgcagccgcugcagccgcuuuacugccaggcgccaccgcgcuacagugcuucugucaccucugcacaaaggacaacuuuacuuguguuacggaugggcugugcuucgugagcguaaccgaaacaacugacaaagugauccauaauuccauguguauugcagagauagaucuuaucccgcgggaccgccccuuugucugcgccccuucuucaaagaccggaagugugacaaccacuuacuguugcaaccaagaucacuguaauaaaauugaacugccaacaaccgguuugccccuccugguucagcgaacgaucgcucguacuauugugcugcaggagagcaucggcaaggggagauucggagaagucuggaggggcaaauggcggggugaggagguggccguaaagauauuuuccucucgcgaagagagaucgugguucagggaagcagagaucuaucagaccguuaugcuccggcaugagaacauuuuaggguuuaucgcugccgacaauaaggauaacggaacauggacucaacuguggcuugugucagacuaccacgaacauggcagcuuguucgauuaucugaaucgcuacaccgucacaguggagggcaugauuaaacuagcgcucaguaccgccuccgggcuggcacaccuucacauggaaaucgugggaacgcaggguaagccugcuauagcccaucgagaccugaaaucuaagaacauuuuggucaaaaagaauggcacuugcuguaucgcugaucucgggcuggccguuagacacgacagcgcaacagauaccauugacaucgccccaaaccauagggugggaacuaagcgguauauggcucccgagguauuagacgauuccaucaauaugaaacacuuugaaucauucaagcgugcggacauuuacgcaaugggccugguguuuugggagauagcccgcagaugcaguaucggugggauucacgaggauuaucagcucccuuacuacgaccuugucccaagcgauccgucuguggaagagaugaggaaaguugugugcgaacagaagcugcggcccaacaucccuaaucgauggcaauccugugaggcuuugcgcgucauggccaaaauaaugagagaaugcugguaugcaaacggagccgcuaggcuaacagcccugcggauuaagaaaacccucucacagcugagccagcaggagggcaucaagauguga

SEQ ID NO: 63733 - RNA, 1779 nt, Artificial Sequence
  derived and/or modified sequence opt3 from TGFBR2__Homo_sapiens__NP_001020018
augggcagagggcugcucaggggacuuuggccccugcacaucguguuguggacccggauugccagcacaauaccuccacauguccagaaguccgacguugagauggaagcucaaaaagaugagaucauuugcccgucuuguaaccgcacugcacaccccuuacgacauaucaauaacgacaugauugugacggauaauaacggugccguaaaguucccucagcugugcaaauuuugugacgugcguuucucaaccugcgauaaucagaagaguuguaugagcaacugcuccaucacaucuauaugugaaaaaccacaggaggucugcguggcgguuuggagaaagaaugacgaaaacaucacucuagagaccgugugucacgaucccaagcucccuuaccaugacuuuauucuggaggaugcugccucgccaaaaugcaucaugaaggagaaaaagaaacccggcgaaacauucuuuauguguucaugcagcagugacgaaugcaaugauaacauuaucuucuccgaggaguauaauaccucuaacccugaccuucuguuggucauauuucaagugacugggauuagccuccugccaccgcugggaguagcaaucuccguuauuaucaucuucuacuguuauagggugaaucggcagcagaagcucucaaguacaugggaaaccggcaagacgcgcaaauuaauggaguuuagcgaacacugcgccauuauacuggaggaugacagaucugacaucuccucaacuugugcuaacaauauuaaccacaacaccgaacuuuugcccaucgagcuggauacacuggucgguaaggggagguucgcagagguguacaaagccaagcucaaacagaauacuagcgaacaauuugagaccguggcugucaagauauucccuuaugaagaguacgccaguuggaaaacagaaaaggacauuuuuagcgauaucaaccugaagcaugagaauauccuucaguuccugaccgcggaggaacggaaaacggaguugggaaagcaguauuggcucauuacugcauuccacgccaaaggcaaccugcaggaauacuuaacacgccauguuaucuccugggaggaccugcgaaagcucggcagcucgcuugcuagagggauugcccaccuacacucugaucauaccccaugcggaaggcccaaaaugccuauagugcaccgggacuugaaguccucaaauauccuaguaaagaacgaucugacuuguugccucugugacuuuggucugagucuucgucuggauccaacauugagcguggacgaucucgcaaauuccggccaagucgggaccgcucgcuacauggcccccgaagugcuggagucuagaaugaacuuagagaauguugaaucuuucaaacagacggacguguauucaauggcgcugguccuaugggagaugaccaguaggugcaacgccgugggagaaguaaaggacuacgagccgccuuuuggcuccaaaguucgggagcaucccuguguggaaagcaugaaggauaauguccuccgagaccgcgguagaccagagauuccuucuuucuggcugaaccaccaggggauccaaauggugugcgaaacacuuacugaguguugggaucaugaccccgaagcaagguugaccgcucagugcgucgccgagcgguuuucagagcuggaacaccucgaucgccugaguggaagaagcugcuccgaggagaaaaucccagaagacggcucucuuaauacaacuaaguga

SEQ ID NO: 63734 - RNA, 2583 nt, Artificial Sequence
  derived and/or modified sequence opt3 from TGFBRAP1__Homo_sapiens__NP_001136093
augaugagcaucaaggccuucacccugguguccgcugucgagagagaacuccuuaugggcgacaaagagaggguuaacauugaaugcguggaguguugcgggcgggaucuguacguaggaacaaaugacuguuuuguguaucacuucuuguuagaagaacgccccgucccugcagguccagccacuuuuacggcgaccaagcagcugcaacgacaucuaggcuucaaaaagccggugaacgagcuccgugcugccucugcacugaauagacuucugguuuugugcgauaacucaauaagucucgugaauaugcugaaccuggaacccgucccuagcggggccaggaucaaaggagcugcaacauuugcccucaaugagaacccaguguccggcgaccccuucuguguagaaguuugcauuaucucugugaagcggcgcacuauucagauguuuuuagucuacgaggauagagugcagaucgugaaggaggucucgaccgcugaacagccucuggccguugcgguggacggucacuuccuuuguuuggcacugacaacccaauauauaauccauaauuacucaacugggguaagccaggaucuauuuccauauugcagugaggaaaggcccccuauugugaaacggaucggacgccaggaguuccuccuggccggcccaggcgggcuuggaauguuugcuacagucgccgguauuucccagcgagcaccggugcacuggucugaaaacguuaucggcgcugccgugagcuuccccuacgucauagcgcuggacgaugaguuuauuaccgugcauuccauguuggaccaacagcagaagcagacgcucccuuucaaagaggggcacauccugcaagauuucgaaggaagaguaauuguugccacuucaaagggcguguauaucuuagucccacugccccucgagaaacagauccaggaccuucuggcaaguaggcggguggaagaggcuuugguccuagccaagggugcucgucgcaauauuccuaaggaaaaauuucaagugauguacagaaggauacugcagcaggccggguucauccaguuugcacaacuccaguuccuggaggccaaggagcuuuuucggagcggacagcuggauguucgagaauugauuucucucuacccauuccuguuacccaccuccagcucauuuacacgcagucacccgccucugcaugaguaugcugaccuaaaccagcucacucaaggcgaccaggagaaaauggcgaaguguaaaagauuccugaugucuuaccuuaaugaggugagguccaccgaaguagcaaacggcuauaaggaggauaucgacacagccuugcugaaacucuacgcugaggccgaucacgacagccugcuugaucuguuggucaccgaaaauuuuugccuccugacggacucggcagccugguuagagaagcauaagaaauauuucgcucuggggcuacucuaccacuauaacaaccaggaugccgcagcggugcagcuguggguuaauauagugaacggagacguccaagauucuacucgguccgaccuuuacgaauacauuguggauuucuugacauauugucuggacgaggagcucguaugggcuuacgccgacugggugcugcagaagucagaagagguugguguccagguguucaccaaacgccccuuagaugaacagcaaaagaauaguuuuaacccagacgauaucaucaauugccugaaaaaguauccuaaggcacuugugaaauacuuggagcaccucgucauugacaagagacugcagaaagaagaguaucauacucaccuagccguucuguaccucgaggaagugcugcuucagagggcuagcgccuccggcaagggggcagaggcuacagaaacccaagccaaauugcgucggcuguuacagaagucugaucucuaucgagugcauuuccugcuugagagacugcagggagcgggcuugcccauggaaagcgccauccuccacgguaagcugggggagcaugagaaagcucuacacauucugguacacgaacuccaggacuucgcagccgcugaggauuacugccugugguguucagaaggcagggacccaccccaucgccaacagcuuuuucacacguugcuggccauauacuuacaugcaggaccuaccgcgcacgagcucgccgucgcugccguggaucugcuuaaccggcacgcaacagaauuugacgcugcccagguucugcagaugcuaccagauacuuggagugugcaacuccugugcccguuuuugaugggcgcaaugagagacuccauccaugccaggcgcaccaugcaggucgcucugggguuagcgcgaagcgagaaucucauuuauacauacgauaagaugaaacugaagggaucuucaauccagcuuagugacaaaaagcugugucagaucugccaaaaccccuucugugagccuguguuuguucgguauccaaaugguggcuuggugcacacucauugcgccgcaagccgucacaccaaccccuccucuucgagcccugggacaagaaccuga

SEQ ID NO: 63735 - RNA, 8307 nt, Artificial Sequence
  derived and/or modified sequence opt3 from TG__Homo_sapiens__NP_003226
auggcccuggugcucgaaaucuucacccuucuggcuagcauuugcugggucuccgcaaacauauuugaauaccagguugacgcccaacccuugagaccuugugaguuacagagggaaacugcguuccugaagcaggcugauuaugugccacagugcgccgaggacggcucuuuucaaacuguacagugucagaaugaugggcggucaugcuggugugugggagccaacgguagugaaguccuaggcagccgccagccggggcgacccguggccugccucuccuucugucaacugcagaagcagcagauccuucugucuggauacauuaauucgacggacaccucauauuugccucaaugccaggauagcggcgacuacgcuccaguucagugugaugugcaacagguccagugcugguguguggacgcagaggguauggagguauaugggacacgucagcucggaagacccaagaggugcccucggaguugcgaaauccgcaacagaaggcugcugcacggcguuggcgauaaauccccaccccaauguucugccgagggggaauuuaugccugugcagugcaaguucgucaauacuaccgacaugaugauuuuugaucucgugcauagcuacaaccgguucccagacgcuuuugugacauucuccucauuucagcgccgauucccggaggucaguggauauugucacugcgccgauagccaggguagagaguuagcggaaaccggccuggagcuuuugcuggacgaaaucuacgacacuauauuugcagggcuagaucuccccucuacauucaccgagacgacucuguacaggauccuucaacggcguuuccuggccguucaguccgugauuucaggacgcuuuagauguccuaccaaaugcgaaguagagagguucacagcuacuagcuuuggccauccauaugugcccaguugucggcgaaauggugacuaccaggccguccagugccaaaccgaggggccuuguuggugcguggaugcacagggaaaggaaaugcacggcacacgccagcagggcgagccacccucuugugcugaagggcaauccugcgccagcgagagacagcaggcguugucgaggcucuauuucggaaccucugguuacuuuucccaacaugaccuguucucaaguccggaaaagcggugggccagcccucgcguugcaagauuugcuacguccugucccccaacuaucaaagaguuauucguggauucuggccugcucaggccuauggucgaggggcagagccagcaguuuucagugagugaaaaccuucugaaggaggccauucgugcuaucuuccccucccggggauuggcccgacuagcacugcaauuuacaaccaauccaaaaagacuccagcagaaccuguucggcgguaaguuucuuguaaauguugggcaguucaaccugagcggcgccuugggaacuaggggcacauucaauuuuucucaauucuuucagcagcucgggcuggcuucauucuuaaacggaggucgccaggaagaccuggcgaaaccccuaagugugggccucgauagcaauuccucuaccgggacgccugaggcagccaagaaggacggaaccaugaacaaaccaacagucggcucguuugguuucgaaauaaaccugcaagagaaucagaacgcucuuaaguuuuuggccagccugcucgagcugccggaguuccuucuguuuuugcagcacgcaauuuccgugcccgaggaugucgcccgggaccucggggaugugauggaaacuguucugucaagucaaaccugugagcagacaccugagagauuauucgugccaucuugcacuaccgaaggcagcuaugaggacguacaguguuuuuccggagaaugcuggugugucaauucauggggcaaagagcugcccgggagcagggugcgcggaggucagccucgaugcccaacagacugugaaaagcaacgggcucguaugcagucucuaaugggcucccagcccgccgggaguacccucuucguuccggcaugcacuagcgagggacacuuucugccugugcaguguuucaacucugagugcuacugugucgaugcggaaggccaagcuaucccagguacgagauccgccauugggaaacccaagaaaugcccuacacccugccagcuucagucagagcaggcauucuugaggaccgugcaagcccugcucaguaauagcucgaugcugccaacuuuauccgacaccuauaucccucaguguucuacagauggccaguggcgccagguacaaugcaacggacccccagaacagguguuugagcuguaccagcggugggaagcucaaaauaagggccaggaccuuaccccggccaaguugcucguuaaaaucaugagcuacagagaggcagcuucagggaacuucagucuguuuauucagucccuauaugaggccggacagcaagaugucuucccugugcugucucaguaccccagccuccaggacgugccacuggcggcccuugaaggcaagaggccccagccucgagagaauauauugcuggaaccauauuuauuuuggcaaauccucaacggucagcugucccaguaccccgggucauauagcgauuucaguacuccucuugcucauuuugaccugcgcaauuguuggugcgucgaugaggcaggacaggaauuggagggcaugcggucugagccguccaaacucccaacaugucccgguagcugcgaagaggccaagcugagaguucuacaauucauuagggaaacggaggagaucgugucggcuucaaacucuagucguuuuccucugggcgaauccuuccucguggccaaagggauacgccugcggaaugaggaccuuggauugccaccccuguuuccuccgagagaagcauucgcggagcaguucuuaaggggcagcgauuacgccauucgacucgcugcccagucuacccugagcuuuuaucaacggcgcagauucucccccgacgauucagcaggggcuagugcccuucugaggagcggaccauacaugccucagugugacgcauuuggcucuugggaacccguacagugccacgccgguacugggcauuguuggugcgucgacgagaagggaggcuucaucccagguucccuaacagcucggucacuccagaucccucaaugucccaccacaugcgagaagagucgaacuagcggccuguuguccucuuggaaacaggcgagaucgcaggaaaacccaagcccgaaggaucuguuugugccugccugcuuagagaccggggaauacgcacgccuccaggcuucaggagccggcacgugguguguugaccccgccuccggggaggaacugaggccaggaaguucuagcuccgcucaaugccccucacuuuguaaugugcugaaaucuggcgucuugagccgucgggugaguccugguuauguuccagcaugcagagccgaggaugggggauucucccccgugcagugugaccaggcgcagggcagcugcugguguguaauggauucuggugaggaagucccuggcaccagggugacagggggacaaccggcuugcgagucaccacgcuguccccucccuuuuaacgccuccgaaguggucggcgggacuauucugugcgagaccaucaguggacccacaggcagcgcaaugcagcagugucagcuacugugccgacaagguucguggucuguuuucccaccugggccccuuauuugcucccucgaaagcggaagaugggagucacagcugccacagccucgggccugucaaaggccgcaguuguggcagacuauacagacccaaggccacuuucagcugcaguuacccccaggcaagaugugcagugcugacuacgcagaucuccugcagacguuccaaguguuuauccuugacgagcugacagcccgcggguucugucagauucagguaaaaaccuuuggaacuuuggugucuaucccugucugcaacaauuccagcgugcagguugguugucucacacgugaaagacugggcgugaacgucaccuggaagucacggcuagaggauauccccguggcgagucugccagaccuucacgauauugaaagggcucucguugggaaggaccuguugggacgcuucacugauuuaauacaaagcggcuccuuccagcugcaucucgacucuaaaaccuuuccugccgagacaauccgauuccugcagggugaccacuuugggacgagccccagaaccugguucggaugcuccgagggcuuuuaucaagugcuuacuucagaagcaucucaggauggccuggggugugucaagugcccggagggaaguuacucgcaggacgaagaguguauuccaugcccuguagguuucuaucaggaacaagccggcagcuuggcuugugugcccugcccaguugggcggacaaccaucuccgccggagcauuuucucagacacauugcgugacugauugucagaggaaugaggcuggccuacagugcgaccaaaacggucaguaccgcgccucacagaaagauagagggagcggaaaggcguucugugucgacggcgagggcaggcggcugcccuggugggaaaccgaggccccucucgaagauucccagugccugaugaugcaaaaauuugagaaggugccggaaaguaagguaauuuucgacgcaaaugcucccguggccguccguucuaaaguuccagauagcgaguuuccugugaugcagugucuuacggacugcacagaggaugaggcuugcucauucuuuaccguguccacuaccgaacccgaaaucaguugcgacuucuaugcauggacaagcgacaacgucgccuguaugacuucugaucagaagcgcgacgccuuaggaaauuccaaagcuaccucauucggaagccugcgaugccaagugaagguuagaucgcacggucaggauucuccugcgguauaccucaaaaagggccaggggaguacaacgaccuugcagaaaagguuugagccaacuggauuccaaaacaugcuguccggccucuacaaucccauaguguuuagcgcaucaggugccaaccugacagacgcucaucuuuucugucuguuggccugcgaucgggaccuauguugcgauggguuuguccugacccaggugcagggaggcgcaaucauuugcggccucuuauccucuccuagcguucugcuuuguaaugugaaggacuggauggauccaagugaagccugggcuaacgcgacuugccccggggucacauaugaccaggagucccaccaagugauccugcgccucggagaucaggaguucauuaagagcuugaccccgcuggaagguacgcaggacacuuuuaccaauuuccagcaaguauaccucuggaaagauucugacaugggcucaagaccugagaguaugggguguaggaaggacacagucccacggcccgccuccccuaccgaagcaggacugacuacagagcuuuuuagcccaguggaucuaaaccagguuaucgugaauggcaaccagucucugucgucacagaaacacugguuguucaagcauuuauuuagcgcucaacaggccaaccuguggugccucucccgauguguccaggagcacaguuucugccaacuggcagaaauaaccgagucugccagccuuuauuuuacauguacucuguaccccgaagcucaggugugcgacgauauuauggaguccaaugcccaggguuguagacucaucuugccgcagaugccuaaagcgcuguuccgcaagaagguuauucuagaagacaaagugaagaacuucuauaccaggcugcccuuucaaaaacucauggggaucucaauacggaauaaggucccaaugagugagaaaucuaucagcaacggauucuuugagugcgaacguagaugugaugcagacccuugcugcacgggcuucggcuuucuuaaugugucccagcugaaagguggggagguaacauguuuaaccuugaacucacuggggauucagaugugcagcgaagagaauggcggggccuggaggauccucgauuguggaucucccgacauugaagugcauacuuacccauucggcugguaucagaagcccaucgcucaaaacaaugccccuuccuuuugcccacugguuguccuuccgagucugaccgagaaagugagccucgauucguggcaguccuuggcucugucuucaguggucguagaccccagcauacgccacuucgauguggcacacguuaguacagccgcuacuuccaacuuuucugccgugcgggacuuaugucuaagcgagugcucacagcaugaagcaugucugauuaccacgcuccagacacaaccuggugcgguccgaugcauguucuacgccgauacccaguccuguacucacagucuucaggggcaaaauugcagacuguugcugagggaggaagcuacacauaucuaccgcaagccaggcaucagccuccugucuuaugaggccucagugcccuccguuccuauuagcacccacggacggcuucucggcagaucucaggcaauccagguggggacaaguuggaaacaggucgaccaauuucugggagugccauacgcugcacccccuuuggcagaacguagguuccaggccccggagccacugaacuggacagguucgugggacgcuuccaagccccgggcgagcuguuggcagccuggcacccgcacgucaacuucucccgggguaagcgaggauugcuuauaucuaaauguguuuauuccacagaacguugccccuaaugcauccguccugguguucuuccauaacaccauggaccgagaagagagugaaggauggcccgcuauagauggcucauuucucgccgccguggguaaccuuaucgucguuacagcaucuuacagaguggggguauucggcuuucugagcuccggaaguggcgaggugagcgggaauuggggauugcuggaccaagucgcugcccucaccugggugcagacacacauuagggguuucggcggggauccacggcgcguuucccuggcggcugacagaggaggcgccgauguggcaucuauccaccuuuuaacugccagggcuaccaacucacagcuguuucgacgggcaguccucaugggugggagcgccuugucgccggcggcuguaauuucccaugagcgugcccagcaacaggcaaucgcccuggcuaaagaagugaguugcccuaugucuagcucacaggagguuguguccugucuaagacagaagcccgccaauguccugaacgacgcacaaacgaagcuccuugcugugucuggcccauuccacuauuggggacccgucauagauggccauuuucugcgcgaaccuccagccagggcguugaaacggagucuguggguggagguugaccuccugaucgggagcucccaggaugacggauuaauuaauagagccaaggcagugaaacaguucgaagagucacgcggcaggacaagcucuaagacugcuuuuuaccaagcccuucagaacagucuggguggggaggacuccgaugcacgaguagaagcugccgccaccugguauuacagccucgagcacucaacagacgauuacgcgucuuucucccgggcucuagaaaaugcaaccagagacuauuuuaucauuugccccaucauagauauggccucggcuugggccaaaagggcacgcggaaacguguucauguaccaugccccugagaauuauggccacgguagccuggaauugcuggcugacguccaguuugcgcucggccuuccguucuacccagccuaugaggggcaguucagucuggaggaaaagucuuugucccugaaaauuaugcaauacuuuagccacuucauccguucaggaaaccccaauuauccuuacgaguuuagucggaagguuccaacuuucgcaacccccuggccugauuuugugcccagagcuggcggggaaaacuacaaggaguucuccgaacucuuaccaaauaggcagggacugaaaaaggccgacuguagcuuuuggucuaaauauaucucaagccuuaagacauccgcagauggcgccaaaggugggcagucugcugagagugaggaagaggaacugacggccggaucgggccuacgcgaggaccuccugagcuugcaggagccggguuccaagacuuacucaaaguga

SEQ ID NO: 63736 - RNA, 828 nt, Artificial Sequence
  derived and/or modified sequence opt3 from TGIF1__Homo_sapiens__NP_001265611
auggccgcugcacacagcggcagauccaucguggccgcgucugggucagagaccgaagacgaggauaguauggacauuccccuggaucucagcuccucugcuggaucggguaagaggcggcgccgaggcaaccuuccuaaagaaucaguccagauacugcgugacugguuguacgagcauagauauaaugccuacccaagcgaacaagagaaggcauuacugagucagcagacacaccuauccacucuccagguuugcaacugguucaucaaugccaggcggcgccugcuuccggauaugcugagaaaagacgggaaggaucccaaccaauuuacgauuucuaggcggggagcuaaaaucagcgagaccuccucaguggaaaguguaaugggcauuaagaauuucaugccugcauuggaggaaacaccauuucauagcuguacugccggucccaacccuacccucgggcgcccacugucucccaagccuuccucaccaggaagcgugcuggcucgaccgagugucaucugccacacaaccgugacugcccucaaagacguucccuucucuuuaugucaguccgugggcgucggccagaauacagauauacagcaaaucgcggcaaagaacuuuaccgacacgagccugauguauccugaggauacuugcaaaucggggccaucuaccaauacacaguccggacuuuucaacacucccccuccaacacccccggacuugaaucaggauuuuucagguuuccagcugcuaguggacguagcccucaagagagcugccgagauggaacugcaagcaaaacuuaccgcuuga

SEQ ID NO: 63737 - RNA, 468 nt, Artificial Sequence
  derived and/or modified sequence opt3 from TGIF2-C20orf24__Homo_sapiens__NP_001186464
augagcgacuccgaucugggcgaggacgaagggcuccuuucucuggccggaaagagaaaaaggcgggguaacuugcccaaggagucagugaaaaucuuacgcgauuggcuguaccuacaccgauauaaugcuuacccuagugaacaggagaagcucagccuguccggccaaaccaaccuuucuguccugcaggacgaguucuuggauguuauuuauugguuucgucagauaaucgcagugguacucggggugauuuggggaguccugccacugagaggcuuccucgguaucgccggguuuugcuuaauuaaugcgggagugcuguaccuuuauuucucgaacuacuugcagaucgacgaagaggaauauggcggcacaugggagcugacuaaagaaggguuuaugacgucauucgcucuauuuaugguuauauggaucauuuucuacaccgccauccauuacgauuga

SEQ ID NO: 63738 - RNA, 714 nt, Artificial Sequence
  derived and/or modified sequence opt3 from TGIF2__Homo_sapiens__NP_001186444
augagcgacuccgaucugggcgaggacgaagggcuccuuucucuggccggaaagagaaaaaggcgggguaacuugcccaaggagucagugaaaaucuuacgcgauuggcuguaccuacaccgauauaaugcuuacccuagugaacaggagaagcucagccuguccggccaaaccaaccuuucuguccugcagauuugcaauugguucauaaacgcacguagaagguugcucccagacaugcugcggaaagaugggaaggacccgaaucaguuuacaaucucgcgcagaggaggcaaggccucagauguugcgcugcccagggguagcaguccuuccgugcucgcuguaucugugccagcccccacuaacgucuuaagccuguccguguguucaaugccucuucauagugggcagggagaaaaaccagcagcccccuucccucggggcgaguuggagagcccaaagccgcugguuacgcccggcucuacccuaacacuccugacucgcgcugaagcaggguccccuaccggaggucuuuuuaauacaccacccccuaccccacccgagcaagacaaagaagauuucagcucauuucagcuguugguggaggucgcccuccagcgagcugccgagauggaacugcagaagcaacaggacccgaguuuaccucugcuccacacucccauuccacuugugucugagaacccucaguga

SEQ ID NO: 63739 - RNA, 726 nt, Artificial Sequence
  derived and/or modified sequence opt3 from TGIF2LX__Homo_sapiens__NP_620410
auggaggccgcugcagacggccccgccgaaacccagagcccuguggagaaggauuccccagcgaaaacacaaucuccggcucaggacacuucaaucaugaguagaaacaaugccgauacggggaggguccuggcacuccccgaacacaagaaaaagcggaaaggaaaccuuccugccgagagcguuaagauucugcgcgacuggauguacaagcaucgauucaaggcuuauccauccgaagaggagaaacagauguugucugagaaaaccaauuuaucgcugcuacagauaucaaacugguuuaucaaugcacguagaaggauucuccccgauaugcugcaacagcggcgcaacgacccuaucauuggucacaagacaggcaaagaugcccaugcuacucaccuucagagcaccgaggccagugugccagcgaaguccgggcccucuggaccugacaauguacagagccugccauuguggccgcuccccaagggccaaauguccagagaaaaacagccugauccagagucagcacccagucagaagcugacagguaucgcccagccuaaaaagaaagugaaggucagcgugaccucuccauccucacccgagcugguuagcccggaagaacaugcugacuucaguucuuuucucuuacugguggaugccgcaguccaaagggcugccgaacuugaguuggagaaaaagcaggaaccuaaccccuga

SEQ ID NO: 63740 - RNA, 2454 nt, Artificial Sequence
  derived and/or modified sequence opt3 from TGM1__Homo_sapiens__NP_000350
augauggacggccccagaagcgauguggggagguggggagguaacccucugcagccaccgaccacacccuccccugagccagaacccgagccugacggccggucucgccgagggggaggccguucauucugggccagaugcugugguugcuguaguugcaggaaugcugcagaugacgauugggggccagaacccagcgacucccggggacgcgggucuucgucaggcacuagaaggccugggagccggggaagugauucccgccgaccagucucuagagguagcggcguuaacgccgcgggggacggaacgaucagggagggcaugcucgugguaaaugguguggaucuucuguccucacggagugaccaaaaccgucgcgaacaccauaccgaugaguacgaguaugacgaauugauugucagaagggggcagccguuucacauguuacugcuacucagccggacauacgagucuuccgaucgaauaacucuggaacuucugaucggaaauaaccccgaggugggcaagggcacccauguuauuaucccuguggggaaaggagguucaggcggguggaaggcucaggucgugaaagccagcggacagaauuugaaccuccgcguacacacaaguccaaaugcaauuaucggcaaguuccaauuuaccguuagaacucagucugacgccggugaguuccagcugcccuuugacccuaggaacgaaauauauauccuguucaauccauggugucccgaggauauuguguacgucgaccaugaagauuggcggcaggaguaugugcucaacgaauccgggcgcaucuacuauggcacagaggcucaaauuggagagagaaccuggaauuacggccaguuugaccacgggguguuagaugcaugccuguacauccuugacaggcguggaaugccguaugguggccggggcgauccugucaacguuagccgagugauaucggccaugguaaauucuuuggacgauaacggagugcugauuggcaacugguccggugacuacucaagagggacgaaucccagugcuugggucggcagcguggaaauccuacucuccuaucugaggacuggauacucuguuccauauggccaguguuggguguucgccggggucaccacaacugugcuucgcugccugggauuggcgacccggacaguaaccaacuuuaauagcgcacacgauacggacacuucacucacaauggacauuuacuucgaugagaacaugaaaccucuggaacauuuaaaucacgacaguguuuggaacuuucauguguggaaugauuguuggaugaagagacccgaccugccauccgguuucgauggcuggcaggucguggacgccacuccccaagagaccagcucugggaucuuuugcuguggaccuugcucagucgaaaguaucaagaacggccucguguauaugaaauacgauacaccauucauuuucgcugagguuaauagcgacaagguguacuggcagaggcaggaugacgguuccuuuaaaauaguauaugucgaggaaaaggccaucgggacccuuauugugacgaaagcaaucucuucgaacaugcgcgaggauauaaccuaccuguauaagcacccggaaggcagcgacgcugagcgaaaggccguugaaacagcggccgcacacggauccaaacccaauguguacgcuaaccggggcucagccgaggaugucgcuaugcaaguggaggcccaggacgcaguaauggggcaggacuugauggugaguguuaugcuaauuaaucauucuagcucccguagaacugucaagcugcaccucuaucugucagugaccuucuacacaggagugagcggcacuaucuuuaaagaaaccaagaaagaggucgaacuugccccuggugcuucugauaggguuacaaugccaguggcguauaaggaguaccgcccccaucugguggaccagggggcaauguugcucaacguauccggacacgucaaagagaguggccaagugcuggccaagcagcauaccuuccgguuaagaacuccugaucugagccuaacgcuccugggugcugccguugugggccaggaaugcgagguccagaucguguuuaagaauccacuucccguuacauugaccaacgugguauucaggcuggaagggucuggacuccaacgaccgaaaauucugaacgucggcgacaucgggggaaaugagacugugacccuucgccaguccuuugugccuguccggccaggccccagacagcugauugcaucauuggauaguccucagcucagccaaguucacggugugauacagguagacguggcccccgcuccaggggauggaggcuucuuuucggacgccgguggcgauucccaccugggggaaacaaucccuauggcaucuaggggaggcgcguga

SEQ ID NO: 63741 - RNA, 1647 nt, Artificial Sequence
  derived and/or modified sequence opt3 from TGM2__Homo_sapiens__NP_945189
auggccgaggaacuggugcucgagagaugcgaccuugaacuggagaccaacggcagggaucaccauacagcugacuugugucgggaaaaguuagucguucgccgagggcagcccuucuggcugacucuacacuuugagggacguaauuacgaggcaagcguggauucccucacguucucuguagugaccgguccugccccaucacaagaagcgggcacaaaagcuagauuuccgcugagggacgccgucgaggaaggggauuggacugcaaccgugguugaccagcaggauugcacacuuagucugcaguugaccacucccgccaacgcuccuaucggacucuaucggcugagccuggaggcauccacaggcuaccaagguucuucguucgugcucgggcauuuuauuuuacuguucaaugccugguguccagcugacgccgucuaucuugauucagaggaggagcgccaggaauacguguugacccagcagggauuuauauaucaaggcagcgcgaaguucaucaaaaacauucccuggaauuuuggccaguucgaggacgggauccuggauauuugccuaauccuccuggacguaaacccuaaguuucuuaaaaaugcaggaagagauuguaguaggcgguccucuccaguuuacgugggucgcgucgugagcggcauggugaacugcaaugacgaccaggggguccuguugggacgaugggauaacaauuauggcgacgguguuucccccaugucauggauagggaguguggauauccucagaagguggaagaaccacggaugucagcggguaaaguacggccaaugcuggguguucgccgcugucgccuguacggugcugcguugcuuaggcauuccuacucgcguugugaccaauuacaacagcgcacaugaccaaaauucuaaccugcucaucgaauauuuuagaaacgaguucggggagauucagggagauaaauccgaaaugaucuggaauuuccacuguugggucgagucauggaugacaaggccagaccuucagccggguuacgaaggcuggcaggcucuggaucccacuccucaggaaaagagcgaagggaccuauugcugcggaccagugcccguacgggccauaaaagagggcgacuugaguacaaaguacgaugcgccuuuuguuuucgccgaggugaacgcagacgucguggauuggauucagcaagacgacgguucuguccacaaauccaucaaucgaagccuaauuguggggcugaagaucucgaccaagucuguuggccgcgaugaaagagaggacaucacgcauacuuauaaauacccagaaggauccucagaggaaagggaggcuuuuacacgggccaaccaccucaauaagcuggcugagaaagaagagaccggcauggccaugcgcauuagaguggggcagaguaugaacaugggaagcgauuucgacguauuugcacauauaacuaauaacacagccgaagaguaugucuguaggcuucuguugugcgcucguaccguguccuacaaugguauccucggccccgagugugggacgaaguaccuguuaaaccugaaucuagaaccguucucuggaaaagcgcucugcagcuggucaauuuguuga

SEQ ID NO: 63742 - RNA, 2082 nt, Artificial Sequence
  derived and/or modified sequence opt3 from TGM3__Homo_sapiens__NP_003236
auggccgcucugggcgugcagagcaucaacuggcaaaccgcauucaauagacaggcccaccauacagacaaguuuuccucucaggagcucauucuuaggcgggggcagaacuuccaaguccugaugauaaugaauaaaggauuggguucaaacgaacgcuuagaguuuaucguuaguacuggccccuacccuagcgaauccgcgaugacgaaggcuguguucccacugucuaaugggucgucaggaggcuggagcgccguacuacaggcaaguaacgguaauacccucacaauuuccaucucuagcccggccuccgcucccauugggcgauauacuauggcacugcagaucuuuucacagggaggcauaaguagcgugaaacuuggcaccuucauccuguuguuuaacccuuggcucaaugucgauucuguguucauggggaaccacgccgagcgugaagaguacguucaagaggacgcuggaauuaucuuuguggguuccacaaauagaauuggcaugaucggguggaacuucggacaguuugaagaggauauacugucaauuugccugagcauccucgacaggaguuuaaauuuccggcgcgaugccgcgaccgacgucgcaucuagaaacgauccaaaguaugugggcaggguacuguccgccaugauuaauagcaacgacgauaacgguguucuugcugggaauuggucgggaacuuacacaggcggccgggacccccgcucuuggaacggguccguggaaaucuugaaaaauuggaagaagucaggauuuaguccuguccgauauggucaguguuggguguucgccggcacccugaacacggcacuaagaagccucgggaucccauccagggugauuacuaauuucaacucugcucaugauaccgaccggaaucugagcgucgauguuuacuaugaccccaugggaaacccucuugacaaaggcucagauaguguguggaauuuucacguauggaacgaggguugguucgugcguuccgaccuggggccaagcuacggcggauggcaggucuuggaugccacaccgcaagagcgcucucagggcguguuucagugcgggcccgcgucaguuauaggagugagagaaggugacguccaacucaauuucgauaugccuuuuaucuucgccgaggugaacgcagacaggauuacuuggcuguacgauaauaccacaggcaagcaguggaaaaacaguguaaauagccauaccaucgggcgguauauauccacgaaggcuguuggaucuaacgcccgaauggacgugacugauaaauacaaguauccagaaggcucggaccaggagcgccaggucuuucaaaaggcuuuagguaaacugaagcccaacacaccuuucgccgcaaccagcuccauggggcucgaaacugaggagcaggaaccaucaauuaucggcaaacuuaagguggccggaaugcuggcugucggcaaagaggugaauuugguucuacugcucaagaaccugaguagagauacaaaaaccgugacgguaaauaugaccgcguggacaaucauuuacaacgggacucuuguccacgaaguguggaaggacucugcaaccaugagccuggaccccgaggaagaggccgagcacccgaucaagauuuccuaugcucaguacgaaaaauauuugaagucagauaauaugauaaggaucacagccguuuguaaagugccugacgagagcgaagucgugguagagcgggauauuauccucgacaaccccacucugaccuuagaagugcugaaugaggcacgcguuagaaagccagucaacgugcagaugcuauuuucuaauccucucgaugagcccgugagggacugcguccugaugguugaaggauccggucuuuugcugggcaaccucaaaaucgaugugccaacacuggggcccaaggagggaagucgugugcgguucgacauucuuccuagccgaucuggcaccaagcaacuguuggccgauuuuuccuguaauaaauucccagcuauaaaggccaugcucucaaucgacguagcagaauga

SEQ ID NO: 63743 - RNA, 2055 nt, Artificial Sequence
  derived and/or modified sequence opt3 from TGM4__Homo_sapiens__NP_003232
augauggacgccagcaaggagcugcaagugcuccacaucgauuuccuuaaccaagacaaugcugucucccaucacaccugggaauuucagacaucuucacccguuuucagaaggggccagguguuucaucugcgguugguauuaaaccagccucugcaaaguuaccaccagcuaaaacucgaguucagcacugggccaaauccguccauugcaaagcauacgcuggugguccuugauccccgcaccccuucugaccacuauaacuggcaggccacacugcagaaugaaucgggaaaagaggugacuguugcggugaccucaagcccaaacgcuauauuggguaaguaccaacucaaugucaaaacaggcaaccacauccugaagagugaagagaauauucuguaucucuuauuuaaccccuggugcaaggaggauaugguguucaugccugacgaagaugagcgaaaagaauacauccugaaugacaccgggugucauuauguaggagccgcacguuccauuaagugcaaaccauggaacuuuggccaguucgagaagaauguucuugauuguugcaucucuuugcugacugagagcucccuaaaacccacagacagaagggauccugugcucgucugucgggccaugugcgcuaugaugucauuugaaaagggucagggggugcugauaggaaacuggaccggcgacuacgagggcgggacggcaccauauaaguggacuggaagugccccgauccuucagcaauacuacaauaccaaacaggcuguguguuucggucagugcugggucuuugccggcauucugacaacuguuuugcgcgcgcucgggauccccgcaagaagcgugaccggauucgauucugcccacgacacagaaaggaaccugaccguagacacguaugugaacgagaauggcgaaaagauuacuuccaugacacaugauucagucuggaacuuucacguguggaccgacgcuuggaugaaacggccugauuuaccaaaggguuacgacggguggcaagccguugaugcaacuccccaggagcgcagccagggaguguucuguugcggcccuaguccacugacagcuauccgaaaaggcgacauauucauugucuaugauaccagauuuguguucucugagguaaauggggacaggcucaucuggcuuguuaagauggugaacggacaggaggaacugcacgucauuuccauggaaacgaccagcaucgguaaaaauaucucgacaaaggccgugggccaagaucggcgucgcgacauuacuuacgaguauaaguaccccgaagggucuuccgaggagagacaggucauggaucaugcguuuuugcuacugucaagugaaagggagcaccggcgaccggugaaagaaaacuuccuccauaugagcguucaguccgacgacgugcugcuuggaaauucuguaaacuuuaccgucauacugaagcgcaaaacagccgcauugcagaaugugaacauccucggcagcuucgagcugcaauuauauacugguaagaaaauggcuaagcugugugaucuaaauaagaccucacagauucaggggcagguuagugaagugacacucacccuggacuccaaaacuuacaucaacagccuugccauauuggaugacgagccugucauuagaggcuuuaucaucgcugagauuguggaaucuaaggagaucauggccucagaaguauucacgaguuuucaauaccccgaguucagcauugagcugccaaauacaggaaggauaggccagcuccuggugugcaacugcaucuuuaaaaauacccuugcaauuccucugacugauguuaaguucuccuuggaaucucucgggaucucgagccugcagaccuccgaccacggaacaguccagcccggugagaccauccaaucacagauuaaauguacuccaauaaagacaggccccaagaaauuuaucgugaaguuaaguucuaaacaggugaaggaaauuaacgcccagaaaaucguccugauuacgaaguga

SEQ ID NO: 63744 - RNA, 1917 nt, Artificial Sequence
  derived and/or modified sequence opt3 from TGM5__Homo_sapiens__NP_004236
auggcccagggccuggagguggcucucaccgaccuucaaagcuccagaaacaaugucaggcaccauacagaagagaucacuguugaucaccuguuggugcggcgcgggcaggcauucaacuuaacgcuguacuuucgaaaucguucuuuccagcccggacuagacaacauuauauuuguaguggaaaccgaggaugccgucuaucucgacucagaaccucagagacaagaguacgugaugaaugauuaugguuucaucuaccagggcaguaagaacuggauuaggccaugcccguggaauuaugggcaguuugaggacaaaaucauugauaucugucugaaacuucuggacaagagcuugcauuuccagacagaucccgcgacugacugcgcucuccggggauccccuguuuacgugucucgcgucgugugugccaugauaaacucgaaugaugacaacggcguacugaaugguaacuggucagaaaauuauaccgauggggcaaacccagccgaguggacaggaagcguugcuauccugaagcaauggaaugcaaccggcugccagcccgugagauacggccaguguugggucuuugccgcugugaugugcacugugaugaggugucucgggauuccuacacgggucaucaccaacuucgacaguggacacgacacggaugguaacuuaauuaucgacgaauacuaugauaauacuggccgcauacuggggaacaaaaagaaggacaccauuuggaauuuucauguuuggaacgagugcuggauggcccgaaaagaucuuccacccgcguacggaggcuggcaaguguuggacgcaacaccucaggagauguccaaugguguauauuguugcgggccagccucugugagagcuaucaaggaaggagaggucgaucugaacuacgacacuccguucguguuuagcaugguuaaugccgauuguauguccuggcuagugcagggcggcaaagaacagaagcuccaccaagacaccucaagugucgggaacuucauuagcacaaaaucuauccaguccgaugagagggacgacaucaccgaaaauuauaaguacgaggagggaucacugcaggaacgucagguguuucuuaaggcacugcaaaaauugaaggcucggagcuuccacgguagucagcgcggcgccgagcuccagcccucuagaccuacgucccugagccaggauucgccaaggucuuuacauacucccucccugcggccuucagacguaguucaagugagucucaaauucaaacuucuggauccacccaacauggggcaggacauuugcuuugucuugcuagcgcugaauaugagcucccaguucaaggaucucaaggugaaccugucugcccagagccuucugcacgacggaucaccguugaguccuuuuuggcaagauacagcauucauaacccucucccccaaagaagcuaagacuuauccaugcaagaucagcuacucucaguacucacaguaucugaguacagacaaauuaauucgaaucagcgcccugggcgaggaaaaguccucuccugagaaaauucuagucaauaagauuaucacccucucguaccccagcaucacgauuaacgugcugggugcugccguugugaaucagccacuuuccauccaaguaauauuuucaaaccccuugagugagcaggucgaagauugugugcugaccguugaggggucuggccucuucaaaaagcagcaaaagguguuucugggaguccuuaaaccucagcaucaggcaagcauaauccuggaaacagugccauucaaguccggccagcgccaaauucaggccaacaugagaucaaauaaauuuaaggacaucaaaggguauaggaacguauacguggauuucgcuuuguga

SEQ ID NO: 63745 - RNA, 1878 nt, Artificial Sequence
  derived and/or modified sequence opt3 from TGM6__Homo_sapiens__NP_001241663
auggccggcaucagagugaccaaggucgacuggcagaggagccggaacggggcugcacaccauacacaagaguaccccugcccugaacugguugugcgccgaggacaguccuucucucucacucuugagcugucacgugccuuggauugugaagagauuuuaauauuuacgauggaaaccgguccaagagcgagugaggcucugcacacaaaagccguauuccagacuagcgagcuagaaaggggcgagggguggaccgcagcccgggaagcucagauggagaagacacucaccgugucccuggcaucuccgcccucggccgucaucggacgcuaucuucugucaauuagauugagcagucauaggaaacacuccaaucggcgccucggcgaguuugugcugcuguucaacccuuggugcgcugaagacgauguuuuucucgccucugaggaggaacgacaagaauacguguuaagcgacuccgguaucauuuucagaggggucgagaagcauaucagggcgcagggauggaauuauggccaguuugaggaagauauacugaacaucugucuuucaauuuuggaccggaguccaggccaccagaauaaccccgcaacugaugugagcugccgucacaauccuaucuacguaacacgcguuauuucugccauggugaacuccaauaacgacagaggggucgugcaaggacaguggcaggguaaauauggcgggggaaccucaccacugcauuggaggggcagcguggcuauccuacagaaguggcucaagggucgguacaaacccgucaaguaugggcaauguuggguuuucgccggagugcugugcacgguacuucgaugucugggcauagcaacucgcguggucaguaauuuuaacucugcucacgauaccgaccagaauuuguccguggauaaauacguugacagcuucggcagaacacucgaggaucugacugaagacucgauguggaacuuucauguguggaaugagucuugguucgccaggcaggacuuagggccuuccuacaacggauggcaaguccuggaugcgaccccacaggaagagucagaggguguguuucggugcggcccggccaguguaacagcaauucgcgaaggggacguucaccucgcucacgauggacccuucguguucgccgaggucaacgcugacuauaucaccuggcuuuggcaugaagaugagagcagagaaaggguguacuccaauacgaagaaaauuggccguuguaucucuacuaaggccgucgguagcgacucacggguggauaucacagaccuguauaaguacccugaggggagucgaaaagagagacagguuuauuccaaggcagugaacagguuguuuggcguagaagccagcggacgccggauuuggauaagaagggcuggcgggcgcugccuauggcgagaugaccugcucgagccagcgaccaaacccucuaucgcaggaaaguucaaaguccuggaaccuccaaugcuuggucacgaucugcgguuggcccucugucuggcuaauuuaacuucacgugcccagagagugaggguuaaccugaguggcgcaacaauucuauacacccgcaagcccguggccgagauccuccaugagagccacgcuguccggcuggggccgcaagaagagaaaagaauaccuauuacgaucuccuauucuaaguacaaggaagaccuuaccgaggacaaaaagaucuugcuggccgcaaugugccucgugacaaaaggagaaaagcugcuuguagagaaagauauuacucuggaggacuuuaucaccauuaagagggcguaccccggcgcuucgggugaaggguugagcccaguguga

SEQ ID NO: 63746 - RNA, 2133 nt, Artificial Sequence
  derived and/or modified sequence opt3 from TGM7__Homo_sapiens__NP_443187
auggaccagguggccacccugagacucgagagcgucgaucuucaauccucuaggaacaauaaggaacaccauacacaggagaugggcguuaaacggcugacugugcgccgagggcagcccuucuacuugcguuuaucauuuaguagaccuuuccagagccaaaacgaccacaucacguuuguagcugaaaccggaccaaagccguccgagcugcuagguacaagggcaacuuucuuucucacccgggugcagcccggcaaugucuggucugccucggauuucacaauugacucaaacagccuucaggugagucuuuuuaccccugcgaaugcuguuauagggcauuauacucugaaaaucgaaauuucccagggacaaggccacucugugacauacccauuggguaccuucauccuccuguuuaaccccuggagcccugaggaugacgucuaucugccauccgagauucucuuacaggaauacaucaugcgcgauuauggguucguguacaagggacaugagagauuuauaacgucauggcccuggaauuauggccaguucgaagaggacaucauugauaucugcuuugagauucugaacaaaagucuuuaccacuugaagaauccugccaaggacuguagccagaggaacgauguaguuuacgugugccgggucgugucugcaaugaucaauuccaacgacgauaauggcgugcugcaagggaacuggggagaagacuauucaaaaggugucagcccacuagaguggaagggcaguguugccauacuccagcaguggucugcucgcgggggacaaccggugaaauacggccaguguuggguauucgcauccgugaugugcacugucaugcgaugucugggugugcccaccagaguugugagcaauuucaggucggcccacaacgucgaccggaaccuuacaauugauacuuauuacgaccguaaugcugaaaugcugucuacccagaagcgcgauaaaaucuggaacuuucauguguggaaugagugcuggaugauuagaaaggacuugccuccaggguauaacggauggcagguacucgaucccacaccucaacagaccuccucaggccuguucuguugcggcccagccaguguuaaggcgaucagggaaggggacgugcacuuagcauacgauacgcccuuugucuaugccgaggugaaugcugacgaggucaucuggcugcucggagauggucaggcccaggaaauucuugcacauaacacuagcuccauaggcaaagagaucucuacaaagaugguggggagcgaccaacggcagucaauuaccaguuccuacaaauacccggaaggaagcccugaggaacgagcuguuuucaugaaggccucucgcaaaaugcugggcccccagagagcgucauugccauuucuagaucugcucgagaguggugggcugagggaccagccugcccaacuucagcugcacuuggcacggauccccgaguggggccaggaccuccagcuguuacugcgcauacaaagagugccagauagcacucaccccaggggaccuauuggccuaguaguccguuucugugcucaggcccuccugcaugggggagguacacagaagccauuuuggcggcacaccgugcgaaugaaucuugacuucggcaaagaaacgcaauggccguugcugcuccccuauuccaacuacagaaauaagcugaccgaugagaagcugaucaggguuucugggaucgcugaaguggaggaaacaggacgcucgaugcuggucuugaaagacauuugccucgagccuccacaucugagcaucgagguguccgaacgggccgagguaggcaaggcauuaagagugcacguuacucugaccaacacacuaauggucgcccucucaaguuguacuauggugcuggaagguucugggcuuauuaauggccagauagcuaaagauuugggaacccugguggcgggccauacacuccagauccagcuggacuuauaucccaccaaggcagggccuaggcaacugcagguccuuauuagcuccaacgagguuaaagagaucaagggauacaaggauaucuuugugacuguggccggugcuccauga

SEQ ID NO: 63747 - RNA, 1362 nt, Artificial Sequence
  derived and/or modified sequence opt3 from TGOLN2__Homo_sapiens__NP_001193770
augagauucguggucgcccugguucuccuuaacguggcugcagccggcgcgguaccccuguuggcuaccgagagcgugaagcaggaagaggccggggucaggccuuccgcaggaaaugugucuacacacccaucauuaagucaacggccggguggcagcacuaaaucccaucccgaaccucagacgccaaaggacucucccucgaaaucaagcgccgaggcucagaccccugaagauacaccaaacaagaguggggcagaggccaaaacucagaaggacuccucuaauaagagcggagcugaggccaaaacccaaaagggcuccacaucaaaaagugguagcgaagcgcagaccacuaaggauucuacauccaaaucacaccccgagcugcagaccccuaaggacagcacggggaagaguggagcagaagcccagacuccagaggauucuccgaaccgcuccggcgcugaggccaaaacccaaaaggacagccccucgaaaucuggcuccgaagcacagacaacuaaggauguuccuaauaaaucaggggcugacggacagaccccaaaggaugguaguagcaaauccggcgccgaggaccagacacccaaggaugugccuaacaagucuggggcggaaaaacaaaccccaaaggacggaagcaauaaaucaggcgccgaggaacagggucccaucgaugggccgaguaaguccggagcagaggagcagacgagcaaagacucuccuaacaaggucgugcccgaacaaccaucacgaaaggaccauaguaaaccuauuagcaaucccuccgauaacaaggagcuaccaaaagcugacacuaaucagcucgccgauaagggcaaacugucuccccacgcuuuuaagacagaaucgggcgaggaaaccgaccuuauaagcccuccacaggaggagguaaaguccucagaaccgacugaggauguugaacccaaagaggccgaagacgaugacacagggccugaggagggaaguccacccaaggaagagaaagaaaagaugucugguagcgcauccucagagaaccgugagggcacccugagcgauucuacgggguccgaaaaagacgauuuguacccuaauggaaguggcaacgguagcgccgagucuucccauuucuuugcuuaucucgugaccgcggcaauccuggucgccgugcuguacauugcucaccacaauaagagaaagaucauugccuucgugcucgaagggaaaaggucaaaggucacacggcgcccaaaagcaagugacuaucagagauuagaccaaaagaucuuuuucccgcccagcccuaacaggaugguuuacucguccggcaaacgguga

SEQ ID NO: 63748 - RNA, 2562 nt, Artificial Sequence
  derived and/or modified sequence opt3 from TGS1__Homo_sapiens__NP_079107
augugcugugagaaguggagcagaguggccgaaauguuccuguuuaucgaggaaagggaggacugcaaaauucucugucuuugcucccgggcuuucgucgaagaucgcaagcuguacaacuugggcuuaaaaggguauuacauacgagacucuggaaauaacucaggugaucaggcaaccgaggaggaagagggcggguauaguuguggaacagccgaaagccacgacuccaagggcaucggucuggaugagucugagcuagacucggaagcggagcucaugcguucaauggggcugccccuucaauuuggaagaauuacugcucauaaagauuucgaaguuagcaugaauacgaggaacaaggugaagaucaaaaagaaaaagcaccagaaaaaguaccuggacgagauuguacaggaaaguuggcggaaggaguaugaggaagaugacaucuuggccuccgaugacccuucuagcauagagcaguacgaaaauacccgcacauaugagcuccaauccaaaaaggauacugaaaccgagaacccaccgguggagaauacacugucacccaaacuggaaaucaccgagaagugggaaaaauacuggaacgaguacggcggcgggcucuuauggcagaguuggcaggaaaagcauccuggacaggcacugagcucugagccauggaauuuucccgacacuaaagaggaaugggagcaacacuauucccagcuuuacugguauuacuuggaacaguuccaguauugggaggcccaagguuggacauuugacgcuucacagagcugcgauaccgacacguacacuucaaagaccgaggcagaugacaagaacgaugaaaaauguaugaaggucgaccuggugucuuucccuuccagcccaauuaugguugauaaugacucgucuggcacauccgauaaagaccauucagagauccuagaugggauuaguaacaucaagcucaauagcgaagaggugacucagucccaacuggacucuugcaccagccacgacggacaccagcagcuuucagaagucaguuccaaaagagagugucccgccagcggccagucugagccuaggaacggugggacaaaugaagagucaaacaguagcggaaacaccaauacggauccaccggcugaagacucccaaaagucuucgggcgccaacacuagcaaggaucggccccaugcguccggcacagacggggaugagucagaagaggacccuccagagcacaaacccaguaagcugaaacgcucucaugaauuggauauagacgagaauccugcaagcgauuuugacgauuccggaucacuccuggguuucaaguauggcagcgggcagaaauacggaggcauuccaaacuuuucucaccgacaggugagauacuuagaaaagaauguaaagcugaaauccaaguaucucgacaugaggcggcagaucaaaaugaagaacaaacacauuuucuuuaccaaggagagugaaaagcccuucuucaaaaagagcaaaauccuuucuaagguugagaaauuucugacuugggugaauaagccgauggaugaggaagccucccaagagucaaguagccaugacaacguccacgacgcuucgacauccucugauagcgaagaacaggacaugucagugaaaaagggugaugacuugcuagagaccaauaacccugaacccgagaagugccagaguguguccucugccggggaacuggagacggaaaauuacgagcgugauagccuccuggcaaccgucccagacgagcaggauuguguuacacaagaagugccugacucccgccaggcugagacugaagccgaggugaaaaagaaaaagaacaaaaagaagaauaaaaaggugaacggccuucccccagaaaucgcggccguccccgagcuggcaaaauauugggcucagagauacagguuguucucacgguuugaugacggaauuaagcucgaucgagagggcugguucagcgugaccccugagaaaauagccgagcauaucgcugggcgcguuagucagucuuuuaagugcgacguggucguggaugccuucugcggaguagguggcaauacaauucaauuugcacugacugggaugagaguuaucgccauagacauugacccagugaagaucgcuuuagcgaggaacaacgcagaagucuauggaaucgccgauaaaauugaguucaucuguggcgacuuucugcuacucgcuuccuuccugaaggccgauguggucuuucuuagcccgcccuggggugggccugacuacgcaaccgccgaaacauucgauauucggaccaugaugucgccagacggcuuugagauauuccgcuugaguaaaaagaucacuaauaacauuguguauuuccugcccagaaaugcugauaucgaccagguugccucucucgcaggaccuggcgggcagguagagaucgaacaaaacuuucugaauaacaaacuuaagacgauuacagcguacuucggagaucugauaaggcguccagcuagugagaccuga

SEQ ID NO: 63749 - RNA, 5862 nt, Artificial Sequence
  derived and/or modified sequence opt3 from THADA__Homo_sapiens__NP_001077422
augggcgugaagaaaaagaaagagaugcaggucgccgcucugaccaucugccaccaggaccucgaaacacuuaagagcuucgcagauguugaggggaaaaaccuggccuccuuguuacugcacugugugcagcugacugacggagugucucagauucacuacauaaagcagaucgugccccuccuggaaaaggcggauaaaaaugguaugugcgacccuacgauucagucaugucuugauauccuggcuggcauuuauuugagucucagccugaagaacccacugaaaaagguccucgccuccucuuuaaauucgcugccggacuuuuuccuucccgaggcaaugcauagauuuaccucaagguugcaggaggaacugaacacaacugaucuauacagcuaucggaaagugaccgacaauaucaguuccugcauggagaacuucaaucucgggcgcgccucuguuaacaaucugcuuaagaacgugcugcacuuuuugcaaaagagccucauagaaauccuggaggaaaaucgaaaaugugcuggaaaccauauuauccagacacaauuaaugaaugaucugcucgucggcauucguguguccaugaugcuuguacagaagguucaggacuuccaggguaaccuguggaaaaccucagauaguccuaucuggcaaaauaugugcggguugcuaagcauauuuacuaaggugcugucugacgaugaccuccugcagacaguccaguccaccucaggacuugcaauuauccuguucauuaaaacgauguuucacccaagcgagaagaucccccacuugaucaguucugugcuccugagauccguggacuguacuagcgucccugagugguucaugucgucuugcagguccuuauguugcggcgauauuucacaaagugccguucuguuucuaugucagggcacccucgcuaugcuggacuggcagaacgggagcaugggacgguccggugaagcccuuuugcuggauacagcgcauguacucuucacucugucuagccagauaaaagagccaacccuugaaauguuucugucacgcaucuuggcaaguuggacaaacuccgccauucaaguacucgagucuagcucacccagucugaccgacagcuuaaauggcaacuccucuaucguggggagacugcuagaauacgucuauacgcacugggagcauccucucgaugcucugaggcaccagacuaagauaauguucaagaaucuuuugcagaugcaccggcugacaguggagggagccgacuucguuccagauccguuuuucguggaacucaccgagucgcuguuacgccuggaauggcauauuaaaggcaaguacacuugccuugguugcuuggucgaguguaucgggguggaacacauccucgcaauugacaaaacaauccccagccagauucuggagguaaugggagaucaaucccuaguuccuuaugcuucagaccugcucgagaccauguuucgaaaccauaagagucaccugaaaucucagacggccgaaagcuccuggauagaucaguggcaugagaccugggugucaccacuuuuguucauccugugcgaaggcaauuuagaccaaaagagcuacgucauugacuacuaucuccccaagcugcuuucuuacuccccugagagucugcaauauauggugaaaaucuugcagacaagcaucgaugcgaagacuggccaggaacagucuuuuccaucccucgggucauguaacaguagaggagcccugggugcacuaauggcuugccugaggauugcccgggcucacggccaccuccaaagcgccaccgacacaugggagaaucuggucucggaugcacguauaaaacaggggcuuauccaucagcacugucaagugcgcauugacacuuugggacuguuaugcgaguccaacagaucuaccgaaaucguuagcauggaggaaaugcaguggauucaguucuuuaucacauacaaucucaacucacagagucccggcgugaggcaacagauauguucccugcuuaagaaacuguucugccggauccaggagucuagccagguacuauauaagcucgagcaauccaagucaaaacgagaaccggagaaugaacugaccaagcagcauccuagcgucaguuugcagcaguacaaaaacuuuaugucuuccauuuguaauagccuguucgaggccuuauuucccgguucgucauauucuacucgcuucagugcucucacgauccugggguccauugcggaaguguuucacguuccagagggcagaaucuacacaguguaccaacuuagccacgauauagacgucggaagguuccagacccugauggagugcuucacuucuaccuuugaagaugugaagauuuuggcauucgaccuccugaugaaacuaagcaagacagccguacauuuucaggauuccggcaagcugcaagggcuuuuccaggcugcccucgagcugucaaccaguacuaaaccuuaugacugugugacagcaagcuacuugcugaacuuuuuaaucuggcaggaugcccuccccucuucccugucagcuuaucuuacgcagcaaguugccugcgacaauggagaucggccagcagcggucguggaacgcaacacccugauggugauuaagugcuugauggagaaccucgaagaggaggucagucaggcugaaaauagccugcuacaggccgcagccgcuuuccccauguacgguagaguucacuguaucacuggcgcccugcagaaacuuucccucaacucucugcaauuggugucggaguggaggccugugguagaaaaguuacugcucaugagcuaucgucugucaacagucguguccccaguuauacagaguucuagcccggaggggcuuauccccauggacaccgacuccgaaucagcaucucggcugcagaugauuuugaaugagauccagccucgagauacaaacgacuacuuuaaucaagcuaaaauucuaaaggagcaugauagcuucgacaugaaagaucugaacgccaguguggucaauaucgacacuuccaccgaaauaaagggaaaggaggugaaaacgugcgauguuaccgcgcagauggugcucguauguugcuggagaagcaugaaggaagucgcccugcuuuuaggcaugcugugucagcucuugccaaugcagcccgugccugagucuucagacggucugcucacaguggagcaagucaaagaaauuggggauuauuuuaagcagcaucugcuucaguccaggcaucgcggcgcuuucgagcuggcauacacuggauuuguuaaauugaccgaagugcuaaaccggugcccaaauguaagucugcaaaagcuccccgagcagugguuauggagcgugcuggaagagaucaaguguucggacccgucuuccaaacuuugcgccacaagaaggagcgcuggcaucccuuucuacauucaggcccugcucgcaucagagccaaagaaagggcgcauggauuugcugaagaucacuaugaaagaacucauuagucuggcgggacccaccgacgauauacagucuacggucccucaagugcacgcccuuaacauccuacgagcucuguuucgggacacacguuugggugagaauauuauccccuauguugccgacggcgcaaaggcugccauuuuaggguucaccuccccagugugggcagucagaaacagcucaacucuacucuucagugcccugaucacaaggauauuuggagugaagcgcgcuaaagaugaacacagcaagaccaaucggaugacuggcagagaguucuuuuccagguucccugaacuuuaccccuuucugcucaaacaguuggagaccguugcgaacacaguggacucugauaugggugagccaaaucgacauccgagcauguuccugcuacugcucguccuugaacgccuguaugccuccccuauggacgggacgucaucugcauuaaguaugggccccuuuguaccauucaucaugcgguguggacacucgcccguguaccauagcagagagauggcugccagggccuugguuccuuuugugaugauugaucacaucccaaacaccauucguacucugcucuccacacugcccucuugcaccgaccaguguuuccgccagaaccauauccacggcacacuucugcaagucuuucaccucuugcaggcuuauucagauagcaagcaugggacuaauuccgacuuccagcacgaacugaccgauauaacggugugcacaaaagcaaaguuauggcuagccaagcggcagaacccuugccugguaaccagagcgguguacauugacauccucuuccuucugacuuguugcuugaauaggagugcuaaagauaaccaaccgguccuggagucucucggauuuugggaagagguucgaggcaucauuagcgguucagagcugauaaccggguucccaugggccuuuaaggugcccggacuuccucaguaucuccagucccugacacgguuggcaaucgccgcugugugggcagccgcggcuaaaaguggcgaacgcgagacuaaugucccaauuagcuucucucaacuguuagaauccgccuuucccgaggugagaucacuaacccuggaggcacuccuugaaaaguuccuggccgcugccagcgguuugggcgagaaagggguuccuccgcugcucuguaacaugggagaaaaguuucugcuuuuagcaaugaaagagaaucaucccgaaugcuucuguaagauccugaagauucuccacugcauggacccaggcgagugguugccucagacagagcacuguguacaucugacgcccaaagaauuucuaaucuggaccauggacauagcuucgaacgagaggucugaaauccagaguguggcccugcggcucgcguccaaggucauuagccaccauaugcagacuugcguggagaaucgagaacuuaucgccgcagagcugaaacaauggguucaguuggugauucugucaugugaggaucaccucccaacagaauccagacuggcugucguggagguauuaaccucuacuacaccucuuuuccugaccaacccccauccaauccucgaacuacaggacacgcuggccuuguggaagugcguccugacucuccuucagagcgaggaacaagcugugcgcgaugcagccaccgagacaguuaccacugccaugagucaggagaauacaugucaguccaccgaauuugcuuucugccagguggacgcgagcauagcacuggccuuggcucuggccguccucugcgauuuacugcaacagugggaccagcuugcaccggggcugccuauucuacucggauggcuguugggcgagucugaugaccugguggccuguguugaaucaaugcaccagguggaggaggauuaccucuuugaaaaagcugaggucaacuucugggcggaaacacuuaucuucgugaaguaccugugcaagcacuuauuuugucuguugaguaaauccgguuggaggcccccaagccccgagaugcucugccaucugcaacguaugguaucugaacagugucaccuacuuucgcaguucuuucgggagcugccuccagccgcagaguucgugaagacuguugaauuuaccagacucaggauccaagaggaacgcacgcuggcuugcuugcgacugcucgccuuccuugaggggaaagaaggagaggacacacuggucuuaucagugugggauagcuaugcagaguccagacagcugaccuugccccggacugaagccgcuuguuga

SEQ ID NO: 63750 - RNA, 774 nt, Artificial Sequence
  derived and/or modified sequence opt3 from THAP10__Homo_sapiens__NP_064532
augcccgccagaugcguggcugcacacuguggcaacaccacaaagagcgggaaaucccuguucagguuuccuaaggaccgggccgugcgccuccuuugggaucgauucguucguggaugcagagcggacugguacgguggcaaugauaggucugugaucuguucagaccauuuugcuccagccugcuucgauguaaguagcgugauucagaaaaaccugcgguuuucccaacgcuugagauuagucgcaggggccgugccgacucugcacaggguucccgcuccugcaccaaagcggggagaggaaggcgaccaggccggucgccuagauacgcgaggggagcuccaggcugccagacauucugaagcggcacccggaccugugucguguaccaggccacgggccggcaaacaggcugccgcaucacaaauaacaugcgagaaugaacugguccagacucagccccacgcugacaacccuagcaauaccgugacaaguguaccaacccauugugaggagggcccgguucacaaguccacucagaucucucuuaagcguccccgccacagaagcguggggauucaagccaaagucaaggcguucggaaaaaggcugugcaacgccacaacccagacggaagaguuguggucccggacuucaagucucuuugauaucuauagcucugacuccgaaaccgauacagacugggauauuaagucagagcagagcgaccugaguuacauggcaguccaggugaaagaggaaacuuguuga

SEQ ID NO: 63751 - RNA, 945 nt, Artificial Sequence
  derived and/or modified sequence opt3 from THAP11__Homo_sapiens__NP_065190
augcccggcuuuaccugcugugugccugggugcuacaacaauagccacagagacaaggcccugcauuucuauacauucccaaaagaugcugagcucaggcggcuuuggcugaagaacgucucccgcgcaggaguuucugguuguuuuucaacuuuccagccgacgaccggccaccgauugugcagugugcauuuucaagggggacguaaaacauacacuguaagagugcccaccaucuucccuuuaaggggcgucaaugaacggaagguggcccgcagaccagcgggugcugccgcagccaggcggcgccagcagcagcaacagcagcagcaacagcagcagcaacagcagcaacagcagcagcaacagcagcagcaacagcagcagcaacagcagagcucccccucugcuucgacagcacagaccgcccaacugcagccuaaccuaguuucagcuagcgccgcggugcuccugacucuucaggcaacagucgacaguucccaagccccagggucugugcagcccgcuccuauuaccccaacgggagaggauguaaaaccgauagaccugacuguucagguggaauuugccgcagcugagggcgccgcggccgcagcugccgcuagcgaauugcaggccgcaaccgccggccucgaggcugcggagugucccauggggccucaacuggucguggugggagaagaggguuucccagauacaggcuccgaccacucauauagucugagcucugggacuaccgaagaggagcucuuacgaaagcugaaugaacagagagauauccuugcauugauggaggucaagaugaaagaaaugaagggauccauuaggcaucugcggcuaacagaggccaaacuccgugaggaacugcgcgagaaggacagacuucuggcuauggccguuaucaggaaaaagcacggcauguga

SEQ ID NO: 63752 - RNA, 642 nt, Artificial Sequence
  derived and/or modified sequence opt3 from THAP1__Homo_sapiens__NP_060575
auggugcagagcugcuccgccuacggcuguaagaacagauaugacaaagauaagcccgucucuuuccacaaauuuccucugaccaggccaucacucugcaaggagugggaagcugcaguucggcgcaaaaauuucaagccgacaaaguacaguagcaucuguuccgagcauuuuacucccgacugcuucaaacgagaauguaacaauaaguugcugaaagagaacgccgugccuacgauuuuucuuugcaccgaaccacacgauaagaaagaggacuuacuggagccccaagaacagcuaccuccacccccucucccaccgcccguaucucagguggaugcggcuauagggcugcuuaugccuccacugcagacacccgucaauuugucgguguucugugaccauaacuauacuguugaggauaccaugcaccaacguaagagaauccaucagcucgaacaacagguggagaagcugaggaaaaagcugaaaacagcccagcagcggugccgcagacaggagaggcagcucgaaaaguuaaaagaggucgugcacuuucaaaaggaaaaagacgauguaucagagcggggauacguuauucugccuaaugacuauuucgaaaucguggaggucccagcauga

SEQ ID NO: 63753 - RNA, 687 nt, Artificial Sequence
  derived and/or modified sequence opt3 from THAP2__Homo_sapiens__NP_113623
augcccaccaacugcgccgcugcaggcugugccacaacuuacaauaagcacaucaacauuagcuuccauagauuuccucuggacccaaaaaggcggaaggagugggugcgccucguccgacguaaaaauuucguuccggggaagcacacguuucuuugcuccaaacauuucgaagcgucuuguuuugaucugaccggacagacaagaagguugaagauggacgcugugcccacuauauucgauuuuugcacccacaucaagucaaugaaauuaaagagucggaaccugcucaaaaagaauaacagcuguuccccugccgguccaucuaaucuaaaaucgaacauuucaagccaacagguacugcuugagcauaguuaugcauuccgcaaucccauggaagccaagaagagaaucauuaaacuggagaaggaaaucgcuuccuugaggcggaaaaugaagacaugccuccagaaagagcgccgagcaaccagaagguggauaaaggccacuugucuggugaaaaaccuggaggcuaauucuguccucccuaagggcacaagcgaacacauguuaccaaccgcccuguccucacuucccuuggaggacuuuaagauccuggaacaggaucaacaggacaaaacgcuacucagucugaaccuuaagcagacuaaaagcaccuucauuuga

SEQ ID NO: 63754 - RNA, 669 nt, Artificial Sequence
  derived and/or modified sequence opt3 from THAP6__Homo_sapiens__NP_653322
auggugaagugcuguagcgccaucggcugcgcuuccagaugucugcccaacucuaaacucaaggggcuuaccuuccacgucuuuccuacagacgagaauauuaaaaggaaguggguucuggcaaugaaacgguuggaugugaacgccgcgggaauaugggaaccaaagaagggugacguauuaugcucacgccauuucaaaaagacugauuuugaccgaagugcuccgaauaucaaacugaagcccggcgugauuccuagcaucuucgauuccccauaccaccuacaggggaaacgugagaagcuccauuguagaaagaacuuuacgcugaaaaccguccccgccacaaauuauaaccaccaucuugugggagcaucuucgugcauugaagaguuccaaucacaguuuaucuucgaacacagcuacaguguuauggacuccccuaagaaacugaagcacaaauuggaucaugugauaggcgagcucgaggacacuaaggaaucucugaggaauguccuggaucgggagaaacgcuuucaaaagagccucagaaagaccaucagggaauuaaaagacgagugucugauuucccaggagacagccaaccggcuugauaccuucugcugggacuguugccaggaaucaaucgagcaggauuauauuaguuga

SEQ ID NO: 63755 - RNA, 1728 nt, Artificial Sequence
  derived and/or modified sequence opt3 from THBD__Homo_sapiens__NP_000352
augcugggcgugcucguccuuggggcccuggcuuuggcaggauuagguuuccccgccccugcggagccacagccgggcgggagccaaugcguugaacacgacuguuuugcucuguaccccggaccugccaccuuccuaaacgcaucccagaucugcgauggccucagaggucaucugaugacagugaggucuucaguagccgcugacgugauuagucuucuguugaauggggauggaggcgucggccggcgccgacucuggauagggcugcagcugccacccggauguggugacccuaagcgucucggcccauuaagaggguuucagugggugacuggagauaacaauacgagcuauuccaggugggcacggcuggaccuuaacggcgcccccuugugcgguccucuguguguugcugugucugccgcggaggcaaccgucccaucggaaccgaucugggaggaacaacagugcgaggugaaagccgauggguuccuaugugaguuucacuuccccgcuacaugccgcccucucgccguagaaccaggagcagcugccgcggccguuucaauuacuuacggcacccccuuugcagcuagaggcgccgacuuccaggcucugccuguggggagcagugccgcagucgccccacuuggacugcaguugauguguacagcucccccgggugcggugcaaggccauugggcaagggaggccccuggggcuugggauugcuccguggaaaauggaggcugugagcacgccugcaacgcaauccccggugccccacggugccaguguccugcuggggccgcacuccaggcggacggccgcucuugcaccgcuagcgccacucaguccuguaaugaucugugcgagcauuuuuguguccccaacccagaccaacccggaucauauaguugcaugugugaaacaggcuaccgauuagcagccgaucagcacagaugcgaggacguugacgauuguauucuggaaccuagcccaugcccgcagaggugugugaauacccaagggggauucgagugccacugcuaucccaacuacgaccucguagauggugaauguguggagccugucgacccaugcuuucgggcuaauugugaguaucagugccagccccuuaaccagacgucuuaccugugugugugcgccgaaggcuucgcaccuaucccacaugagccccaccguugucaaauguuuugcaaucagacugcuuguccggccgauugcgacccuaacacccaggcguccugugaaugcccagagggguacauauuggaugacggauucaucugcacagauauugacgaaugugagaauggcgguuucugcucagggguuugucauaaccuacccggcacuuuugagugcaucuguggaccugauagcgcccuggcucgccacauuggcaccgacugcgacagugggaagguggauggaggugacucuggcuccggggaacccccaccuagccccacaccaggaucgacccucacgccgccugcagucggccuggugcacucuggucuucugaucgggauauccauugccucauugugucucguaguugcucuguuagcccugcuaugccaucucaggaaaaagcagggcgcagcgagagccaaaauggaguauaagugugcugcccccaguaaggaagugguccugcaacacgugcggacugagcgaacaccacagcgccuuuga

SEQ ID NO: 63756 - RNA, 3513 nt, Artificial Sequence
  derived and/or modified sequence opt3 from THBS1__Homo_sapiens__NP_003237
augggccuggccugggggcucggagugcuuuuccugaugcacgucugcgguaccaacagaauccccgagagcggcggggacaauuccguuuuugauauuuucgaauugacaggagcugcaaggaagggcucuggucggcgcuuagugaaagggccugacccaucaaguccggccuuucgaauagaggaugcgaaccugauucccccuguaccagacgauaaguuccaggaccuaguggaugcuguccgugccgaaaaaggauuucuccugcuugcaagccugagacaaaugaagaaaacuaggggcacguugcucgcccuggagcggaaggaccauuccggccagguguucucuguugugucgaaugggaaggcuggaacccuggaucucucauuaacaguccaggguaaacagcacgugguaagcguugaagaggcacugcuugccacuggccaauggaagaguaucaccuuguuugugcaggaggaccgcgcucagcuguacaucgauugugaaaagauggagaacgccgaacuagacguccccauucaguccguguucacaagagaucucgcgucuaucgcaaggcugcggauagccaaagggggagugaaugacaacuuucaaggcguccuucagaauguucgcuucguguuugguaccacuccugaggacauccugcgaaacaaagggugcagcuccucaacaaguguauugcucacccuggauaauaacguggucaauggaagcucuccagcuauuagaacgaacuauaucggccauaagacuaaggacuuacaggccauuuguggcaucuccugcgaugagcugucaagcauggugcucgaacuuagggggcugcggaccauaguuacaacuuugcaggacaguauucguaaagugaccgaggaaaauaaggagcuagcaaacgaacugcgcagacccccucucuguuaccacaauggaguccaauauaggaacaacgaggaguggacaguggauucuugcaccgaaugucauugccaaaauuccguaacgaucuguaaaaagguuagcugcccaauuaugccguguucgaacgcuacugugcccgacggugagugcugcccucgguguuggccaucugauuccgccgacgauggcuggucacccuggagugaauggacaagcugcuccaccucuugugggaauggaauccagcagcgaggccgcagcugcgacucacugaacaauagaugugaggguaguuccguccagacuaggacaugccacauccaggaaugugauaaacgguucaagcaggacgggggcuggagccacuggucuccuuggucaaguugcagcgugaccuguggagacggcgucauuacgcgcauaagacuuugcaacuccccaucuccccaaaugaaugggaaaccgugugagggagaggcgagggaaaccaaggccugcaagaaagaugcaugcccuaucaacgguggcugggggcccuggucgccaugggacauuuguagcgugacaugcggaggcgguguucagaagcguucccggcuguguaauaacccuacuccccaguuugggggcaaagauugcgugggagacguaaccgagaaucagaucuguaacaagcaagauugcccaauagacggcuguuugucaaaucccugcuucgcuggggucaaauguacaaguuacccugauggaucuuggaagugcggugccuguccaccgggcuauagcgggaacgggauucagugcacugacguggaugaaugcaaggagguucccgacgcuuguuucaaucauaacggcgaacaccgaugcgagaacaccgauccugguuacaauugucucccaugucccccuagauuuacagggucccagccauucggccagggaguggagcaugccaccgcaaacaaacaagucugcaagcccaggaauccgugcacugacggcacgcacgauuguaacaaaaaugccaagugcaacuaucuggggcacuacucagacccuauguaccgcugugaaugcaaaccaggauaugcuggcaaugguaucaucuguggggaggacacagauuuagacggauggcccaacgaaaaucuggugugcguagcgaacgcaaccuaccauugcaagaaggauaauuguccuaaccuacccaauagcggccaggaggacuaugauaaagacgguauuggcgaugccugcgacgaugacgaugacaacgauaagaucccagacgaccgggauaauuguccuuuucacuacaaccccgcucaguaugacuacgauagagacgaugugggggacaggugcgauaacuguccauauaaucauaacccggaccaggccgauacugacaauaacggagagggcgaugcaugcgccgcugacauugacggggauggaauacucaaugaacgcgacaacugucaauacguuuacaaugucgaucagcgagacaccgauauggacggcgugggugaucagugcgacaacuguccucuggagcacaaucccgaucaacuugacucugauuccgaccggaucggggauacaugcgacaacaaucaggacauugaugaagacggacaucagaacaauuuggauaacuguccauaugugcccaaugccaaccaggcagaccacgauaaagacggcaagggugaugcgugcgaccacgaugacgauaacgacggcaucccugaugacaaagacaauugccgucuggucccaaaccccgaucaaaaggacagugauggggacggaagaggcgaugcuuguaaggacgauuucgaccaugauagcguuccugacaucgaugacauuugcccggagaauguggacauaucugaaaccgauuuuaggcgcuuccagaugaucccacucgaccccaaagggacuucccagaacgauccuaauugggugguacggcaccagggaaaggagcugguccaaacagugaacugugacccaggccuugccguugguuacgaugaguuuaaugcaguggacuucucagggacguuuuucauuaacaccgaaagagaugacgauuaugccggauuugucuucggcuaccagaguagcucgagguuuuaugugguuauguggaaacaggugacucaguccuacugggacacaaaucccacccgagcucaagguuauucuggccugagcguaaaggucgugaacucaacaacugggccuggagagcauuugcgcaaugcccucuggcacaccggcaacacgccgggacaggugcggacccuguggcacgaucccagacauaucggauggaaagacuucacagcauacagguggcguuuaagucaccgcccaaagacuggcuucauucgggucguuauguacgaagguaaaaagaucauggcugauuccgggccuauauaugacaagaccuacgccggaggcagacugggccuauuuguguucucucaggagaugguauuuuucagcgaccucaaauaugaaugcagggaucccuga

SEQ ID NO: 63757 - RNA, 3519 nt, Artificial Sequence
  derived and/or modified sequence opt3 from THBS2__Homo_sapiens__NP_003238
augguguggagacugguccuccuugcccuguggguuuggcccagcacccaggcuggccaccaagacaaggauacaacuuucgacuuguuuuccaucucuaacauuaauaggaaaacgauaggggcaaagcaguuccggggaccugauccaggugugccggccuaccgcuuuguacgauucgacuauaucccaccugugaacgcggaugacuuaucaaaaauuaccaagaucaugcgucagaaagagggcuuuuuccugacagcucagcuaaagcaagaugggaagaguagaggaacucuccuggcccuugaaggcccaggucugagccagaggcaguuugagauugucuccaaugggcccgcagacaccuuggaucucacauacuggaucgacggaacccggcaugugguuucucuggaagaugugggccuggccgacucgcaguggaaaaacgucacugugcaaguagcuggcgagacauauucacuccacguugggugcgauuuaauagacagcuucgcacuggacgaaccuuuuuacgagcaucuucaggccgagaagagucgcauguauguggcuaaaggauccgccagagaaucucacuucagggguuugcugcagaauguccaucuaguguuugagaacagcguggaagauauccucuccaagaaaggcugucagcaagggcagggagcggagauuaaugcaaucucagagaacaccgaaacgcugcggcuuggcccacacgucacuaccgaguacguuggucccaguagcgaacgccgaccugaggugugcgaaagaucuugugaggagcuggggaauaugguacaggaauuguccggacuccacgugcuggucaaccaauuaucagagaaucugaagagggugagcaacgacaaucaguuccucugggaacuuauuggcggcccaccgaagacacggaacaugagugccugcuggcaggaugggcgcuuuuucgcugagaaugaaacuuggguuguggacucuuguaccacaugcaccuguaaaaaguucaaaacgaucugccaucagauaacuugucccccugccacaugcgcaucccccagcuuugucgagggagaguguugccccucgugccugcacucuguggauggugaagagggcugguccccuugggcugaauggacccaauguucaguaacuugcgggaguggaacacagcagcguggcagaagcugugacguuaccuccaacacgugcuuggguccaucuauucagaccagggccuguagccuaucaaagugcgauacacggauccgacaagacgggggcuggagucauuggucccccuggagcucuuguucagugacuugcggagucggcaacauuacccgcaucagacuguguaauaguccggugccucagaugggagggaaaaacugcaaggguagcggcagggagacaaaagcgugucagggggcccccugcccaaucgauggacggugguccccuuggucucccuggucggcaugcacugucaccugugcuggcgguauucgcgaaagaacaagggugugcaauagcccagagccccaguaugggggcaaggccuguguuggagacgugcaagagcgucagaugugcaacaagcgguccuguccuguagauggcugccucucaaauccauguuucccgggggcucagugcaguucuuuucccgacggaagcugguccugugguucaugcccugucggcuuccuggggaacggaacccacugugaagaccuugaugagugcgcccuggugccagacauaugcuuuagcacuucuaaaguuccccgaugugugaauacgcagccuggcuuccacugcuugccaugucccccgagauacagggguaaccaaccugucggggugggccucgaagcagccaagacagagaaacagguaugcgagccagaaaaucccuguaaggauaaaacccauaacugccacaagcaugcugaguguaucuaccugggacacuuuuccgacccuauguauaagugcgaaugucagacuggcuacgcgggggauggauuaauuugcggcgaggacagugaucuggacgguuggcccaaucuaaaccucgugugugcaaccaaugccacauaucauugcaucaaagauaacugcccacaucugccuaauagcgggcaagaagacuucgauaaggacggaauaggcgaugcuugugacgacgaugacgauaacgacgguguuaccgaugagaaagacaacugccagcuuuuguuuaauccccgccaggccgauuacgacaaggaugaggucggcgaccggugugauaacugcccauaugugcacaauccggcacagauugacacugauaacaauggggaaggagacgccuguucuguggacaucgauggcgacgaugucuucaacgagagagacaauugcccuuacguuuauaacacagaucaaagggacacggauggggacggagugggcgaucacugugacaauugcccccuggugcacaacccagaucagaccgacguagacaaugaucucgucggugaccagugugauaacaaugaagacaucgaugacgaugggcaucagaacaaucaagacaacugccccuacauuuccaacgcuaaucaggccgaucacgaccgcgauggacagggcgacgcaugugauccugacgacgauaacgacggugugccagaugaccgagauaauugccggcugguuuuuaaccccgaccaggaggaucuugacggcgaugggcguggagacaucugcaaagaugacuucgauaaugacaacauuccugacauagaugacguguguccggaaaauaacgcgaucucagagacugauuuuagaaauuuccaaauggucccacuggaccccaagggcacaacccagauugauccuaacugggugaucaggcaccaggggaaggaguugguucaaacagcuaauagugacccaggaaucgccgugggcuucgaugaauuugguagcguagacuucucggggacuuuuuacgucaacaccgaucgcgacgaugacuaugcaggauucguguuuggcuaccaguccucuagccgguucuauguggucauguggaaacagguuacgcagaccuacugggaggaccaacccacaagagccuaugguuacucaggcgugagucucaagguagugaacuccacuaccgggacaggagaacaucugaggaaugcuuuauggcacacuggcaauaccccugggcagguccgaacgcuguggcaugauccgcgcaacauuggauggaaagacuauacagccuaccgguggcaccuaacccauagacccaagacuggcuacauaagggugcucguucacgaggguaaacaggugauggcagauucugggccaaucuaugaccagacauacgcuggaggccgucugggccuuuuugucuucagccaagaaaugguguauuuuuccgauuugaaguacgagugccgcgacauuuga

SEQ ID NO: 63758 - RNA, 2511 nt, Artificial Sequence
  derived and/or modified sequence opt3 from THBS3__Homo_sapiens__NP_001239537
auggagacccaggaacugagaggcgcccucgcucuccuguuguuaugcuucuuuacaagcgcaucccaagaccuucaggugaucgaucuacucacugucggggagucuaggcagaugguugccguggcggaaaagauucggacggcucugcuuaccgccggagacauauaccuguugucaacauuccgccuucccccuaaacaggguggcguacuguuugggcuguauagucgacaagauaacacucguuggcucgaggcaagcguggucggaaagaucaauaaagugaccaacgccuuacacuccauucugggcgaacagacaaaggcucuuguuacccaguugacucuguucaaucagauccuaguggagcucagagacgauauuagggaccaagucaaagagaugucucugauccggaacacaauaauggaaugucaggugugcgguuuucaugagcagcgcucgcacuguucaccaaauccgugcuucagagggguagauuguauggaaguuuacgaguaucccggauacaggugcggcccuuguccacccggccuucaggggaacggaacccauugcagcgacaucaaugagugugcacacgccgauccuugcuuuccagguaguuccuguauuaacacgaugcccggcuuccauugcgaggcuugcccucggggguauaagggaacucaagugucuggcgucgguaucgacuacgcccgcgcgagcaaacagguguguaaugauauugacgaaugcaacgaugggaauaacggaggcugugacccaaauuccaucugcaccaacacagugggcucauuuaagugugggccgugccgacugggauucuuggguaaucagagucaaggcugucuccccgcaagaacuugccacagcccugcccacucuccaugucauauacacgcucauugccuguuugaaaggaacggggccgucuccugucagugcaacguuggaugggcaggcaaugguaacgugugcgggaccgacacagauauugacggcuaucccgaucaggcuuuaccuuguauggacaauaacaagcacugcaaacaggauaauugucugcucaccccaaacucaggacaagaggacgccgauaaugacggcguaggggaucagugcgacgaugacgcggacggagaugguaucaagaacguggaagacaauugucggcuuuuccccaacaaagaucagcagaauagcgacacggauaguuuuggcgacgccugcgauaacuguccgaaugucccuaacaaugaccaaaaggauacugacgggaacggagagggcgaugcaugcgacaacgauguggacggugacgggauucccaauggccuggauaacuguccaaagguuccuaaucccuugcagacagaccgugaugaggacggagugggcgaugcuugcgacucuuguccagaaauguccaaccccacccagacugaugccgacagcgaucuagucggggacgugugcgauacaaaugaggacucggauggagacggucaccaggacaccaaagauaacugcccucaacugccaaauucuucccagcucgacucagauaacgacggccugggggaugaaugugacggagaugacgauaaugacggcaucccggauuacguacccccugguccagacaacugccgccuuguucccaauccuaaccagaaggacagugaugggaauggcgugggagacgucugugaggaugacuucgauaacgacgcuguggucgauccacuggacgugugccccgaaagcgccgagguuacguugaccgauuucagagcauaccagacagugguacucgacccggagggcgaugcccaaaucgacccuaauugggucgugcugaaccaggggauggaaauuguucagacuaugaacuccgauccaggauuagcugugggcuauaccgcguuuaauggugucgacuucgaggggacauuucaugugaacacuguaaccgacgaugacuacgcaggauuccuguuuucuuaucaagauagcggcagguucuacgugguuauguggaaacagacagaacagaccuauuggcaggccacucccuuucgggcugucgcccaaccuggucuacagcucaaggcagugacgucagugaguggccccggggagcaucugcgaaaugcccuuuggcacacaggacacaccccagaccagguccgcuugcuguggacugauccuagaaacguuggcuggagggacaaaaccuccuaccgguggcagcuccugcaucgcccccaagugggguauauaagagugaagcuguacgaaggaccacagcugguagcugauagcggcgucaucauugacacaucuaugaggggugggcguuugggaguguucuguuuuucacaggagaauaucauauggaguaaccuccaguaccggugcaaugauaccguuccggaggacuucgaaccuuuucgaagacaacuguuacagggcaggguguga

SEQ ID NO: 63759 - RNA, 2886 nt, Artificial Sequence
  derived and/or modified sequence opt3 from THBS4__Homo_sapiens__NP_003239
augcuggcccccagaggcgcugcagugcuccuucugcacuuggucuuacagagguggcuggccgcgggggcucaagccaccccucagguuuucgaccuacucccaagcuccucucagcggcugaacccgggagcacuucugcccguguugacagauccugcccucaaugaccuguacguaaucucaacuuuuaagcugcagacgaaaaguagcgcuaccauuuucggucucuauuccucuacagauaacucgaaguacuuugaguucacugugaugggccgcuuaaauaaagcaauacugcgauaucuuaagaacgacgggaaaguccauuuggugguuuuuaauaaccugcaacuagccgauggacguagacacaggauccuccugcggcuuucaaaucugcagcgcggcgcugguagcuuggaacucuaccuggacugcauucagguggauaguguccauaacuuaccaagagccuucgcggggcccucccagaagccugagaccaucgaacugaggacauuucaacggaagccacaggacuuccucgaggaacuuaaacuggugguacgcggaucuuuguuucagguugcaagccuacaggauuguuuccugcaacaguccgagccccucgccgcuaccggcacuggcgacuuuaaucgacaguuccuggggcaaaugacacagcuuaaccagcuguugggagaggugaaggaucuccugagacagcaagucaaagaaaccucauuuuuaaggaauacgauugccgagugccaggcaugugguccucugaaguuccagaguccaacuccgagcaccguggugcccccugcuccacccgccccuccaacacggcccccgcgucgcugcgacucuaacccuuguuucagaggcguccagugcacugauuccagggacggguuucaauguggacccugcccagaaggcuauaccgguaaugggaucacauguauagacguugaugagugcaaauaccacccuuguuaucccggagugcauugcaucaaccuaucaccaggcuuccggugcgacgcgugucccguaggcuuuaccgggccuauggugcagggagucgguauuagcuucgccaagaguaauaaacaggugugcacggauaucgacgagugucgaaacggcgcaugcguuccaaacucuauuugugugaauacucucggguccuaccgcugcggaccguguaagcccggcuacacaggugaucagaucagagggugcaaggcugaaaggaacugucggaauccugagcugaacccaugcagcgucaaugcccaauguauagaagaacgccagggcgacgugaccugcguaugcggaguuggcugggcuggggauggauauauuugugguaaagacguggauaucgacucguaccccgaugaggagcuuccuugcucugccagaaacuguaagaaagacaauugcaaguaugucccaaacuccggccaggaggacgcagauagggacgggauuggagaugccugugacgaagaugcugacggcgaugguaucuugaaugagcaggacaacugcgugcugauccacaaugucgaucaacguaacucagacaaagauauuuuuggggacgcgugugauaauugccucagugugcugaacaaugaccagaaggacacugauggcgacggacggggcgaugcaugugacgaugacauggauggggacggaauaaagaacauccuugauaacugccccaaauucccgaaucgagaccagagagauaaggacggugauggcguuggggacgccugugacagcugcccugauguguccaacccaaaucaaucugacguagauaacgaccuggucggagauagcugcgacacaaaucaggauucagacggcgauggucaccaggacaguaccgauaacugucccacggugauuaauuccgcucaguuggacaccgacaaagaugggaucggcgacgaaugcgaugacgaugacgauaacgacggaauaccugaucucguucccccaggcccugacaauuguaggcuggugcccaacccagcccaagaggauagcaauucugacggggucggagauauuugcgaaucagacuuugaccaggaucaggugaucgaccgcaucgauguauguccggagaacgcagaggugacauuaacugacuuccgggccuaccagaccguuguccuggauccugaaggcgacgcucaaauugaucccaauuggguggugcuaaaccaggguauggagaucguccagacaaugaauagugacccagggcucgccguuggauauacugcauuuaacggcguggauuucgaagguaccuuucaugugaacacacagaccgacgaugacuacgcgggcuucauuuuuggguaucaagauagcuccucuuucuacguagucauguggaagcagacugagcagacguacuggcaagcuacacccuucagagccguggcagaaccuggaauacagcugaaagccguuaagucgaagaccggcccaggggagcaccuuaggaauagcuuguggcauacuggagacaccuccgaccaggugcgccugcucuggaaagauucacgaaacgucggcuggaaggacaaagugaguuaucggugguuucugcagcaccguccccaaguugguuacaucagagugagguucuaugaggggucugaauuaguagcugauagcggagucacaauugacaccacuaugcgcggcggucggcugggcguguuuugcuucucccaggagaauaucaucuggucaaaccuuaaguacagauguaaugauacaauuccugaagacuuucaggaguuccagacgcaaaacuuugauagguucgacaauuga

SEQ ID NO: 63760 - RNA, 1140 nt, Artificial Sequence
  derived and/or modified sequence opt3 from THEG__Homo_sapiens__NP_057669
augggcgacagcagaaggcggucccuggggaaccagcccucuucagaggccgcuggacgcagugaacgagagcaagauggugacccucguggccuccagagcuccguguacgaaucuagaagggucaccgauccagagcggcaggaccuugauaaugcagaacuggggccggaggaccccgaggaagaguugccuccagaagagguugccggagaggaguuccccgaaacauuagauccuaaggaagcgcugucggagcuagaacgcgugcucgacaaagaucuggaggaggacaucccagaaauuucaagacuuagcauaagucagaagcugcccuccacuacgaugaccaaagcuaggaagcggcgccgaagaaggcgguugauggagcucgccgaaccuaaaaucaacuggcaaguacugaaggaucguaagggccgcugcgguaaaggguaugcauggauuucuccauguaagaugagccugcacuuuugccucuguuggccguccguguacuggacagagagauucuuagaagacacuacccugacaaucaccguccccgccgugucaaggcggguugaggagcuuagucgaccuaaacgcuuuuauuuggaauacuauaauaacaauagaacuacaccaguguggcccauuccuaggagcucucuggaguaccgggcuuccucacgccuaaaggaacucgcagccccaaaaaucagagauaacuucuggagcaugcccaugagugaggucucucagguguccagggcugcccagauggcgguaccgagcucgcguauacugcagcuuucuaagccuaaggcacccgccacccuguuggaagagugggacccaguuccuaaacccaagccacauguguccgaccacaaucggcuccugcauuuagcucgacccaaagcccaaucagauaagugcgucccugacagagauccaaggugggaggugcuggacgugacgaaaaaggucguugcaaguccgcgcaucauuagccucgcuaaacccaaggugcggaagggacuuaacgaaggcuaugauagaaggccucuggccuccaugucuuugccacccccuaaagcgagcccagagaagugugaccagccccgcccgggccuauga

SEQ ID NO: 63761 - RNA, 723 nt, Artificial Sequence
  derived and/or modified sequence opt3 from THEM4__Homo_sapiens__NP_444283
augcugagaagcugcgccgcuaggcuccggacccuuggcgcacuguguuugcccccuguggggcgccgauuaccaggauccgagccgcgucccgaacugagaucuuucucaagugaggaagucauccuaaaggacugcagcguuccuaacccauccuggaauaaagaucucaggcugcuuuuugaccaguucaugaagaaaugugaggaugguucuuggaagcggcugcccucguacaaacgcacaccuacugaauggauucaagacuuuaagacgcacuucuuggauccaaagcucaugaaagaggagcagaugucacaggcccagcuguuuaccaggagcuucgacgauggccugggguuugaauaugugauguucuacaacgacauagagaagagaaugguaugccucuuucaaggaggccccuauuuagaagguccuccaggguucauccauggaggcgcgauugcuacaaugaucgaugccacugugggcaugugugcaaugauggccgggggaauugucaugaccgcuaaucugaacaucaauuacaaacggccgauaccccuuugcagugugguuaugaucaacucccaguuggacaagguggagggucgcaaauuuuucgucucuuguaaugugcagagcguagaugagaagacacuguauuccgaagcaaccucacuauuuauuaagcucaacccugccaaaagucugacuuga

SEQ ID NO: 63762 - RNA, 744 nt, Artificial Sequence
  derived and/or modified sequence opt3 from THEM5__Homo_sapiens__NP_872384
augaucagaaggugcuuccagguggccgcucggcugggccaccaucgcgggcuccuugaggcaccccguauucugccucgauugaacccagccagcgcguuuggauccucuaccgacucaauguucaguagauuuuuaccggaaaagacagaucugaaagacuacgcucuacccaaugccagcugguguuccgauaugcucucucuguaucaagaguuccuugaaaagacuaaaucgucagguuggauaaagcugccuagcuuuaaaaguaacagggaccacauccggggcuugaagcucccauccgggcuggcagucucuagcgauaagggagacugccgcauuuucacgagauguauccagguugagggccaggguuuugaauacgugauuuucuuucagcccacccagaaaaaguccguaugccuguuccaaccugggucauaucucgagggaccacccggcuuugcccauggcgggaguuuagcugcaaugauggaugagacauucagcaaaacugccuuucuggcuggagaaggucuuuucaccuugucucugaauaucagguucaagaaccuaauaccuguggacucccucgucgugauggauguugagguggacaaaaucgaagaucagaagcuguacaugucauguauugcccacagccgggaccagcaaacagucuaugcgaagaguucuggcguguuucuucagcugcaguuggaggaggaauccccacaguga

SEQ ID NO: 63763 - RNA, 627 nt, Artificial Sequence
  derived and/or modified sequence opt3 from THEM6__Homo_sapiens__NP_057731
augcugggccuccuuguggcccuguuggcuuuagggcuggcagucuucgcccuacucgacguuugguaccuggugagacuucccugcgcgguacugagggcucgguugcuccagccucgcgugcgagaucugcuggccgagcaacguuuuccaggaagaguccucccgagcgacuuagaucugcuuuugcacaugaacaaugcaagguaucugcgggaagccgacuucgcucgcguggcacaucuaaccagaugugguguucucggcgcccugagggagcuucgggcucacacagugcuggccgcguccugcgcacgccaucgaagaucuuugaggcuccuggaacccuuugagguccggacucguuuacuggggugggaugaccgcgccuucuaccucgaagcuagauuugugucacuuagggauggauucguaugugcccuguugcgguuucgacagcaccuacugggcacgaguccugagcgcguugugcagcaucucugccagagaagggucgagccacccgaacugccugcagaccuucaacacuggaucagcuauaacgaggcuuccucucagcuguugcggauggaaucgggucucucagaugugaccaaggaccaguga

SEQ ID NO: 63764 - RNA, 1791 nt, Artificial Sequence
  derived and/or modified sequence opt3 from THEMIS2__Homo_sapiens__XP_011540747
auggagcccgugccucugcaggacuucgucagagcccucgauccagcuagccuuccgaggguucugcgggugugcuccggcguauacuuugaaggguauuucacccccuugaacacaccucaaucuuacgagacuuuagaagaacuggugucagcaacgacccagaguagcaagcagcuaccaacauguuuuauguccacucaccgcaucgucaccgaaggacgagugguuacagaggaccagcuccugaugcuugaggccguggucaugcaucuggguauucguucugcgagaugcguguugggcauggaagggcaacagguaauacuccaucugccccugucgcagaaaggaccuuucuggaccugggagccaucagcucccaggacucucuuacagguucugcaagauccugcccuuaaggacuuggugcugacauguccaacccuaccguggcacagccucauccugcggccccaguaugaaauucaggcaaucaugcacaugcgcagaacgauugucaaaaucccuaguacucuugagguggauguggaggacgucaccgccuccucuaggcauguucacuuuauaaagccacuguugcucagcgaagugcuggcuugggagggccccuucccuuuauccauggaaauccuggagguaccagaaggucggcccauuuuucucucaccguggguggggagucuucagaaaggacaacgccugugcgucuacggcuuggcaagcccucccuggcgagugcuagccucuuccaagggcagaaagguuccaaggcacuuccuggugucagggggauaucaggguaaacuccggcgucgcccuagagaguuucccacagcuuacgaucugcuuggcgccuuccagccagggaggccccugcgggucguggcgacuaaggacugugagggagaacgagaggaaaauccugaguuuaccagcuuggcaguaggcgaucgccucgaaguucuggguccagggcaagcccauggagcucagggcagugacguggaugucuuagugugccagagacugucugaccaggccggcgaggaugaggaagaggaauguaaagaggaagcagaguccccggagaggguccuacuccccuuccacuuuccugggagcuucguggaagagaugucggacucucggcgcuauucccuggcugaccuuacagcccaauucucauugccaugcgaaguuaaggugguagcgaaagauaccagucaucccacggacccucugacuagcuuucucggacugagacuugaggagaagaucacagaaccauuccuggucguguccuuggauucugagcccgguauguguuuugaaauuccgccuagguggcucgaccugaccguugugaaggccaaaggccagccagauuuacccgaggggagccugccuaucgcaacugucgaggagcuaacagacaccuucuacuaccgucuccggaagcugcccgcuugcgagauacaggccccaccuccccgaccaccgaaaaaccagggacuuucaaagcaaagaaggcacaguuccgaaggcggugugaaaagcucucagguauuggggcugcagcagcacgcucgccucccuaagcccaaagccaagacgcugccagaguuuauuaaggauggcucaaguaccuauagcaaaauccccgcacaucggaagggacacagaccugccaaaccacaaaggcaggacuuagaugacgaugaacaugacuacgaggaaauucuggagcaguuccagaagacaaucuga

SEQ ID NO: 63765 - RNA, 1926 nt, Artificial Sequence
  derived and/or modified sequence opt3 from THEMIS__Homo_sapiens__NP_001010923
auggcccugagccucgaggaguucgugcacucccuugaccugcggaccuugcccagggucuuagaaauccaggcuggcauuuaccuggaagggucuauauaugagauguuuggaaacgaaugcuguuucucaacaggugagguuaucaagauuacuggccuaaaagugaagaaaaucauugcagagaucugcgaacaaauagaggggugugaaagucuccagccuuuugagcugccaaugaauuucccgggacuuuuuaagaucguagccgauaaaacgcccuaccugaccauggaggaaauuacacggacuauccauauuggcccuagccgcuugggucacccaugcuucuaucaucagaaggacaucaagcucgagaaccugauaauuaaacagggggaacaaaucaugcucaauuccguggaggaaauugauggagagaucauggucucuugugcgguggcucgaaaccaccagacccauucguuuaaucugcccuuaucacaggagggcgaguucuacgaaugcgaagacgagcguaucuauacacugaaggaaauuguugaguggaaaauaccuaagaacagaaccaggacugugaaucuuacagauuuuagcaacaaaugggacaguaccaauccauuccccaaggauuuuuacggcacguugauccugaagccugucuaugagauucagggggugaugaaauuccggaaggacaucauacgcauucuaccaucccucgauguagaaguuaaagacaucacugauucuuacgacgccaacugguuucugcaacuucugagcaccgaggauuuguucgaaaugacauccaaggaguucccgaucgugacugaagucauugaggcacccgagggaaaucaccucccucagucaauccugcagccagguaaaaccauugugauacacaagaaauaccaggccaguagaaucuuagcuagcgaaauuaggucuaacuuucccaagcggcauuuccugaucccuacauccuauaagggcaaauuuaagcgccgaccaagagaguuccccaccgcauacgaccucgaaaucgccaaaucagagaaggagccgcuucacguggucgcuacgaaagccuuucauagcccucacgacaagcugaguucuguuuccgugggggaucaauucuugguacaccagagcgaaacuacagaggugcuaugugaaggaauuaagaaagucgugaauguucuggcgugcgagaagauacucaaaaagucguaugaagcagcccugcuuccccuguacauggagggcgguuuuguggaggucauccaugacaaaaagcaguauccaauuucugaauuguguaagcaauucaggcucccuuuuaacgugaaaguauccguucgggaucugucaaucgaggaagacguguuagcugccacccccgggcugcagcuagaggaagauauuacugacaguuaccuccugaucagcgauuucgcaaauccaacagagugcugggagauacccgucggacgucuuaacaugaccgugcaguuggucuccaacuuuucucgcgacgcugaaccuuuccuggugagaacgcucguugaggaaaucaccgaggaacaguauuacaugaugaggcgguacgagagcucagccagucacccaccgccccgaccuccaaagcaucccuccguggaggaaacaaaacugacucuucugaccuuggcggaggaacgcacaguagaucucccuaagagcccaaaaagacaccaugucgacauuacuaagaagcugcaccccaaucaagccggcuuagauucuaaagugcugaucggcucacagaacgaccuaguugacgaggagaaggaaaggaguaauagaggggcaaccgcuauugccgagacauuuaaaaacgaaaagcaccagaaauga

SEQ ID NO: 63766 - RNA, 897 nt, Artificial Sequence
  derived and/or modified sequence opt3 from THG1L__Homo_sapiens__NP_060342
auguggggcgccugcaaggugaaaguccacgacagccuggcuaccaucuccauuacacucagaagguaccuucggcugggggcaacuauggccaagucuaaauucgaguauguucgcgauuuugaagcggacgauacguguuuggcucauugcugggugguagugcgauuagacggacguaacuuccacagauuugccgagaagcauaauuucgcaaaacccaacgauucaagggcccugcagcuaaugaccaagugugcucaaacagucauggaggaacucgaagacauagugaucgcauacggucagagugaugaguauagcuuuguuuucaagcggaaaacuaauugguuuaagcgcagagccuccaaauucaugacccacguggcuucucaguuugccucgucauacgucuucuauuggagggacuacuuugaggaucagccucugcuuuauccaccgggcuucgacgggcgggugguaguuuaccccagcaaccaaacacugaaggauuacuugaguuggcgccaggcggacugccauauuaauaaccucuauaauaccguguuuugggcacugauccagcaguccggacugacuccuguccaagcccagggccgacuccaggguacauuagcugccgauaaaaacgaaauucuguucucugaguucaauaucaacuacaauaacgaacuuccaauguauagaaaggggaccguguugauauggcagaagguggacgaggucaugacgaaagagaucaagcugcccacugaaauggagggcaaaaagauggcaguuaccaggacacggacuaaaccugugccacuacacugugacauuaucggagaugcuuuuuggaaggaacaccccgagauucucgacgaagauagcuga

SEQ ID NO: 63767 - RNA, 1494 nt, Artificial Sequence
  derived and/or modified sequence opt3 from TH__Homo_sapiens__NP_000351
augcccaccccugacgccacaacuccacaggcuaagggcuucagaagggcagugagcgagcuggaugccaaacaagcggaagcuaucauguccccgcgguuuauugggcgccgacagucucucauagaggacgcccguaaggaaagagaggcagccgucgcugcagccgcugccgcgguucccucagaaccuggagauccacuugaggcaguggccuucgaggaaaaagaggguaaggcuguacugaacuuguuauuuagucccagggccacgaaaccuagcgcacugucccgggcugugaaggucuucgaaaccuuugaggccaagauccaccaucuagagacacgcccagcgcagagacccagggccggcgggccucaccucgaauacuucgugcggcuggagguucgccgaggagaccuugcagcucuguugucuggcgugagacaggucucggaagaugugaggucaccagccgguccgaaaguacccugguuuccucggaagguuagcgagcucgacaaaugccaucaccuggugacuaaguucgauccagaccuggaucucgaccaucccggguuuagugaucaagucuaucgucagcgcagaaaauuaauugcugaaaucgccuuccaguacaggcacggagacccuauuccacggguggaguauaccgcagaggaaaucgccacauggaaggagguguacaccacucugaagggccuuuaugcuacacacgcguguggcgaacauuuggaggcauuugcccugcuagaacgauucuccggguaccgcgaggauaauauaccccagcucgaggacgucucuagauuucugaaagaaaggaccggauuccaacuucggccgguugcuggucuguugagcgcccgcgacuuccucgcaucccuggccuuuagaguguuccagugcacgcaguauaucaggcacgcuucaaguccuaugcauagccccgagccagauuguugccacgaauuacugggccacguaccuaugcucgccgaccguacuuuugcacaguucucucaagauauugggcuugcgucccugggagcuucagacgaggaaaucgagaaguugagcacccuauacugguuuacaguggaguucggccuguguaaacagaacggugaagucaaggccuacggggcaggacuccugaguucuuauggcgagcuucugcauugcuuguccgaggaacccgagauucgggccuuugauccagaagcugccgcagugcagcccuaccaagaccagacuuaucagagcguuuacuucgugucggagucuuuuuccgaugcuaaagacaagcuccgaucauaugccaguagaauccagaggccuuucagcgucaaauuugauccauacacccuggcgauagacguguuagauuccccgcaagccguacgccggucucuggaaggcguucaggacgagcuagacacacucgcucacgcacugagcgccauuggguga

SEQ ID NO: 63768 - RNA, 2232 nt, Artificial Sequence
  derived and/or modified sequence opt3 from THNSL1__Homo_sapiens__NP_079114
augcugcacuucaacagaugccaucaccucaagaaaaucacccagaaguguuuuagcuccauucaugugaaaacagacaagcacgcccaaagguuccuuucucggacuuuugcucuggcagaguugcgcaaaucaugguacaguacgcauagcuuagucggcgauaagaauauaauccugauggggcccccuggagccgguaagaccacaguuggccgaauuaucgggcagaaacuaggaugcugugugauugacguagaugacgauauccucgaaaagacuuggaacauguccgugucugagaaacugcaggacgucggcaaugaacaguuccuugaggaagaggguaaggcggugcugaacuuuucggcuucagggagcguuauaaguuugaccggauccaauccaaugcacgaugccucuauguggcaccucaaaaagaacggcaucauuguguaucuggacgucccgcugcucgauuuaaucugccgucugaagcugaugaaaacagacagaauugugggccaaaauagcgggaccuccaugaaggauuugcugaaauucaggcggcaguacuauaagaaaugguacgacgcacgcguauuuugugagucaggagccagucccgaagagguugcugauaaggugcuaaacgcaaucaaaagauaucaggacgucgacagcgaaacuuucauaucuacaaggcauguguggccugaggauugcgagcagaagguguccgccaaguuuuucucagaagcugucauugagggucucgccagcgacggcgggcuguuuguuccagcgaaagaguuccccaaacuuaguuguggagaauggaaaucucuggugggcgcaaccuacguagaacgggcccaaaucuugcucgagcgcugcauucacccugcugauaucccagccgcacgacugggugagaugaucgaaacggcuuauggggagaauuuugccuguuccaagauugcgcccgugagacauuuaagcggaaaccaguucauacuggaacucuuccacggcccuacuggcucguuuaaagaccuuucucugcaguugaugccacacaucuucgcccauugcauuccgcccuccuguaauuacaugauccuagucgcaaccucaggggauacaggaagugcugugcugaacgguuuuagcaggcucaauaagaacgacaagcagcggauagccguuguggcuuucuuuccugagaauggcgucuccgauuuccaaaaagcccagauuaucgggucucagcgugaaaacggaugggcagugggcguagagagcgacuuugauuucugccaaacugccaucaagcgcauuuuuaacgacucagauuucaccgguuuucugacaguugaguacgggaccauccuuaguuccgcuaauagcauuaacuggggcagacuguugccacagguggucuaucacgcgucugcauaccucgaccuggugucacagggauucauaaguuuuggcagccccgucgacgugugcaucccuacggggaauuucggaaacauuuuagccgcuguuuaugccaaaaugauggguaucccaaucaggaaguucauuugugcauccaaucagaaccaugugcugacugauuuuauaaaaacaggccacuacgaccuacgggaacgaaagcucgcccaaaccuucucucccucgaucgauauucuuaagagcuccaaucuugagcgccauuugcaccugauggcuaacaaagacgggcagcucaugacugaacuguuuaauagacuugagucacagcaccauuuccagaucgaaaaggcccugguagagaaauugcaacaggauuuugucgcagacuggugcagugagggagaaugucucgcggcuauuaacucuacauauaauaccagcggcuacauccuggauccgcacacggccguggcaaagguuguggccgacaggguccaggauaaaaccugcccugugauaaucuccucaacagcucauuauagcaaguucgcccccgcaauuaugcaggcuuuaaagaucaaagagauuaacgaaacuucuuccagucaacuguaccuacucgguagcuacaaugcccugccaccucuucacgaggcguugcuggagcggaccaagcagcaggaaaagauggaguaucagguaugugccgcugacaugaacgugcucaagucucacguugaacaacugguccagaaucaguuuaucuga

SEQ ID NO: 63769 - RNA, 1218 nt, Artificial Sequence
  derived and/or modified sequence opt3 from THNSL2__Homo_sapiens__NP_001231605
augugguacgugagcaccagaggcgucgcccccaggguuaacuucgagggggcucuguuuuccggauaugcaccugacgguggccucuucaugccagaggaacuuccgcagcuggaucgggggacauugugccaauggucuacuuuaucauaccccggacuggugaaggaacuaugugcccucuuuaucggcagugagcugcuuccuaaagacgaacugaaugauuugauugaccgcgcguucagccgauuucgucacagagagguagugcaucucuccaggcugcggaacggucugaauguccucgaguuauggcacggggugacguaugcuuucaaggaucugucucuuucgugcaccacacaguuuuugcaguacuuccuggaaaaacgcgagaagcauguuacuguggucgugggaaccucaggcgacacaggcagcgccgcaauagaaaguguacagggggccaaaaacauggauaucauuguucuacucccaaagggacacuguaccaagauccaagagcugcagaugacuacagugcuuaaacagaauguccauguguuugguguggagggcaacuccgacgaacuggaugagcccauuaagaccgucuucgcugacguugcauuugugaaaaagcacaauuugaugucucucaacagcaucaauugguccagaguacuggugcagauggcccaccauuucuuugcuuauuuccaaugcacgccuucauuagauacucacccacugccccucgucgaagugguugugccuaccggggccgcgggaaaccuugcagccggcuacauagcucagaaaaucggucugccaauuagguuggucguggccguaaaucggaacgacaucauucaucgcacaguucagcagggggauuucagucuaagcgaggcagugaagucuacucuggcuuccgccauggacauccaagucccguauaauauggaacgaguguuuuggcuccugucaggaagcgacagucaggucaccagagcgcuuauggagcaguucgagaggacacaaucugugaaccugcccaaggaauugcacuccaaaugggagcggcaggauuacgaaaagauggccguuauggagugugacggcugcuguguggaacucugccugggcaauugugggccucgucgcggaagcguaaccgauauaccagguacggcaauggucagaggcgggggauga

SEQ ID NO: 63770 - RNA, 1974 nt, Artificial Sequence
  derived and/or modified sequence opt3 from THOC1__Homo_sapiens__NP_005122
augagccccaccccuccacuguucucccucccggaggccagaacaagguuuacuaagucuacgcgggaagcucuuaacaauaaaaacaucaagccccuguugucaaccuucagucaggugccuggcagcgagaaugaaaagaagugcacauuagaccaagcauuucgcgggauucuggaggaagagauaaucaaccacuccucuugugagaauguccuagccauuaucucgcucgcgauuggagguguuacugaaggcaucugcaccgcuucaacaccauucgugcugcuuggggauguacuggacuguuugccccucgaucagugcgacaccauauuuacuuucguggagaaaaacgucgccacauggaaaagcaauaccuuuuacagugcaggaaagaacuaucugcugcgaauguguaaugaucucuuacguagacuguccaaaucucagaacacgguguucugcggcaggauccaguuguuucuugcccggcuguucccucuaagcgaaaaguccggucucaaucugcaaucacaguuuaaccuugagaauguuacuguguucaacaccaaugagcaggaaaguacacuggggcagaaacauacugaggaccgcgaagagggaauggaugucgaagagggcgagaugggcgacgaagaggcuccaaccacauguagcauucccaucgauuacaacuuguauagaaaguuuuggucucuccaagacuacuucaggaacccugugcagugcuaugagaaaauuuccuggaagaccuuccugaaguacucagaggaaguauuagcaguuuuuaaaagcuauaagcuggaugacacgcaggccagucggaaaaagauggaggagcucaaaacugggggagaacacguguacuucgcuaaguuucuuacaucugagaaacugauggauuugcagcuauccgacagcaauuuccgccgacauauccugcuccaauaccugauacuuuuucaguaucugaagggucaggucaaguucaaaucgucuaacuacguguugaccgacgaacaaucccucuggauugaggauacuacaaagucaguguaucagcuguuaagugaaaauccaccggacggcgagagauuuagcaaaauggucgagcacauccugaacaccgaagagaauuggaacuccuggaagaaugaagggugucccucuuucguuaaagagaggacgagcgauaccaagccuacacggauuauccguaagcgcacugccccagaggacuuucuaggaaaaggccccaccaagaaaauccucauggguaacgaagaacugacaagacuuuggaauuugugcccugauaacauggaagcguguaagucagagacuagggaacauaugccaacccuggaggaguucuuugaagaggcaauugaacaggccgaccccgagaauaugguggaaaacgaguacaaagcuguaaauaacaguaauuauggguggcgggcccuccgacugcuugcacgcagauccccgcacuucuuucagccuacaaaccaacaguucaagagccugcccgaguacuuggaaaacauggugauaaagcucgcuaaagagcugccaccucccucugaagagaucaagaccggagaagaugaggacgaggaagauaaugacgccuuacugaaagagaacgaaucaccagaugucaggcgggacaagcccgugacuggcgagcagauugagguuuucgcgaauaaacuaggcgaacaguggaagauccucgccccuuaucuggagaugaaggacagugaaauacgccaaauugagugcgauagcgaagacaugaaaaugagagcaaagcagcuuuugguggcuuggcaggaucaggaggggguccacgccacgccagagaaccugaucaaugcucucaacaaauccggacugucugacuuagccgaaucgcugacaaaugauaacgagaccaauagcuga

SEQ ID NO: 63771 - RNA, 4782 nt, Artificial Sequence
  derived and/or modified sequence opt3 from THOC2__Homo_sapiens__NP_001075019
auggccgcugcagccguggucguucccgcggaauggaucaagaacugggaaaagagcggcagaggggaguuccugcaccucugcaggauucuuuccgaaaauaagucucaugacucaaguaccuaccgggauuuucagcaagcucuguaugaguugagcuaccacgugauaaaaggaaacuuaaagcaugaacaggccuccaauguacugucugacaucucggaguuccgcgaggauaugccuucaauucuagcagacguguuuuguauccucgauauugaaacaaacugccuggaggaaaagagcaagcgagacuauuucacucagcuuguccuggccuguuuguaccucgugagugauacgguucugaaggagcgucuggacccagagacccucgaauccuuaggucugaucaaacagucucaacaguuuaaucaaaagagcgugaaaauaaagacaaaacuuuucuauaagcagcagaaguuuaacuugcugagagaggaaaaugagggcuacgcuaaacuaaucgcagaacucgggcaggaucuguccggaucaauuaccagugaccuuauccuggagaacauuaagagcuugaucggcugcuucaaucucgauccgaacaggguccuggacgugauauuagagguauuugaaugucggcccgagcacgaugacuucuuuauuucucugcucgaauccuauaugucaaugugcgagccucagacucuuugucauauccuggguuucaaauuuaaguucuaccaggaaccaaauggggagacacccagcaguuuguaccgcguugccgcugugcuacugcaauucaaccucauugaccuggaugaccuuuauguccaccuguugccugccgauaauugcaucauggacgagcacaaaagagaaaucgcggaggcaaagcagauugugaggaaacucaccauggugguccugucuuccgaaaagauggaugagcgggaaaaggagaaagagaaggaagaggaaaaaguugagaagccacccgacaaccagaaauuaggacugcuagaggcccuccugaagauaggcgauuggcaacaugcucagaauaucauggaccagaugccuccauacuaugccgcaagccacaaacuuauugcuuuggccaucuguaaacugauacauauuacuaucgaaccgcucuaccgccgagugggcguacccaagggggcgaaaggaucgccugugaacgcccugcagaacaagagagcaccaaaacaagcugagucuuuugaagaucuuaggcgggacgucuucaauauguuuugcuaucuggguccccacuugucccacgauccuauccucuucgccaaggugguucguauuggcaagucauuuaugaaagaguuccagagugacgggagcaagcaggaagacaaagagaagacagaggugauccuguccuguuuacugucuauuaccgaucagguccuacucccaagccugucacuuauggacugcaacgcuugcaugagugaagaguuguggggaauguuuaaaacguuccccuaccaacaucgcuauagacuguacggccaguggaagaaugaaacuuacaacucccacccgcuccuggugaagguaaaagcccagaccauagauagggcaaaguauaucaugaaacgguuaacaaaggagaauguuaaaccuagcggucgacagauugggaagcugucucauucaaaccccacuauccuuuuugacuacaucuugagucaaauucagaaauaugauaaucucauaaccccaguggucgacagccugaaguaccuaacaucccugaacuaugaugugcucgccuacuguaucauugaagcucuggcgaauccugagaaggagcgcaugaaacacgacgauaccacgaucucuucguggcuucagagcuuggcauccuucugcggagccgucuuuagaaaguaucccauugaccuggcuggcuuacuccaguacguggccaaccaacugaaagcaggcaagucauucgaucuucugaucuugaaagaaguugugcagaagauggccgggauagagaucacugaagagaugacaauggaacagcucgaggcuaugaccggaggugagcaacugaaggccgaaggcggguacuuuggacagauuaggaauacuaaaaagaguucucagcggcuaaaagacgcacugcucgaucaugaccuggcgcuuccauugugucuguuaauggcucagcaacgcaacggcguaaucuuccaggaggguggggaaaagcaccucaaacuggucggcaaacuuuaugaccagugccacgauacacuggugcaguucggaggcuuucuagccagcaaucucuccaccgaggacuacauuaagagaguucccucaaucgaugugcuguguaacgaguuccauacgccucacgacgcagccuuuuucuugagcaggccaauguaugcucaucacauaucuuccaaauacgaugaacugaagaaaagugagaaggggagcaaacaacagcacaagguccauaaguauauuaccucuugcgaaauggugauggccccgguacacgaggcagugguuuccuuacaugucucaaaagugugggacgauaucaguccccaguuuuacgcuacauucuggagccucacuauguaugaccuggccgugccucacaccucguacgaacgugaggucaauaaacuuaaaguucagaugaaggcgauugaugacaaccaagagaugccacccaacaaaaagaaaaaggaaaaggagcgguguacagcccugcaggauaaauugcucgaagaggaaaagaaacagauggagcaugugcaacgagugcugcagagacuaaagcuggagaaagacaauuggcuucucgcuaaguccacuaagaacgaaaccaucacaaaauuucugcaguugugcauauucccuagguguaucuuuucugcaauugaugccguauacugcgcucgcuucgucgagcuggugcaccagcaaaagaccccaaauuuuagcacuuuacucuguuaugaccggguuuucucagacaucauuuacacgguggccaguugcacagaaaacgaggcauccagauauggaagguuucugugcuguaugcuugaaaccgucacucgcuggcacucugaucgagcgaccuacgagaaagagugcgguaauuaucccggcuuccugacaaucuugcgggccaccggguucgacggaggcaacaaggcugaucagcucgacuacgaaaauuuucgucaugugguucacaaauggcauuauaagcugacuaaggccagcgugcacugucuagagacaggugaauacacgcauauaagaaacauucugaucguacuuaccaaaauccucccgugguacccuaagguccugaauuuggggcaggcauuagagaggcgcgugcacaaaauuugccaggaggaaaaggagaaacggccagaucuguaugcucucgccaugggcuacuccggacaacugaagucaagaaagagcuauaugauccccgaaaacgaguuccaccauaaagacccucccccaaggaaugcaguggccaguguccagaacggcccugggggaggucccucuuccagcucgauuggcucagcuucuaagagugaugaauccagcacugaggagacagacaaaucucgagaacgcagccagugugggguuaaggcggugaauaaagccuccucaaccacaccaaagggaaacaguagcaauggcaacucugguuccaacucaaauaaggcaguaaaagagaacgauaaggaaaaagggaaggagaaagaaaaggagaaaaaggagaagacuccggcuaccacgccugaagcccgggugcuuggcaaagacggaaaggagaaacccaaggaagagagaccaaauaaagaugaaaaggccagggagaccaaggagcguacacccaaaagugacaaggaaaaagagaaguuuaaaaaggaagagaaggcuaaagacgagaaguucaaaacuaccgucccuaacgcagaaagcaaguccacacaggagcgcgaacgggagaaagaaccaucuagagagagggauauagccaaggagaugaagucgaaagaaaaugugaagggcggggagaaaacucccguuagcggaucacugaaguccccugugccgcgaagugacaucccagaacccgagcgggaacaaaaacgcagaaagauugauacccacccuucuccaagccauuccucaacggucaaagacucuuugaucgagcuaaaggagagcagugcgaagcuguacauuaaccacacacccccuccgcucuccaaaagcaaggaaagggagauggauaaaaaggaccuggauaaaucucgggaacgaucaagagagcgcgaaaagaaggacgagaaagauaggaaggagcguaaacgggaccacuccaauaacgauagagaagugcccccagaccuuaccaagaggcgcaaagaggaaaauggcacuauggguguuaguaagcauaagagcgagucgccuugcgagucucccuauccaaacgaaaaagauaaggagaaaaauaaguccaaaagcucagggaaggaaaagggaagugacucuuuuaaauccgagaagauggacaaaaucagcucaggcgguaagaaagaaagucgacacgauaaggagaaaauagagaagaaggaaaagagagacagcuccggcgggaaggaggagaaaaagcaucacaaaucuagcgauaagcaucgguga

SEQ ID NO: 63772 - RNA, 2052 nt, Artificial Sequence
  derived and/or modified sequence opt3 from THOC5__Homo_sapiens__NP_001002878
augagcuccgaaucuucaaagaaaagaaagcccaaagugaucaggagugacggcgccccugcugaagggaagcggaaccgcagcgauaccgagcaggaaggaaaauacuauuccgaggaagcagaggucgaccugcgagauccaggucgugacuacgagcucuauaaguacacaugccaagaacuucagagacugauggccgagauucaggauuugaagucuaggggcgggaaagacguugcgauagaaaucgaggagcggcgcauucagucgugugugcacuucaugacuuuaaagaaacugaauagacuagcucauaucaggcucaagaaaggacgggaucaaacgcacgaagccaagcagaagguagacgcauaucaucugcagcuucagaaccuguuguacgaggugaugcaccuccaaaaagaaauuaccaagugccuggaguuuaaaucaaagcaugaagagaucgaucuggucagccucgaggaguucuauaaagaagccccgcccgacauaaguaaggcugaagugacaaugggcgauccucaccagcagacuuuagcacgccuggacugggagcuugaacagcgaaaaagauuggccgagaaguacagggagugucuguccaauaaggagaaaauccuaaaggaaauugaaguuaaaaaggaguaccucucuagccugcaaccacggcuuaacuccaucaugcaggcuucacugcccgugcaggaauauuuguuuaugccuuucgaucaagcccacaaacaguacgagaccgcgcgucaucucccacccccucuguaugucuuauuugugcaggcaacagccuacggucaggcuugcgacaagacccugaguguagccauugaggggagcguugacgaagcaaaggcucucuucaaaccaccggaggauucucaagacgaugaauccgacucagaugccgaggaggaacagacuacaaagcgcagaaggcccacccuuggagugcagcuggacgauaaacggaaggagauguugaaacgacacccucuaagcgucaugcuggaccucaaguguaaggaugacagugugcugcaucuuacguuuuauuaccugaugaauuugaacaucaugacugugaaagcgaaggucaccacagccauggaacucauaacuccaauuucugcaggcgaucuguuaucccccgacagcguucugucgugccuauauccuggcgaccacgggaaaaagaccccaaaucccgcuaaccaguaccaauucgauaaagugggaauccucacacugucugacuacguacuugaguugggucacccguaucugugggugcagaagcucggcgggcugcauuuuccuaaggaacagccccagcaaaccgucauugccgaucacucccuuucagcuagucauauggagacgacuaugaaacuguugaagacacgcgugcagagcagacucgcccugcacaaacaguucgcauccuuagagcauggaaucguuccagugaccucugacugucaguaccuguuuccugccaaggucgugagcaggcuaguaaaauggguuacuguggcucacgaagauuauauggagcuccacuucacaaaggacaucgucgaugcgggccuggccggugacaccaaucuuuacuauauggcauugauugaacgggggacggcuaaacugcaagccgcagugguccucaaccccggauacucaaguauaccacccguguuucagcugugcuuaaauuggaagggcgagaagaccaacuccaaugaugacaacauccgcgccauggaaggcgagguuaauguguguuauaaagagcugugcgggccuuggccaagccaucagcuuuugacaaaccaacuccagagacuguguguacuacuggaugucuaccucgaaacugagucucacgacgauucaguggaaggaccgaaggaguucccccaggagaaaaugugccugaggcuuuuccgugguccuagucggaugaagccauuuaaauacaaccauccccagggcuucuuuagccaccgauga

SEQ ID NO: 63773 - RNA, 891 nt, Artificial Sequence
  derived and/or modified sequence opt3 from THOC6__Homo_sapiens__NP_001135822
auggagagagccgugccccuggcugucccucucggccagaccgaaguuuuccaagcacuucagaggcugcacaugacaaucuuuagccaguccgugucuccaugcgggaaguucuuggccgcgggaaacaauuacggucagauugcuauauuuucauuaaguagcgcccuguccucugaggcaaaagaagagucgaagaaaccgguagugacuuuccaagcccaugacggccccgucuauucaauggugagcacggaucggcaccuacucagugcuggggacggagaaguuaaggcauggcugugggccgagaugcuuaaaaagggcuguaaggagcuguggcgccgacagccuccauaccguaccuccuuggaagugcccgagaucaacgcucuccugcuggucccuaaagaaaauucucucauuuuagccgguggggauugccagcugcauacaauggaccuugagacuggaaccuuuacaagaguguugaggggccacaccgauuauauccauugucuggcgcuacgggagcgcagcccagaaguacucuccggcggggaggacggagcaguuagacugugggaucuuaggacugccaaggaagugcagacaauugaggucuacaaacacgaagagugcucacggccccacaacggucgcuggaucggcugucuggcuaccgacagugauuggauggugugcgggggaggcccugccuugacgcucuggcaucugcgaagcucuacuccaaccacaauauucccgaucagagcaccccaaaagcacgugacuuuuuaucaggacuuaguccugaccgcugccgguaauuccuguaggguugauguguucacaaaccucggguaccgggcguuuucacuuagcuucuga

SEQ ID NO: 63774 - RNA, 1134 nt, Artificial Sequence
  derived and/or modified sequence opt3 from T__Homo_sapiens__NP_001257413
augagcucccccggcaccgagucugccgggaagucacugcaguacagaguggaccaccuccuuagugcugucgaaaacgagcugcaagcaggaagcgaaaaaggugauccuacagagagggaauugcggguuggcuuagaggaguccgaacuguggcuacgcuucaaggagcucacuaaugaaaugaucgugacgaaaaacgggcgacguauguuuccaguacugaaggugaaugucucuggacuugacccgaacgccauguauucguuccuguuggauuuuguggcggcugacaaucauagauggaaauacguuaacggcgagugggugcccggugggaagccugagccacaggcccccucaugcgucuauauucacccugauagcccaaauuucggagcacauuggaugaaggcccccgugaguuuuuccaaaguaaagcucaccaacaaacugaauggcggcgggcagauaaugcugaacucucuccacaaguacgaaccuaggauccauauuguucgggugggagguccacagcgcaugaucacaagccacuguuucccggagacucaauuuauugcugucaccgcauaucagaaugaagagaucacagccuuaaaaauaaaguacaaccccuucgcuaaggccuuucuggacgcgaaagaaagauccgaucacaaggagaugauggaggaaccuggcgacucacagcagccaggguauagucaaagcuacucugauaauucccccgcaugccuuucaauguugcagagccaugacaacuggaguucucugggaaugccugcccacccauccaugcuacccgugagccauaaugcuucgccgccuaccucuuccucacaguaccccagucucuggagcguguccaacggcgccgucacuccagguucucaggcagcugccguuagcaacgggcugggagcgcaauucuuuaggggcaguccugcccacuauacaccccuuacccacccagugucagcacccuccagcucuggcucaccucuguacgagggggcugccgcugccacggauaucguagacagucaguaugaugcagccgcucagggacgguugauugcgagcuggacuccaguguccccgcccucuauguga

SEQ ID NO: 63775 - RNA, 2070 nt, Artificial Sequence
  derived and/or modified sequence opt3 from THOP1__Homo_sapiens__NP_003240
augaagcccccugccgcuugcgcaggcgacauggccgaugcggcuagcccauguuccguggucaacgaccugagaugggaucucucugcccagcaaaucgaggaaaggacccgggagcuuauugaacagacaaaacgcguuuacgaccagguggggacucaggaguucgaagauguaucauaugagaguacgcugaaggcauuggccgacguggaggucaccuacacagugcaacgaaauauauuagauuuuccgcagcacguuagccccuccaaagacauccguacugcuucuaccgaagcagauaagaaacugucggaguucgacguggaaaugucaaugagagaggaugucuaucagaggauuguguggcuacaggagaagguacaaaaggacagccuccggccugaagccgcucgcuaccuggagagacuuaucaaacugggaaggcggaacgguuugcaucucccacgcgaaacacaggagaauauuaagcgaaucaaaaagaaacugagucugcucugcauagauuuuaacaagaauuuaaacgaagacaccacuuuccugcccuuuacacuucaggaguugggcgggcugccugaggacuuccuaaauucccucgaaaagauggaggauggaaaacugaagguuacccuuaaauauccacacuacuuuccccuguugaagaaaugucaugugccugaaacgagaaggaaggucgaggaagccuucaacugccgguguaaagaggagaauugcgcgauccucaaggaacuggugacuuuacgugcacagaagucucgccugcucggcuuucacacccaugccgacuaugugcuugagaugaacauggcuaaaacaagccaaacugucgccaccuuccuggaugaauuggcacagaagcuaaaaccacugggugagcaggaaagagcuguuauucucgagcugaagagggccgagugugaacggcgagggcuuccguuugacggacgcaucagagcgugggauaugagguacuacaugaaucaaguggaggaaacacgguauugcguagaccagaaccuguugaaagaguacuuccccgugcaggucgugacccacggccuccugggcauuuaucaggaguuacuggggcuagccuuucaccaugaagagggagcauccgcuuggcacgaagauguucgccucuacacggccagagacgcugccucaggugagguggucggcaaguucuaucuggaucuuuacccuagggaagggaaguauggacaugcagccuguuucggcuugcaaccagguugccugcgucaggacgggagucggcagaucgcuauagcggcaaugguggccaauuuuacuaaacccacagcugaugccccuagccuccugcagcacgacgagguagagaccuacuuccacgaauuuggacauguuaugcaccaacuuuguucucaggcagaguucgccauguuuuccggcacucauguggaacgagacuucgucgaggcuccaucacagaugcuggaaaacugggugugggagcaggagcccuugcucagaaugagcaggcacuaccgcacaggcagugccgucccgcgggaacuguuagagaagcugauugaaucuagacaagcaaauaccgggcuauuuaaccucaggcagaucgugcuggcgaaaguugaucaggcccuucauacgcagaccgacgcugauccugcagaggaauaugcccgcuugugccaagagauucugggagugcccgcuacaccagguacuaacaugccugccaccuucggccaccucgcagggggauacgacgcucaguauuacggcuaucugugguccgagguauacagcauggauauguuucacacacgauucaagcaggaaggugucuuaaauucgaaaguggggauggacuaucggucuugcauccugcgucccggcggauccgaggaugccucagcgaugcuuagaagguuuuugggccgcgacccaaagcaagaugccuuccuccugaguaaggggcuacagguuggagguugugaacccgagccucaggugugcuga

SEQ ID NO: 63776 - RNA, 1482 nt, Artificial Sequence
  derived and/or modified sequence opt3 from THPO__Homo_sapiens__NP_001276932
auggaucccccuauccagauuuucagcguggucugcguuggcgggggaguggacccagguccgggcagaggguccagggaggaaaaggccucucugcccggagcuuuuaccucaguaugguggcucccuagucuuauaggccaaaaauggccacggcaggcauacgaccuguuguuauggcgcgguugugcgcccccuccacacguguuccugcccaucugcagcccugaggggugucuacucugcacauggguccuggaaccauuuuccacucgaauugauucuucgccgcuugcccgucugugucccacguugcucugcccugaggugcaggaaccaaagcccccuccauggccccaggagggauucagaggcgaggcuccgaacagggaaccucggcaacccgacaccccagcccgcauggagcugacagaacugcucuuaguugugaugcugcuuuugacugcaagacugacccuaucaagcccugcucccccagccugugaucucaggguccugaguaaacuucugcgggacucccauguguugcacucucgccucagccagugccccgagguacauccucugccaacaccgguuuuacugcccgcaguggauuuuucccucggcgaguggaagacccagauggaagagacuaaagcccaggacauccuuggggcugucacacuguugcuagaaggagugauggccgcgcgaggucaacugggcccuaccugucucucaagucugcuugggcagcugagcggacaggugagauugcuccugggcgcauuacagucucugcuagguacgcaacucccaccccaggggaggacuaccgcccacaaggauccuaaugcuauuuuccuguccuuucagcaucuuuugcggggaaagguccguuuccugaugcucguuggcggcucaacacugugcgugcgcagagccccacccacuaccgcaguaccgagcaggacaagucuugugcugaccuugaacgagcucccuaaucggacgucugggcuguuagaaacuaacuuuacagcuuccgcccgaaccacuggaagcggucugcuaaaauggcaacagggcuuccgcgcgaagaucccagggcuccugaaucagacaucgagaucucuugaccagauacccggauauuugaacaggauccacgagcugcucaauggcacccggggucuguuuccugggcccucccgcagaacguuaggcgccccagauauuucaaguggaaccagcgacacaggcucccugccucccaaccuucaaccaggguacucuccgagcccuacucaucccccaaccggacaguauacauuguucccccucccuccaacucugcccaccccugucgugcagcuacacccgcugcucccagaucccucagcaccuacaccaacccccacgaguccucugcuuaauacuuccuacacacacagccagaacuugucucaagaggguuga

SEQ ID NO: 63777 - RNA, 1356 nt, Artificial Sequence
  derived and/or modified sequence opt3 from THRA__Homo_sapiens__NP_001177847
auggagcagaagcccagcaaaguggaaugcggcuccgacccugaggaaaacucugccagaucaccagaugggaagaggaaacggaagaauggacaauguagucugaaaaccagcauguccgguuacaucccgucuuaucucgacaaggaugagcagugcgucguuuguggcgacaaggcuacaggguaccacuaucgcugcauuacuugugaaggaugcaaaggcuucuuucgacguacgauacagaagaaccuucaucccaccuacucguguaaauaugauucaugcugugugaucgacaagauuacaagaaaucagugccaacuguguagguucaaaaagugcaucgcaguagguauggccauggauuugguguuagacgauagcaagcgggucgcgaaacgcaagcugauugagcagaacagagagaggcggcgcaaagaagagaugauccgaagucuacagcagagaccugaaccaacucccgaggagugggaccucauacacaucgcuaccgaagcccauagguccacaaaugcacaagggucucacuggaagcagcggcguaaauuucugccugaugacauuggacagagcccaaucguguccaugcccgauggcgacaagguugaccuugaggccuucucagaauuuaccaaaauuaucacuccugcuauaacacgcguggucgauuucgcaaagaagcugccaauguuuagugaguugccgugcgaagaccagauuauccuccugaaaggcuguugcauggagauuaugagccugagagccgcugugagguacgaucccgagucugacacccucacguuauccggggaaauggccguaaagcgggagcaacugaaaaacggaggucuuggcguugugucagaugcgaucuucgaauuggggaagucccugagugcauuuaaucuagacgauacugaggucgcccuccugcaggcugugcuucugaugucuaccgaccgauccggauugcucuguguggauaaaaucgaaaagagccaggaggccuaucuguuagcauucgagcauuacgucaaccaccgcaagcacaauauuccucauuuuuggccaaaacugcucaugaagggcccccaaguuagacagcuugaacagcagcugggugaggcugggucguugcaaggaccugugcuacagcaccagucuccaaaaagcccccagcaaaggcugcucgaacugcuucaucggucaggcauacugcacgcccgcgcgguaugcggcgaggacgauaguagcgaagccgacuccccgucuagcucagaggaggaaccugaggugugugaagacuuggcagggaacgcugccagucccuga

SEQ ID NO: 63778 - RNA, 1386 nt, Artificial Sequence
  derived and/or modified sequence opt3 from THRB__Homo_sapiens__NP_001239563
augacccccaacagcaugacagagaauggccugacugccugggacaagccuaaacacugcccagauagagaacaugacuggaagcucguggggauguccgaggcuugucuucacaggaaaucucauucagaacggcgcaguacgcugaagaacgagcagagcuccccgcacuugauccaaaccacauggacuucuucgauuuuccauuuagaucacgacgaugucaaugaccagucaguuagcagugcacagaccuuucagacagaagagaaaaagugcaagggauacauacccuccuaucuggauaaagacgagcuaugugugguaugcggugauaaggccaccggcuaccacuaucgauguaucacuugcgaaggguguaaaggauucuuucguagaacaauucaaaagaaccuccauccuucuuacagcugcaaauaugagggcaagugugugaucgacaaggucaccaggaaucagugccaggaaugucgguucaaaaagugcauuuacguggguauggcgacggaucugguucuugacgauuccaaacgccuggcuaagagaaaauugaucgaggagaacagggaaaagcggcgccgagaggaacuccagaaaucaauagggcacaagccagagcccacugacgaagagugggagcugaucaagaccgugacagaagcccaugucgcaacuaaugcccaaggaagucacuggaaacagaagagaaaauuucugccugaggacauuggccaggcuccaaucgugaacgcacccgaaggcgggaagguagaucucgaggccuucagccacuuuaccaaaauuaucaccccugcuauaacaaggguuguggacuucgccaagaaguuaccaauguuuugcgaacugccgugugaggaucagauuauccuuuugaaaggaugcuguauggagauuaugucucugcgggcggcaguccguuaugaccccgaauccgagacgcuaacucucaauggugaaauggccgugacacgcggccaacugaagaacgggggacuuggcguggucucagaugcuaucuucgaccuggguaugagcuugaguucuuuuaaucucgaugacaccgagguugcccuguuacaggcagugcugcucauguccagcgauagaccugggcuugcuugcguagaaaggaucgagaaauaccaggacucguuccuguuggccuuugagcauuacauuaacuaucggaagcaccaugugacucacuucuggccaaaacuacugaugaaggucacagaucuccgaaugauaggagcgugucaugccucucgcuuccugcacaugaagguggaaugccccaccgagcuuuuuccuccacuguucuuggaaguuuuugaggacuga

SEQ ID NO: 63779 - RNA, 441 nt, Artificial Sequence
  derived and/or modified sequence opt3 from THRSP__Homo_sapiens__NP_003242
augcaagugcugaccaagagauaccccaaaaacugccuccuuacagucauggacagguaugccgcugagguucacaauauggaacaggugguaaugaucccuagccuguugcgggaugugcaguuauccggcccagggggacaggcacaggccgaggcgccggaccuguacacuuauuucacgaugcuaaaggcuauuugugucgauguggaccauggucuccugccccgcgaagaguggcaagccaaaguugcaggcucugaagagaacgggaccgccgagacagaagagguggaagaugagucagcuaguggagagcuugaccuggaagcacaguuucacuugcauuucagcucccuccaccauauacugaugcaccugacugagaaggcccaggaagucacccgaaaauaccaggagaugacaggccaagugugguga

SEQ ID NO: 63780 - RNA, 2559 nt, Artificial Sequence
  derived and/or modified sequence opt3 from THSD1__Homo_sapiens__NP_061146
augaagcccaugcugaaagacuucagcaaccuccuucugguggucuugugcgauuacguuuuaggcgaggccgaauaucugcuacucagagagccugggcacguggcucuguccaaugacaccguauacguggauuuucaguauuucgacggagcaaacgguacacuuaggaaugucucugugcuguugcucgaagccaacacuaaucaaacgguuaccacaaaguaccugcugacuaaccagucacagggcacccucaaauuugaguguuucuauuuuaaggaagcgggggauuacugguucacaaugaccccagaggcuacugacaauaguacaccguuucccuggugggagaaaagcgccuucuuaaagguggaauggccugucuuucauguggaucugaaccgguccgcaaaggccgcugagggaaccuuccagguaggccuuuuuacgucucaaccauugugccccuucccuguugacaaaccaaauaucguggucgaugugauuuuuacuaacucgcugcccgaagcacgccgaaauucacgucagccucuagagauaagaaccagcaagaggacagagcucgcccagggucaguggguggaguucgggugugcuccacugggaccggaagccuaugucacuguugugcuuaaacuguugggccgggacaguguaaucaccuccacaggccccauugaucucgcgcaaaaguucggguacaaacuggugauggucccugaauuaaccugcgagucuggaguggaaguuacggugcugccacccccuuguacuuuuguccagggugugguaacaguuuucaaggaggcaccacgcuaccccggcaagagaaccauccaccucgccgagaacagccuuccgcugggggaaaggcggacuauuuuuaauugcacauuguucgacauggggaaaaacaaguauuguuuugauuucggcaucuccucacgcagucauuuuagcgcuaaagaggaaugcaugcuaauacagcgaaauaccgagacguggggucuguggcagccuuggucucaauguuccgcaaccugcggggacggagugagagaaaggcggcgugucugucucacaucauuccccagcaguccagugugcccuggcaugucucuggaggccucccuuugcagccuggaggaaugugcugccuuucagcccucgucuccaucccccuugcagccucaaggcccagucaagucaaacaacaucgugacuguuaccgggauuagucucugccuguucaucauuaucgcgacaguguuaauaacucuguggcgcagauuuggaaggccggccaaauguagcacccccgcacggcacaauuccauucauucuccuagcuuccgaaagaacucagacgaggaaaauaucugcgagcuaagugaacagcgcgguuccuuuagcgauggcggggacggaccaacaggcucucccggugauaccgggauuccucucacuuacagaaggucaggcccaguacccccggaggacgaugcuaguggaagcgaguccuuccagucuaacgcccagaaaaucaucccuccacuguucucguaucggcuugcucaacagcaguugaaggaaaugaagaaaaagggccugacggagacaaccaaagucuaccacgugagccagucaccccucacugacaccgccauugaugcagccccuuccgcuccccuggaccuugaaaguccagaggaggcggcagccaauaaguuucgcauaaaaucuccuuuccccgaacaaccagcuguuagcgccggggagagaccgccuuccaggcuggauuugaacgugacacaggcaucaugugccaucagccccucucagacccucauucguaagucccaggcucggcacgucggaagucgagguggcccaagcgaaagaucucaugccaggaaugcacacuuucgccggacugcguccuuccaugaggcuagacaagccaggcccuuucgcgaacgaucaaugaguacacugacgccucggcaggcaccagccuauagcucgcguaccagaacuugcgagcaggcugaggacagguuccgcccccagucccggggagcccacuuauuuccugaaaagcuggagcacuuccaagaagcaucuggaacaagaggcccgcuaaacccacuccccaaaagcuacacccugggucagccucuuaggaagccagauuugggggaccaucaggcuggccugguggccggaaucgagcgaacagaaccccaccgcgcgcggagaggcccuucaccgagucauaaauccguaucuaggaagcaaagcucccccauaucaccaaaagacaauuaucagcgugugagcagucucucuccuucccagugucgcaaggauaagugccagagcuuucccacucacccagaguucgccuuuuacgacaacaccucguucgggcugacggaggcugaacaacggauguuagaucugccuggauacuuugguucaaaugaggaagacgagaccacaucuacucuuaguguugaaaaauuggucauuuga

SEQ ID NO: 63781 - RNA, 1977 nt, Artificial Sequence
  derived and/or modified sequence opt3 from THSD4__Homo_sapiens__NP_001273358
auguucgugagcuaccugauccucacccuucugcacguccagacagccguuuuggcuagacccggcggggaguccauuggaugcgacgauuauuuagguucugacaaggugguagauaaauguggcgugugcgggggagacaacacuggcugucaagucgugucagguguuuuuaagcaugcacugacgagucuaggguaccacaggguggucgaaauaccugagggagccaccaaaaucaauauuacagaaauguauaagagcaacaauuaccucgcgcugcggucccgcucuggccgaucgaucauuaacggcaauugggcuaucgaucguccagggaaauaugagggagguggcacuauguucaccuacaagagaccgaacgaaauaucaagcacagccggggagaguuuucuugcagagggacccaccaaugaaauccuggacguguauaugauucaucagcagccuaacccaggcguacacuacgaguacguuaucauggguacuaaugccauuucuccccaggugccuccacauaggcggcccggggaaccuuucaacggacaaauggucacagagggccgcucccaggaggaaggcgagcagaaggggagaaaugaagagaaagaagauuugaggggagaggcuccagagauguuuaccagcgaauccgcacagacguucccggugcggcaccccgaccgcuuuucaccucaccgaccagauaaccucgugcccccugccccacaacccccgagaaggagucgggaccauaauuggaagcagcuggguacuaccgagugcagcacaacuuguggcaaagggucucaguauccuaucuuccguugcguccaccgcuccacccaugaagaggcucccgaaucauacugugauagcaguaugaagccaacaccugaggaggaacccugcaacauauuuccaugucccgccuucugggacauuggagaguggucugaaugcuccaaaaccuguggccuggguaugcagcacagacaaguucucugccgacagguguaugcgaaucggagcuuaacgguacagccuuaccgaugccaacaccuggagaagccagaaacuacaucgaccugucagcuuaagaucugcucugaguggcagauucgcacugauuggacauccuguucagugccgugcggggucggccagagaaccagggacgugaaauguguuaguaacaucggagacguggucgaugacgaggaaugcaacaugaaguugcggcccaaugauaucgagaacugugacaugggcccuugcgcaaaaagcugguuucugacggaaugguccgagcgcuguucugccgagugcggggcuggagugagaaccaggagcguaguuuguaugacaaaucaugugucaagucuaccacucgaagguugcggcaacaaucgucccgccgaggcaacuccuugcgauaacgggccauguaccggaaaggucgaaugguucgcuggcuccuggagccaaugcucuauugagugugguucagggacacagcagcgggaagugauaugcgucaggaaaaaugccgacacuuuugaggugcuggaucccagugaguguagcuuccuugaaaagccgccuucccagcaaucuugccaccugaaaccauguggcgcgaagugguucucgaccgaguggagcaugugcuccaagucaugucagggaggcuuuagaguuagggaagugcgcugcuugagugacgauaugacacucucuaaccugugugacccccaguuaaaaccugaggaacgggagagcugcaauccccaggauugcguaccagaggucgacgaaaacuguaaggacaaauauuacaauugcaacgugguugugcaagccagacugugugucuauaauuacuacaagaccgcaugcugugcuuccugcacuaggguggccaaccgccagacgggguuccucggaucacgauga

SEQ ID NO: 63782 - RNA, 4974 nt, Artificial Sequence
  derived and/or modified sequence opt3 from THSD7A__Homo_sapiens__NP_056019
augggccugcaggccagaaggugggcuagcgggucccggggagcagccgguccccgccgaggcgugcuccaacuucugccuuugccauuaccgcugccccuacuccugcuucuguugcuccguccuggggcgggcagagcugccgcacagggagaggccgaagcuccaacccuguaccuguggaagacaggucccugggggaggugcaugggagacgaguguggcccuggcgggauccagacucgggcagucuggugcgcccacguugaaggauggacgacccuccauacaaacuguaaacaggcugagcgcccaaauaaccaacagaauugcuucaaggugugugauuggcacaaagaauuauaugacuggagacugggucccuggaaccagugccagccuguaauuucuaagucacuugagaaaccauuggaguguauaaagggcgaagaggggauccaagugagggaaauugccugcauccagaaggauaaagacauuccggcggaggauaucauaugugaguacuuugaacccaagccucugcuagagcaggcaugccucaucccaugucagcaagacugcauugucagugaguucagcgccugguccgagugcucuaaaacuuguggaucgggccugcagcaucggacccgccacgugguugcucccccucaguuuggugggucaggaugcccaaaucuuacagaguuccaagugugucagagcagucccugcgaagccgaggaacugcgauauuccuugcaugucggcccguggucuaccuguagcaugccucacuccagacaggugaggcaggcacggcgucgcggcaagaacaaagagagagaaaaggauaggucaaaggggguaaaagaccccgaggcucgggaacucaucaagaaaaagcgaaaucgcaacagacaaaauaggcaggagaacaaauacugggauauucagaucggauaucagacucgggagguuaugugcauaaauaagacagguaaagccgcggaccugaguuuuugucaacaggaaaaguuaccaaugaccuuccagagcugcgugauuacgaaggagugucaggucucugaaugguccgaguggucaccuugcagcaaaacuugucacgauauggugagucccgccggcacccgcgugagaacaaggacuauccgucaauuuccaauugggucugaaaaggagugccccgaguucgaagagaaagaaccuugccugucccagggagacggcgucguuccaugugcaaccuacgguuggcggacaaccgaguggacggagugccgaguggauccgcuccuuagccagcaggacaagagaagggggaaccaaacugcucuguguggcggaggcauccagacacgcgaaguauauugcgugcaggccaaugagaacuugcuaucgcaacugucuacccauaaaaauaaggaggcuuccaagcccauggaccucaaacuguguacugggccuaucccaaacacaacccagcuuugccacauucccuguccuacggaaugcgaagucucaccauggagugccuggggacccuguaccuacgagaacugcaaugaucagcaggguaagaaaggcuuuaagcugcggaaaagaaggauaacaaacgagccgacugggggaagcggcgugaccgguaauuguccucauuugcucgaagcaaucccaugcgaggaacccgccugcuacgacuggaaggcuguucgccuggggaacugugagccugauaauggcaaggaaugcggacccggcacacaagugcaggaggucguguguauuaacuccgacggggaggaaguagaucgacaguuaugccgggacgcgaucuucccaauaccuguugcaugugaugcccccugcccaaaagacugugugcugucuacuuggagcaccuggucaaguugcucccacacauguagcggaaagaccacugaggguaaacagauucgugcuagaucuauccuagccuaugcaggcgaagaagggggaaucaggugcccaaauucaagugcccuccaagaaguccgcagcuguaacgagcacccuugcacgguguaccauuggcagacaggccccuggggucagugcauugaggauaccuccgucucuucguuuaauacuaccacaaccuggaacggggaagcuagcuguuccgugggcaugcagacucggaagguuaucugcgugagaguaaaugucggacaagugggcccaaagaagugucccgagucacugaggccugaaacaguucgaccaugccuuuugcccuguaagaaagacugcauugugacgccuuauagugauuggaccucuuguccgagcuccugcaaggagggggacucaagcauacgcaaacagucucggcacagagucaucauucagcugccagccaacggaggcagggacuguacugauccccucuacgaggaaaaggcaugcgaggcgccucaggcuugucaauccuaucguuggaaaacacauaaguggcgccggugccagcuggugccauggaguguacagcaagacagccccggugcccaggaagggugcggaccuggcagacaggcaagggccaucaccugucgaaaacaggaugguggccaagcugggauccacgagugccuucaguacgccggaccggugcccgcacugacacaggcuugucagauuccaugccaagacgauugucaguugacuucuugguccaaguucucaaguugcaauggcgacuguggggccguucggacccgcaagagaacgcucgucggaaaaagcaagaaaaaggaaaaaugcaagaacucgcaucuguauccuuuaauagagacccaguacugucccugcgauaaguacaaugcgcagccagugggcaacugguccgacuguauccugccugaggguaaaguggaaguccuacucgggaugaagguucaaggagauauuaaagagugcggccaggguuauagguaccaggccauggcuugcuaugaccaaaacggccggcugguggaaacaucucgauguaauagccacggguacaucgaggaagcaugcauuauccccuguccaucagauugcaaacuuagugagugguccaacuggucuagauguagcaaauccugcggaucaggcgugaagguacgcagcaagugguugagggagaaaccguauaaugggggacguccuugucccaagcuggaccacgucaaccaggcccagguguacgaaguugugccaugccauagugauuguaaucaguaucucugggucacugagcccuggucuauaugcaaagugaccuuuguuaacaugcgggaaaauuguggcgagggugugcaaacaagaaagguaaggugcaugcagaacacugcugacgggccuuccgaacacgucgaggacuaccugugugauccagaggaaaugcccuuaggaagccgcgugugcaaacugccuugcccggaggacugugugaucucggaauggggcccauggacccagugcguccuucccuguaaucagucaucuuuccgacaaagaagugccgauccuauucggcagcccgcagacgaggguagguccugcccaaacgcgguugagaaggaaccuuguaauuugaacaagaauugcuaccauuaugauuacaacgugacggacuggagcacaugucagcucucugagaaagccguaugcggcaaugggaucaagacccgcaugcuggauugugugcguagcgacggaaaauccgucgaucuaaaguauugcgaagcucugggccucgagaaaaacuggcagaugaacacuucauguaugguggaaugccccguuaauugccaacugagugacuggagcccauggucugaguguucccagacaugcgggcuuaccggaaagaugauuagacggaggacugugacccagccuuuccaaggcgauggucgcccgugucccucauugauggaccagaguaaaccaugcccugucaagcccuguuaccgauggcaguaugggcaguggagcccaugccaagugcaggaggcccaguguggagaaggcacaagaacgcggaacaucuccugcguugugucugauggcucggcagacgacuuuagcaaggucguagaugaggaguucugugcugacauagaacugauuaucgaugggaauaaaaacaugguguuagaagagucaugcucccagccuugucccggagacugcuaccucaaggauuggaguucuuggagccugugccaacuuaccuguguuaauggugaggaccugggcuuugggggcauucaggugaggucccgcccggucaucauacaggaauuggagaaccagcaccucugcccagaacaaaugcuggagacuaaaucauguuaugauggacagugcuacgaauacaaguggauggccucugcauggaaagguagcaguagaacaguguggugucagagguccgacgggaucaauguaaccggaggcugccuagugaugagccagccugaugccgaccggucuuguaaucccccaugcucacaaccccacuccuauuguagugagacaaagacuugccauugugaggaaggcuacaccgaggucaugagcucuaacucgacgcuggaacagugcacacucauuccuguuguggugcugccgaccauggaggauaagcguggggacgucaaaacuucccgcgcugugcaccccacccagccaagcucaaacccugcgggacgagguagaacaugguuccuucaacccuuuggcccugacgggagguugaagacuuggguuuauggaguagccgcaggcgcuuucgugcuguuaaucuuuauugucaguaugaucuaccucgccugcaaaaagccgaaaaagccccagcggcgccagaauaacagacugaagccucuuacccuggccuaugauggugacgcugauauguga

SEQ ID NO: 63783 - RNA, 501 nt, Artificial Sequence
  derived and/or modified sequence opt3 from THYN1__Homo_sapiens__NP_001032381
augagcagacccaggaagcggcuggcuggcaccuccgggucugacaaaggacucucagguaagcgcacaaaaacugagaacaguggcgaagcucuugcaaagguggaggauagcaauccucagaaaacguccgccaccaagaacugccugaagaauuugucuucgcacugguuaaugaaaucagaaccagagagccgacuggaaaagggggucgacguuaaauucaguaucgaggaucuaaaggcgcaaccgaaacagacaacuuguugggacggagugcguaacuaccaggcuagaaauuuucucagggccaugaagcugggcgaggaagcauucuuuuaucauuccaacugcaaggagcccgguauugccgggcuuaugaaaauaguaaaggaagccuacccugaucacacccaguucgagaaaaauaacccacauuaugaccccucuagcaaggaggauaauccuaaaugguccaugaagucacugaucuuguuuuga

SEQ ID NO: 63784 - RNA, 1128 nt, Artificial Sequence
  derived and/or modified sequence opt3 from TIA1__Homo_sapiens__NP_071320
auggaggacgaaaugcccaagacccuguacgugggcaaccucagcagagaugucacagaggcccuuauccugcaguuguucucccaaauugggccuugcaaaaauuguaagaugauaauggacacugcuggaaacgauccauauugcuuuguugaguuccacgaacauaggcacgcagccgcggcuuuagccgcaaugaauggucggaaaaucaugggcaaggaagugaaaguaaacugggccacgaccccgucuucacagaagaaggacacaaguaaucauuuucacguguucgucggggaucugagccccgagauuacuaccgaggacaucaaagcugcauuugccccuuucggacgcauuuccgaugcucgagugguuaaggacauggccacaggcaaaucuaaggguuacggguuugugucguucuuuaacaaaugggaugcggaaaaugcaauccagcagaugggaggccaauggcuaggcgggcgucagauaagaaccaacugggccacuaggaagccacccgcuccuaagucaacauaugagagcaauaccaaacagcucaguuacgacgaagucgugaaccaguccucuccaagcaauuguacgguauauugcggagguguuacuuccggccugaccgagcaacuuaugcggcagacauucucacccuuugggcagaucauggagauucgcguguucccugauaagggauacaguuuugucagauucaacagccaugaaucugccgcacacgcuaucguguccgugaauggcacuaccauugagggucacgucguuaaauguuauugggggaaggaaacacuggacaugaucaacccagugcagcaacagaaucagauaggauacccgcaacccuacggccaguggggccagugguaugggaacgcccagcaaauuggacaguacaugccuaacgguuggcagguaccagcguauggcauguacgggcaggccuggaaucaacagggauucaaccagacccagucaagcgcacccuggaugggcccuaauuauggugugcaaccaccccaggggcagaacggcaguauguugccgaaucagccuucuggauacagggucgcuggcuaugagacgcaauga

SEQ ID NO: 63785 - RNA, 348 nt, Artificial Sequence
  derived and/or modified sequence opt3 from TIAF1__Homo_sapiens__NP_004731
augagcucccccucuucaccuuucagagagcagaguuuucugugcgccgcuggcgacgcaggggaagagagcagggugcaaguccucaagaacgaaguucggcgcggauccccagugcuucuggguuggguagagcaggccuacgcggauaaaugugugugcggcccgucugcucccccugccccaacacccccuucguugucacagcgagucauguguaaugacuuauucaaggugaacccauuucagcugcaacaguuccgugcagaucccagcaccgccagucuacuccugugcccugggggacuugaccacaaacugaauuugagaggcaaggcuugggguuga

SEQ ID NO: 63786 - RNA, 1179 nt, Artificial Sequence
  derived and/or modified sequence opt3 from TIAL1__Homo_sapiens__NP_001029097
augauggaggacgauggccagcccagaacccuguacguggggaaccucagcagggacgucacagaaguucuuauccugcaauuguucucccagauuggaccuugcaagucuuguaaaaugauaacugagcagccagauucacggcgcgugaauaguagcguagguuuuuccguguuacagcacacgucuaacgacccguauugcuucgucgaauuuuacgagcaucgagaugccgcugcagcccuggcggcuaugaauggccguaagauccuagggaaagaagugaagguuaacugggccaccacacccucgucacagaaaaaggacacuagcaaucacuuccauguguuugucggagaucucaguccugagauuaccacagaggacaucaaguccgcauucgccccauuuggcaaaauuucugaugcuagagugguaaaggacauggcaaccgguaaaagcaagggguauggauucguuuccuuuuacaacaaacuggaugccgaaaaugcuaucgugcacaugggcggccaguggcuugggggaaggcagauacggacuaacugggccacacgcaagcccccugcgccaaagucaacccaggagaauaacacgaaacaacugagauucgaagacgucgugaaucagaguagccccaagaacuguacuguguauugcgguggcaucgcaucuggguugaccgaucagcucaugaggcagacauuuuccccuuucggacaaauuauggagauccgggucuuuccagagaaaggcuacucauucguucgcuucagcacucaugaaagugccgcucacgccauugugucuguaaaugguaccacaaucgaggggcacguggucaaguguuauuggggaaaagaauccccggacaugaccaagaacuuucaacagguggacuacagccaauggggccaguggucgcagguuuacggcaauccccagcaauaugggcaguacauggcaaacggauggcaagugccuccauauggugucuacggccagcccuggaaccagcagggguucggaguggaucagucuccuuccgcugccuggaugggcgguuuuggggcgcagccaccccaaggccaggccccgccucccguaauaccaccucccaaucaggcaggauauggcauggcuucauaccagacgcaauga

SEQ ID NO: 63787 - RNA, 4776 nt, Artificial Sequence
  derived and/or modified sequence opt3 from TIAM1__Homo_sapiens__XP_005261095
augggcaacgccgagagccagcacguggaacaugaguucuacggggaaaagcacgcuucccugggaagaaaacauaccucuaggucacuccggcuuagucacaagacacgccgaacucgucaugcaagcuccgguaaagucauccacagaaauucugagguuucgacgaggucaagcaguacccccuccauuccucaaucucuggccgaaaacggcuuggagccauuuagccaggacgggacauuagaggauuucggauccccgauauggguggaccggguagauaugggccugcgccccgugucauauacugacaguagcgucaccccuucuguggauuccucaaucguucuaacagcggcuagcgugcagaguaugccagacaccgaagagucuagacucuacggugaugacgccacuuaucuggcagaagggggaaggcggcagcacuccuacacaagcaauggccccaccuuuauggagacggccucguucaagaaaaagcgcucuaaguccgcugauauuuggcgagaggacucacuugaauuuagucugagcgauuugucccaagagcaucucacuucuaacgaagagauccugggcagcgcagaagagaaagacugcgaggaagccagagggauggagaccagggcuucaccucggcagcugaguacaugucagcgugccaauucccucggagauuuauaugcgcagaagaacagcggugucacugcaaauggcgggccaggaucuaaauucgccggcuacugccgcaaccuggugucagacauucccaaucuugcuaaccacaagaugccuccagccgcagcugaagagaccccgcccuauaguaauuacaacacauugccuuguagaaaaagccauugccuguccgaaggugccaccaauccacaaaucucucacucgaacagcaugcaggggaggcgggcgaagacgacucaggacguaaaugccggagagggcuccgaguuugcagauucaggcauagaaggggcuacaaccgacacugaucuacucagucgacgcucuaacgccacaaacagcuccuacucacccaccacggggagagcuuucguugguagcgacucuggcuccaguagcaccggggaugccgcaaggcagggaguguaugagaauuuucggcgcgaacuggagaugucuacaacuaacuccgaaucacuugaggaggccggcagugcucacagcgacgaacaaucguccgguacccugucuagcccugggcagucagauaucuugcucacagcggcacagggcacugucagaaaggccggagcucuggccgugaaaaauuucuuagugcauaagaaaaacaagaaagucgagagugcaaccaggcguaaguggaaacacuacuggguuucccugaagggcuguacacucuuuuucuaugaaucugacgggcggagcggaauugaucauaauuccaucccaaagcacgccguguggguagagaacucaauugugcaagcuguccccgagcauccgaaaaaggacuuuguguucugccuuagcaauagucugggugaugccuucuuguuucagaccacuucucagacggaacuagagaacuggaucacagcaauacacuccgcgugugcuaccgccguugcacgacaccaucacaaagaagacacucugagacuccuuaagagcgagauuaaaaagcuggaacagaagaucgacauggaugagaaaaugaagaaaaugggcgagaugcaacugucgucagugaccgacucuaagaaaaagaagacaauuuuggaucagaucuucgucugggaacagaaucucgagcaguuucaaauggaccuguucagguuucgcugcuacuuagccagucugcagggaggagaacuaccuaaccccaaacggcuccuggcuuucgccuccagaccaaccaagguggcaaugggcaggcuugguaucuuuagcguaucuagcuuccaugcuuugguugccgcgcgcacuggggagacaggcgugcgacggcguacgcaggccauguccagaucagcuaguaaaaggcgcagccgguuuucuucccuguggggacucgauaccacuucaaagaaaaagcagggcagaccuaguauuaaucaagucuucggggaaggaacagaggcagugaagaaaagccuggaggguauauuugacgauaucguccccgacggcaagagggaaaaagaggugguucuuccaaacgugcaccagcacaaucccgauugugacauuuggguacaugaauauuucaccccuuccugguuuugccugccaaacaaucagccggccuugacagucgugcgacccggggauacugcucgcgacacccucgagcugaucuguaagacgcaccaguuagaucauucugcccacuaccugcggcuaaaauuccucauagaaaacaagaugcaacuguauguuccucagccagaggaggacauuuacgaacuuuuguacaaagagaucgaaaucugccccaaggugacccagucgauucauaucgagaaaagcgacacagcagcggauacuuauggauucucacuguccagugucgaggaagacggcauuagaaggcucuacgugaacucuguaaaagagaccggucuggccagcaagaaaggguuaaaggcuggcgaugaaauacuggagaucaauaaccgugccgcagacgcucuuaauuccucaauguugaaagauuuucucucucaaccuagccugggacuacuggugcgcacauauccagaacucgaggagggcguugaacugcuugagagucccccgcaccgggucgacgggccugccgauuugggagaauccccacuggcauucuuaacuagcaaccccggccacucucucugcucagagcaggguuccagugccgaaaccgcuccugaggagacggaagggcccgaccuggagagcucggaugaaacagaccauucuuccaagagcaccgaacagguggcggccuuuuguagaucacuucacgaaaugaauccaagugaucagucuccuagcccccaagacuccacuggaccacagcuggcaacaaugaggcaguugucagaugcugacaagcuccgaaaagugauuugcgagcugcuagagaccgaacggacuuacgucaaggaccugaacugucucauggagcgcuaucugaaaccgcuucagaaggaaaccuucuugacacaagaugagcuggacguuuuauuuggcaaucucacggagaugguggaguuccagguggaguuucugaaaacccuugaagaugguguaagacuggucccugaccuagagaagcucgaaaagguggaucaguucaaaaagguucuguuuaguuugggcgggagcuuccuguacuaugccgacagguuuaaauuauacuccgccuucugcgcuucucauacuaaggugcccaaaguccucgugaaggcaaagacagauaccgccuuuaaagcguuccuggacgcucagaacccaaagcaacagcacagcuccacacuugagucauaccugaucaaacccauccagcggauuuugaaguauccucuccugcuacgagagcuguucgcccuuacugaugcagaaucugaggaacauuaccaccucgacguugccauaaaaaccaugaauaagguggcuagucacaucaacgagaugcaaaagauucaugaagaguuuggagcaguauucgaucagcugaucgccgagcagacgggcgaaaagaaggaggucgcggacuugucgaugggggaccuguuacuccacacaaccgugauuuggcugaauccacccgcuagccuuggaaaauggaagaaagaaccugagcuggccgcauuuguguucaagacugccgucguuuugguguauaaagauggcuccaagcagaagaaaaagcucguagguucucauagacugucaaucuacgaagacugggauccguuucgcuucaggcacaugauaccaaccgaggcucuacaagugcgugcccuggcaagcgcugacgccgaggcgaacgccgucugugaaaucgugcacguuaaauccgagagugaagggcggcccgagagaguguuucaucuuugcuguucuagcccugagucaaggaaggauuuccucaaagcaguccacuccauucugcgcgacaagcaucgaagacaguuguuaaagacagaaagucugccaagcucucagcaguaugugcccuuuggaggcaaacggcucugcgcucugaagggugccaggccugcuaugucccgcgcaguuucagccccgagcaaaucgcuuggccguagacggaggcgccuggcccgaaauagauucacuaucgauucugacgcugugagugcguccagccccgagaaggaaucacaacagccaccugggggaggcgauaccgaccggugggucgaggaacaguuugauuuggcacaguacgaggagcaagacgauauuaaagaaacagacauccuauccgacgaugacgaguucugugaaucuguaaagggggccagcguggauagggaccugcaggagcgccuccaggcuacgaguauaucccagagagaaaggggacggaagacccuggauagccacgccucucguauggcacaacuuaaaaagcaggccgcuuuaucaggcauuaacggugggcuggagagugcguccgaggaaguuaucugggugcgccgagaggacuucgcccccagcagaaaacucaauacugaaauuuga

SEQ ID NO: 63788 - RNA, 5106 nt, Artificial Sequence
  derived and/or modified sequence opt3 from TIAM2__Homo_sapiens__NP_036586
augggcaacagcgacucccaguacacccugcaagggucuaagaaucacucaaacacaaucacuggagccaaacagauucccugcagucucaagauaagagguauccaugcuaaagaggaaaagagccuucacggcugggggcauggauccaauggcgcagguuauaaaucuaggucgcuggcccggucauguuugagccacuucaagaguaaccagccuuacgcgucccgcuuagggggaccaacgugcaaggugucucgaggcgucgcuuauagcacccaucguacaaaugccccgggcaaagauuuucaggggauuuccgcagccuucucaacugagaacggauuucacaguguuggucacgaacuggcugacaaucauaucaccagcagagauuguaacggccaccuacucaauugcuacgggaggaacgagucuauugcauccacacccccuggagaagaccggaagucaccacgcgugcugaucaaaacccuuggcaagcuggaugguuguuugagaguagaguuccauaaugggggaaaccccagcaaagugccugccgaggacugcagugaaccaguccaacuccugagguauucucccacucuggcuuccgagacaagcccugugccagaagcccggcgcggcucgucugcggauucccucccgucacaccgacccaguccuaccgacagcagauuaagguccucuaagggcagcucacugaguuccgagagcucuugguacgauucaccaugggggaaugcaggagagcuuagugaagccgaggguagcuuuuuggcucccggcaugccugacccaucccugcacgccucuuuccccccgggggaugcaaagaaaccuuuuaaccagucgagcucccuaucaagucuccgggaacuguauaaggacgcuaaucuuggaucucugagccccuccggcauacguuugucagaugaguacauggguacgcaugccagccucucuaaccgcguuuccuucgcgagugacaucgacgugccaagcagagucgcccacggggauccuauucaguacucuuccuuuacucugcccuguaggaaaccaaaggcauucguggaagacaccgcuaaaaaggauucauuaaaagcccggaugcgacgcaucagugacuggacaggcagccugucgagaaagaagaggaaacuccaggagccccgguccaaggagggaucugauuauuuugacagccgcucagauggccuuaacacugacguacaagggaguucccaggcuucugccuuccuguggagcggagguuccacccagauuuugucacagagaagcgaaaguacacaugcaaucggcucugauccucuaaggcaaaauauauacgagaacuuuaugcgugaacuggagaugucccggaccaauacggaaaacauugagacuagcacagagaccgccgaaucgucaucugagagucucuccagccuggaacagcuugaccuguuguucgagaaagaacaggggguugugcgaaaggcuggauggcucuucuuuaaaccacuggucacugugcaaaaggagagaaaguuagagcugguggcgaggcgcaaauggaagcaguauugggucacacuaaaaggcugcacccuccuguucuacgaaacguaugguaagaauucuauggaucagagcuccgcaccgcggugugcccuuuuugcugaggacucaaucguucagagugugcccgaacacccuaaaaaggagaacguauucugcuugagcaauucuuuuggggacguguaccuguuccaagccaccucccagacagaucucgagaacugggucacugcagugcauucagccugugcuagucuguuugccaagaaacacggcaaggaagacacccuuagacuguugaaaaaucagacaaagaaccuccugcagaaaauugauauggacagcaagaugaagaaaauggcagaguuacaacuguccguugugucugauccaaagaauaggaaagcgaucgaaaaccagauccagcagugggagcaaaaucuagaaaaguuccacauggaccucuuucgcaugcgaugcuaucuggcuucgcuucagggaggcgaguugcccaacccuaaaagccugcucgccgcagccucacggccauccaagcuggcuuuagggcgucugggaauucuuagugucucuagcuuccaugccuuggugugcuccagagaugacucagcacucaggaaacgcacucugucucuaacccagcgggguagaaauaagaagggcauauuuagcagucugaaagggcucgauacacuggcuaggaagggaaaagagaagcgacccuccaucacccagguagacgaacuuuugcacauuuacggcagcacuguugauggugugccgcgcgacaacgccugggagauccaaacguacguccauuuccaggauaaccacggggugacagucggcauaaaaccugaacaccggguggaggacauucugaccuuagcguguaagaugagacagcucgaaccaucucauuauggacugcaacuuaggaagcugguugacgauaauguggaguacugcauccccgccccuuaugaguacaugcagcagcagguauaugacgaaaucgaggucuuucccuugaacguguacgauguucaacucacuaaaaccggcucagugugugacuucggguucgcugucacagcacagguggaugaacgucagcaccugucccgcauuuuuaucagugacguacuaccagauggacuggccuauggcgagggucuccggaaggggaaugaaauuaugacccugaacggagaggcugugagcgaccuugauuugaaacagauggaggcccuguucucggaaaagucuguuggcuuaacucucauagcaagaccucccgacacaaaagcgacgcugugcaccuccuggagcgauucagaccuuuuuaguagggaucaaaagucucugcuaccaccgccuaaucagucccagcuccuggaggaauucuuggacaacuuuaagaaaaauacugccaacgacuucagcaauguccccgauaucacaaccggucugaagcgaucacagacagacggcacuuuagaucaagugagucaucgggagaaaauggagcagaccuuucgcagcgcugaacagauuacggcccucuguagauccuucaacgacucucaagcaaaugggauggagggaccaagggaaaaccaggaucccccuccacggccccuggcucgacaccuuagcgacgccgauagacugcgcaaggugauccaggaguuggucgacaccgaaaaauccuacguuaaggaucucucaugccuguuugagcuauaccuggagccucuucagaaugaaacauuccucacucaagacgagauggaaucucuguuuggcaguuugccggagaugcuggaauuccagaagguguuuuuagagacccucgaggaugggaucucggcaagcuccgacuucaacacacuggaaacuccaucucaguucaggaaacuucuguuuucauugggaggcagcuuccucuauuacgccgaccauuuuaagcuguauuccgguuucugugcuaaucacauuaaagugcagaagguacuagagcgugcgaaaaccgauaaggccuuuaaagcauuccuggacgcucggaaccccacgaagcaacacaguucuacacuugaaagcuaccucauaaagccuguccagagagugcugaaauauccauuguuacugaaggagcucguuucacugaccgaucaggaauccgaggagcauuaccaccuuacugaagcccugaaagccauggagaagguggcuagucauaucaacgaaaugcagaaaauuuaugaggacuacgggacagucuuugaucaauugguggcagagcagagcggaaccgaaaaggagguuacugaacuaucuaugggcgagcugcucaugcacuccaccgugucauggcugaaucccuuccuuagcuuagguaaggccaggaaagaccuggaacucacaguauuugucuucaagcgcgcggugaucuugguguacaaagagaacugcaagcugaaaaagaagcucccuucgaauucucgaccggcucauaacaguacggaucuggaccccuuuaaauucagauggcuuauuccaaucuccgcccugcagguccgguugggcaauccugcagggaccgagaacaauagcauaugggaacuaauccacacuaagucagagauugaaggaaggcccgagacaaucuuccagcuguguugcuccgauucugaaagcaaaaccaacauuguuaaggugauccgcaguauacuccgugagaauuuuagacggcacauuaaaugugaguuaccacuggaaaagacaugcaaggacaggcuuguaccucugaaaaaccgcgugcccgucuccgccaagcucgcuagcucucgaucauugaaagugcugaagaauaguuccagcaacgaguggacuggcgaaaccgggaaaggaacgcuccuggauucugacgagggcucgcuuucaagcgguacacaauccagugggugcccaaccgcagaaggaagacaggauucuaagagcacuuccccgggcaaguauccucaucccggucuagccgacuucgcggacaaucugaucaaagagucagauauuuugagugacgaggaugacgaucaccggcagaccguuaagcaaggcucuccaacaaaagacaucgaaauacaguuucagagguuacgcaucagcgaggaucccgacgugcauccugaagcugagcagcaaccagggcccgaguccggagaaggccagaaggggggagagcagccuaaacuggucagaggccacuucuguccgauuaagaggaaagccaacucaacuaagcgggaucgugguacccuccugaaggcacagauccgccaccaaagccuugacucucaguccgaaaaugccacaauugaucugaacagugugcucgagcgagaauuuagcguucagucguugacguccguggucucugaggagugcuucuacgaaaccgagucacaugggaaaagcuga

SEQ ID NO: 63789 - RNA, 2139 nt, Artificial Sequence
  derived and/or modified sequence opt3 from TICAM1__Homo_sapiens__NP_891549
auggccugcaccggccccagccugccuuccgcuuucgacauccucggggcagccggacaggauaagcugcuguacuugaaacacaaguuaaaaacaccaagaccggguugucaaggccaggaccugcuacaugcgauggugcuccugaaacuugggcaggagacugaagcuaggauuucucuggaggccuugaaggcagaugccgucgcucggcucguugcacgccagugggccggaguggacucaacggaagaucccgaggaaccuccagacguaaguugggcuguggcccgacuguaucaccuucucgcggaggagaaguuaugccccgcaagccugcgugaugucgccuaccaagaagcugugagaacccuuuccucuagggacgaucaucgguugggcgagcugcaggacgaagcccgcaacagaugugguugggauauagcaggggacccuggaucgaucaggacacuacagucaaaucucggcugccugccacccagcagugcccuuccuuccggcacucggucucugccacgcccgauugaugggguuagcgacuggucccagggauguucauugcgaaguaccgguagccccgcuucucucgcguccaaccuggagaucucacaaagcccuacaaugccauuuuuaagucugcacagaucuccccauggcccuuccaagcucugcgacgauccacaggccagccuugugcccgagccggucccugggggaugucaggaacccgaggaaaugucguggccaccuucuggcgagauugcauccccuccagaacugcccucaaguccuccaccggguuugcccgagguggcuccugacgccaccagcacugggcuaccagauacacccgcugccccugagaccuccacgaauuauccaguagaaugcacugagggaucugcaggcccccagagccugccgcucccuauccuggaaccaguuaaaaaccccuguucagugaaggaccaaaccccucuucagcugagugucgaggauacaacuucccccaauaccaaaccaugcccucccacaccaaccacgccggaaacuagcccucccccacccccuccacccccuucuucaacaccguguagugcccacuugaccccaagcucccucuuccccucuucgcuggagagcuccucagagcagaaguuuuacaacuucgugauauuacacgcuagggcggacgaacauaucgcacugcgggugcgugagaaacuagaagcccucggcgucccugauggggcuacuuuuugcgaggacuuccaaguuccaggacgcggugaacugaguugccuucaggaugccauugaccacucugcauuuaucauuuugcugcucacaagcaauuucgauuguagacugucccuucaucaggugaaccaggccaugaugucaaaucugaccaggcaaggcagccccgacugcguaauccccuuuuugccgcucgagucuucccccgcucagcugaguagcgacacggccucuuuacuguccgggcuagugcggcucgaugagcacucacagauauucgcacgaaaggucgcgaacaccuuuaagccacaccgccugcaggcuagaaaagccauguggaggaaggaacaagacacacgggcacuucgcgagcagagucagcauuuggauggagaaagaaugcaggccgcugcccugaaugcagcuuauagcgccuaccuccaaucguaucuguccuaccaggcgcagauggagcaguuacaaguggccuucggcucucacaugagcuuugguacuggggcuccuuacggcgcaaggaugcccuucggaggccagguuccacugggggccccucccccauucccgaccuggccuggauguccccagccacccccucuucaugcuuggcaagccgguacaccacccccuccgucaccacagcccgcagcguuuccucagaguuugcccuucccacaguccccugccuuucccacugcuucuccagccccuccgcaaagccccggccuccagccacugauuauccaccaugcacagauggugcagcuagggcugaacaaucacauguggaaccaacguggaucccaggcuccugaggacaaaacccaggaagccgaguga

SEQ ID NO: 63790 - RNA, 708 nt, Artificial Sequence
  derived and/or modified sequence opt3 from TICAM2__Homo_sapiens__NP_067681
augggcaucggaaagagcaaaauuaacuccugcccccugucucucucaugggggaagagacacaguguggacaccagcccugguuaccaugaguccgauucuaaaaagucggaagaccuuucacuguguaaugucgccgagcacagcaacacaacugaaggcccaacggggaaacaggagggagcucaaaguguugaagagauguucgaggaagaggcagaagaggagguguuuuugaaguucguaauauuacaugccgaagaugacaccgaugaggcgcugagggugcagaaucuacuccaggacgauuuuggcaucaagccggguauuaucuucgcugaaaugcccugcgggcggcagcaucugcaaaaccuugacgaugccgucaauggauccgcauggacaauucuguugcucacugagaacuuucugcgcgacaccugguguaauuuccaguuuuauacaucucugaugaacagcgugaaucgacagcacaaauacaacuccguuaucccuaugcguccacucaauaaccccuuaccuagagaaaggaccccauucgcccugcagacuauaaaugcucuugaggaggaaucacggggcuuucccacacaaguggagcgcaucuuccaggaaagugucuauaagacccagcagacgauuuggaaagagacuagaaacauggugcaaaggcaguuuaucgcauga

SEQ ID NO: 63791 - RNA, 5733 nt, Artificial Sequence
  derived and/or modified sequence opt3 from TICRR__Homo_sapiens__NP_689472
auggcaugcugucacaaggugaugcugcuccuugauaccgcuggcggggcagcccggcauagcaggguccggcgcgcggcucugcgauuguuaacauaccuguccugccguuucgggcuagccagaguucacugggcauuuaaauucuuugauucucagggugccaggucacggccaagucgcgugagcgacuucagagagcucggcuccaggucuugggaagauuuugaggaggaacuggaagcucggcuugaggaccgcgcacaucugccugggccagccccgcgagcuacucacacgcauggagccuugauggagacccuccuggauuaucaaugggacagacccgaaauaacaucgccuacuaagccaauucugaggucaagcggccggcgucucuuagauguagagagugaagcgaaagaggcagaggccgcucugggugggcuugugaacgccgucuucuugcuggcacccuguccucacucccagcgcgaacuacuccaguuugugucuggaugcgaggcucaggcccaaagacugccacccaccccuaagcagguuauggaaaaacuucugccaaagagggugcgggaggucaugguggcgcgaaagauaacauucuacuggguagacaccacugaauggagcaaauugugggaguccccggaucaccucggcuauuggacaguuugugagcuguuacaucacggcgggggaaccgugcugcccucagaaaguuuuagcugggacuucgcccaggccggugagaugcuccuucgcucuggcaucaagcuguccucagaaccucauuugagcccauggauuaguaugcuacccacggaugcuacucugaauagacuccuguacaacucuccugaguaugaagccuccuuuccaaggauggaggggaugcuuuuccugcccgucgaggcuggaaaagaaauccaggagaccuggacagugacuuuggaaccgcucgccaugcaccaacggcacuuucagaagccugugcgcauuuuccugaaaggcagcgucgcacaguggucguuacccaccucuuccacacuggguaccgacucauggaugcuagggaguccagaggaaagcacggccacucagagacuccuguuccaacagcuuguuuccagguugacagcugaggagcugcaucucguggcggauguagacccuggagaaggccgucccccaaucaccggcgugauaucuccccugagcgcaucagccaugauccuuacugucugccggacaaaggaggcugaauuucagcgacacgugcugcaaaccgccguugcagacaguccuagagauacggccuccuuguucagcgacguggucgauucuauucucaaucagacccaugacucacuggcugauacagccagugcagcgagcccagugccggagugggcucagcaggaguuagggcacacuacccccugguccccugccguaguugaaaagugguuuccauucuguaacaucucuggagcaucgagcgaccugauggaguccuuuggucuacuccaagccgcuucagccaauaaagaagagaguucuaagacagaaggcgagcugauucauugccuugcagaguuguaccagaggaaaagccgcgaagaguccacuaucgcucaccaggaagauucaaagaaaaagagaggggugcccagaaccccugucaggcagaaaaugaacacaaugugucgcagccugaagaugcucaauguggcccgacugaacgucaaggcgcaaaaauuacacccagacggaucucccgauguggccggcgagaaggguauacagaaaauuccguccgggcggaccguugacaagcuggaagaucguggcagaacucuuaggaguagcaaaccuaaggacuucaagacggaggaggaauugcucucuuauauccgcgagaauuaccagaaaacaguggcuaccggagaaauuaugcuguacgcaugcgcccggaacaugaucuccacuguaaagauguuucuaaaaucaaagggcaccaaagagcuggaagucaauugucucaaccaggugaagaguagccugcuuaagacaucgaaauccuugagacaaaaucuggggaagaaauuagacaaggaggauaaaguuagggagugccagcuccagguguuccugcgacuugaaaugugccugcaguguccaucuaucaacgagagcaccgacgauauggaacaagucguggaggagguaacugacuugcuccgcauggugugccugacagaagauucagcuuaucuagccgaguuucuggaagagauucuccggcuguacauagacaguauccccaagacgcuuggaaauuuguauaacucccuggguuucguuauuccucagaaguuagcaggcguccuccccaccgacuuuuucucugacgauagcaugacucaggaaaacaaauccccacugcuuucagugccuuuucugagcagugcgagaaggucuguguccgggagccccgagucggacgagcuacaagaacuccguacacgcucagccaagaaacggagaaagaaugcucugaucaggcauaaaucuauagccgaggucagucagaacuugcgacagauugaaaucccaaagguuuccaaacgggcaaccaagaaggagaauagccacccggcuccucagcaacccucucagccagugaaagauacagugcaggaaguaacuaagguccgcagaaaccuguucaaucaggaguuacucagccccuccaaaaggucacugaagcggggacuuccucgaagucauagcgugucugccguugacggccuggaggauaaauuggacaacuucaagaagaauaaagguuaccacaagcuccugaccaaauccguggcagaaacgccaguccacaagcaaaucucaaaaagacuacugcaucgccagauuaaggggaggaguagcgaccccggcccugauaucggagugguugaggaauccccggagaagggcgacgaaauuucucuucgucggucgccaagaauaaaacagcucagcuuuucaaggacccacuccgccaguuucuauucugugagccagcccaagucccgcucaguacaacgaguccauucuuuucagcaggauaaaagcgaccaaagagagaacaguccugugcaguccauccggagcccaaagucucuguuguucggggcuaugucagagaugauuucccccagugaaaaaggaagcgcgaggaugaagaagcgcucgcguaauacacuggauucugaggugccugccgcauaccagacuccgaaaaagucccaccaaaagagcuuaucauuuaguaagaccacacccagacggaucucucauacuccacagaccccucucuauacgcccgaaaggcugcagaaauccccagcuaagaugacaccuaccaaacaggccgccuucaaggagagccuuaaggacucaaguagccccggucacgauuccccacuggacucuaaaaucacuccgcagaagcgccacacacaagcuggcgaggggaccagcuuggaaacuaaaaccccucgaacacccaagagacagggaacgcagccacccggcuuucucccuaacuguaccuggccacauuccgucaauucaucucccgagaguccuucgugcccggcaccacccacuagcuccacagcccagccucggagggaaugucugacccccauucgcgauccacuaagaacaccucccagggcggcugccuucauggguacuccacaaaaccagacccaccagcagccucauguucugcgggcagcccgugcugaggaaccggcacaaaaacuuaaggacaaggccauaaaaacgcccaagcgcccaggaaauucuacagugaccucaagcccucccguaacucccaagaaacucuuuaccuccccucugugcgaugugaguaaaaagucucccuuccgaaagagcaaaaucgaguguccgucaccaggcgaguuggaccagaaggaaccucagaugucccccagugucgcggcuagcuuaucuugcccagugcccuccacaccuccggagcugucacaaagagccacucucgauaccguucccccaccucccccuagcaaagugggaaagaggugucggaaaacaucggacccacgcagaucuauugucgaaugccagcccgacgcaagugccacgccuggcguggggaccgcugauuccccagccgcacccacugacagcagggaugaccagaagggacugucacuuuccccgcagucuccuccagagcggcgaggcuaccccgguccugggcugagaagcgauuggcacgcuaguuccccauugcuaaucacaagcgacaccgaacauguuacucugcucucugaggccgagcaccacggaauuggcgaucugaagucaaacgugcuuagugucgaagagggugaaggcuuacgcacagcggacgccgagaaauccagccugucucaucccgggaucccgccuucgcccccaucauguggaccuggcagcccccucaugccauccagggauguacacugcaccacggacgggcggcaaugccaggcaagugcucaguuggauaaucugcccgccucugcuuggcauagcacugacuccgcaucaccucagaccuacgaaguggagcucgagaugcaagccaguggacugccaaaacuucguaucaaaaagaucgacccgucuagcucccuggaagccgagcccuugucaaaagaagagagcucucuaggcgaggaauccuuucugccugcucucaguaugccaagagcgagcaggucguuauccaagcccgagccuacauauguuucuccacccuguccucgccugucacacagcaccccggguaagagucgggggcagacuuacauuugccaggcauguacaccaacccacggacccuccucuacaccuagccccuuccagacugauggcgugccauggaccccuucacccaaacauuccgguaagacgacaccagacaucauuaaagauuggccgcgaagaaagagggccgucggcugcggggcuggaaguagcucuggccgcggggaagugggagccgaccuuccuggcucacugucccucuuggagagcgaagguaaagaucacgggcuggagcucucuauccaucggacccccauacuggaggacuuugaacuugagggaguaugucaacuaccagaucagagucccccuagaaacucgaugccaaaggcagaagaggccuccagcuggggccaguucggucugucaucucguaaaaggguguuguuagcuaaggaagaggcggaccggggcgccaagcgcauuugcgaucugcgagaggacagcgaagucuccaaaaguaaggaggggucacccucuuggagcgcauggcaacucccuuccacuggagaugaagagguuuucgugaguggcagcaccccgccacccuccugugcugugagaucuugccugucagccagcgcacuucaggcccugacacagucgccucucuuguuucaggggaaaacuccauccagucaaucuaaggaccccagggaugaagacgucgacgugcugccuagcaccguugaggauucacccuucucccgggcuuuuucucgcagaaggccaaucagucgaacguauacacggaaaaagcuaaugggaaccuggcuggaggaccucuga

SEQ ID NO: 63792 - RNA, 555 nt, Artificial Sequence
  derived and/or modified sequence opt3 from TIFA__Homo_sapiens__NP_443096
augaccagcuucgaggacgccgauacagaagagacugugacgugccugcagaugaccgucuaccaccccggccaacuccagugugggaucuuucaguccauuucuuucaacagagaaaaguuaccuucaagugagguugugaaauuuggaaggaauagcaacauaugccauuauacauuccaggacaagcaaguaucccgggugcaguuuucucugcaguuguucaaaaaguuuaauucgucaguccuuagcuucgaaaucaaaaacaugaguaagaagacuaaucugauuguggauucccgcgagcuagguuaccucaacaaaauggaccugccauaucgauguaugguucguuuuggcgaguaccaguuccuuauggaaaaggaggauggggaaucucuggaguuuuucgagacccaauuuaucuugagcccgagaucccuccugcaggaaaauaacuggcccccucacaggccaauucccgaguauggaacauacucacugugcaguagccagucuuccucaccuaccgaaauggacgagaaugaaagcuga

SEQ ID NO: 63793 - RNA, 1578 nt, Artificial Sequence
  derived and/or modified sequence opt3 from TIGD2__Homo_sapiens__NP_663761
augcugggcaagagaaaaagagugguccucaccaucaaggacaaacuugauauuauaaagaaacuggaggaagggaucagcuucaagaaguuguccguuguguacggaauuggugagucuacaguacgggacaucaaaaagaacaaagaacgcauuaucaauuaugccaacucaagugaucccacuagcggcguguccaagcgaaaaucuaugaagucgucaacguacgaggaauuagaccgugucaugauagagugguuuaaucagcaaaagaccgaugggaucccugugagcggaacaauuugcgcuaaacaggcaaaguucuuuuucgacgcccugggcauggagggugauuuuaacgcgaguuccggguggcuaacuagauucaaacagaggcacggaaucccaaaggcugccggcaaaggcaccaagcucaaaggggacgaaacagcagcccgggaguuuuguggaucuuuccaggaauuuguugagaaggagaaucugcaaccggaacagauuuauggugcugaucagaccggccuuuucuggaagugccugcccagccgcacuuugacacucgagaccgaccaguccacgucaggguguagaaguagcagggaacggaucauaauuaugugcugugcaaacgccacuggacugcauaaacugaaucucugcguggucggcaaggcuaaaaagccucgcgccuuuaaagguaccgauuuaucuaaccugccagugacauacuauucccaaaagggggcguggaucgagcagucaguauuccgacagugguuugaaaaguacuucguuccccaggugcaaaaacaccuuaagagcaaaggauugcuggagaaggcaguccuacuccuggacuucccuccagccagacccaaugaggaaaugcuuaguucugaugacggcaggauuaucgugaaauaucugccuccaaacgugacuuccuugauccagccgaugagccagggcguccucgcuaccguuaagcgguacuaccgugccgggcuguuacaaaaguauauggacgagggaaaugaucccaaaauauuuuggaagaaccugacagugcucgacgcaauuuacgaaguaucgcgcgcuuggaauauggugaaaucuuccaccaucacgaaggccuggaaaaagcuguucccugguaacgaggaaaauucaggcaugaacauugaugagggggcgauccuugccgcaaacuuggcuacuguccuacagaauacagaggaaugugagcauguggacauagaaaacauugaucagugguuugacaguagaagcuccgauucuagcugccagguucugaccgacucagagagugccgaagaucaaacuaaggcugccgagcagaaaccauccagcaagucuaggaaaacagagcucaaucccgaaaagcacaucucacauaaagcagcccuggaguggaccgaaaaccuucuggacuauuuggagcagcaggaugacaugcuccugagugacaaguuagugcugcggcgacuacgcacgaucauuaggaaaaagcaaaagauccagaauaacaaaaaucacuga

SEQ ID NO: 63794 - RNA, 735 nt, Artificial Sequence
  derived and/or modified sequence opt3 from TIGIT__Homo_sapiens__NP_776160
augagauggugccugcuccuuaucugggcccagggccugaggcaagcucccuuggcaagcgggaugaugaccggaacaauugagacuacggguaacauauccgccgaaaagggcgggucuaucauuuuacagugucaccugucaaguaccacagcucaggugacucaggucaauugggagcaacaggaccagcuacucgcgaucugcaacgccgaucugggauggcauauuagcccuuccuucaaagaccggguugcaccaggcccgggucuugggcugaccuugcagucucucacagugaaugauaccggagaauacuuuuguaucuaucacacuuaccccgacggcacauauaccggccgcauauuccuggagguacuggaaucgucaguggccgagcauggggcucgauuucaaaucccucucuuaggagcaauggccgcuacgcuggucgugauuugcacugccguuaucguggucguggcgcuuacccguaagaaaaaggcauugaggauucacagcguagagggugaucugagacggaaaagugccggccaggaagagugguccccaucugcucccagcccuccaggguccuguguucaggccgaagcagcucccgccggacuaugcggcgagcagcgcggugaggacugugcggaacuccaugauuacuucaacgugcugucauauagaagucuugggaauugcagcuuuuucacagagacuggauga

SEQ ID NO: 63795 - RNA, 1053 nt, Artificial Sequence
  derived and/or modified sequence opt3 from TIMD4__Homo_sapiens__NP_001140198
augagcaaggagccccugauccucuggcuuaugauugaguucugguggcuguacuugaccccugugacauccgaaacugucguuacggaaguguuaggccacagaguaacccugccaugccuauauucuucauggagucauaacagcaauuccauguguugggggaaagaccagugcccguacucuggauguaaggaggcccucauaaggacagaugguaugcgggugacuucgcgcaaaucagcuaaguaucgacugcaaggcaccaucccccguggggacgucagccuuacaauucugaacccuagugaauccgauucuggaguguacugcuguagaaucgagguuccaggcugguuuaaugacgugaaaauuaacgucagguugaaucuccagcgggcaagcaccacuacacaccgcaccgccacgacuaccacaagaaggacuaccacaaccucccccacgacuacacggcagaugaccacuaccccugcggcucugccaacaacggugguaaccacacccgaucugacuaccgguacaccucuccagaugacuaccaucgccguuuucacaaccgcaaacacuugcuuaucacugacgccaaguacacuuccggaggaagccaccggguugcugacucccgagccuagcaaggaaggaccaauacuaaccgcugagucugagacagugcuccccuccgacucauggagcagugucgaaucuaccuccgcagauacugugcugcuuacaagcaaggccucggacacggcugugccugagcaaaauaaaaccacuaagacaggccagauggauggcaucccaaugucuaugaaaaacgaaaugcccauuucccagcuguugaugaucauugccccgucacucggguuuguccuguucgcguuauuuguugcauuccugcuccgcggaaaacuuauggagaccuauuguagucagaagcauacacgacuggacuacaucggugauagcaagaauguguugaacgacguacaacacggcagagaagaugaggacgggcuauuuacucuguga

SEQ ID NO: 63796 - RNA, 3627 nt, Artificial Sequence
  derived and/or modified sequence opt3 from TIMELESS__Homo_sapiens__NP_003911
auggaccugcacaugaugaacugcgagcuccuugccaccuguagcgcucugggcuacuuggaaggggauacauaucauaaggagcccgacugcuuagaauccgugaaagaucugaucagauaccuaaggcacgaggacgaaacucgggauguccgccagcaacucggagcagcccagauucugcagucugaccuucugccuauauugacgcagcaucaccaagauaagccacucuucgacgcgguuauccgacugauggugaaucugacccagccggcucucuuauguuuugguaaccugcccaaagagccuucauuccgucaucacuuucuucagguauugacauaucugcaggccuacaaggaggcauucgccagugaaaaggcuuuuggcgugcuaagcgagacucucuaugaacugcuucaacuggggugggaggagagacaggaagaggauaauuugcucauugaaaggauccuguuacugguccggaacauucuccacgugccagcagaccuugaucaggagaaaaagaucgacgaugacgccuccgcucaugaccagcuguugugggccauacaccuaucuggacuggaugaccuccugcuuuuccuggcgucgucaagcgcagaagaacaauggaguuugcauguucucgagaucgugucccugauguuucgcgaucagaaucccgaacaguuagccggcgucggucaagggagacuggcucaggagaggucugccgacuucgcagaacuagaggugcuccggcagcgcgaaauggcugagaaaaagacccgagcccugcagagaggaaacaggcacagccgguuuggcggcuccuacauuguacaagggcuuaaaucaaucggagagcgugauuugauuuuccacaagggucugcauaaucuccgcaacuauaguagcgaccugggcaaacagccuaagaagguuccaaaaagaaggcaggcggcccgggaacuuucuauccagcgacgcuccgcacugaaugugagauuguuucucagggauuucugcucagaguuucuggaaaacuguuacaaucgguuaauggggagcgucaaggaccaucugcuacgcgagaaagcucaacagcacgaugaaacauacuauaugugggcccucgcuuucuucauggccuuuaacagagcagccaguuucaggcccggacuggugucugagacccuuuccgugcguacuuuucacuucauagagcagaauuugacaaacuacuaugaaaugaugcugaccgaccggaaggaggcugcgagcugggcacgaagaaugcaucucgcccugaaggcuuaccaggaauuacuggccacggucaaugagauggauauuucgccugacgaggcaguuagggaaucuucccgcaucauuaaaaacaacaucuuuuaugugauggaguaccgggaacuuuucuuggcccucuuuagaaaauucgacgagaggugccaaccacgcucauuucugcgagaucuaguagaaacuacccaccuguuccucaagaugcuggagcgguuuugucguaguagaggcaaucuugugguccagaacaagcagaaaaagaggcgcaaaaagaaaaagaagguguuggaccaggcuaucguuagcgguaaugugccguccucucccgaggaagucgaggccguguggccugcacuggcggaacaauuacagugcugugcucagaacagcgagcucucaauggauaguguaguuccauucgacgccgcauccgaagugcccgucgaggagcaacgggccgaagcuauggugcggauucaggauugccugcuugccgggcaggcaccucaggcucugacauugcucaggagcgcccgagaggucuggccagaaggagacguguuuggcucucaagauauaucacccgaggaagagauccagcugcuaaaacagauucugagugcgccgcucccucgccagcaaggccccgaggaaagaggggccgaggaagaggaggaagaggaagaggaagaggaggaggagcugcagguugugcagguaagcgaaaaggaguucaauuuccuugacuauuugaaaagauuugcuuguuccacugucgugagggcauacguucuguuacuccguucuuaccagcaaaacucggcccacaccaaucauugcaucgugaagaugcugcaccgccuugcucaugaucugaaaauggaagcccuacucuuccagcugagcgucuuuugcuuguucaaccggcuguuauccgacccagcagcgggagccuauaaggagcucgugacauuugcuaaguacauacuggguaaauucuuugcccuugcagcuguaaaucagaaggccuucguggagcuguuguuuuggaaaaacaccgcaguugucagagaaaugacggagggcuaugggucacucgaugacaggaguucuagccgacgggccccuacuuggucccccgaagaggaagcucaucugcgcgagcuauaccuggcgaauaaggauguggagggacaagacguggucgaagccauucuugcacaccucaacacaguuccaagaaccaggaaacagaucauccaccaccuggugcagaugggcuuggcugacucagugaaggauuuccagcggaaggguacucauauuguacuguggacaggggaccaagaguuagaacuccagcgacuguuugaggaguucagagauagcgacgauguccuuggccacaucaugaaaaauauuaccgccaagcgcucuagggcccguauaguggacaaacuguuggcucucggacugguugcagaacggagagagcuauauaagaaaaggcagaagaaacuggccuccaguauccuucccaacggcgcggaaagccucaaggauuuuugucaggaggaccuggaagaggaggaaaauuugccugaggaagauucugaggaagaggaggaagggggauccgaggcugaacaagugcaggguucauuaguccugaguaacgagaaccucggccagagccugcaucaggaaggguucucgauuccacuucugugguugcaaaauugccuaauccgcgccgcagacgaucgagaggaggacggauguucccaggccgugccgcugguuccccucacggaagagaacgaagaggcuauggagaaugaacaguuccagcaacugcuuagaaaguuaggcgugcggccuccagcaucuggucaggagaccuuuuggaggauccccgccaaacugagcccuacacagcuccgccgugcggcugccucauugagucaaccagaagaggaacagaagcugcagcccgagcuccagccgaaaguaccuggggagcaaggcuccgaugaggaacacugcaaggaacacagagcacaggcccugcgggcccuucuguuggcucauaaaaagaaggcaggacuagcuucuccagaggaagaggacgccgucggcaaagagccccugaaggcggccccuaaaaagaggcagcucuuagacagcgaugaggaacaggaagaggacgaagggcgcaaccgagcacccgagcugggagcuccagguauucagaaaaagaagagauaccaaauagaggaugacgaagaugacuga

SEQ ID NO: 63797 - RNA, 273 nt, Artificial Sequence
  derived and/or modified sequence opt3 from TIMM10__Homo_sapiens__NP_036588
auggacccccugagagcccagcaacucgcugcagagcuugaaguggagaugauggccgauauguacaacaggaugaccagcgcgugccaccggaagugugucccuccacauuauaaagaagcugagcuguccaagggcgaaucuguuugcuuggaccgcugugugucaaaauacuuagauauccacgagcgaauggggaagaaacugacagagcuaaguaugcaggacgaggaacucaugaagcguguacagcagagcuccggaccggccuga

SEQ ID NO: 63798 - RNA, 516 nt, Artificial Sequence
  derived and/or modified sequence opt3 from TIMM17A__Homo_sapiens__NP_006326
auggaggaauacgccagagagcccugcccuuggaggaucguggacgauuguggcggggcuuucaccaugggaacaauugguggcgggauauuucaggcaaucaagggauuccggaacagcccagucggcguuaaucaccgccugcgagguucccucacugccauuaaaacgcgugcgccgcaacuugggggaucuuuugcuguguggggcggccuguucucaaugaucgacugcaguaugguacaggugagagggaaggaagaucccuggaacagcauuaccuccggagccuugacaggugcaaucuuagccgcuaggaauggcccugucgcaaugguggggucugccgcuaugggaggcauacugcuagcccucaucgagggugcggggauucugcuuacucgguuugcaucggcccaguucccaaacggaccccaguuugcugaagacccuucacaacugccaagcacccaguugcccaguuccccuuucggcgauuaucgccaguaccaguga

SEQ ID NO: 63799 - RNA, 747 nt, Artificial Sequence
  derived and/or modified sequence opt3 from TIMM21__Homo_sapiens__NP_054896
augaucugcaccuuccugagagccgugcaguacacagagaagcuccacaggagcuccgcuaaacggcuucuguugcccuauauugucuuaaacaaggcaugucugaaaacugaaccuucucuacgcugcggccuccaauaccagaagaaaacgcugcgaccacguuguauacuugggguuacccagaagacaaucuggacucagggaccgucacccagaaaggccaaagaggacgguaguaagcaagugagcguacauaggucccagcggggcgggaccgcggugccuacaucucagaaagucaaggaagcuggacgcgauuuuaccuaucugauugugguuuuguucggcaucucgauuacuggugggcucuuuuacacaaucuucaaagagcuguuuucaagcaguuccccaucuaagauauauggcagagcccuggaaaagugcaggagccaccccgaggugaucggagucuucggcgaguccgugaaaggguacggagaaguaacccggcgcggucgaagacagcauguuagguuuacggaguaugugaaggacggccucaaacacacuugugucaaguucuacauugaagggucagagccuggaaaacaaggcaccguguacgcacaggugaaggagaauccagguaguggggaauaugauuuucgguacaucuucgucgagauugaaagcuauccccgucgcacaaucauaauugaggacaacagaucucaggaugacuga

SEQ ID NO: 63800 - RNA, 585 nt, Artificial Sequence
  derived and/or modified sequence opt3 from TIMM22__Homo_sapiens__NP_037469
auggccgcugcagcccccaacgcgggcgggagcgcuccugagaccgccggauccgcagaagccccacugcaguacucucuccuucugcaauauuuggugggugacaagagacagccgagguuacuggagcccggcucacuagggggaaucccuaguccagcuaaaagcgaggaacagaagaugauugaaaaagcaauggaguccugcgccuucaaggcugcccucgcgugugucggcgguuuuguucuugggggagcauucggcguguuuacagccggcauagauacuaauguaggguucgaccccaaagauccuuaccggacgccaaccgcuaaggaggugcugaaggacaugggacagcgcgguaugucuuaugccaaaaacuuugcaaucgucggcgcuauguucucgugcacagaaugucugauugagucauaccgagggacuagcgauuggaagaauagugugaucuccggaugcauuaccggcggugccaucggguuucgugcgggauugaaagccggcgcaauaggcugugggggauucgcugccuuuucugcugccaucgacuauuaccucagauga

SEQ ID NO: 63801 - RNA, 630 nt, Artificial Sequence
  derived and/or modified sequence opt3 from TIMM23__Homo_sapiens__NP_006318
auggagggcgggggagguagcggcaacaagaccacagggggacuggccggcuucuuuggugcugggggagcaggcuacucccacgccgaccucgcgggcgugccccuuacugggaugaauccucugucuccauauuugaacgucgauccgagauacuuaguucaggacacggaugaguucauccugcccaccggagcuaauaaaacaaggggucgguuugaacuagccuucuuuacuauuggcgggugcuguaugaccggagcagccuucggcgcuaugaacggucuccgccuggggcuuaaggaaacacaaaauauggcauggucaaaaccucgaaacgugcagauacugaauaugguaacccgucagggagccuugugggcuaacacucucggcagucuggcccugcucuauagcgcguuuggcgugaucauugagaagacaagaggggcagaagacgauuuaaauaccgucgccgcuggaacgaugacugguaugcuguacaaaugcaccggcgggcuuaggggaaucgcccggggcgguuugacagggcugacucuaaccucccucuaugcacuguacaacaauugggagcauaugaagggcucucuucugcagcaaucguuguga

SEQ ID NO: 63802 - RNA, 1359 nt, Artificial Sequence
  derived and/or modified sequence opt3 from TIMM44__Homo_sapiens__NP_006342
auggccgcugcagcccugagaagcggcugguguaggugcccccggcgcugccucggguccggaauccaguuccuuucuucacacaaccugccucaugguaguaccuaccaaaugcgacguccaggcggggaguugccguuaagcaaguccuauucuucgggaaauagaaaaggcuuucugucaggucuacucgacaacgugaagcaggaacuggcgaaaaauaaggagaugaaagaaagcauuaagaaguucagggaugaggcucggcgccuugaagagagugacguccugcaggaggccagaaggaaauacaagacaauagaauccgagacuguucggacgucugaaguguugcgcaaaaagcucggggagcugaccggaacaguaaaagagagccugcacgaaguguccaagucagaucucggccgaaagaucaaagagggcgucgaagaggcagccaagacugcuaaacagagugcagaaagcgugucuaaagggggagagaaguuagguagaaccgccgcuuuuagggcccugucccaaggcguugagucagugaagaaagaaauugacgauagcguccuugggcagacaggacccuaucggcguccucagcgcuugagaaagaggaccgaguucgcgggcgacaaguuuaaagaagagaagguguucgaaccaaacgaggaggcacuggguguaguucuacauaaagauaguaagugguaccagcaauggaaagacuuuaaggaaaauaacguggucuucaaucgguuuuucgagaugaagaugaaauaugaugaaucugacaacgccuuuauccgagcuucccgcgcccucacugauaaggugacagaccugcuugggggacuguucagcaaaaccgagaugucggaaguguugacggagauucucagagucgaucccgcauuugacaaggacagguuccugaaacagugugagaaugauaucauaccuaacguuuuagaagcuaugaucucuggcgagcuggacauucucaaggauuggugcuacgaagccacuuauucccagcuugcgcacccaauccagcaagccaaggcacugggcuugcaguuccauucacggauucuagacaucgauaauguggaccuggcuauggggaaaaugauggagcagggacccguacucauaauuaccuuucaagcccagcuggugauggucgugcgcaacccuaagggugagguuguggaaggcgauccagacaaaguccuuagaaugcuguacgugugggcuuuguguagggaucaggacgagcucaauccguacgccgcauggcgucuguuagauaucagugccagcuccacagaacagauucuguga

SEQ ID NO: 63803 - RNA, 1371 nt, Artificial Sequence
  derived and/or modified sequence opt3 from TIMM50__Homo_sapiens__NP_001001563
auggccagcgcucugucccucggcaacaagugcgaccccuuccuuagaugugugcugugcaggggagggggugcauugcagggcccucgggggcgcggaccagaugacuuugagucucaauuaucaccgcccggcagugcccgacgucuggucagaagcaaaagggcgugugguaauccuccagaugcuuucgggcuaucccgggccucuguucaucccccucucccacgcgugucgaucggaugcucaagcggccccggcagagcaaagagggaacggguagggggagccgcuuggcgccagcgaaaaauggcagccagugcugccguguuuuccagacugaggucuggucuucggcugggcagccguggguuguguacccgccucgcgacaccuccaagaagggcaccggaccaggccgcugagauuggaucccggggcucaacuaaggcccaggguccccaacagcagccugggagugaaggaccaagcuacgcgaaaaaggucgcucuguggcuggccggccucuuaggcgcagggggaacggugucuguuguguauauauucgguaacaaucccgucgaugagaacggcgccaagaucccugacgaauuugauaaugacccaauucuggugcagcaacuucgacgcaccuacaaauauuucaaggauuacagacagaugaucauugagcccacauccccgugcuugcugccugacccccuacaggagccauauuaccagccucccuauacucucguacuggaacuuaccgggguucuguugcacccagaguggucacucgcaacaggauggagguuuaaaaagcggcccggcaucgaaacccuguuccaacaguuagcuccucuguacgagauagugaucuuuacuagcgagacagguaugaccgccuucccacucauugauagugucgacccgcacggguuuaucucuuaccgccuuuucagagaugcuacgagguauauggacggccaucacgugaaagacauuuccugucugaaccgugaucccgcccggguggucguuguggacugcaagaaggaagcauuucgauugcagccuuacaauggaguagcccuaagaccaugggauggcaacagcgacgauagggugcugcucgaccugucggcuuuccuuaaaacuaucgcgcugaauggggucgaggaugugcgcaccguuuuggaacauuaugcacucgaggacgauccccuggccgcuuucaagcaacggcagucuagauuagaacaggaggagcagcaaaggcuggccgaacuauccaaaucaaacaagcagaaucucuuucugggaagucuuacaagccgcuuguggccucgauccaaacagccauga

SEQ ID NO: 63804 - RNA, 294 nt, Artificial Sequence
  derived and/or modified sequence opt3 from TIMM8A__Homo_sapiens__NP_004076
auggacagcuccucuucaaguagcgccgcuggccugggggcaguggauccccagcuccaacacuucaucgaggucgaaacccagaagcagagauuucagcaacuuguucaucagaugacagagcugugcugggaaaaauguauggacaagccuggaccaaaauuggauuccagggccgaggcgugcuucgugaacuguguagaacgguuuauugacacuucucaguucauauuaaaucgccuggagcagacgcaaaagucgaaaccgguguuuucagagagccuaagugauuga

SEQ ID NO: 63805 - RNA, 297 nt, Artificial Sequence
  derived and/or modified sequence opt3 from TIMM8B__Homo_sapiens__NP_036591
augagaaagcacagcugcaggaaaguggccucccugcggcgcaccauggcugagcucggcgaagcagacgaggccgaacuucagcgacuggucgcggcugagcaacagaaggcccaguucacagcacagguucaucacuuuauggaauuguguugggauaaaugcguggagaagcccgggaaccguuuagacucuagaacugagaauugucugucaaguugcguagauagguucaucgacacgacccuagccauuacaagccgguuugcucaaauagugcagaaaggaggucaguga

SEQ ID NO: 63806 - RNA, 858 nt, Artificial Sequence
  derived and/or modified sequence opt3 from TIMMDC1__Homo_sapiens__NP_057673
auggaggugcccccuccagccccgaggagcuuccugugcagagcucucugucuuuuuccccgggucuucgcagccgaagcgguuaccgcugacuccgaggugcuggaagaacgccagaagcgauugccuuacguaccagaacccuauuacccugagucuggcugggaucguuuaagagagcuguuugggaaagacgaacaacagaggaucucaaaggaucuagccaacauuugcaaaacagcagccacugcuggaauaaucgguuggguguauggcgggauuccagcauucauccacgccaagcagcaguacauugagcaaagucaggcugaaaucuaucauaaucgguuugacgccguccagagcgcgcaccgcgcagccacgagaggauucauaagguacggcuggcggugggguuggcgcaccgcuguguuuguuacaaucuucaacacugugaauaccucccucaacgucuaucgaaauaaagaugcccugucucauuuugugauugcaggggcuguaacaggaucgcuuuucagaaucaacguuggccugaggggcuugguggccgggggaauuaucggugcgcuccugggcacccccgucgggggacugcucauggccuuucagaaguacucaggcgagacugugcaagagcggaagcagaaagaccguaaggcauuacacgaacugaaacuugaggaauggaagggucgcuugcaagugacagagcaucugccugagaaaauagagagcagucuacaggaggaugaaccagagaaugacgcuaagaagauugaagcccuccugaaccuuccgagaaaucccuccgucaucgauaaacaggacaaggauuga

SEQ ID NO: 63807 - RNA, 624 nt, Artificial Sequence
  derived and/or modified sequence opt3 from TIMP1__Homo_sapiens__NP_003245
auggcccccuucgagccucuggcuagcggcauccuccuucuguugugguuaauugcaccauccagagccugcaccugugugccgccccacccucagacagcguuuugcaauucugaccuggucauaagggcuaaguucguugggacuccagaagugaaucaaacgacccuauaccagcgguaugagaucaaaaugacaaagauguacaaaggauuucaggcccucggugaugcagccgacauucgcuucguauauacucccgcuauggaaucaguguguggcuacuuucaucgaagucacaaccguagcgaggaguuccugaucgcagggaaacuucaggauggacuguugcauauuaccacaugcuccuuugucgccccuuggaacucucucucgcuggcucaaagaaggggcuucaccaagacuuauacaguggguugugaagagugcaccguuuuuccaugucugucaauccccugcaagcuccagagcgggacgcacuguuuauggacugaccagcugcuucagggaagugaaaagggcuuccaaucccggcauuuggccugccugccucgcgagccaggccuauguaccuggcagucucucagaagccagauagcguga

SEQ ID NO: 63808 - RNA, 663 nt, Artificial Sequence
  derived and/or modified sequence opt3 from TIMP2__Homo_sapiens__NP_003246
augggcgccgcugcaagaacccugaggcucgcccuugggcuguuguuacuggcgacacuacuccggcccgcugacgccugcagcuguuccccugugcacccacagcaagcauucugcaacgccgaugucguuauccgcgcuaaggcagugucugagaaagaaguagacucaggaaaugauauuuacgguaacccgauaaagcgaauccaguaugagauuaaacagaucaagauguuuaaaggccccgaaaaggacauugaguucaucuacacugccccuaguagcgcuguguguggggucucccuggaugugggaggcaagaaagaauaucuuauagccgguaaggcggagggggacggaaaaaugcauaucacgcugugcgauuuuauuguuccaugggacaccuugucuacaacucagaagaaaucgcucaaucaccguuaccaaaugggcugugagugcaagaucaccagaugucccaugauuccuugcuauaucucaagcccagaugaaugucuguggauggacugggugacagagaagaacauaaauggccaucaggcaaaauucuuugccugcauuaagaggagugauggguccugugcuugguaccggggagccgcacccccuaaacaggaguuccuggacaucgaagauccauga

SEQ ID NO: 63809 - RNA, 636 nt, Artificial Sequence
  derived and/or modified sequence opt3 from TIMP3__Homo_sapiens__NP_000353
augacccccuggcugggccucaucgugcuucuggggagcugguccuugggagacuggggugccgaggcuugcacauguucuccuucacacccacaggaugcauucugcaacagugacauugucauaagagccaagguugugggcaaaaaguuaguaaaagaagggccguuuggaacucugguguacacgaucaagcaaaugaaaauguauaggggcuucaccaagaugccccauguccaguacauucacacagaggcgagcgaaucccuauguggucucaagcuggaggugaauaaauaucaguaccuucugacugggcggguuuaugauggaaagauguacaccggcuugugcaacuuuguggaacgcugggaccagcucacacugucucaacgaaaaggccugaauuaucguuaccaucucggguguaacugcaagaucaaaucguguuacuauuuaccuugcuucgucaccucaaagaaugagugucuguggacugauaugcuuagcaacuuuggauacccagguuaucagaguaagcacuacgcuugcauuagacagaaaggcggguauuguuccugguacaggggaugggcacccccugacaagucuaucauaaaugccacagauccauga

SEQ ID NO: 63810 - RNA, 675 nt, Artificial Sequence
  derived and/or modified sequence opt3 from TIMP4__Homo_sapiens__NP_003247
augcccggcagcccuagaccagccccguccugggugcugcuccuuaggcuguuggcuuuacugcggcccccugggcuaggagaggcaugcucuugugccccagcgcacccccagcaacacaucugccacucagcucucgucauucgcgccaagauaaguagcgaaaaaguugugccugcauccgccgacccagcugauaccgagaagaugcugcgauacgaaaucaaacagauuaagauguucaaagguuuugagaagguaaaggacgugcaguauaucuacacacccuucgauucuucgcuuuguggcgucaaacuggaagcaaacucacagaagcaauauuugcucacuggacaggugcugagcgacgggaaaguuuuuauucaucugugcaauuacaucgagccuugggaggaucucaguuuagugcagcgugaaucccugaaccaccauuaucaccuuaauuguggcugccagauaacgaccuguuacacagucccaugcacuaucucugccccgaacgaguguuuguggaccgacuggcugcuagaaagaaagcucuaugguuaccaagcucagcacuacgugugcaugaaacauguagaugggacauguagcugguauaggggacaucugccccuucggaaggaguucguugacauugugcagccuuga

SEQ ID NO: 63811 - RNA, 1431 nt, Artificial Sequence
  derived and/or modified sequence opt3 from TINAG__Homo_sapiens__NP_055279
auguggaccggcuacaagauccugauuuucagcuaucucacaacugagauauggauggaaaaacaguaccuuucccaaagagagguggaccuggaagccuauuuuacgaggaaccacaccgucuugcaggggacacgguucaagcgcgcuaucuuucagggacaguacugccgaaauuucgguuguugcgaggaucgugacgauggcuguguuacugaauuuuaugcagccaacgcguuaugcuacugugacaaauucugcgauagagaaaauucugacuguugccccgauuauaagucauuuuguagggaggagaaagaguggccuccacauacccaaccgugguaccccgaagggugcuucaaggacggacagcacuacgaggagggcagugugauuaaggaaaacuguaauagcugcacaugcuccggucagcaguggaaauguucucaacauguaugccuggugcggucggagcuaaucgaacaggucaacaagggggauuauggauggaccgcucagaauuacucacaguuuuggggcaugacucucgaggacggcuucaaauuucgccuggggacacuuccuccaagccccaugcuguugaguaugaacgaaaugaccgccucccucccugcaacgacugaucugccagaguucuuuguggccucuuauaaguggcccggauggacccacgguccucuggaccaaaagaauugugcugcaagcugggccuucuccacagcuucaguugccgcggauagaauugcaauccagaguaagggcagguacacugccaaccucagcccacagaauuuaauaucuugcugugcuaagaaccggcaugggugcaauuccggaucaaucgaccgcgccuggugguaucugcgaaaaagaggccuugugagccacgcauguuacccguuguucaaggaccaaaacgcuaccaauaacgguugcgccauggcgaguaggucugaugggcggggaaaacgucacgccacaaagcccuguccuaacaaugucgagaaauccaaccgcauuuaucagugcagcccacccuacagagugucgucuaaugaaaccgagaucaugaaggaaauuaugcagaacggcccuguacaggcaaucaugcaaguuagggaggacuuuuuccauuacaaaacgggcauauaucggcacgugacuuccacaaauaaggaaucagagaaguaccgaaaacugcagacccaugcugucaagcuaacuggguggggaacacuccgcggugcccagggccagaaagagaaguuuuggauugcugccaacaguugggggaaaagcuggggagaaaauggcuauuucagaauccugaggggugugaacgaguccgauauugaaaaacuuaucaucgcagccugggggcaacugaccucuagcgacgagccauga

SEQ ID NO: 63812 - RNA, 1356 nt, Artificial Sequence
  derived and/or modified sequence opt3 from TINF2__Homo_sapiens__NP_001092744
auggccacaccccugguggcuggcccugcagcccucagauucgcggcugccgcaagcuggcaagucguuagggggcggugcguggagcacuuuccacgcguacuugaguuccugcgauccuugcgugccguggcuccgggauuagucagauacaggcaucacgaacggcuguguaugggucuaaaggcaaaagugguuguggaacucauccugcaaggccgccccugggcccagguccuuaaggcucugaaccaucacuuuccugagucugggccaauugugagagaccccaaagccaccaagcaggauuugaggaaaauacucgaagcgcaggagacuuucuaucaacagguaaagcagcugucagaggcaccuguugaccuggccaguaagcuccaggaauuagagcaagaauacggagagccauuucuggcugccauggagaaacuuuuguucgaauaucugugccagcuagagaaggcacuccccacgccucaggcucagcaacugcaggaugugcuuagcuggaugcagccaggcgucuccaucaccucuucgcuggccuggcggcaauacgguguggacauggggugguugcucccggaauguucagugacagauagcgucaaucuggcggagcccauggaacagaacccuccacagcagcaacgcuuagcccugcauaauccccucccuaaagcaaagccaggaacucaccuuccccagggcccgaguucccgaacccacccugagccccuggcuggcagacauuuuaacuuggccccacuagggaggcggcguguucagucucagugggcuagcacacgcggaggucacaaagagagaccuaccgugaugcuguuccccuuuaggaaucucggcuccccaacucaaguaauuucaaagcccgaaaguaaggaggaacaugccaucuauacagcagaccuggccauggggacccgggcugcgagcacgggaaaaucuaaguccccuugccagacucuuggcggucgagcacugaaagagaacccaguggauuugccggccaccgaacagaaggagaauugucucgacugcuacauggauccccugcgcuuaucacugcuaccuccaagagcuaggaaacccgucuguccuccaagccucugcaguucugugauuacaaucggggaccugguucuugauuccgacgaggaagagaacggacagggcgaaggcaaggagagcuuggaaaauuaucagaaaacuaaguucgauacccugauacccacacucugugaguaccugccgccuucggggcacggagccaucccagugucuuccugcgacugucgggacucaagucgcccccuuuga

SEQ ID NO: 63813 - RNA, 1974 nt, Artificial Sequence
  derived and/or modified sequence opt3 from TIPARP__Homo_sapiens__NP_001171646
auggagauggaaaccacagagcccgaaccugacugcgugguccagccaccgagucccccugaugacuucuccugucaaaugagacugucugagaagaucacuccacucaaaacgugcuuuaagaaaaaggaucagaaaaggcuuggcaccgggacacugcggucauugcgccccauuuuaaacacucugcuagaaaguggaagccucgacgguguuuuccgaucccguaaucagucuaccgaugagaacucgcugcacgagccuaugaugaagaaggccauggaaauaaauucaagcuguccacccgcugagaacaauaugagugugcuuaucccugacagaacaaacguaggcgaucagauuccagaagcacauccguccaccgaggcccccgagaggguggucccuauccaagaccacucuuuuccaagcgaaacucuguccgggacaguggcggauucaacccccgcucauuuccagacggacuugcuccacccuguuaguagcgaugugccaacuucucccgacugccuggauaaagucauugacuacgugccgggaaucuuucaggaaaauuccuucaccauacaguauauccuggacacaucagauaagcucagcacugaauuauuucaagacaaaagugaggaagccucucuggaucuuguauucgaguugguuaaccagcugcaguaccauacccaccaggagaauggcauugaaaucuguauggacuuucuacaagguacaugcauuuaugggcgggauugucucaagcaccauaccgugcugccuuaccacuggcagaucaaacgcacgacuacacagaaguggcaauccgucuucaacgacagccaggagcaucuugaaagauuuuauugcaaucccgagaacgauaggaugcggaugaaguacggaggccaggaguucugggcagaccugaaugccaugaacguguaugagaccacugaguuugaucaguugcgccgacucucgacaccaccuucuuccaaugugaacucaauauaccacaccgucuggaaauucuucuguagagaccacuuuggcuggagggaauaccccgagaguguuauucggcugaucgaagaggcuaacagccguggguuaaaggaagugcgcuucaugauguggaauaaccauuauauucugcacaauuccuuuuucagaagggagaucaaacggcgaccacucuuucgcucuugcuucauccuucugcccuacuugcaaacgcuaggagguguaccuacccaggcaccaccgccccuggaggccacaagcucaagucagauuauauguccugauggcgugacuuccgcuaacuuuuauccagaaaccugggucuacaugcaucccagccaggacuucauccaagugccuguuucugccgaggacaagucauauagaauuaucuacaaucucuuucacaaaacagugccagaguucaaguauaggauacugcagauucuucggguccagaaccaguuucugugggaaaaauacaagcgcaagaaagaguacaugaauagaaagauguucgggagggaucguaucaucaacgaacggcauuuguuucacggaacuagccaagacgugguagauggcauuugcaaacacaauuucgacccccgaguuugcgguaagcaugcgaccauguucgggcagggaagcuauuuugccaaaaaggcauccuacucucacaacuucucgaagaaaagcuccaagggcgugcauuuuauguuccucgcuaaaguccugacaggcagauauaccauggggucacacggaaugaggcgcccgccuccagugaaucccgguagugucacuucugauuuauacgacagcuguguggauaacuuuuucgagccucagaucuuuguuauuuucaaugacgaucaguccuaucccuacuuugugauacaauaugaagagguaucaaacacggucagcaucuga

SEQ ID NO: 63814 - RNA, 603 nt, Artificial Sequence
  derived and/or modified sequence opt3 from TIPIN__Homo_sapiens__NP_001276915
augcugaucagacacauggagcauugggcccacaggcuuuuccccaagcuccaguuugaagacuucauugaucggguggaguaccugggcagcaaaaaggaaguccaaaccugcuugaaacgcauacgauuagaccugccuauccuacaugaggauuuuguuuccaacaaugacgaaguggcugagaacaaugagcacgauguaacaucuacugaacucgacccauuccugacgaaccuuucagagagugaaauguuugcaagcgagcugucccguucuuugaccgaggaacagcagcagagaauugagaggaauaagcaacucgcccuggaacggcgccaggcgaaacugcucucgaacucacagacauuagggaaugauaugcugaugaacacuccgagagcucauaccguggaggaagucaauacagacgaggaucagaaggaggaaagcaacggacuuaaugaggacaucuuggauaaccccuguaaugacgccauugcaaacacccugaaugaagaggaaacucuacucgaucaaaguuucaagaacgugcagcagcagcuggacgccacauccaggaacaucaccgaggcucgguga

SEQ ID NO: 63815 - RNA, 537 nt, Artificial Sequence
  derived and/or modified sequence opt3 from TIPRL__Homo_sapiens__NP_001026970
augaugauccacggcuuccagagcucccauagagacuuuugcuucgggcccuggaagcugaccgccucuaaaacacacauuaugaagucagcugauguggagaaacucgcagacgaacuucauaugccuagucugccagagaugauguuuggagauaacgucuugaggauacaacacgguagcggcuucgggaucgaauuuaaugccacugacgcguuacgguguguuaacaauuaccagggaaugcugaagguggcuugcgccgaggaauggcaggagucccgcacggagggcgaacauucuaaagagguaauuaagccguaugauuggaccuacacaacugacuauaaggguacccuacucggggaaucgcugaaacuuaaggugguccccacaaccgaucacaucgacacugagaaacugaaggcacgagagcagauuaaauucuuugaagaggugcucuuguucgaagaugagcugcacgaccauggaguuucaagccugagugugaagaucccuggcggcgggcaccucuga

SEQ ID NO: 63816 - RNA, 1035 nt, Artificial Sequence
  derived and/or modified sequence opt3 from TIRAP__Homo_sapiens__XP_005271456
augcagaagcccggcuggcaagggcugggaccucaguggacccagggucucccaagaccggccagccccgcugcaggccuuugcccuagggugucccgggucuggacagggccaggaggcguugguggggccgugcgccgagcggcucugcccgagucuggagccugugcauuguuauucccugccgaaccagcucagucagcacaacccaguagccagcugggcccucgugccggcuggcuacuccacgagguaaaaacuggguccccaccgucuucgcccuuuacgaacgcuuggucacauggagccagcuucgacccucacgcgauggcaaguuccaccucucugccagcccccgguagcagaccuaagaaaccacuuggcaagauggcugauugguuuaggcagacacuguugaaaaagcccaagaaacggccgaauaguccugaaucaacuuccagcgacgccucucagcccaccucccaagauucaccacucccucccagccugaguucugugacauccccaagccugcccccuacccaugcaucggacucuggguccucacgcuggaguaaggauuacgacgucugcgugugucacagcgaggaagaucucguugcugcccaggacuuaguguccuaucuggagggaucuacugcgagccuuagaugcuucuugcagcugagggaugccacaccaggcggugcaaucgucucagagcuaugucaggcucucaguuccagccauugccgggugcugcuuauuaccccgggguuucugcaagaccccugguguaaauaccagauguugcaggcccucacggaagcuccuggagccgagggcugcacuauaccacuguuaucuggccugucacgcgcagccuaucccccugaacuccgauucauguacuauguagaugggagaggaccagacgguggcuuuaggcaaguuaaggaggcugugaugcgguguaaacuucugcaggagggggaaggagagcgugauagugcgaccgucagcgacuugcuauga

SEQ ID NO: 63817 - RNA, 5247 nt, Artificial Sequence
  derived and/or modified sequence opt3 from TJP1__Homo_sapiens__NP_003248
augagcgccagagcugccgccgcgaaguccaccgcuauggaggaaacagccaucugggagcagcacacugugacgcugcauagggcacccggauucggguuuggaauugccauaucugguggacgggacaacccucacuuccaaucaggggaaaccaguaucgucauuagcgauguucucaaaggaggcccagcugagggucagcuucaggaaaaugaccgcguggcaauggugaacgggguguccauggauaaugucgagcaugccuuugcugugcagcaacugcgaaagucuggcaaaaacgccaagaucaccauucguagaaagaagaaaguucagaucccggugucgaggcccgacccugagccagucucagauaaugaagaggacagcuacgaugaagagauacacgacccccggaguggccgcuccggcgugguaaacagaaggucugagaaaaucuggccucgggaucgcagcgcgucccgagaaagaucauugaguccaaggagcgaccggcguucuguugcauccucacagcccgccaaaccuacuaaagugaccuuagucaagagccgcaaaaaugaggaauaugggcugagacuagcuagucauauuuucgugaaggagaucucucaggauucccucgccgcaagggacggaaacauucaagaaggugaugugguccugaagaucaauggcacaguuaccgagaacaugagccuuacugacgcuaaaacacugauagagcggucgaaggggaaauugaagauggugguacagcgagacgaacgcgccacccuccugaaugugccagaucugucugacuccauucacucagcgaacgccagugagagagaugacaucagcgaaauucagucccucgcaucugaucacagcggaaggucacaugaccggccgccccgcagaaguaggucccguagcccugaucagcggucugagccaucagaccacagucgacauagcccccaacagccuuccaauggcucuuuaagaucgagggaugaggagcgcaucagcaaaccaggugcugucuccacgcccgugaagcacgccgacgaucacacuccgaaaaccguugaggaagugacagucgagcggaacgaaaagcagacuccuucacugcccgagccaaagccuguguacgcucaaguagggcagcccgacguugaccuuccagugagucccucugauggagucuugccuaauagcacccaugaagacggcauccugagaccauccaugaagcuagugaaguuuaggaaaggcgauucagucgggcuccgccuggccggagguaacgacgugggcauuuucguugcaggggugcuugaggauagcccggccgcuaaggagggacuggaagagggcgaccagauauugcgaguaaacaaugucgauuuuacaaacaucauucgggaagaggcgguacucuuccuguuagaccugcccaaaggugaggaaguuaccauccucgcacagaagaagaaagauguguaucguagaauagucgagucugacgugggggauuccuuuuacauuaggacgcacuucgaauaugagaaggaaaguccuuacggccuuagcuuuaauaaaggagagguauuccgcgugguugacacucuguauaacggcaaguuggggucuuggcuagccauccggaucggcaaaaaucauaaggaggucgaaagagguauuaucccaaacaagaauagggcugagcaacuggccuccgugcaguacacacuccccaaaaccgcaggcggggaucgagccgacuuuuggcgcuuccggggacugagaucaaguaagaggaaccuucguaaaagccgcgaagaccugucggcucagccugugcagacuaaguucccagccuacgagcgggucguuuugagagaagcaggcuuucucaggcccgugacaauuuucgguccgauagcggauguggcucgagagaaacuggcccgggaggaaccugacaucuaucaaauugcaaaguccgagccacgcgaugccgggaccgaccagagaucuagcggcaucaucagguuacacacgauuaagcagauaaucgaucaggacaaacaugcucugcuagauguaacccccaaugccgucgaccggcucaacuacgcacaaugguauccuauugugguuuuucugaaucccgauucaaagcagggagugaaaacaaugcgaaugagacuuugcccagaaagucgcaaguccgcuaggaaauuguacgagcguucucacaagcugcggaaaaacaaucaccaucucuucacuaccacaaucaaccugaauagcaugaacgacggcugguauggggcccuuaaggaagcgauucagcagcaacagaaccagcuggucuggguguccgagggaaaggccgauggugcuacuucagacgauuuggaccuccacgacgauagacugagcuacuuaagugcaccuggcucugaguauuccauguacagcaccgacucgaggcauacaucagauuacgaagacaccgauacugaagggggagccuauacggaccaagaacuggaugagacacuaaaugacgagguuggcacacccccagaaucugcuaucacucgcaguuccgagccggugcgagaagauagcucugguaugcaccacgagaaccagaccuacccucccuauagcccacaggcccagccccaaccuauacauagaaucgacuccccaggguuuaaacccgcaucacagcagaaggcggaagccaguagcccuguaccguaccucucuccagagacaaaucccgcuuccucaaccagugccgucaaccacaaugugaaccugacuaaugugcggcuugaggaaccuacaccagcacccagcacguccuauucuccucaggcugauucguugaggaccccgagcacugaggccgcacauauuaugcugcgcgaccaagaacccucacucuccagucacgucgacccaacaaaaguuuaccguaaggauccuuaucccgaggaaaugaugagacagaaccaugugcugaaacagccagccguaucucacccuggccaccggcccgacaaggagccaaauuuaaccuacgagccgcagcugccuuacguggaaaagcaagcuagcagggaucuugagcagcccacauaucgcuacgaauccucaucuuauacugaccaguucagccgaaacuacgagcauagauugcgguaugaagauagggucccaauguacgaggagcaauggaguuauuacgacgauaaacagcccuacccuucccgcccacccuuugacaaucagcacagccaggaucucgacucuagacaacauccugaagagucauccgaaaggggauauuucccgcgguuugaggagccagcgccccugaguuacgauagccguccucgcuaugaacaggcaccccgagcaucggcucuaagacacgaggaacagccagccccuggcuacgacacccaugggaggcugcggcccgaggcccagccacacccuucugcuggaccgaagcccgcagaauccaaacaauauuucgagcaguacagccgcucauaugagcaagugccaccucagggcuuuacgaguagagccggucacuucgaaccccuccauggggcggcugccguuccaccucugauccccucuucccaacacaagccggaggcacuuccaagcaacaccaaaccuuugcccccacccccuacacagacugaagaggaagaggauccggccaugaagccccagucagugcugaccagggucaagauguuugagaauaaacggagugcuagcuuagaaacaaagaaagacgugaacgacacuggauccuucaagccaccugagguugcaucuaaacccagcggcgccccuauuaucgguccaaagcccaccucccagaaucaauucucagaacaugauaagacgcucuaccgaauaccugagccacagaaaccccagcugaagccgccugaagacauugugagaucuaaccacuacgauccagaggaggacgaagaguauuaccgcaaacaacuuaguuauuuugauaggcggucguucgaaaacaagcccccugcgcacaucgcugccagccaucuguccgagccagcaaaacccgcccacucucagaaucagucaaacuuuagcuccuacaguucuaagggcaaaccgccugaggcugacggggucgaucguagcuucggagaaaagagauaugagcccauucaggccacaccaccucccccacccuugccuucacaauacgcacagccaucccagccgguaaccagugcuagccuccauauccacucuaagggcgcccauggggaaggaaauuccgugucacuggacuuucagaacagccuaguuucgaaacccgauccuccacccucucaaaauaagccugcgacuuucaggccacccaaccgcgaggacacagcccaggcagcuuuuuauccucagaaaaguuucccggauaaggccccagugaauggcaccgaacagacucagaaaaccgucacacccgcuuacaaccgguuuacgccuaagcccuacaccuccagcgcacgaccauucgagagaaaguuugagucaccuaaauucaaucacaaccugcuccccuccgaaacugcccacaagccagaccugucuagcaaaacaccgaccaguccuaagacacuugugaaaucccauagcuuggcccagcccccagaguuugauucugguguagaaacuuucucaauacacgcugagaagcccaaguaucagaucaauaacauuaguaccgugccuaaagcgaucccagucucccccagcgcaguugaagaggacgaggacgaagaugggcauacggugguggccacagcuaggggaauuuucaauucuaacggcgguguccugucgucaaucgagaccggcgugagcauaauuaucccucaaggggccaucccggaaggaguugagcaggaaauuuacuuuaagguaugucgcgacaauuccaucuuaccaccccucgauaaagagaagggcgagacucugcuuaguccucuggugaugugcgggccacacggacuaaaauuccucaagcccgucgaacugcgguugccucacugugaccccaagaccuggcagaacaaaugccugccaggcgauccgaacuauuuagugggugcaaauuguguuucugugcucauugaccauuuuuga

SEQ ID NO: 63818 - RNA, 3063 nt, Artificial Sequence
  derived and/or modified sequence opt3 from TJP2__Homo_sapiens__NP_001163885
auggaggaacugaucugggagcaguacaccgugacacuccaaaaggacagcaaaagaggcuucgggauugccgucuccggagguagggauaacccccacuuugaaaauggcgagacuucuauaguuaucucagacgugcuuccugggggaccagcugauggccuguugcaggaaaacgaccggguagugauggucaaugguacgccgauggaggauguguuacauaguuucgcaguucagcagcugcgcaagagcgggaaaguggccgcgauugucgugaagcgaccccguaaaguacaaguugcugcccuacaggcauccccuccacucgaccaggaugacagagccuuugaggugauggaugaguucgacggaaggucuuuucggucgggcuauucagagcgcagcagacugaacagucacggcgggaggucccggucuugggaagauagccccgagcgcggacgaccucaugagagagcuaggucccgggaacgugaccuuucacgcgauagaaguaggggucggagccuggagcgaggcuuggaccaggaccacgcacgcaccagagauaggucucgggggcgcucccucgaaagaggacuggaccaugauuucggcccaucaagggaccgugaucgggaccgaagcagagguaggaguaucgaucaagacuacgagcgcgccuaucaccgggcuuacgaucccgacuaugaaagagccuacucuccugaguauaggcgcggggcgcgacacgaugcacggucccguggaccaagaagcaggucgcgcgagcauccgcacucucggucccccucaccugaaccaagaggcaggcccggcccuauugggguccugcucaugaagagucgagccaaugaggaauacggauuacgccuggguagccagaucuuugugaaggagaugacacggacuggccuugcuaccaaagacgggaacuugcaugaaggagacauaauccugaagauuaauggcacagugaccgagaacaugucccuaacugaugccagaaaacucaucgagaagucuagggguaaacugcagcuugucguucugcgugacagccagcaaacauugauuaauaucccaucacucaacgauagugacuccgaaauagaggauauuagcgaaaucgagucuaaucgcucauucagucccgaagaacggagacaccaguacagcgacuaugauuaccacuccucuucggagaagcugaaggaaaggccgagcucccgagaggacaccccuucacgguuaagucgcaugggggcaacgcccacuccauuuaaaucuaccggcgauauugcuggaacagugguaccugaaacuaacaaggagcccagauaucaggaggacccacccgccccucaaccaaaagcggccccgaggaccuuccugcggcccagcccugaagaugaggcaaucuacggcccaaauacaaagauggugcgauuuaaaaagggggacuccgucggacucagacuugcugguggcaacgauguggggaucuucguugccggcauucaggaaggaaccucagcugagcaggaaggucugcaggagggggaccaaauauugaaagugaauacgcaggacuuucgcggccuagucagggaggaugccgugcuguaucuccuggaaauccccaagggagagaugguaacuauucuugcacagagccgugccgacguuuaccgggauauccuggcuugcggcagaggggacucuuucuucauaaggucccauuuugaaugugagaaggaaacaccucagaguuuggcguucacccgcggagagguguuucgagucguggauacucucuaugacgguaaacugggcaacugguuagcagucagaauugggaacgagcuggaaaagggacuaaucccaaauaaaagccgggccgagcaaauggcuucugugcagaacgcccagagggauaaugcaggcgaccgcgccgauuucuggcguaugagaggucagcgguccgggguuaagaaaaaccucaggaagucacgcgaagaccugacagcugugguaagugucagcaccaaguuucccgccuacgagcgagugcuuuugagagaagcaggcuucaaacggccgguugugcuguuuggaccuaucgcggauauugcuauggagaagcucgccaaugagcugccagacugguuccaaacggcaaaaaccgaacccaaggaugccggcucggagaaauccacaggggucgugaggcuuaacacuguacgccagaucauugaacaggacaagcacgcucuguuggacgugaccccuaaggccguugaucuccugaauuacacacagugguuucccauagucaucuucuuuaacccagacucuagacaaggagugaaaacuaugaggcagcgguuaaauccuaccagcaacaagucaagucguaaacuguucgaucaggcaaauaagcugaaaaagacaugcgcucaucucuuuaccgccacuauuaaccuaaauuccgcgaacgacucuugguucggcagccuuaaggauacgauccaacaccagcagggugaggccgugugggucuccgaggggaaaauggaaggaauggacgaugaccccgaggaucgcaugucauauuugacagcuaugggcgcagacuaccugagcugugauagucgacucaucucugacuucgaagacaccgauggugagggcggggccuauacugacaaugaacuggaugagccagcugaggaaccguuaguuuccagcauuaccagaucgucagagccugugcagcaugaagagauagaaaucgcccaaaagcaccccgacauuuacgcagugccaaucaaaacacacaagcccgauccuggaaccccacagcauacuucuaguaggcccccugagccgcagaaagcgccaucccggcccuaucaggacacacgcggcagcuacgggucugaugccgaggaagaggaauauagacaacagcugagcgagcacuccaagaggggauacuacggccagucagcucgguaucgagacacggaacuuuga

SEQ ID NO: 63819 - RNA, 2760 nt, Artificial Sequence
  derived and/or modified sequence opt3 from TJP3__Homo_sapiens__NP_001254489
auggaggaacugaccaucugggagcagcacacagccacucucagcaaggaccccagaaggggcuucgggauugcuauauccggaggucgggaucgcccuggcgggucuaugguggucucagacguugugccaggaggcccggcagaaggucgacuucaaacgggggaucauaucguaauggugaacggagucaguauggagaaugccaccagcgcguuugcuauucagauccugaaaacaugcacuaagauggccaacauuaccgugaaacgucccagaaggauccacuugccugcaacaaaggccuccccaucuucgcccggccggcaggacucagaugaagacgauggcccucagcgcguugaggagguggaccaagggagaggauacgauggugacagcaguuccggcucugggaggagcugggaugaacggucccgccgaccaagacccggaaggcggggccgugcugguucacaugggcgcagaaguccuggaggcggcagcgaggcaaauggguuagcccuggucucuggauucaaaaggcuaccacggcaggacgugcagaugaagccgguaaaguccguucucgugaaacgacgcgauucagaagaguuuggugucaagcugggcagccagauauucaucaaacacauuaccgacagugggcuugcugccagacauaggggacugcaagagggcgacuugauccuccagauuaacggugugucuucccagaaucugagccugaacgauacucggcgccucaucgaaaagucggaggggaaauuaucucugcuuguguugagagacaggggccaguuucuggucaauauacccccugcgguuuccgauucagacaguagcccacuagaagauauuuccgaccucgcaucugagcugagccaagcgcccccuucacacaucccacccccgccucgucacgcucagcggagucccgaagccucccagacagauagcccaguggagucuccucgacuuagaagggagucaaguguagacagccgcaccauuuccgaacccgaugagcaacggucugaacugccaagagagucgagcuaugacaucuacagggugcccuccucacagaguauggaagaucgcggauauucuccugacacgcgagucgugcgguucuugaagggcaagagcaucgggcuccgucuggcaggagguaacgacguuggcauuuuuguguccgggguccaggcuggaucaccagccgauggccaggguauacaagagggggaccagaucuuacaggugaaugauguaccguuccagaaccugacuagagaggaagcgguucaauuucuccuuggccugcccccuggagaggaaauggaguuggugacccagaggaaacaggacauuuucuggaagaugguccagagccgcgugggcgauucuuuuuacauccggacacauuucgaacuagagccaagucccccuuccgggcugggauuuacuagaggugacgucuuccacgugcucgauacccugcauccaggccccgggcaaagccacgccaggggaggccacuggcuugcaguucgaaugggucgcgaccugcgggagcaggaaagagggauaauuccgaaucagucuagggcugagcaguuggccucccucgaagcugcccaacgugcagugggcguaggaccuggcucaagugccgggagcaacgcucgcgcggaguucuggcggcugagaggauuaaggcgaggcgcaaagaagacaacccagcggucgcgcgaggaucuguccgcccuaacgagacaggguagguauccacccuacgaacgggucgugcuccgagaggcuucuuuuaaaagaccuguugugauccuggggcccgucgccgacaucgcaaugcaaaaacuuacugccgaaaugccagaucaguucgagauugcugaaacagugagccgcaccgacucaccuaguaaaaucauuaaguuggauacuguaagggugauagccgagaaggacaaacaugcacugcucgacguuacacccuccgcgaucgagcgucugaauuauguccaguacuacccaauugugguguuuuucaucccggaaucucggccugcucuuaaggcccugagacagugguuggcacccgccagcaggcgcuccacccgaagacucuaugcucaagcccagaaacugcggaagcacucaagccauuuauuuacggcaaccaucccacugaacggaacaagugauacuugguaccaggagcuaaaagcuauuauaagggaacagcaaacccgccccaucuggacagccgaggaccagcucgauggcucucuggaagacaaucuugauuugccucaccauggucuggcggacuccagcgccgaucucucgugugacucacgugucaacucugauuaugagacugacggcgaagggggagcuuacaccgauggcgagggguauacagacggagagggcgguccauacaccgauguugacgacgaacccccugcaccggcccuggcuagaaguuccgagccagugcaggccgaugaaagccagucuccccgggacagggggcgcauuagcgcacaccaaggagcccagguggauucccgacacccucagggccaauggagacaggacucaaugcggacuuaugagagggaggccuuaaagaagaaauucaugcgcguacaugaugcugaaaguagcgacgaggaugguuacgacuggggcccagccacggaucuguga

SEQ ID NO: 63820 - RNA, 705 nt, Artificial Sequence
  derived and/or modified sequence opt3 from TK1__Homo_sapiens__NP_003249
augagcugcaucaaccugcccaccgugcucccuggcuccccaucuaagacaagagggcagauucaagucauacuuggaccgauguucucagguaaaaguacugagcugaugaggcggguucgccgauuucagaucgcccaguacaaguguuuggugauuaaauaugcuaaggacacgcguuacagcuccucuuucugcacccacgauagaaauacaauggaagcauuacccgccugucugcuaagggacguagcgcaggaggcucucggcguggccgucaucgggauugaugaaggacaauuuuucccugacaucguggaguuuugcgaagcaauggccaacgcuggcaaaacuguuauaguggcagcccuggaugguaccuuccagcggaagccauuuggggcuauccuuaaucugguccccuuggccgagucggugguaaagcucacagcgguuuguauggagugcuuccgcgaagcagccuauaccaaaagacugggaacugagaaggaaguggaggucauuggcggcgcugacaaauaccauucaguguguaggcugugcuauuuuaagaaagccagcgggcagccugcaggaccagauaacaaggagaauugucccgugccugguaagccaggcgaagcugucgccgcgcggaaacucuucgccccgcagcaaaucuuacagugcagucccgcaaacuga

SEQ ID NO: 63821 - RNA, 705 nt, Artificial Sequence
  derived and/or modified sequence opt3 from TK2__Homo_sapiens__NP_001166114
augggcgccuucugccagagacccagcuccgacaaggagcaagaaaaagagaagaaaucugugaucugugucgaagggaacauugcuucaggaaagaccacaugccuggaguuuuucaguaaugcaacugauguugaagugcucacggagccuguaagcaaauggaggaacgugcggggucacaauccacuuggccugauguaccaugacgccucccgcuggggguugaccuuacagacauauguccagcugacuaugcuagaucgacacacccguccccaggugucuucgguuagacucauggagaggucaauacauagcgcgcgguacaucuuuguggaaaaccuguaucgcaguggaaagaugccggaggucgacuacgugguacuuuccgaaugguucgauuggauucugagaaauauggacguuucuguggauuugaucgucuaucucaggacaaacccugagaccuguuaccaacggcugaagaaacgcugccgagaggaagagaaggugauuccacuggaauaucucgaggcuauccaccauuuacacgaagaguggcugauaaaaggcagccuuuuucccauggccgcaccuguguuggucaucgaggccgaccaccauauggaaagaaugcuggagcuauucgaacagaauagggaucggauucucacuccagagaaccguaagcacugucccuga

SEQ ID NO: 63822 - RNA, 1872 nt, Artificial Sequence
  derived and/or modified sequence opt3 from TKT__Homo_sapiens__NP_001128527
auggagagcuaccacaagcccgaccagcaaaaacugcaggcccucaaggauaccgcuaacagacuuaggaucuccucuauucaggcaacaacugccgcgggcucagggcauccuacgaguugcuguagcgcugccgaaauaauggcagugcuguucuuucacaccaugcgguauaaaucccaggacccacgcaauccgcauaacgaucgauucgucuugucuaagggacacgccgcucccaucuuauacgcaguuugggccgaggcugguuuucuggccgaagcggagcuacucaaucugcguaaaauuucgucagaccuugauggccauccugugccaaagcaagcauucacagacguagccacugggagccugggacagggcuugggugcugccugcgggauggcauauaccggaaaguacuuugauaaagcuaguuauagaguguacugucuccugggcgacggcgaacuguccgaggggucugucugggaggccauggcguucgccagcaucuauaagcucgauaacuuaguggcaauucuggacaucaauaggcuuggacaguccgaucccgcuccuuugcagcaccaaauggacauauaccagaaacggugcgaagccuuugguuggcacgcuaucauuguugauggccauucaguggaggaacuguguaaggccuucgggcaggcaaaacaccagccaacagccaucauugcuaagaccuuuaagggacgcggcaucacuggugucgaggacaaagagaguuggcaugggaagccccuaccuaaaaacauggcggaacaaauaauucaggagaucuacagccagauucaaucuaagaaaaagauccucgcaacaccaccgcaggaagacgcccccuccguggauaucgcuaauauuagaaugccuucacugccaagcuauaaaguaggagacaagauagccaccaggaaggcauacggccaggcccuugcuaaacugggccacgccagugaucggaucauugcauuggacggggauacgaagaacucuacuuucuccgagaucuuuaaaaaggaacaccccgaccgcuucauagagugcuauauugcggagcagaauaugguuagcaucgcugugggaugugccacccgaaacagaacagucccuuuuugcucgacuuucgcagccuucuuuaccagggcuuucgaucaaauccggauggccgcaauuucugaauccaauaucaaccucugugguucacauugcggcgugaguauuggggaggacggaccaagccagauggcucuggaagauuuagccauguuucguuccgugcccacaucuaccgucuucuacccgagcgacggcguugcgacggagaaagccguggaacuggcugcaaauacuaaggguauauguuuuauccgcacaucaagaccugagaacgccauuaucuauaauaacaacgaggauuuccagguagggcaggcuaaggugguccucaaaaguaaggacgaccaagugaccguuaucggcgccggagugacucuucacgaagcacuggcggccgcugaguugcugaaaaaggagaaaauuaauauaaggguccuagaucccuuuacaaucaagccacucgaccggaagcugauucuugauuccgcccgagcaaccaaaggccgcauccugacgguggaagaccauuacuaugaagggggaauuggugaggcuguaagcucugccguugugggcgagccugggaucaccgucacacacuuggcagugaacagaguccccaggucaggaaagccagccgaacuccugaaaauguucggcauagaucgggacgcuaucgcgcaggccgugcgcgguuuaauuacuaaggcauga

SEQ ID NO: 63823 - RNA, 1773 nt, Artificial Sequence
  derived and/or modified sequence opt3 from TKTL1__Homo_sapiens__NP_001139405
auggccgacgcugaggcaagagccgaguuccccgaggaagcgaggccugaucggggcaccuuacaggugcuccaagacauggcuagccgccuucgaauccacuccauucgugccacaugcucuacuucaagugggagcuccucugagauaaugucgguccuguuuuucuacaucaugagauauaagcagucagauccagaaaacccggacaaugauagguuuguuuuggcaaaacggcugagcuucguggacguagccacgggauggcugggucagggccuagggguggcuuguggaauggcauacaccggcaaguauuuugaucgcgccaguuacagagucuucugccucauguccgacggugagucuagcgagggguccgugugggaagcuauggccuuugcgucauauuacagucuggauaaccuuguugcaauuuucgacgugaauaggcugggacauagcggcgccuugcccgcugagcacuguaucaacauuuaucagcggcgcugcgaagccuuuggcuggaauacauacgucguggaugggcgagacguagaggcacucugucaaguuuucuggcaggcuucucaggugaaacauaagccuacugccgucguggcgaaaaccuuuaagggaagagguacaccauccaucgaggaugccgaaucauggcacgcaaagcccaugccuagggagcgggcugacgccauaaucaaacugauugaaagccagauccaaaccagucguaaccuggacccacagcccccuauugaggauucuccagaagugaauaucacugacguccgcaugacauccccgcccgauuacagaguuggcgacaagauagcuaccaggaaagccugcgggcucgcauuagccaagcugggauaugcuaacaaucgggugguagugcuugauggcgacacgcgauacagcacuuucucggagauuuuuaacaaagaguauccugaacgcuucaucgaguguuucauggcggaacagaauauggucucuguggcauuggguugcgccuccagagggaggaccauugcuuuugccucaacauucgcagccuuucugacucgggcuuucgaucauauccgcaucggaggccuagccgagaguaacauuaauauaaucggcagccacugugggguuuccgugggagacgauggugcaucucagauggcgcucgaagacauugcuauguuuagaaccaucccaaagugcacaauauucuaccccaccgaugccgucagcacggagcacgcaguggcccuggcugccaacgcaaagggcauguguuuuauuaggacuacacguccugagaccaugguaaucuauacuccacaagaacgguucgagaucgggcaggcuaaaguucuucgacauugcgugucagacaaggucacagugauuggagccggcaucaccgucuacgaagcgcuggccgcugcagacgaguugaguaaacaggauauuuuuauaagagugaucgaccucuucacgauuaagccccuggauguugccaccaucguguccagcgcuaaagccacagaagguaggaucauuacuguagaggaccacuauccgcaagggggcauaggagaggcagucugcgcggccgugucuauggauccugacauccagguucauucauuagcugugaguggcgucccccagagcgggaaguccgaagaacugcucgauauguacggaauuucugcccgccacaucauuguggcaguaaaauguaugcuucugaauuga

SEQ ID NO: 63824 - RNA, 1881 nt, Artificial Sequence
  derived and/or modified sequence opt3 from TKTL2__Homo_sapiens__NP_115512
augauggccaacgacgcuaagcccgaugugaaaaccguccagguucugagagacacagcaaauaggcuccggauccacagcauucgcgccacuugcgcguccggcucugggcaacuuacgucauguugcagugcugccgaggugguaagcgugcuguucuuucauaccaugaaguacaaacagacagauccugaacacccagacaacgaucgauucauauugucccguggacaugcagccccgaucuuauaugcugcaugggucgaggugggugacauuucugaaucggaucugcuaaaucucagaaagcugcacucagaccuugagaggcaucccacuccucggcugccauuuguugauguggccaccggcagcuuggggcagggacucggcacagcuugugguauggccuacaccgggaaauaucuggacaaggcgaguuaccgcgucuucugccugaugggagauggcgaauccucugagggcagcgugugggaggcauuugccuucgcuucccacuauaaccucgacaauuuaguagccguuuuugaugugaacagacuggggcagucaggacccgcaccucuugaacacggugcugacaucuaccaaaauuguugcgaggccuucggcuggaacacuuauuuggucgacgggcaugauguggaagcgcugugucaggccuuuuggcaggcaagucaggugaagaauaaaccaacagcuauugucgccaagaccuucaaaggaaggggcauccccaacauagaggacgcugagaauuggcacgguaagccuguuccaaaagaacgggccgaugcaaucgugaagcuaauugagagccaaauccagacgaacgaaaaucucauuccgaagucucccguagaggacuccccucagaucucaauaacugauauuaaaaugaccagcccacccgccuacaaggugggggacaaaaucgcuacacagaagacuuacggacuggcgcuugcaaaacugggccgcgccaacgaacgagucauuguguugaguggcgauaccaugaacucuacauuuuccgagaucuucagaaaggagcauccugaaagguuuaucgagugcauuauagcugaacaaaauaugguuagcguggcccucgggugugcaacccggggacguacgaucgccuucgcuggugccuucgcagcguuuuucacucgcgcuuuugaccagcugagaaugggcgccauuucgcaggcaaacaucaauuuaauagggucucacugcggagucuccacaggcgaggauggugugucacaaauggcccuggaagaccucgcuauguucaggaguauuccaaacuguaccguauuuuaucccagcgaugccaucuccacugagcacgcaaucuaccuugcugccaauacaaaagggaugugcuucauucggaccucucagccggagacggcgguuaucuauaccccucaggaaaacuuugagauuggccaggccaaggugguccgacauggagugaaugacaaggucacagugauaggcgcugggguuacucugcacgaagcauuggaggccgcugaccaucuaagccaacagggaaucucagugcgcguaauugaucccuucaccaucaaaccacuggacgccgcaacaaucauuaguuccgcgaaggccacugguggcagagucauaaccguggaagaucacuacagggaagggggaaucggcgaggcuguuugcgccgcagugagccgggagccugacauucucguccaucagcuggcugugucugguguaccccagcgcgggaaaacaucagagcuucuggauauguuuggcaucaguaccagacacauuaucgccgcagugacuuugacgcucaugaaguga

SEQ ID NO: 63825 - RNA, 1485 nt, Artificial Sequence
  derived and/or modified sequence opt3 from TLDC1__Homo_sapiens__XP_005256131
augcugcccggcaacagagagggggccgcucucgaaaggagcccuugggcagccggaccagaccggaccgcgccggguucccccgcuggcgaguucugccagaucucugggcaaaugggaaauucacgcagucgagugggccguagcuuuuguucccaguuccuuccugaggaacaggccgaaauugaucagcuguuugacgcauugucuucggauaagaacucaccaaaugucagcaguaaauccuucucuuuaaaggcccugcaaaaccacguuggugaggcucuacccccugagauggugacaagacucuacgacgggaugaggcggguagaucugacuggaaaagcaaagggcccaagcgaaaaugugucccaggagcaguuuacggccucaaugagucaucuucugaaaggcaacagcgaagagaagucuuugaugauaaugaagaugaucuccgcuaccgaggggcccgucaaagcccgcgaagugcagaaguucacagaggaccucguuggaucagugguccacgugcugagccauagacaagaacugagggguuggacuggcaaagaggcgccugggccaaauccgcggguacagguucucgcagcccaguuacugagugauaugaaacuucaggacggaaagcgcuugcugggcccccaauggcuagauuaugacugcgaucgagcugugauugaagacugggucuuuagagugccucacguggccaucuuccucucugucguuauuuguaaggguuuucugauccuuugcuccagccuggauuugaccacacucgugccagagaggcagguagaccaggggcggggauucgagucgauacuggacguguuaucugucauguacaucaacgcacaacugccccgugaacagcgccauagauggugucuccuguuuuccucagagcuucacggccacaguuucagccaguugugcggccauauuacccacagggggccuuguguggcuguucuagaagaucaugacaagcacguguuuggagguuucgccuccugcucuugggaggucaaaccacaguuccaaggcgauaaucgguguuuucuguucagcaucugccccucaauggcgguguauacucacacaggguacaacgaccauuauauguaccucaaucacggacagcagaccauuccgaacggccuggguaugggcgggcagcauaauuauuuuggacuuuggguagauguugacuucggcaaggggcacagucgagccaaaccuacguguacuaccuacaacagcccccaacuguccgcacaggaaaauuuucaguucgauaagauggaggugugggcugucggagacccaucugaggaacaguuggccaaagguaacaagucaauccucgaugcugacccugaggcccaagcacuguuagaaauaaguggccauagccgccacuccgaggggcugagagaagugcccgaugacgaguga

SEQ ID NO: 63826 - RNA, 2343 nt, Artificial Sequence
  derived and/or modified sequence opt3 from TLE1__Homo_sapiens__NP_001290032
auguucccccagagcagacacccuaccccacaccaagccgcuggccagccguuuaaguucacaauccccgagucccuggacaggauuaaagaagaguuucaguuccuccaggcacaauaccacucucuuaagcuggaaugcgagaaauuggccucagaaaagacugagaugcagcggcauuaugugauguacuaugagaugaguuacggguuaaacauagaaaugcacaaacagacggagaucgcgaagcgccugaauaccauuugugcucaggucaucccuuuucuaagccaagaacaucagcagcagguugcccaagcaguggagcgagccaagcagguaacaauggcugagcucaacgcaauuaucggagugcguggucugccaggccuucccccuacucagcaacagcugcaggcccagcacuugucccacgggcauggaccacccgucccucucaccccacacccgucuggccugcaacccccugguauaccaccccugggagggucggcuggccucuuagcccugucaagcgcgcuuaguggccagucccauuuggcaaucaaagaugacaagaaacaccacgaugccgaacaucacagagacagggagccugggacaucuaauagccugcuagugccagauucccuccggggaaccgacaagcgcagaaacggucccgaguucucaaaugauauuaaaaagaggaagguugacgauaaagacaguagccauuaugauucugacggcgauaaguccgacgacaaccugguggucgaugugucaaaugaagacccgagcaguccucgggcuucucccgcccacuccccacgcgaaaacgggaucgauaaaaaucgacuucugaagaaagacgcaagcucgucuccugcuuccacugccucaagugcgagcuccacaucucucaagagcaaagagaugucauugcaugagaaggccaguacccccguacugaaguccagcacgccaacucccagaucugauaugccuaccccaggaacaucagcaacuccgggcuuaaggcccggucuggggaaaccuccagcuauugacccccucguuaaccaggccgcugccggacuucggaccccucuggcagugccaggccccuacccggccccuuuuggcauggucccacacgcugggaugaauggagaauugacaagucccggugcggcauaugccagccuacacaacauguccccucagaugucugcugccgcagccgcugccgcagugguggcguacggccguucgcccauggucggguucgauccaccuccccauaugcgcguuccaaccaucccgccuaaucuggcuggaauacccggcgguaagccagccuacagcuuucacgugacggcagacgggcaaaugcagcccguaccuuucccacccgaugcccucauuggcccuggaaucccgagacaugcuaggcagauuaacacucugaaucacggcgagguggucugcgccgugacaaucuccaacccaacccggcacguuuauacugggggaaaagguugugugaaggucugggacaucucacaucccggcaacaaaaguccugugucucagcuugauugccugaaucgagacaacuacauucgcagcuguaaguugcucccagacgggugcacacugauaguaggaggcgaagcauccaccuuaucaaucugggaucuggcugcccccacgccuagaauuaaggcggagcuaaccagcucugccccggcuuguuaugcacucgccaucucccccgacaguaaaguuugcuuuagcuguugcucugaugguaauauagcugugugggaccugcacaaccaaacacuugucaggcaguuccaggggcauacugauggcgccuccuguauugacaucucaaaugauggaaccaaguuguggacaggcgggcuggacaacacugugcggaguugggaucuccgcgaaggaagacagcugcaacagcacgacuuuaccagccagaucuucucgcuugguuacugcccaacaggcgaguggcuggcagucgggauggaguccucuaauguggaaguuuugcaugugaacaaaccugauaaguaucaacuccaucugcacgagagcugcguauuaucacugaaauucgcguacuguggaaagugguuugucaguaccggcaaggacaaucuacucaacgccuggaggacucccuauggugcuuccauuuuccagucuaaagaaagcuccucagugcugagcugcgauaucaguguugacgacaaguacauugugacggggucuggcgauaaaaaggccacagucuacgaggugauauauuga

SEQ ID NO: 63827 - RNA, 2121 nt, Artificial Sequence
  derived and/or modified sequence opt3 from TLE2__Homo_sapiens__NP_001138233
auggugcagagcagacugaccgccacauccgcuucucaagacucacccgcaaguggccuccagacuccucuucagagcgggcagccauucaaguuuuccauccuggagauuugcgauaggauaaaagaagaguuccaauuuuugcaggcccaguaccacucuuuaaagcuggaaugugagaaacuagcgucggaaaagacggagaugcagcggcauuaugucauguacuaugagaugucauacggacucaacaucgaaaugcacaaacaagcugagauuguuaagcgccugagcgguaucugcgcccagauuaucccguuccuuacccaggaacaucagcaacaggugcugcaggcaguagagcgagccaagcaagugacagucggcgaguugaauagucucauagggcagcagcagcugcaaccccugucccaccaugcuccuccagugccccucacuccucguccagcaggauuaguuggcgguucugccaccgggcugcuugcuuugagcggagcccuggcggcacaggcccagcuagcugccgcagugaaagaagacagagcuggcgucgaggccgaaggcuccaggguggagcgggcgcccucacgcagugccagcccuucuccaccggaaucccucguagaggaggaaagacccucagggccuggagguggcgggaagcagagggcagaugagaaagaaccaagcggacccuaugagagugacgaagauaagucugacuacaaccugguuguggaugaggaccaaccuuccgagccacccagcccggcuacaaccccuuguggcaaaguccccaucugcauuccagcccggcgcgaucuuguggacucgccugcuucucuggccuccucauuggguaguccccucccacgagcaaaggaacugaucuuaaaugaucugcccgccagcacuccugcuuccaagucuugugacagcucaccaccgcaggaugcgaguacacccgggccuuccagcgcaucucaccucugccagcuugccgcuaaaccagcccccucaaccgacaguguggcacugagaagcccuuugacgcuauccucuccauuuacuaccucguucagccugggaucccacucaacacucaacggcgaccugaguguccccucuagcuauguuucccuucaucugucaccucaggugucuagcuccguaguguacggcaggaguccggucauggccuuugagagccacccacauuugcgggggucuuccgugucaaguagccuccccucgauuccuggagguaagcccgcuuacuccuuccacguuucugccgauggccaaaugcagccagugccuuuucccagcgacgcacuggucggggcgggaaucccacgucacgcucgccaguuacauacucuggcccacggcgaagugguaugugcaguuaccauaucagguaguacacagcauguguauaccgggggcaaaggaugcgucaaggugugggaugucggccaaccgggggccaaaacgccuguggcucagcuagacugucucaauagagauaacuacauuagguccugcaagcugcuucccgacggacggucuuugaucguugguggcgaggccagcacucuguccauuugggaucucgcagcuccaacaccccgaaucaaagccgaacugaccucaagcgcgccugccuguuaugcucuugcagugaguccagacgccaagguaugcuucucuugcuguuccgaugggaauaucgucgugugggaccugcagaaccaaacuaugguucgccaguuucagggacacacagauggcgcuagcugcauugacauaucggacuacgguaccagauuguggaccgggggccucgauaauacggugagguguugggaccugcgggagggacgccaguuacaacagcaugauuucucaucucagaucuuuagucugggccacugccccaaccaggacuggcuagccgucgggauggaguccagcaauguggaaauucuccacguaagaaagccugagaaauaucaacugcaucuucacgaaucuuguguguugagccugaaguucgcauccugcguucagggagucgugcucucaccggagcuguga

SEQ ID NO: 63828 - RNA, 2310 nt, Artificial Sequence
  derived and/or modified sequence opt3 from TLE3__Homo_sapiens__NP_001098662
auguacccccagggcagacacccugccccacaucaaccggggcagcccggauucaaguuuaccguggcugagagcugcgacaggaucaaagaugaguuccaguuucugcaggcacaauaucacucccucaaggucgaauacgacaaacuugccaacgaaaagacagagaugcagcggcauuauguuauguacuaugaaaugucuuacggucugaauauugagaugcacaaacagacugagauagcgaagcgcuugaacacgaucuuagcucagauuaugccuuuccugucacaagaacaucagcaacagguggcccaggcaguagagcgagccaaacaggugaccaugacagaacuaaaugcuaucauuggccagcaacagcuccaggcacagcaccugagucacgccacucaugggccacccguccaacuuccuccacaccccagcggacugcagccuccaggcaucccgcccgugaccgguuccucuucgggguugcucgcucugggagcccugggcucacaggcgcaucucacaguuaaagaugagaagaaccaccacgaguuagaccaucgugaaagagagagcagugcaaauaacuccgugucuccuagcgaaucccugagggccucagagaaacaccggggcagugcugauuauagcauggaagccaagaaacgcaaggcagaggagaaggacucucuuuccagauacgauucagacggggauaaaagcgacgauuuggucguggacguaaguaaugaagauccagcuacccccaggguuucuccugcccauuccccacccgagaacggacuggacaaggcgcggagccuaaagaaggacgccccgacuucgccugcaucuguggcuuccucaaguagcacacccuccucuaaaaccaaggaucucggucacaaugacaaaagcucaacgccaggccugaagaguaacacuccuaccccucgcaaugaugccccaacacccgggacuuccaccacaccuggacuucgaagcaugccaggcaagccgcccgguauggacccuauagcuucugcccugagaaccccaaucucaauuacgaguagcuacgcagcccccuuugcuaugaugucccaucacgaaaugaacgggucuuugacuucgccuggagcguaugcaggccuccacaauaucccaccccagaugagcgccgcugccgcagccgcugccgcagcguacggcagguccccgauggucucauucggggcugugggauuugauccucauccacccaugcgggccacaggucugccuaguucuuuagcaagcauucccggcgggaaaccagccuauuccuuccacgugucagcugacggacaaaugcagccuguccccuuuccacaugaugcccuggcaggcccggguaucccucgucacgcucgccagauaaacacccucagccacggggagguugugugugccguaacuauuucuaaucccacaagacauguguacaccggcggaaagggcugcgucaaaaucugggacauuucccagccagggaguaagagccccaucucucaacuugauugucugaacagggacaacuauauccgguccugcaaauugcuaccugauggacgaacgcugauuguggguggcgaagcgucaacccucacaauaugggaccuggccaguccaacuccccgcaucaaggcugagcuuaccagcucggcacccgccuguuacgcucuggccauuuccccggacgcaaagguuugcuucucuuguugcagcgaugggaauaucgcggugugggacuugcacaaccagacacucgucagacaguuucagggacauacugauggcgccucauguauagacauuagucacgaugguaccaaacuguggacagggggcuuagacaauaccgugagguccugggaucugcgggagggacgccaacuacagcagcaugacuucacuucucaaaucuuuagccucggcuauugcccaacgggggaauggcuggcuguaggaauggaguccucaaacguugaagugcuucaccacacaaagcccgauaaauaccaguugcaucugcacgagagcuguguccucagucugaaguucgccuacugcgguaaaugguucgugucuaccggcaaggacaaucuucugaacgcauggagaacuccuuauggggcuuccaucuuucagagcaaggaaucgucaucugucuugaguugcgauauuuccgccgacgauaaauacaucgugaccggaagcggcgacaagaaagcaacaguuuaugaggugauuuacuga

SEQ ID NO: 63829 - RNA, 2418 nt, Artificial Sequence
  derived and/or modified sequence opt3 from TLE4__Homo_sapiens__NP_001269677
augaucagagaccugagcaagauguacccccagaccaggcacccugccccacaucaaccggcucagcccuucaaauuuacaauuuccgagucuugcgaucggauaaaggaagaguuccaguuucuccaggcacaauaucacucacuuaaacuggaaugugagaaguuggccagugaaaagacugagaugcagcgccauuacgugauguauuacgagaugagcuauggcuuaaacaucgaaaugcacaagcaggcggagauugucaagcgacugaaugcuaucugcgcccagguuauuccuuuccuaucccaagaacaucagcaacaggugguacaggcaguggagcgugccaaacaggucacgauggcugagcucaacgcaaucauagggcagcaacugcaggcccagcaccuuucucacggacauggucugccagugcccuugaccccucacccaucgggccuccagcccccugcuaucccaccgauugggucaagcgccggacugcuggcgcucaguuccgcauuaggcggucaaucucaucugcccaucaaggacgagaaaaagcaccacgauaaugaccaucagagagauagggacagcauuaaauccucaaguguuagcccuucugccuccuuucgcggggcugagaagcaccggaacucagccgauuacagcagugaaucuaagaaacagaagacagaggaaaaagagaucgcagcuagauaugacuccgauggagagaagucagacgauaaucuuguggucgacgugucgaacgaagauccaucuucccccaggggcagcccugcccauaguccacgggagaauggcuuggacaaaacucgccugcuaaagaaagacgcgcccauaagcccggccuccauugcaucuagcucaaguaccccuuccagcaagucuaaggaacucucacugaaacgagauauggggaaacuuagugagacaagacugagcgaagacgagcaguguaccuugggacuccaaaggugguucugccggcugugguuuaugaacgagaaauccacuacacccguaucuaagucgaauaccccaacgccucguacugaugcucccaccccagguagcaacuccacacccggcuuacgcccuguuccagggaaaccgcccggaguggacccucuggccucaagucucagaacuccaauggcuguccccuguccuuacccaacccccuucggcaucgugccgcacgccgguaugaauggggaacuuacaucuccuggagcagccuacgcuggccugcauaacauuagcccacagauguccgcggcagccgcugccgcagccgcugccgcagcguauggcaggucacccguggucggguuugauccucaccaccauaugcggguucccgcuaucccaccuaauuugaccggaauccccgguggcaagccagccuacagcuuccacgugucugcagacgggcagaugcagccgguaccuuuucccccagaugcccuaauuggacccggcauaccucgacaugcucgccaaaucaacacgcugaaucacggugagguggucugcgccgugacuauuuccaacccaacaagacacguuuauaccgggggcaagggaugugugaaagucugggacaucagucaucccggcaacaagagcccugugucucagcucgauugccugaauagggacaacuacauacgguccugucgccuucugccggaugggagaacuuugauuguaggaggugaagcaucaacacucaguaucugggaccuggcugccccaacccccaggaucaaagcggaguuaacgagcucggccccugcuugcuaugcacuggccauuuccccagacucuaagguuuguuucagcugcugcucagauggcaauaucgcugugugggaccuacacaaccagacccucguccgucaguuucaagggcauacagauggagccaguuguauugacauauccaaugauggcacuaaacuguggaccggugggcuugacaacacagugcggucuugggauuugcgagaaggcagacagcugcagcaacacgacuucacuagccagaucuucucccucggauacugccccaccggcgaguggcuggcagucgggauggaaaauucaaacguggaaguucuucaugugacaaagccugauaaguaucagcugcacuugcacgagagcuguguacucagucugaaauuugcgcauugcggaaagugguucgucucuaccgguaaagacaauuuacugaacgccuggaggacuccguacggcgcuuccauuuuucagagcaaggaaucgucaucugugcuaaguugugauaucuccguugacgauaaauacaucgugacggggagcggagacaagaaggccacagucuaugaggugauuuacuga

SEQ ID NO: 63830 - RNA, 1719 nt, Artificial Sequence
  derived and/or modified sequence opt3 from TLE6__Homo_sapiens__NP_001137458
augaccagcagagaccagcccaggccuaagggcccaccgaaauccacaucucccugcccugggaucucaaacagugagagcuccccaacucugaauuaccaagggauucucaaccggcuuaagcaguucccccgcuuuucuccucacuucgccgcugaacuggagucgauauauuacucauugcauaaaauccagcaggauguggcagaacaccauaagcaaauugguaaugucuuacagaucguugagagcuguagucagcugcagggcuuucaauccgaagaggugucuccagccgagcccgcgagcccugggacgccacagcagguaaaagacaagacccuacaggaauccucauucgaggauauuauggcuacacgaaguagcgacuggcuccguagaccgcugggagaagauaaccaacccgagacucagcuguuuugggacaaggagccuugguucuggcacgauacccuuacagaacaguuguggaggaucuuugccggcgugcaugacgagaaagcaaagccacgggaucgccaacaggcccccggucucgggcaggaaucuaaagcuccuggauccugcgacccaggcaccgaucccuguccggaggacgcaucaacuccuagacccccagaagccagcaguucuccucccgagggcucccaggauaggaauacaagcuggggagucgugcaagagccacccggacgggcuucgcgcuuccugcagucuauauccugggacccugaagacuuugaggaugccuggaagcgaccagacgcgcugccgggucagucaaaaagacucgcaguucccugcaaguuagaaaagaugaggauccuggcccacggcgagcuuguguuggcuaccgccauuaguagcuucacgcggcacgucuuuacuugugggcgucgcggaaucaaaguguggucccugaccggccagguagcagaagauagauucccugagucucaucuaccaauucaaacacccggugcuuuucucaggacuugccugcuuagcucaaacagucggucccuguugaccgggggauauaaucucgccagcguuucugugugggaccuggcggccccuucauuacacgucaaggagcagcugccaugugcaggccucaacugccaggcucuugaugccaaucuggacgcuaacuuggccuucgcaaguuucacaagcggcguggugcgaaucugggaucuacgcgaccaguccgucguuagagaucugaaaggguaccccgacggagugaagucuauaguagugaaagguuauaauauuuggaccggcgggccggaugccugucucaggugcugggaccaacggacgaucaugaagccucuggaauaccaguuuaaaucgcagauuaugagccuuucccauucaccacaggaggacuggguccuguugggaauggcuaacggccaacaguggcuccagaguacuucugguagccaacgccacaugguggggcagaaggauuccguuauccugucagugaaguucagccccuuuggccaguggugggcgucugucggaauggacgauuucuuaggcguguauuccaugccugcagggacaaaaguauuugaaguucccgagaugaguccagugaccuguugcgacgucagcucuaauaacagacugguggucacuggauccggugaacacgccucaguguaccagaucacauacuga

SEQ ID NO: 63831 - RNA, 2157 nt, Artificial Sequence
  derived and/or modified sequence opt3 from TLK1__Homo_sapiens__NP_001130026
auggacgagcugcacagccucgaucccagaaggcaggaacuucuggaggcccgguucaccggcguggcuuccgggucuacaggaucaacugguaguugcagcgucggcgcaaaggccuccacgaacaaugaaucuucgaaccauucauuugggagcuugggaaguuuauccgacaaagagucugaaaccccugagaagaaacaaagcgaguccucacgcggccgaaagcguaaagcggaaaaucagaacgagaguagccaggguaagucuaucgggggaagaggccacaagauuuccgauuacuucgaauaucagggcgggaauggaucaagcccaguuagggguauaccgcccgcuauccggaguccucaaaacucucauucccacagcacaccaucgucuuccgugcgccccaauucaccuaguccaacugcccuggcauuuggcgaccaucccauuguacagccuaaacagcucagcuucaagaucauucagaccgaucuaacaaugcugaaacuugccgcucuggaguccaacaagauccaagacuuggagaaaaaggaagggagaauagaugaccuccugagggcaaauugugaucugcggcgccagaucgacgagcagcagaagcucuuagaaaaauacaaggagcgacugaacaaaugcauuucuaugagcaagaaacuuuugaucgaaaagucaacccaagagaaacugaguuccagagaaaagagcaugcaggauaggcuacggcucggacacuuuacuacagugcgucacggcgccucuuucaccgaacaguggacggacgguuuugcuuuccaaaaucuggucaagcagcaggagugggugaaccagcaacgcgaagauauugagagacagaggaaacuucuggccaagcggaaaccaccgacugcgaauaacucacaggcacccaguaccaauagcgaaccuaagcagcgcaaaaacaaggccguuaacggggcugagaaugacccauuugugcgacccaacuugccucaacuccugacauuagccgaguaucaugaacaggaggaaaucuucaagcugagacucggacaccuuaaaaaggaggaagcagagauacaggcugagcuggaaagguuggagcggguccgcaaucuacauauuagagaacugaaaaggaucaacaaugaggacaacucccaguuuaaggaucacccaacucucaaugagcguuaccugcuucugcacuugcucggccggggcggguucucugaaguguauaaagccuuugaccuguacgagcaacgauaugcggccguaaagauucaucaguuaaacaagucguggagagaugagaaaaaggagaauuaccacaaacaugcauguagggaauaccgcauccacaaggagcuggaccauccccggaucguuaaacuauaugauuacuucagccucgacaccgauacauucugcaccgugcuggaguauugugaaggaaacgaccuugauuuuuacuugaagcagcacaagcugauguccgagaaagaagcuagaucaauugucaugcagauagugaaugcccucagguaucugaacgagaucaagccgccuauuauccacuacgaccuuaaacccgguaauauacuguugguggauggcacggcuugcggggaaauuaagaucacugacuucggacucaguaaaaucauggacgaugacucuuauggcgucgaugguauggaccugacaagccaaggggccggcaccuacugguacuuaccaccugaguguuuuguugugggaaaggagcccccaaaaauuuccaacaagguagauguguggucagucggcgugaucuucuuucagugccuguaugggcgcaagcccuucggacauaaucagagccaacaggacauucuacaggaaaacacuauacucaaagcaacagagguucaguuuccugugaagccagucgugucuuccgaagccaaggcuuucauccgacggugucuggcguaccguaaagaggauagauuugacguacaccaacuugcaaacgauccguauuugcugccccauaugaggcgcaguaauagcucugguaaccuccacauggccggccugaccgcuuccccuacgccacccucaaguagcauuaucaccuacuga

SEQ ID NO: 63832 - RNA, 2319 nt, Artificial Sequence
  derived and/or modified sequence opt3 from TLK2__Homo_sapiens__NP_001271262
augauggaggaacugcacagccucgaccccagaaggcaggagcuucuggaagcccgguucaccggcgugggggucuccaagggaccuuugaacucugagucaaguaaucagagcuuaugcuccguugguucucugucggauaaagaaguggagacaccagagaagaaacaaaacgaccagcgcaaucgaaagcguaaagcugaaccguacgagacuucacagggcaaggggacgcccagaggacauaagaucagcgauuauuuugaguucgcaggcgguagugccccugggaccuccccaggaaggucuguacccccuguggcgcggagcuccccacaacacucacuaaguaacccccucccucgcagagucgagcagccacuguacggccuugacggcagcgcugccaaagaggcaacagaagaacagucugcccugccgacuuugauguccgugaugcucgcuaagcccaggcuggauaccgaacagcuggcacaacgcggggccggacucuguuuuacauucguuucagcucagcagaauagcccuaguucuaccgguuccggcaacacugagcauagcugcucgucucagaaacaaauuuccauacagcaccggcagacacaaucagacuuaaccaucgaaaagauuagugcccuggagaauagcaaaaacuccgaucuugagaagaaggaagggcgaaucgacgauuugcugagagcgaauugugaccuaaggcggcagauugaugagcagcagaaaaugcucgaaaaguauaaagagcgucugaaccgcugcgugacgaugucuaagaaacuucugaucgaaaagagcaaacaagagaagauggcauguagagacaagucaaugcaggauagguugcggcucggacauuuuacuaccguccgacacggcgccaguuucacagagcaguggacugacgguuacgcuuuucagaaucugauaaaacaacaggaacgcaucaacucccagagagaggaaauugagaggcagcggaagauguuagccaaacgcaagccacccgcaauggggcaagcuccuccagccaccaaugaacagaaacagagaaagagcaagacaaacggagcggagaaugagacccccucuucaggcaacacggaacugaaagacacugccccggcacucggcgcucacagucuucugagguugacacuagccgaguaucaugaacaggaggagaucuucaagcugcgucucgggcaccugaaaaaggaagaggcugaaauucaagccgagcuugaacggcuggagcgagugagaaacuugcauaucagggagcucaaacgcauacacaaugaagauaacagccaguuuaaggaccacccuacccugaaugaucgguacuuacugcuacaucuccugggaagagguggcuucuccgagguauauaaggcauuugaccuuacugaacagagguacguugccgugaaaauucaccaauugaacaagaauuggcgcgaugagaaaaaggaaaacuaccauaaacacgcuugccgagaguaucggauccauaaggagcuggaccacccccguauugucaagcucuacgauuauuucucucuggacacagauucguuuuguaccgugcuugaauacugcgaggggaaugaccuggauuucuauuugaaacagcacaagcucaugagcgaaaaagaggcgagauccaucaucaugcagauugugaacgcacugaaguacuuaaaugaaauaaaaccaccuaucauucauuaugaccugaagcccggaaacauccuacucgucaauggcacggccuguggugagauaaaaauuaccgacuucgggcugucaaagaucauggaugacgauaguuacaacucuguugacggcauggagcuuacaagccagggagcuggcacuuacugguauuugccacccgaaugcuuugugguagggaaggagccuccaaaaaucuccaauaagguggaugucuggucagugggaguuauuuucuaccaaugucuguaugguaggaaaccguuuggccacaaccagagccagcaggacauccuccaagaaaauaccauucugaaggccacagaggugcaguuucccccuaaaccagucgugacucccgaggcaaaggccuucauacgccggugcuuagcuuacagaaaggaagauaggaucgacguacagcagcuggccugcgauccuuaucuuuugccacauauucgaaaaucuguuuccaccaguagccccgcaggggcggcuaucgccucuacauccggagcaucaaacaacaguagcucgaauuga

SEQ ID NO: 63833 - RNA, 1179 nt, Artificial Sequence
  derived and/or modified sequence opt3 from TLL1__Homo_sapiens__NP_001191689
augggccuggggacccucagccccagaaugcuuguguggcuggucgccuccggaaucguuuucuacggugaguugugggugugcgcuggcuuagacuaugauuacacauuugacgggaacgaagaggauaagacugaaacgauugacuauaaagauccuuguaaggcagccguauucuggggagacauagcgcuggaugacgaggaucuaaauaucuuucagauugacaggaccaucgaucucacacaaaacccauucggcaaucugggucacacuaccgggggacuuggcgaccaugcuaugucuaaaaagcggggcgcccuguaccaguugauugaucgcauccgacguauaggguuuggacucgaacagaacaauacagugaaagguaaggucccgcugcaguucucaggccaaaacgagaagaauagagugcccagggcagccaccagucggacugagcgcaucuggccugggggaguuauuccauaugugaucggcgguaacuuuacagggagccagagagcuauguucaaacaggcaaugaggcacugggaaaagcauaccugcgucacguuuauugagcgguccgacgaagagucuuacaucguguucacuuaucgccccuguggaugcuguucguacguaggccgaagaggcaaugggccucaggccauaucaauugguaaaaacugcgacaaguuuggaaucguugugcacgagcugggccaugucauuggguucuggcacgaacacaccaggccagaucgggacaaucaugugacaaucauccgugagaacauucaacccggacaggaauacaauuuucucaaaauggagccuggcgaagugaacagcuuaggugagcgcuaugauuucgacaguauaaugcacuacgcuagaaauacuuucuccagggggauguuucuggauaccauccuuccaucucgggacgauaacggcauucgaccggccaucggacagcgcacaagauugagcaagggcgacauagcgcaggcaaggaagcuguaucggugucccgccugcggggagacccuacaagaauccaacggaaaucucucaaguccugguuucccaaacggcuaccccagcuauacgcauuguauuuggcgcgucucuguuacuccuggggagaaagugguauuuucccugugcuga

SEQ ID NO: 63834 - RNA, 3048 nt, Artificial Sequence
  derived and/or modified sequence opt3 from TLL2__Homo_sapiens__NP_036597
augcccagagccaccgcucugggcgcacucgugagccuucuguuguuacugccucuaccacgcggggccggaggucucggcgagcggccggacgcgacagcugauuacuccgaacuggacggggaggaaggaacugagcagcaacuugaacacuaucaugaucccugcaaggccgcagucuucuggggcgacaucgcccuggaugaggacgauuugaaacucuuucacauugacaaggcucgcgauuggacgaaacagaccguuggugcaacagggcauucuacuggaggccuggaggaacaggccucagagaguagcccugacaccacagcuauggauaccggcacuaaggaagccgggaaagacggacgagagaacacaacccugcuccacuccccagguacguuacaugcggcagccaagacuuucucuccccgugugagaagggcuaccacaucgcggacugagcgcauauggccuggcgggguaaucccauacgugauuggaggcaauuuuaccgguucacagagagccaucuucaagcaagcaaugaggcacugggaaaaacacacaugugucaccuuuauugagcggacggaugaagagagcuucaucguguuuaguuaucgcacuugcggguguugcuccuacguuggacgaagaggcggcgggccccaggcuauaucuaucggaaagaacugugacaaauucgguauuguggcccaugaacugggccacgucgugggguuuuggcaugagcacacaaggccugaccgggaucagcacguaaccaucauucgugagaauauccagccaggacaagaauauaacuuccuuaagauggaggcgggcgaaguuagcuccuugggugagacuuacgacuuugauucaauaaugcauuaugcccgcaauacauucaguagagggguguuucuggacaccauucuaccgaggcaggaugacaacggcguccggcccacgaucggacagcgagugcgccucagccagggcgauauugcacaagcuagaaaacuguacaagugcccugccuguggggaaacccuucaggacacaacuggaaauuucucugcuccagguuuccccaacggcuacccuuccuauucacacugcguguggaggaucagcgucaccccaggggagaagaucguucugaauuuuacaaguauggauuuguucaaaucucggcucuguugguacgacuauguggagguacgcgauggauacuggagaaaggcaccccuguuaggcagguuuugcggugacaaaauuccggaaccucugguguccacugacagccgucucugggucgaguuccggucgucuuccaacauacuugggaagggcuuuuucgccgccuaugaagcuaccuguggaggcgauaugaauaaagacgcggggcagauccaaucacccaacuacccagaugacuaucgaccuaguaaggagugcguguggagaauuacaguuagcgaaggauuucaugugggucugaccuuccaggcauuugagaucgagaggcacgauuccugcgccuacgacuacuuggaaguccgcgauggccccacugaggaaucugcucuaauagggcauuucuguggauaugagaaaccagaggacgugaagaguucaaguaaucggcuguggaugaaguuuguauccgauggcagcauuaacaaagccgguuucgcagccaacuuuuucaaggaaguugacgagugcucuuggcccgaucacgggggcugugaacacagaugcgugaauacgcucggaucauacaaaugugcuugcgacccuggcuaugagcuggccgcagauaagaaaaugugugaagucgcgugcgggggauucaucacaaaacuuaacggcaccaucacuagcccagguuggccgaaggaguaccccaccaauaagaacuguguguggcaggucguggcuccugcccaguauaggauuagccugcaauuugagguuuucgaauuggaggggaaugacgugugcaaguacgacuuuguagaaguccgcuccggacucucuccagaugcaaaacugcauggccgauucugugguucggagacacccgaagugaucaccagccaguccaacaauaugcggguugaguuuaagucagacaacacugugaguaaacguggcuucagagcccacuuuuucucugauaaggacgagugcgcuaaggauaaugggggaugccagcaugaaugugucaacacauuuggcagcuauuuauguaggugccgcaauggguacuggcugcacgagaacggacacgacugcaaagaagccggcugugcacauaagauuuccucaguggaggguacgcuagcuagcccuaauuggccagauaaauaccccucucggagagaaugcaccuggaacauauccaguacugccgggcacaggguaaagcucacauucaaugaguuugagaucgaacagcaucaagagugugcguaugaccaccuggaaauguacgauggaccggacagccuugccccuauuuugggccgauucugcgguucuaaaaagccagaucccaccguggcuuccggcucaaguauguuucugcgcuucuauagcgacgcaucgguucagcggaagggguuccaggccguccauuccacagaguguggaggcagacucaaagcugaggugcagacuaaggaacuguacucucacgcccaauuuggggauaacaauuauccuagcgaggcaaggugcgacugggugaucgucgcggaagacggauacggcguugagcuuaccuuccguacguuugaaguggaggaggaagccgauugugguuaugacuacauggaggcuuacgauggguaugacucaagugcccccaggcugggacgguucugcggcuccgguccauuggaagagaucuacucugcaggcgauagccucaugauuagauuuaggaccgacgauacaauaaacaaaaagggguuccacgcucgauauacuuccaccaaauuucaggacgcccugcauaugaagaaauga

SEQ ID NO: 63835 - RNA, 7626 nt, Artificial Sequence
  derived and/or modified sequence opt3 from TLN1__Homo_sapiens__NP_006280
augguggcccugagccucaagaucuccauuggcaacgucguuaaaaccaugcaguucgagcccucuacaaugguguacgacgcuugcagaauaaucagggaacggauuccugaggcaccagccgggccgcccucagauuuuggacuuuuccugagugacgaugacccuaagaaagguaucugguuggaagcgggcaaggcuuuagauuauuacaugcugcgcaauggggacacuauggaguaucgaaaaaagcaacguccacuaaagauuagaaugcucgauggaacgguaaaaaccaucaugguggacgauagcaagacagucacugacaugcugaugaccauaugugccaggaucggcauuacaaaccacgaugaauacucccuugugcgggagcugauggaggaaaaaaaggaggaaaucaccgguacuuugcgcaaagacaagacacuccugagagaugagaagaaaauggagaagcugaaacagaagcuccauaccgacgacgaauuaaauuggcuggaucacgggaggacgcuucgggagcagggaguugaagagcaugaaacuuugcugcuacgccgaaaauuuuucuauucugaccagaacguggauucgagagaccccguccaacucaaucugcuuuacgugcaggcaagggaugacauucugaacggcucacacccuguaagcuuugauaaggccugcgaguucgcuggcuuucagugucagauccaauucgggccacauaaugagcagaaacacaaggcaggauuuuuggaccucaaggauuuccugcccaaagaauauguuaagcagaaaggugagcggaagauauuucaggcccacaaaaacugcggccaaaugagugaaauugaggcuaaggugcguuacgucaaguuagcccgcucccugaaaaccuacggggugucuuucuuucucgugaaggaaaaaaugaagggaaaaaauaagcuugucccuagacuguugggcaucacaaaggaguguguuaugaggguggacgagaaaacuaaggaaguaauucaggaguggaaccuaaccaauaucaaacggugggcggcaagcccaaaguccuucacacuggauuucggugacuaucaggacggguacuauucagugcaaaccacggaaggagagcagaucgcccagcucauugcuggcuacauagauaucauucugaaaaagaagaaaaguaaggaccauuuuggccuugaaggggaugaggagagcacuaugcuggaagacucugucuccccgaaaaagucaacaguguugcagcaacaguauaaccgaguuggaaaaguggagcacgguagcgucgcccuccccgcaaucaugcgcaguggcgcuucugggccugaaaauuuccaggugggauccaugccacccgcccagcaacagauaaccagcggccagaugcauagaggucacaugccuccacugacuucggcgcagcaagccuuaacagggaccauuaacucuuccaugcaggcaguacaggcugcccaggcuacgcuggaugacuuugauacccuacccccgcucggccaagacgccgcaucaaaggccuggaggaaaaauaagauggaugagaguaagcacgagauccauagccagguugacgcuaucacagcgggaacugcauccguggucaaccugaccgccggcgauccugcugaaacagacuacacugccguggggugcgcagucaccacaauuucuagcaaccuuaccgagaugucacggggagugaaauugcuggccgcucuccuggaagaugaggguggcagugggcgcccccuucugcaggccgcaaagggauuggcgggcgcuguuuccgaacuccugagaagcgcccaaccagcaucugccgagccuaggcagaauuuacugcaggcugccgguaacguggggcaggcaucaggcgagcuacuccaacagaucggagaaagugacacugacccccacuuccaggaugcucugaugcagcuugccaaagcgguagccagcgcugcagccgcuuugguccugaaggccaaauccguggcacaacguacggaggacucuggccuccagacacagguuauugcggccgcuacccagugugcccugucgacuagccaauuaguggcaugcaccaaggucguggcuccaacaauauccucacccguaugucaggaacagcugguggaggccgggcggcuuguugcaaaggccgucgaaggaugcgugagugcuucucaagcggccaccgaggauggucaguugcuccgaggcgugggggcagcugccacugccgucacacaggcucugaaugagcuacugcagcauguuaaagcacacgccacgggagcgggcccugcugguagauaugaccaagccaccgauacuauccucacagugaccgaaaacauuuuuagcuccaugggggacgcaggcgagauggugaggcaggcccgcauccuggcucaggcaacaucagaucuuguaaaugccaucaaggcggacgcugaaggagagagcgauuuggaaaacucucggaaacuguuauccgccgcaaagauucucgccgacgcuacugccaaaauggucgaggcagcuaagggcgccgcggcccauccagauagugaggaacagcaacagagacugagggaggcagcugaagggcuucgcauggccaccaaugcugcagcccagaacgccauaaagaaaaagcuggugcagcgauuggagcacgcugcgaaacaagcagccgcuagcgccacgcagaccaucgcagccgcucagcacgcggccucuacaccgaaggcauccgcuggaccccagccucuccugguucaaucauguaaagccguggcagagcagauuccacuacugguccagggcgugcgggguagucaagcccagcccgacagcccuucggcucagcucgcccugaucgcggcaucccagucuuuccuucaaccagggggaaagaugguugccgcugccaaggcuagcgugcccacuauucaggaucaggcaucagccaugcaguugagucaaugcgcuaaaaaucugggcaccgccuuagcagaacuccguacagcggcccagaaggcucaggaggccugcgguccgcuggaaauggacuccgcacuuucuguaguccagaaccuggagaaagaccuacaagaagugaaggcugccgcaagagauggcaaacucaagccucugccaggggagacuauggagaaauguacccaggacuugggaaauagcacgaaggccguguccucagcuaucgcgcagcuguuaggcgaagucgcccaagggaacgagaauuacgcaggaauagcugccagggauguugccggcggucuccgcagccuggcacaggcugcccgggggguggcggcucuuacaagugaccccgccguacaggcaaucgugcuggauaccgccucugacgucuuggauaaggcuuccagccucauugaagaggcaaaaaaggccgcgggacauccuggcgaccccgaaucgcagcaaagacuggcucagguggccaaagcaguuacucaggcccuaaacaggugcgugucaugucugccaggucagcgagaugucgacaaugcucuucgcgccgugggcgaugcaucuaagcggcuccugagugacuccuugccucccagcacagggaccuuucaagaggcucagucuagacugaacgaggccgcggccggauuaaaccaggcagcuacugaacucguucaggccagcaggggcaccccacaagaccuggcacgugcuuccgggcgcuucggacaggauuuuucaacauuccuugaggccggcguggaaauggccggucaggcgccgagucaggaggaccgggcucaagucguaagcaaucugaaagggaucucuauguccucaaguaaguugcuccuggcagccaaggcucuaagcacggauccugccgcacccaaccugaaaucccagcuugccgcugcggccagagcagugaccgacucuauuaaucagcucaucacuaugugcacacaacaggcuccaggacagaaggaaugugauaacgcccugagggaguuggagaccguucgagaauuacuggagaaucccgugcagccuauaaacgacaugucguacuuuggcugccucgauagcgucauggaaaauucaaaagugcugggugaggcaaugacaggcauuucccaaaacgccaagaaugggaaccuuccagaguucggagacgcuaucaguacugccucuaaagcgcuguguggcuuuaccgaagcagccgcucaggccgcauauuugguaggggugagcgaucccaauucccaggcuggacagcaaggccuagucgagccuacgcaguucgcccgggcuaaccaggccauucagauggcaugccaaucacugggugaaccgggguguacacaggcgcagguucucucugccgcuaccaucguggccaagcacacuagcgcacugugcaauaguugucgccuugcuuccgccagaaccacaaacccaacugcaaagaggcaauucgugcagagcgccaaagaggucgcgaauucuaccgcuaacuuagugaagacaauaaaagcccuggacggagcauuuacggaagagaaccgggcccagugccgagcugccaccgcaccccucuuggaggcuguugauaaucugucagccuucgcguccaacccugaauuuaguagcaucccagcucagauuucgcccgagggcagagccgcaauggaaccuaucguaauuucugccaagacuaugcucgaguccgcuggcgggcugauccaaacagcacgcgcccuugcggugaauccgagggaccccccaagcuggucaguccuggccggacauagucguaccgugucugauuccauaaaaaaguugauuacuagcaugcgggacaaggcuccuggucagcuagaaugcgagacagcaaucgccgcucugaacucaugucucagagacuuagaucaggccagucuggcagcuguuagccagcaacuugcccccagggagggcaucucccaggaagcgcugcacacccagaugcucacggccgugcaggagauuucucacuugaucgaaccacuggcaaaugcugcccgcgcagaggccagccaacucgggcauaaagucucccagauggcucaguacuucgaaccucugacucuugccgcggugggagcugcaucaaagacccuaucucacccccaacagauggcccuguuggaccagacaaaaaccuuagcugagagugcccugcagcuccuguauacugcaaaggaggccggcgguaacccaaaacaagcugcgcauacacaggaagcccuugaggaagcaguacagaugaugaccgaggccgucgaggaucugacaacuacccucaaugaagcugcaucggccgcuggggugguuggaggcaugguggacagcauuacgcaggccauaaaccaauuggaugagggcccgaugggggaaccugagggauccuuugucgacuaccagacaaccauggugcgaacugcgaaggcaaucgccguuaccgugcaggaaauggucacaaagucuaauacuucacccgaggagcuggguccacuagcuaaccagcugaccagcgauuauggcagacucgccuccgaagcaaaacccgcugccguggcggccgagaaugaagagauugggagucacaucaagcaucggguacaagaacuuggacacggcugcgcugcacuggugacgaaagccggugcuuuacaguguucuccuagcgacgcauacacaaagaaagaguugauugagugcgccaggcgcguuucagaaaaggucucccacgugcuggcugcccuccaggcagggaaccguggaacccaggccuguaucacugcggcuagugccgugagcggcauaaucgcagaucuggacacaaccauuauguucgccacugcuggcacacuuaauagagaggggaccgaaacguuugccgaucaucgggagggaauccugaaaacugcaaagguccucguagaagacaccaagguguugguucaaaacgcugccgguucucaggagaaacuggcgcaggcagcccaauccucaguggcuacaauuaccagguuagccgaugucgugaagcuaggcgcugcaagccugggggccgaggacccagaaacacagguugugcucaucaaugcggucaaagacguggccaaggcucuuggagaucugauaucggcaacuaaagccgcugccggcaagguaggugacgaucccgcaguguggcaguugaagaacucugccaaaguuauggucaccaacgugacgagucugcucaagacagugaaagcugucgaggacgaagcgacuaaggggacccgcgcccuggaggcaacaaccgagcacauucgacaggaacuugcuguuuucugcuccccugagccgccagccaaaacuagcacccccgaagauuuuaucagaaugacaaagggaaucacgauggcaacugccaaggcuguggcggccggcaauucaugucggcaagaggacguaauugcaaccgcuaaccucuccaggcgcgccauagccgauaugcugagagcuugcaaagaagcagccuaucauccugagguggcucccgacgucagguugcgggcgcugcacuacggccgugagugugccaauggguacuuagaacuacuggaucaugugcuccuuacacugcagaagccaucuccugaguugaaacagcagcugaccggacacagcaagcgcguugcagguagugugacugaacucauccaagccgcugaggcaaugaaaggcacagaaugggucgaccccgaggauccaaccguaauugccgagaacgaacugcuuggggcugccgcagcgaucgaggccgcugccaagaaguuagaacagcugaaaccucgagcaaagccgaaagaggcugacgaaucccucaauuucgaggagcagauuuuggaagccgcgaagagcaucgccgcugcaacgucugcccuggugaaagcugcaucagccgcccagagagagcuaguugcucaaggaaaggugggcgcaauacccgccaacgcgcuggacgauggucaguggagucaggggcucaucuccgcugccaggauggucgcagccgcuacuaauaaccuuugcgaagccgcaaaugcugccgugcaaggacacgcgagccaggagaaacugauuucuucggcaaagcaggucgccgcuucaacagcccaguugcugguggcuuguaagguuaaagcagaccaagauagcgaggccaugaagcggcuccaggcggccggcaacgcugugaaacgcgcauccgacaaucugguaaaggccgcucagaaagccgcagccuuugaagagcaggaaaacgagaccguggucguuaaggaaaagauggugggcgggaucgcucaaauuaucgcggcccaggaggagauguuaagaaaagaaagggagcuugaagaggcacggaagaaacuggcucagauacgacagcaacaguauaaguuccucccaagugaacuaagagaugagcauuga

SEQ ID NO: 63836 - RNA, 7629 nt, Artificial Sequence
  derived and/or modified sequence opt3 from TLN2__Homo_sapiens__XP_011520408
augguggcccugagccucaagaucugcgucagacacuguaacguugugaaaaccaugcaguucgagcccuccacagcuguguacgacgcaugcagggugauucgggaacgcgucccugaggcccaaacuggccaggcgucugauuaugggcuuuuucugucagacgaagauccacgaaagggaauaugguuggaggcuggucguacguuagacuacuauaugcugagaaauggcgauaucuuagaauacaaaaagaaacagaggccgcagaagauucggaugcucgacgggagugugaagaccguuaugguggaugacagcaaaacagucggagagcugcuugugacuaucuguucccgcauuggcaucaccaacuaugaggaauacucucugauacaagagacaaucgaagagaagaaagaggaagguaccgggacuuugaagaaagauagaacacuccugagggacgagcggaagauggaaaagcugaaagccaagcuccauaccgaugacgauuuaaauuggcuggaccacucgcgcacguuccgagagcagggaguagacgaaaacgagacucuuuugcugagaaggaaauuuuucuauucagaucagaauguugacagccgggaucccgugcagcugaaccuccuguacguccaagcacgugacgauauucuuaauggcagucauccuguguccuuugagaaggccugcgaguucggcggguuucaggcucagauccaguucggaccacacguggagcauaaacacaagcccgguuuucuggacuugaaagaguuccucccuaaggaguacauuaagcaacgcggcgcagagaagagaaucuuucaggagcacaagaacuguggggagaugucugaaauagaggccaaagucaaguauguuaaacuggcuaggagcuuacggaccuacggaguguccuucuuucugguaaaggaaaagaugaaaggcaagaauaaacucgugccacgacuucuggguauuacaaaggauucagucaugcgcguggacgagaaaacuaaggaaguuuugcaggaguggccccuaaccacagugaagagaugggccgcgaguccuaagucauucacccuggauuucggggaguaucaagaaucuuacuauuccguccagacgacugagggagaacagaucucacagcucauugcaggcuacaucgacaucauucugaagaaaaagcaaagcaaagauagguuuggccuugagggggacgaggaaaguacaaugcuggaggaaucuguguccccgaaaaagagcaccauauugcagcagcaguucaaccggacuggaaaagccgagcaugguucgguagcucucccagccguuaugcgcucuggcuccucagggcccgaaacauuuaaugugggaaguaugccuagcccacaacagcaggucauggugggccagaugcacagaggucauaugcccccucugaccuccgcacaacaggcuuuaauggggacgaucaacaccucuaugcacgccguccagcaggcgcaagacgaucugagcgagcuagacucacucccaccccugggccaggauauggccaguaggguguggguucagaauaagguggacgaguccaaacacgaaauucauagccaaguagaugcaaucacagcuggaacugccucugucgugaaccuuaccgcuggcgacccggccgauacagacuauacugcaguugggugcgccauaaccacaauuucaaguaauuugaccgagaugagcaagggagugaaacugcucgcugcgcugauggaugacgaagucgguuccggcgaggaucuucugcgugcagcccggacuuuggcuggggccgugucugaccuccugaaggcaguacagccuacgucgggagaaccccgacagacaguguuaaccgccgcuggcagcaucggucaggccuccggggaucugcuaagacaaaucggcgagaacgagacugacgaaagguuccaggacguucucaugucacuggcaaaagcggucgcuaacgccgcagccaugcuuguguugaaggcuaagaauguggcccaggucgcagaggauaccguucugcagaaccgcgugauugcugccgcgacacaaugugcccucaguaccucucagcugguggcuugcgcaaaaguagucagcccaacuaucuccucaccugugugucaggaacaguuaauugaggccggaaagcugguugaccggagcguggaaaauugcgucagagcuugucaagccgcaacaacggauucugagcuuuugaaacagguguccgcggccgcuaguguugugagccaggcccuccacgaccugcuacaacauguaaggcaguuugcaucucgcggcgagcccauagggcgauacgaucaggcuaccgacacuaucaugugcgucacagaauccauuuucucaaguaugggagaugccggugagauggugcggcaggcacgugugcuggcccaagcuaccagcgaccucgucaacgcgaugagaucggaugccgaagcagagaucgacauggaaaauuccaagaaacugcuugcugccgccaaguugcuggcugauucuacagcaaggaugguugaagccgcgaagggcgcugccgcaaacccagagaaugaagaccagcagcagcgcuuacgggaggccgcugaagggcucagaguggcaacuaacgccgcggcucaaaaugccaucaaaaagaaaauuguaaacaggcuggagguggcagccaagcaggcugccgcagcugccacccagacgauagcggccagccagaaugcagcugucucaaacaaaaaucccgccgcucaacagcagcuugugcagaguugcaaggcaguugccgaucacaucccucaacuggugcagggaguccgaggcucccaggcccaagcugaggacuugucugcgcagcucgcacugauuaucagcucccagaacuuucuacagccagguucaaagauggugagcagugccaaagcugccguuccgaccgugucugaccaagcagccgcuaugcagcugucccagugugcgaagaaucucgccacaagccuggcagaacuucgcacugcuucgcagaaagcccaugaggcaugcgggcccauggaaauugauucagccuugaacaccguccaaacacugaagaacgaguuacaggacgcuaaaauggccgcgguagaaucucagcucaagccucugccaggcgagacucuugagaagugugcacaggaucugggaaguaccuccaaagccgugggcagcucuauggcucaacuacucacgugcgccgcucaggggaaugaacacuacacaggaguugcagcccgggagaccgcucaggcccugaagacuuuggcacaagcggccagaggcguggcugccagcacaaccgaccccgcagcugcccacgcaaugcuggauuccgccagggacgucauggaagguucagcuauguuaauccaggaggcgaaacaggcccucauagcaccuggggaugcugaacgucagcaacgccuggcccagguggccaaggcaguaagucauagccuuaacaauugugugaacugccugccaggacagaaagacgucgauguugcuuugaagucuaucggcgaguccagcaaaaagcuccugguggacagucuacccccgagcacuaagccuuuccaggaggcccaauccgaacugaaucaggcggcugccgaucuuaaccagucugccggugaagugguccacgcaacccggggccagucgggggaacucgcugcagccagcggaaaauuuucagacgacuucgaugaguuucuggacgcgggcauugagauggcugggcaagcccagacaaaggaagaucagauccaggugauuggaaauuugaaaaacaucuccauggcaaguucuaagcuguuacucgccgcuaaaagccuguccguugacccaggcgcccccaaugcaaagaaccuucuggcugccgcggccagagcaguaacggagucaauaaaucaauugauuacccucuguacucagcaggcuccuggucaaaaggaaugcgauaacgcccugagggagcuagaaacagugaaagggaugcuggacaaucccaacgagccagucucugaucuuagcuauuucgacuguaucgagagugugauggaaaauuccaagguucucggagagagcauggcaggcauuucucagaacgcuaaaaccggugaucugccugccuuuggcgaaugcguggggaucgccucaaaggcguuguguggauuaacagaggcugcagcccaggcugccuaccuggucggcauauccgaccccaacagucaggcagggcaucaaggacucguggauccaauccaguucgcccgagcuaaucaggcgauucagauggccugccaaaaccugguagacccgggcagcucgccuucucagguccuuuccgcagcuacuaucguggccaaacacaccagcgcacugugcaaugccugucggauugcuucaaguaagacggccaaccccguugcgaagcgccacuucgugcagucugcaaaagaagucgccaauuccacagcuaacuuggugaagaccaucaaagcccuagauggugacuuuagcgaggacaauagaaacaagugcaggauagcaacugcuccacugauugaggccguugaaaaucucaccgcuuucgccucaaaccccgaguuugugaguaucccugcacagaucagcuccgaagggucucaagcgcaggagccaauucuggucagcgccaaaacaaugcuugaauccucaucuuauuuaauccggacugcucgaagucuggccauuaaucccaaggauccuccgaccuggucggugcucgcaggacauagccacacaguauccgacucuauaaagucauugaucacgagcauuagagauaaagcuccaggccagcgcgagugugacuacuccaucgaugguauuaacaggugcauccgugacauagagcaagccagucuggcagccgugucucagagccucgcgacccgggaugacaucucaguugaagcucugcaggagcagcuuacuuccgucgugcaagaaauuggccaucugaucgaucccauugccacagcagccagaggggaggcugcccaguugggacacaaggugacccagcuagcaaguuauuucgagccucugauccucgcugccgucggcguagcgagcaaaauauuagaccaucagcaacagaugacugugcuggaucagacaaagacccuugcugaaucugcccugcagaugcucuacgcagccaaagaagggggaggcaauccaaaggcucaacacacgcacgacgcaauuacugaagccgcgcaguugaugaaggaggccguugaugacaucauggugacccugaacgaagcugcauccgaggucggucucguagggggaaugguugacgccaucgcugaggccaugucaaaacuggaugaaggcacacccccugagccgaagggcaccuuuguggacuaucagacuacagucgugaaauacagcaaggcaauugcuguaaccgcccaagaaaugaugacaaaaucggugacuaaucccgaggaacuugggggacuagcgucucagaugaccagugauuacggucaucuggccuuccagggccagauggcagcugccacggcagagccagaggaaauaggguuucaaaucaggacacgcguucaggacuugggacacggcuguauuuucuuaguccagaaggccggugcucuacaggugugcccuaccgauuccuauacuaaacgagagcucaucgaaugugccagagcggugaccgagaaggucagccugguucuuucagcucugcaagcagggaacaagggaacacaggccugcauuacugcugccaccgcaguguccggcaucauagccgaccucgauacgacaaucauguuugcuaccgcgggcacuuugaacgccgaaaauucugagacauucgcagaccaucgggagaacauucugaaaaccgccaaggcucuaguagaagauacuaaacugcucgugagcggggcagccaguacacccgacaaacuugcucaggccgcgcaguccagcgcagccaccaucacgcaacuggcugaggucgugaaauuaggagccgcaucuuuggguucagaugacccagaaacucagguugugcugauuaaugcuaucaaggacgucgccaaggcgcucagugaucugauauccgccaccaaaggcgcugcaagcaagccuguagacgaucccucuauguaccagcuuaaaggggccgcuaaggugaugguuacaaacgugaccucgcugcucaaaacagucaaggcaguggaggacgaggccacuaggggaacccgcgcuuuggaagccacgauugaguguaucaagcaggaacugacagucuuucaaucaaaagaugugccagagaagacuagcuccccggaagagaguauccguaugaccaaaggcauuacaauggcaaccgccaaggcgguugcugccgguaauucuugcagacaggaggacgugaucgcaacugccaacuuaagccggaaagcuguauccgauaugcuaaccgccuguaagcaggcaucauuccacccugacgugagugaugaagucaggacacgcgcucugcgauuugggacggagugcacucucggauaucuugaccuguuggaacauguucuggugauacuccaaaagcccaccccagaguucaaacagcagcuggccgcguucucuaagagagucgcaggcgccgugacagaacuuauucaggcugccgaggcuaugaaaggcaccgaguggguagaucccgaagacccuacugugaucgcagagacagaacuccugggggccgcggccagcauugaggcugcagccaagaaauuggaacaacugaagccacgggcuaaacccaagcaggccgaugagaccuuagacuuugaggaacagauccuagaggcagccaaguccauagcugcggccacgucagcacugguuaaaagcgcuucugccgcacagagggaacucguggcccaaggaaaggucgguuccauuccugcuaaugcggccgacgauggccaguggagucaggggcuuaucagcgcagcucgcaugguggccgccgcuacuucgucccugugcgaggcagccaacgcuucuguccagggacacgcgucagaggaaaaauugaucagcagugccaagcaaguggcagccuccacagcucagcugcucguugcauguaaaguaaaggccgaccaggauucugaggcuaugagaaggcugcaagccgcaggcaaugcggugaagcgggccagcgacaaccuuguccgugcugcccagaaagcagcuuucgguaaggccgaugacgaugacgugguugugaaaaccaaguuugucgggggaauugcgcagaucauugccgcucaggaagagaugcugaaaaaggaacgcgagcuagaggaagcacgaaagaaacucgcccaaauaagacagcagcaguacaaguucuugccgaccgagcugagggaagaugagggcuga

SEQ ID NO: 63837 - RNA, 2436 nt, Artificial Sequence
  derived and/or modified sequence opt3 from TLR10__Homo_sapiens__XP_011512064
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaguucaauaaagaacugagauaccucgauuuaucgaacaauaggcugaagucaguaaccugguaucuuuuggcggggcugcgguaccuagaccucagcuuuaacgauuucgacacaaugcccauuugugaggaagcuggaaauaugagucaccuggagauccuuggucuguccggcgccaaaauacagaagucugauuuucaaaagaucgcacauuugcaccucaacaccguguuccugggguuucgcacuuuaccucauuaugaagagggaagccugccaauucucaauacaaccaaacuucacaucguccugcccauggacacgaacuucuggguguugcuaagagauggcauuaagacuuccaaaauccuggagaugaccaauauagacgguaagucacaguuuguuaguuacgaaaugcagaggaaccucagccuggagaaugccaaaacaucugugcuucuguugaacaaggucgaucuccugugggacgacuuauuccugauucuacaguuuguguggcacacuuccguagaacauuuccaaauccggaacguuaccuucgggggaaaggcuuaucucgaucacaauucauuugacuacagcaacacagugaugcgcaccauuaaacuggagcauguccacuuccgaguguuuuacauccagcaggauaagaucuaucuuuugcugacgaaaauggacauugaaaaucucacuauaaguaacgcacagaugccucacaugcuguucccaaauuaccccacaaaguuucaauaucuuaacuucgccaauaacauccugaccgaugaguuguuuaaaagaacuauucagcucccucaucugaagacauuaauccugaauggcaacaaacuagagacccucucucugguguccugcuucgcuaauaacacgccacuugaacacuuggaccugagccagaaucuccugcaacauaagaacgaugagaauuguucguggccggaaaccgucguuaacaugaacuuaucuuacaauaagcuguccgacucaguguuuaggugccuucccaaaaguauacagauuuuggaucucaacaauaaccagauccagacaguaccuaaggagacuauccaccugauggcccuacgggaacugaauauugcguucaacuuucucaccgaccugccaggcuguagccauuucucccgucuuucuguguugaauaucgagaugaacuuuauucugagccccucauuagauuucguccaaaguugccaggaggugaaaacacucaaugcagggcgcaacccuuucagauguacuugcgaacugaagaauuuuauacagcuugagaccuauuccgaaguuaugauggugggauggagcgacucuuacacaugugaguauccacugaacuugagggguacccggcucaaagacguccaucugcacgaacuaucaugcaauacugcccugcucaucgugacgauuguaguuaucaugcuggugcuuggcuuggcugucgccuucugcugucugcacuuugauuuacccugguaccuccgaaugcuggggcagugcacacaaaccuggcaccgcgugagaaagacuacccaggagcagcuuaagaggaacguccgguuccaugcauuuaucaguuacagcgagcacgacucccugugggugaaaaaugaacuaauuccgaaccucgagaaggaagauggaucuauacugaucuguuuguaugagucguacuucgacccuggcaaaagcauuuccgagaacaucguuucauuuauugaaaagaguuauaaaucuaucuucgugcugagccccaauuuuguacagaacgaguggugccacuacgaguucuauuuugcucaucacaauuuauuccaugaaaacuccgaucacauaauccucauucugcuugaaccaaucccuuuuuacuguauucccacacgcuaucauaagcugaaggccuugcucgagaaaaaggcguaccuggaguggccaaaagacagaaggaagugcggucuauucugggccaaucugcgugcagcuaucaacgucaaugugcuugccacccgggaaauguacgagcuccaaacuuucacagaacugaacgaggaaucacgagggagcacgauaucuuugaugagaaccgauugucuguga

SEQ ID NO: 63838 - RNA, 2361 nt, Artificial Sequence
  derived and/or modified sequence opt3 from TLR1__Homo_sapiens__NP_003254
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccaaccuuacccugaacaauaucgagacgacuuggaacagcuucauacgaauuuugcaacucguuuggcauaccacagugugguauuuuucgaucucuaaugucaaacugcagggacaguuagauuuccgugacuuugauuacuccggcacuucacugaaggcccuaaguauccaccagguggugagcgacgucuucgguuuuccccaauccuauauuuacgaaaucuucucuaacaugaauauuaaaaacuuuaccguuagcgggacaagaauggugcacaugcucugcccuucaaagauaaguccauuccugcaucuugacuuuuccaauaacuugcugaccgauacgguauucgagaauuguggacaccucacugagcuggaaacacuuauccugcagaugaaccaguugaaggagcucagcaaaauugcagaaaugaccacucaaaugaagucucugcagcaguuagacaucucacagaauagugugagcuacgaugagaaaaagggcgacugcuccuggacaaaaucucugcuaucgcucaacaugagcuccaauauccugaccgauacgauuuuuaggugucuucccccucggauaaaggucuuggaccugcauucaaacaagaucaaaaguauuccaaagcaagugguuaaacucgaagcccugcaggaguuaaauguggcuuucaacucucugaccgaucuuccgggcugcgggagcuuuuccucauugagcguccucaucauugaccacaacucugugucccaucccagugcagauuucuuccagagcugucagaagaugcgcucuaucaaagccggagacaauccuuuucaaugcacaugugagcugggugaguucguaaagaacauagaucagguuuccucagaagugcuagaaggcuggccagacaguuauaagugcgacuaccccgagagcuauagagggacucugcucaaagauuuucacaugucggaacuguccugcaauaucacccuuuugauugucacaaucguggcuacuaugcuggucuuagccgugaccguuacaucucucuguagcuaccuggaccuuccuugguaucugaggauggugugccaguggacccagacucggcgccgagcgagaaacauuccauuggaggagcuccaaaggaaucugcaguuccacgcauuuaucucauacaguggacaugauuccuucuggguaaagaacgaacuacugcccaaucucgagaaagaaggcaugcagauaugucugcacgagcggaacuuugucccggguaagucuauuguggagaauaucauuacgugcaucgagaaaagcuauaaguccauauucguucuuucaccuaacuuugugcagagcgaauggugucauuacgaauuguacuucgcccaccacaaucuguuucaugaggggaguaacucuuuaauccucauucugcuugaacccaucccacaauauuccauuccuagcucguaccacaagcugaaaucacuaauggcucgucgcacauaucucgaguggcccaaggagaaaucuaagagaggacuguucugggccaauuugagggcagcuaucaacauaaaacugaccgaacaggccaagaaauga

SEQ ID NO: 63839 - RNA, 2355 nt, Artificial Sequence
  derived and/or modified sequence opt3 from TLR2__Homo_sapiens__XP_011530518
augccccacacccuguggaugguguggguccucggcguuaucauuagccuuuccaaggaggaaucuucaaaccaggccagucugagcugcgacagaaaugggauauguaaaggauccucugguucguugaacucaaucccuagcggcuuaacagaggcugugaagagucuggaucuauccaauaacaggauuacuuacaucucuaauagcgaccuccaacggugcguaaaccugcaggcacuugugcugacguccaaugggauuaacaccaucgaagaggauucauucaguagcuugggaucucucgaacaucuggaccuguccuauaauuaccucucaaacuuaagcaguucuugguuuaaaccacuguccagccuuacauucuugaaucugcuaggcaacccguauaagacucucggugagaccucgcuguuuucucaccuuacaaaacugcagauauugcgcgucgggaauauggauaccuucacuaagauccagcgaaaggacuuugccggacucacauuccuggaggaauuagagauugaugcguccgaccugcaaucauacgaacccaaaagucucaagagcauccagaacgugucccaucuuauucugcacaugaaacagcauaucuugcuacuggagauauuuguugaugugaccucuagcgucgagugucucgaacugcgugacacggaucuugacacuuuccacuuuucagagcugaguaccggcgaaacaaauuccuugauuaagaaauucacuuuuagaaacgugaagaucaccgaugagagccucuuccagguaaugaagcuguuaaaccaaauuucuggccugcuagaacucgaguuugacgacugcacacugaaugggguuggaaacuucagggcuucagauaaugaccgggugaucgauccugguaaagucgagacccuuacgauccgcagauugcacauuccaagguucuaucuguuuuacgaccucaguacucuguauagccuuacagaacgggugaagcgcauaaccguggagaacuccaaagucuuccugguucccuguuugcucucucagcaucugaagucguuagaauaccuggaucuaagcgagaaucucaugguggaagaguaccugaaaaacuccgccugcgaggacgcauggccuucacuucagacuuugauccugcgacagaaucaccucgccagucuggaaaagacaggcgagaccuuacugacgcuuaaaaacuugaccaauauugauaucucuaagaacagcuuucauuccaugccagaaacaugucaauggcccgagaagaugaaauaucucaaucugucaagcacuagaauacacucuguaaccgggugcauuccuaagacacuagaaauccuggacguguccaacaauaaccucaaucuguucagucuuaacuugccacagcugaaagaguuauacaucagcaggaacaagcucaugacucugccggaugcuucucuucugcccauguugcucguccugaaaauuucccggaaugcaaucaccacauuuucaaaggagcagcuagacaguuuccacacccugaagacucucgaagccggaggcaacaauuuuauuuguagcugcgaguuccugucguuuacgcaagaacagcaggcucuugccaaaguguugauagauuggccugcgaacuaucugugugacuccccaucucauguucguggucagcaagugcaggacguccgcuuaagcgugucagagugccacagaacagcacucguaagugggaugugcugugcccuguuccuucugauccuacucaccggaguucugugccauagguuucacggcuugugguacaugaagaugaugugggcuuggcugcaggccaaacggaagccccgaaaagcaccuucccgcaauauuuguuaugaugcuuucgugucuuacagcgagagagacgccuauugggucgaaaacuuaauggugcaggagcucgaaaauuuuaacccacccuucaagcugugccuucauaagagggauuucaucccgggcaaauggaucauugacaauauaaucgauuccauugagaagucacacaaaacugucuuugugcugagcgaaaacuucguuaagagugagugguguaaauacgaguuggacuuuucucacuuccggcucuuugaugaaaauaacgacgcggccauccugauucuacuggagccuaucgaaaagaaggcaauaccccaacgcuucugcaaacuuagaaagaucaugaauaccaaaacauaccucgaguggccaauggaugaagcucagagggagggguuuugggugaaccugcgugccgcuauuaaguccuga

SEQ ID NO: 63840 - RNA, 2715 nt, Artificial Sequence
  derived and/or modified sequence opt3 from TLR3__Homo_sapiens__NP_003256
augagacagacccugcccugcaucuacuucuggggcgggcuccuuccuuuuggaaugcugugugccagcuccacaacuaagugcacggugucucacgaggucgcugacuguucacauuugaaauuaacccaaguuccagaugaccugccgacaaacauuacugugcuaaaucucacccacaaccagcugaggcggcuucccgcagccaauuucacacgcuauagucagcugaccagcuuggauguagguuuuaacacuauauccaagcucgaaccugagcugugccagaaacugccaaugcucaagguguuaaaucugcaacauaacgaacuuucucaguugucggacaaaacauucgcguuuuguaccaaucugacggagcuacaccucaugucaaacagcauccagaagauuaagaauaaccccuucgucaaacagaagaaucugaucacucuugaucugagucauaacggcuuguccucuaccaaacucgggacacaagugcagcuggaaaauuuacaggagcugcuccuuagcaacaauaagauucaggcucugaaauccgaggaauuggacaucuuugccaacucaagucuaaagaagcuggagcucagcucuaaccaaauaaaagaguucuccccuggaugcuuucacgcaaucggccgacuguucggucuuuuucugaauaacguucaguuggggccaucacucacugaaaagcuguguuuagagcuggccaauaccagcauucguaaccuaagucucucuaauucccagcugagcacaaccucgaacacgacuuuccuuggauugaaauggacaaaucugaccaugcucgaucugucuuacaacaaucuuaacguggucggcaaugacuccuuugcuuggcugccccaauuggaauauuucuuccucgaguacaacaauauccagcaccuguuuucacauaguuuacacggccuguucaacgugagauaucuaaaucucaagaggagcuuuacuaaacaguccauuucucuggcaagccuuccuaagaucgaugacuucucauuucagugguugaaaugccuggaacaucucaacauggaggauaacgacauaccagggauuaagaguaauauguucacaggacugaucaacuuaaaguaccugucccuuagcaauucuuuuaccucauugcggacgcucaccaacgaaacauucguaagucuggcccacagcccgcuacacauucugaaucucacuaaaaacaagaucuccaaaaucgagucugaugcuuuuucguggcugggucaucuugagguuuuggaccugggcuuaaaugaaauugggcaagagcucaccggacaggaauggcgcggccuggagaacauauucgaaaucuaucuuagcuacaauaaguaccugcaguugacaagaaacuccuuugcccucgugcccucacugcagaggcuaaugcugcggcgcgucgcgcucaaaaauguggacaguucuccuagcccauuccaaccccugcgaaaccuuacuauuuuggaucuguccaauaacaauaucgcaaacauaaacgacgauauguuagagggucucgagaagcuggaaauucuugaccugcagcacaauaaccuagccagacucuggaagcaugcuaauccugggggaccaaucuauuuucugaaaggcuugucacaucugcacaucuuaaaccucgagagcaauggcuucgaugaaauucccguggaggucuucaaggaccuguuugaacuuaaaaucauugaucugggguugaacaaucucaacacccugccggccucuguuuucaauaaccaggugucccuaaagagucugaaucuucagaaaaaccucauaacaagcguagagaagaagguguuuggaccugcauucaggaaucugaccgaguuggacaugcgguuuaaccccuucgauuguacuugcgaaucuaucgcuugguuugucaauuggauuaacgagacgcacacaaacaucccagaacuguccucacacuacuuauguaauaccccuccccauuaucacgguuucccagugcgucucuuugacaccaguagcugcaaagauucggcccccuucgagcuguuuuucaugaucaacacuuccauucuucugauauuuaucuucauuguuuugcucauccauuucgagggcuggcgcauuucuuuuuacuggaaugugagcguccacagagugcugggguucaaggaaaucgacaggcaaacagagcaguuugaauaugcggccuacauaauccacgcauauaaagacaaggauuggguaugggagcauuucucaaguauggaaaaagaggaccagucccuaaaguuuugccuggaggaacgggauuucgaggcuggaguuuuugaacuugaggccauugugaacucuaucaagcgaagccgcaaaauuaucuucgucauaacccaccaucuccugaaggacccuuuguguaaaagauuuaaggugcaccaugcuguccagcaagccauugaacagaauuuagauuccaucauucugguguuccucgaggagaucccagacuacaaacugaaccacgcacuuugccugaggcggggcauguuuaagucacacuguauauugaauuggccgguucagaaagaacgcaucggugccuucagacauaagcuacaaguggcucuggggagcaagaacaguguacacuga

SEQ ID NO: 63841 - RNA, 2400 nt, Artificial Sequence
  derived and/or modified sequence opt3 from TLR4__Homo_sapiens__NP_003257
auggagcugaacuucuacaagauccccgacaaucucccuuuuagcaccaaaaaccuugaucuguccuucaauccauugagacacuuaggcucuuauucauuuuucaguuuuccggaacugcaagugcuagaccucuccaggugcgagauucaaacaauagaagauggggccuaccagagccugucucaucuuucgacucugaucuugacgggaaaccccauucagucacucgcucugggugcauucagcggccugaguucccuccagaaguuagucgccguugagaccaaucuggcgucucuugaaaacuuuccuaucgggcacuugaaaacacugaaggagcuaaauguggcucauaaccucauucagagcuucaaacugccagaguauuuuuccaaucuuacuaaccuggaacacuuggaccucucaaguaauaagauccagagcauauacuguaccgaucugcggguauuacaucagaugccccugcucaaccuuucucuggacuugucccuaaauccuaugaacuucauccagccaggagccuuuaaggagauucgccugcacaaacucacacugcgaaauaacuucgauucacuuaacgugaugaagaccugcauccaaggccuggcagguuuggaaguccaccgucucgugcugggggaguuuagaaaugagggaaacuuagaaaaauucgacaagagcgcccuggagggccuauguaaucucacuauugaagaguucaggcuggcuuaucuugauuacuauuuggacgauaucauagaccuguuuaacugccucacaaauguuaguucuuucucccuggugagcgucaccauugaacgggugaaagauuuuucguacaacuucggcuggcagcaucuugagcugguaaauuguaaguuugggcaguuccccacguugaagcucaaaucucugaagcgcuuaacuuuuaccuccaacaaaggagguaaugcauucucagagguugaccugccuagucuagaauuucucgaccugagcagaaacggccuuuccuucaaggggugcuguucucagagcgauuuuggaacaacuucauugaaauaccuggaccucaguuucaauggcgugaucaccauguccagcaacuuucuggguuuagagcaacuggaacaccuugauuuccagcauucuaauuugaagcagaugucagaguucagugucuuucucagccugaggaaccuaauuuaucuggacaucucccacacacacacccggguggccuucaaugggaucuuuaacggacucucuucgcuggaagugcuuaaaauggcuggcaacagcuuccaagagaacuuuuugccagauauuuucacggagcugcgcaauuuaacuuuucucgaccugucccagugccagcuugaacagcugucaccgacagccuucaauaguuugucuagccuccaaguccugaacaugucccauaauaacuuuuucucacuagauaccuuucccuacaagugucugaauagccuccagguucuggacuauucucuuaaccacauaaugacuuccaagaaacaggaguugcagcauuucccuaguagccuggcguuuuuaaaucucacacaaaacgauuucgcaugcaccugugaacaccagucuuuccugcaguggaucaaggaccagcgacaacuucugguggagguagaaagaauggagugcgccacgccauccgauaaacagggcaugcccgugcuaucacucaauauuaccugccagaugaacaagacaaucauaggggucagugugcugagcguuuugguggucucggugguagcuguucugguguacaaauuuuauuuccauuuaaugcuccuggccggauguauuaaguacgguaggggcgagaauaucuaugacgcauuugucaucuacuccucucaggacgaagauugggugcggaacgagcuugucaagaaucuggaagagggggugccuccauuccaauugugccuccacuaccgugacuuuauucccggaguugcuaucgccgcgaacauuauacacgagggcuuccauaaaagccgcaaggugaucguagucgugucacagcacuuuauucagaguagaugguguaucuucgaauaugagaucgcccaaacuuggcaguuucuguccucuagggcagguauuauauucaucguucuacagaaaguggaaaagacccugcuucggcagcaagucgagcucuaccgacuguugagccgcaacacauaucuggaaugggaggauuccguguuagggagacauaucuuuuggaggcggcuccgcaaagcucugcuugacggcaagucauggaauccggagggaacuguaggcaccgggugcaacuggcaggaagccacaagcauuuga

SEQ ID NO: 63842 - RNA, 2577 nt, Artificial Sequence
  derived and/or modified sequence opt3 from TLR5__Homo_sapiens__XP_006711569
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuagcaacgcuaucaguaagucucaagcauucucccucauucuggcccaucacaucaugggcgcuggguuuggauuccacaauauaaaagaucccgaccagaacacauuugccggcuuagcgcggagcucgguucgccaucuggaccuaucucacgguuucguguuuucccucaacucacgagucuucgagacccugaaggaucuuaaaguguugaaucuggcauacaacaagauuaauaagaucgccgacgaggcuuuuuacgggcucgauaaccugcaagugcuuaaucugaguuauaacuugcucggagaacuguacagcuccaauuucuauggcuuaccuaaagucgccuacauugaccugcagaagaaccauaucgcaaucauucaggaucagacguucaaauuucuagagaagcuccagacucuggaccuuagagauaaugcuuugaccacaauacacuucaucccaucuauuccggacaucuuucugagcggcaacaaacucguuacucugcccaagauaaauuuaaccgccaaccugauucaccuuucagaaaauagguuggagaaccucgauauccuguauuuccuacugcgggugccucaucuccaaauccugauucuuaaucagaaccguuuuaguuccuguagcggggaccagacaccaucugaaaaccccucauuggagcagcuguucuuaggagaaaauaugcuccaacuggcgugggagaccgagcuuugcugggauguauuugaaggucugagucaccuccagguguuguaccugaaccauaauuaucuaaacagccugccuccaggcgucuucucccaccucacggcccugcgcgggcuuucuuugaacucgaauagacugacuguguuaagccauaaugaccuccccgcaaaccuggagauccuugacauuuccaggaaucagcugcuagcuccgaacccugauguuuuugugucacucaguguccuggacauaacacacaauaaauucaucugugaaugcgaguugucuaccuuuauuaacuggcugaaucacacuaacgugacaaucgccggacccccagcugauaucuacuguguauacccugacagcuucuccggcguuucauuauuuagccucucuaccgaagguugcgaugaggaggaagugcugaagucccuuaaguucagucuguucauugucuguacggugaccuugacacucuuucugaugacuauacuaaccgucacaaaauuccggggguuuugcuucaucugcuauaagacugcccagcgacugguguuuaaagaccauccccaaggcaccgagccagauauguacaaguaugacgcauaccuuuguuucagcucuaaagauuuuacauggguucagaaugcccuccugaagcacuuggacacccaguauuccgaucagaaccgcuucaaccugugcuuugaagagagagacuucgugcccggagaaaauaggauugcuaacauccaagaugcgauuuggaauagucggaagaucguauguuuagucucacgccauuuucucagagacggcuggugccuggaggcauucagcuacgcccaggggaggugucuuucggaccugaacuccgcuuugauaauggugguugugggaucucucagccaguaucagcugaugaaacaccaaucaauccgugguuucguccagaagcagcaauaccuacgguggccugaggaucugcaggacgugggcugguuucuucacaaacucagucagcagauucugaagaaagaaaaggagaagaaaaaggauaauaacaucccauugcaaacuguagccacgauuuccuga

SEQ ID NO: 63843 - RNA, 2391 nt, Artificial Sequence
  derived and/or modified sequence opt3 from TLR6__Homo_sapiens__NP_006059
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucucuguuugccauucaggugaauaucagcguaaacacccucgggugucugcagcuuacaaauauuaagcugaacgaugacaauugccagguuuucaucaaauucuugucugagcucaccagaggauccacucuguuaaacuuuacacugaaccauaucgaaaccacguggaagugucuagugagggucuuccaauuucucuggcccaaaccuguggaguaucugaauauuuacaaccuuacuauaaucgagucaauucgggaagaggacuucaccuauagcaagacaacuuugaaagcacugaccaucgaacacauaacaaaucagguguuucucuucagucagaccgcccuguacacggucuuuucugagaugaacauuaugaugcuuacuaucuccgauacaccauucauccacaugcugugcccccaugcuccuagcaccuuuaaguucuugaauuuuacucaaaacguuuucacagacucgauuuuugaaaaguguucuacccucgugaaacuggagacguuaauccugcagaagaauggccuaaaagaucucuucaagguaggucugaugaccaaagacaugccaucccuugagauuuuggaugugucauggaacagucuggaaagcgggcgccacaaggagaauugcacaugggucgaauccauagugguucucaaccugucuagcaauauguuaacugacucaguguucagaugucugccgcccaggaucaagguccuugauuugcauaguaacaaaauuaaguccgugccuaaacagguaguuaagcucgaggcacugcaggaacuaaauguggccuuuaacagccugaccgaccucccaggaugcggcucuuucucaagucugagcguccuuaucaucgaucacaauuccgugucucaucccucggcugacuuuuuccaaagcugucagaaaaugcgguccauuaaggccggcgauaacccuuuucagugcacaugcgaguugcgcgaguucgucaagaacauagaccaggugucaagugaaguucuggagggguggccagacucuuacaaaugugauuaucccgaaagcuaccgaggauccccguuaaaggacuuucacaugucagagcucagcugcaauaucacucugcuuauugugaccaucggugcgacaaugcugguauuggcagucaccgugacuucucucuguauuuaucuggaucuaccuugguaccugagaaugguuugccaauggacgcagacaaggcggcgugcccgcaacaucccccucgaagaacugcagagaaaucuucaguuccacgcuuuuauauccuauagugagcaugacagcgccugggugaaaucugaauuggucccauaccuggagaaggaagauauccaaauuuguuuacacgagaggaacuucgugccuggcaaauccaucguagagaauauuaucaacugcauagaaaagucauauaagaguauuuuugugcucagccccaauuucguucagucggaguggugucauuacgaacuguacuuugcacaccacaaccuuuuccaugagggguccaauaaccugauccuaauucuccuggaaccaaucccccagaauaguauaccuaacaaauaucacaaguugaaagcucugaugacccagcggacuuacuuacaauggccaaaggagaaaagcaagcgaggacucuucugggccaauauccgcgcggccuuuaacaugaaacugacccuugucacagagaauaacgacgugaagucauga

SEQ ID NO: 63844 - RNA, 3150 nt, Artificial Sequence
  derived and/or modified sequence opt3 from TLR7__Homo_sapiens__NP_057646
augguguuccccauguggacccugaagagacagauccucauucuuuuuaacauaauccugauuagcaaauuguuaggcgccaggugguucccuaagacacugccaugcgacgucacucuagauguuccgaaaaaucacgugaucguagacuguacggauaagcaucucaccgagauucccgggggaaucccuacaaacacuaccaaucugacacuuaccauaaaccacaucccagacauuucccccgcuucuuuucaucggcuggaucacuugguggaaaucgacuuccgcugcaauugugucccuauuccacucgguagcaaaaacaauaugugcaucaagcgacugcaaauaaagccccguaguuuuagcggccugacuuaccucaaauccuuauaucuggaugggaaccagcuuuuggagauuccucagggacugccaccgucucuacagcuccugucgcuugaagcaaauaacaucuucucaauuagaaaggagaaucugacagaauuggccaacaucgagauccucuaccugggccaaaauuguuauuacaggaaccccugcuaugugagcuacaguauugagaaagacgcguuuuuaaaucugaccaagcucaaaguucuuucccugaaggauaacaacgugacggcugucccuacuguguugccaucuacccuaacagaacuguaucucuacaauaacaugauagccaagauccaggaggacgauuucaauaaccugaaucagcuucagauucuggacuugagcgguaacuguccccggugcuacaaugcaccuuuuccaugugcccccugcaaaaacaauuccccgcuccaaaucccuguaaacgcuuucgaugcacugacugaauuaaagguucugcgccuacauucaaauagucuccagcacgugcccccaagaugguuuaaaaacauaaauaagcugcaggagcuugacuugagccagaacuuccuggccaaagagauuggggacgcuaaguuucuccacuuccugccuucucuuauccaacuggauuuguccuucaauuuugaacuccaggucuauagggccucaaugaaccugagccaggcguucaguucuuuaaaaucccugaagauccuacggauucgcggauacguguuuaaggagcucaaaucauucaaccugucgccccuucauaauuugcaaaaccuggaagugcucgaccugggcaccaauuuuaucaagauugcaaacuuaucuauguucaaacaguuuaagcgacugaaagucauagaucuuuccguuaauaagaucucaccaaguggcgacagcuccgaggugggguucuguucuaacgccagaacaagcguagaaucauaugagccccagguguuggagcagcuccacuacuuuagguaugauaaguacgcucggaguugccguuucaaaaauaaggaagccuccuuuaugagcgucaacgagucuugcuauaaauacggacaaacccuggaccuaucaaagaauaguauuuucuuugugaaaagcuccgauuuccagcaucugucuuuccucaagugucugaaccuuucggguaauuugaucagccagacgcugaacggcuccgaauuucagccuuuagcagagcuccgcuaccuggacuucucaaauaacagacuugaucuguugcacaguacugcuuuugaagaacuccacaagcuggagguucuagacaucucuagcaauucccauuauuuccaaucagaagggauuacacacaugcugaacuuuaccaaaaaccucaaggugcugcagaaacuuaugaugaaugauaacgacauaaguucuuccacuagcaggacaauggagagcgaaucuuugcggacccuggaguuccgaggaaaucauuuagacguccucuggcgcgaaggcgauaacagauaccugcagcuuuuuaagaaucugcuaaaacucgaggagcuggacaucuccaagaacucauugaguuuccugccaagcgguguguuugaugggaugccgcccaauuuaaagaaccucucgcuggccaaaaauggacuuaaguccuucucuuggaaaaagcugcagugcuugaaaaaccucgaaacgcuggaccuaagccacaaucaacugaccacaguaccugagaggcuuucaaacuguagucggucccucaagaaucugauuuugaaaaacaaucagauccgcucucugacuaaguacuuuuuacaggaugcguuccagcucagauaucuggaccuuagcuccaacaagauucaaaugauccagaaaaccucauuuccagaaaacguucugaauaacuugaagaugcuccugcuacaucacaauagguuccugugcacaugugaugccgugugguucgucuggugggugaaccacacugaggucaccauacccuaucuugcaacagacgugaccugcguuggcccuggcgcucauaaagggcagagcgugaucagucucgaucuguacacuugugaguuggacuuaacgaaucugauucucuuuucucuguccaucagcguaucgcuuuuccugauggucaugaugacagccucacacuuguauuuuugggaugugugguacauuuaccauuucugcaaggcuaaaaucaagggauaucaacgucuaauaucuccagacuguugcuacgaugccuuuauuguuuaugacaccaaggaccccgcagugacugaauggguccuggccgagcucguggcuaaacuggaagauccgcgggagaagcacuucaaccuuuguuuagaggagcgagacuggcugccuggucagccaguacucgagaauuugagucaguccauccagcugagcaaaaagaccguguuuguuaugacagauaaauacgcgaagaccgaaaacuucaagauugcauuuuaucucucucaccaaagacugauggacgagaaagucgaugugaucauacuuaucuuccuggaaaagcccuuucagaaaagcaaguucuugcagcuaaggaaacgccugugcggcuccucagugcucgaguggccuacuaauccccaggcccauccauacuucuggcaaugcuuaaagaacgcucuggccacagacaaucacgucgcauauagucagguuuuuaaggaaacgguguga

SEQ ID NO: 63845 - RNA, 3126 nt, Artificial Sequence
  derived and/or modified sequence opt3 from TLR8__Homo_sapiens__NP_619542
auggagaacauguuccugcagagcuccauguugaccugcaucuuucuucugauuucuggcucaugugaauugugcgccgaggaaaauuucaguagaagcuaccccugugacgagaagaaacaaaacgauuccgugauagcugaaugcucuaauaggcgguuacaggaggucccucagacaguugggaaguaugugacugagcuggaccuaucggauaacuuuaucacgcacauuaccaaugaaucauuccagggacuccaaaaccugacaaaaaucaaucuuaaccauaauccaaacguacagcaccagaaugguaacccgggcauucagagcaaugggcugaacaucacugacggagcauuuuugaaucucaagaaccugcgcgagcugcucuuagaagauaaccaacugccccagauaccuaguggccuuccagaguccuugaccgagcugucucuaauccagaauaacauuuacaauaucacaaaagaagguauuagccgacucaucaaccugaagaaucuuuaucuggccuggaacuguuacuucaauaaggugugcgagaaaaccaacauagaagacggggucuuugagacuuugacaaaucucgaacuguuaucccugucauucaacagucucagccaugugcccccuaaacuuccaucuucccugcguaaguuguuucuaucaaauacccagauuaaguauaucagcgaggaggauuucaaaggacugauuaaccucacgcugcuugaccugaguggcaauugucccagaugcuuuaacgcgccuuucccauguguuccgugcgauggcggggcuucuaucaauaucgacagguuugccuuccaaaacuugacucagcuccgguaccugaacuuauccagcaccucgcugcgcaagauuaaugcagccugguucaagaacaugccccaccuaaaagugcucgaucuggaauuuaauuaucuugucggagagauagcuucuggugcauucuugacaaugcugccuagacucgaaauccuggaccuuuccuuuaacuacauuaagggcucauacccacagcauaucaauauaaguaggaacuucagcaaacuguugucccuccgggcccugcacuuacgcggguauguguuucaagagcugcgagaagaugacuuccagccccuaaugcagcucccuaaucugucuacuauuaaccuuggaaucaauuuuaucaagcagauugacuucaaauuguuucaaaacuucagcaaucuggagaucauuuaccucucagagaacagaauaaguccacugguaaaggauaccaggcaguccuaugcuaauucuucuucauuucagcggcacauccguaaacgcagaaguacagacuucgaauuugauccccauagcaacuucuaccacuucaccaggccguuaauuaagccucagugugccgcguauggcaaggcacuggaccuuuccuugaauagcaucuuuuucaucggucccaaccaauuugagaaccucccagauauugccugccugaaucuaucggcuaacagcaaugcccagguucuguccgggacggaauuuucagcaauaccucaugugaaauaccucgaccugacuaacaaucggcuugauuuugacaacgcuagugccuugacagagcugucugauuuagaaguccucgaccugagcuauaauucccacuacuuccgaaucgcgggagugacccaccaucuugaguuuauucagaacuucacuaaucugaagguguugaaccucucacacaauaacaucuacacacugaccgauaaauauaaucuagagagcaagucucuggucgaacucguuuucuccggcaaccgccuggacauucuuuggaaugacgaugacaacagauacaucaguauauucaaaggcuugaagaaccugacgagguuagaucucagccugaaucggcuuaagcauauccccaacgaggccuuucugaaucuaccagcaucucucaccgaacugcacauuaacgacaauauguugaaauucuuuaacuggacacuguuacagcaauucccccgccucgagcugcuugaucugagagggaauaagcuccucuuccugacugacucccuaucagauuuuaccaguagccugaggacacuucuccugucgcauaaccguaucucccacuugccuucuggauuccugagcgaggugucaaguuuaaaacaccucgaccuguccucuaaucuucugaagacuauuaacaaaagcgcuuuggaaaccaagacaaccacuaagcucuccaugcuggagcuacaugguaauccauuugaaugcacgugugauaucggcgacuuccggcgauggauggaugagcaccugaacguaaaaauaccgagacuuguggacgucauuugcgccucacccggggaucagaggggaaagagcaucgugagucucgaacugacaaccuguguuucugacgugacugcugucauuuuguuuuucuuuaccuucuuuaucacaaccauggugauguuagccgcacuggcccaucaccucuucuauugggacguaugguuuauauacaauguuugccuggcuaaagugaagggcuaucgcucccuuagcacuucgcagacauucuacgaugcguauaucucauacgacacgaaagaugcaucugucaccgacugggugauuaacgagcugcgguaccacuuggaggaaaguagagauaagaauguccuacugugucucgaggaaagggacugggauccuggucuggccaucauugacaaccuuaugcaguccaucaaucaaagcaagaaaacuguguucguuuuaacaaagaaauaugcuaagucuuggaacuuuaaaaccgccuucuaccuggcacuccagcgcuugauggaugagaacauggacgugauaauuuuuauccugcucgaaccaguacugcagcauagccaauaucuucgacugcggcagcguaucugcaaguccucaauuuugcaguggcccgauaauccuaaagccgaggggcuauucuggcagacacugagaaacgucgugcucacugagaaugacaguagguacaacaauauguauguugauagcaucaagcaauacuga

SEQ ID NO: 63846 - RNA, 3099 nt, Artificial Sequence
  derived and/or modified sequence opt3 from TLR9__Homo_sapiens__NP_059138
augggcuucugcagaagcgcccugcacccccucucccuucuggugcaggcuaucauguuggcaaugaccuuagcccuggggacacuaccugcguuucucccaugugagcugcaaccgcauggacuugucaacugcaauuggcuguucuugaagucuguuccccacuuuucaauggcugccccuagggguaacgugacgagucucagccuguccucuaaucggauucaucaccuucaugacucggauuucgcacaccucccaucauuacgccaccugaaccuuaaauggaauugucccccuguaggcuugagcccaaugcauuuucccugccacaugacuauagaaccuaguaccuuccuggccgugccaacacuagaggaacucaaccuguccuacaauaacaucaugacugucccggcucugcccaagucucugauuagcuugucccucucacauaccaauauccugauguuagacagugcaagccuggccgggcuccacgcucugcgauuucuguucauggauggaaacuguuauuacaaaaauccuugccgucaggccuuggagguggcgccaggcgcacuacugggucucgggaaccugacacaccuuucucugaaguauaauaacuugaccguugugcccagaaaucucccuuccucacuggaauacuuacugcuaagcuauaacaggauugucaaacucgccccagaggaccuggcuaaccuuacugccuugcgggugcuggauguaggaggcaauugucgcagaugcgaccaugcacccaacccguguauggagugcccuaggcacuuuccccagcuccauccagauacauucagucaccugucucggcuugaaggccugguuuugaaggacuccagccucucguggcugaaugcuucuugguuucgcggguuaggaaaccugcgagugcuagaucucuccgagaauuuccuguacaaguguaucaccaaaacgaaggccuuucagggucuuacucaauugagaaaacugaaccucucauucaauuaucagaagagggucaguuucgcgcaucugagcuuagccccuuccuuuggcucucugguggcacuuaaagaauuggacaugcacgggauauucuuucggagccucgaugagaccacacugcguccccuagcucgccugccaaugcuccagacucugagacuucagaugaacuucaucaaucaagcccaguugggaauuuuuagggcuuuccccggccugcgguacguggacuuaucagauaaccgaaucaguggugccuccgagcucaccgcaacaaugggggaagccgacggaggcgagaaggucuggcugcagccuggcgaccuugcuccagcgccgguugauacccccagcucugaagacuuucgcccuaauugcucaacgcugaacuucacuuuggaucucaguagaaauaaccuggugacaguacagccagagauguuugcacaacuaagccaccuucagugccucaggcugucccauaauuguauuucucaggccgugaacgggucgcaauuccuucccuugaccggacugcaggucuuagaccucagccacaacaagcuggaucuuuaccaugaacacuccuuuacugagcugccucggcuagaggcucucgaccugucauauaauagucagccauucgguaugcagggcguggggcacaacuuuucuuucguugcccauuugcgcacacugagacacuuaagccucgcacauaauaacauccacucccaagugucacagcagcugugcagcaccucucuuagggcccuggauuucuccggaaaugcuuugggccauaugugggccgaaggugaccucuaccugcacuuuuuccaggggcuaaguggccugauauggcuugaucucagccaaaaccgucugcacacguugcugccccagaccuuacggaaucucccgaaaucucugcagguccuucgacugagagacaacuauuuggcauuuuucaagugguggucccuccauuuucugccuaaacuagaggugcuggaucuugcgggaaaucagcucaaggcucugacaaacggcucauugccagccgggacuagguuacgccggcuggacguaaguuguaauagcauuucguucguugcacccggauuuuucuccaaagccaaggaacucagagagcugaaccuuucugcuaaugcccugaaaaccguggaccacagcugguuugguccuuuggcaucagcucuacaaauccuggaugucagugccaacccccuccauugcgcguguggcgccgcuuucauggacuuucugcuugaagugcaggcagccgucccaggguuaccuuccagggugaagugcggaucucccggccagcugcagggucucagcauuuucgcucaagauuugcgccugugucucgacgaggcccuguccugggauugcuuugcacuuucacuguuggcgguugcccuagggcugggcgugccaaugcuccaccauuuauguggaugggaccugugguacugcuuccaccuuugucuggcuuggcucccguggcgaggccggcagagcgggcgugaugaggacgccuugccuuaugaugcauucguagucuuugacaagacacagagugcuguggccgauuggguuuacaaugaacugagaggacaacucgaggaaugcaggggucgcugggcacugcggcuuugccuagaggaaagagacuggcugcccggcaaaacuuuguucgagaacuuaugggccucuguguauggguccaggaagacccuguuuguccucgcucacacagaucgagugagcggacugcuucgcgcgucguuccugcucgcccagcagcgguugcuggaggacagaaaagacguagugguucuagucauccugucaccagauggcaggcguucucgcuacgugcggcucagacagaggcuuugucgacaaagugugcuguuauggccccaucagccuuccggucagcggagcuuuugggcacaguuggggauggcucugacccgcgacaaccaccauuucuacaauagaaacuuuugccaaggcccaacugccgaauga

SEQ ID NO: 63847 - RNA, 774 nt, Artificial Sequence
  derived and/or modified sequence opt3 from TLX1__Homo_sapiens__NP_001182446
auggagcaccugggcccccaucaccuccauccugggcacgccgaaccaaucagcuucggaauugaccagauacuuaacuccccggaucaagguggcugcauggggcccgcuucuagacugcaggacggagaguacggcuuggguuguuuagucgggggagcauauaccuacggcggcgggggaucagccgcggcuacaggugccggcggggcaggagccuauggcacuggugggccuggaggcccaggcgggcccgcuggagguggcggggcaugcaguaugggaccucugacgggcagcuacaaugugaacauggcccuagcuggugggccaggccccggaggcgggggagguuccucuggcggggccggagcgcucucggcagccggcguuaucagggugccugcucaucggccacuggccggugcaguagcucacccgcagccccuugccaccgggcugccuacagugccaucaguccccgcgaugccuggcgugaauaacuugacuggacucaccuuuccauggauggaaagcaaucgccgauauacaaaggaucguuucaccggccaccccuaccagaacagaacuccgccuaaaaagaaaaagcccaggacaaguuuuacccggcugcaaauuugugagcuggaaaaacgcuuccauagacagaaguaucucgccuccgcagagagggcugccuuagcuaaggcccugaaaaugacggacgcacagguuaagacuugguuucagaaucggcgcaccaaauggcgauga

SEQ ID NO: 63848 - RNA, 855 nt, Artificial Sequence
  derived and/or modified sequence opt3 from TLX2__Homo_sapiens__NP_057254
auggagcccggcaugcuggggccucacaaccucccacaucacgaaccgaucagcuucggaauugaccagauacuuuccggucccgagaccccuggcgggggacugggcuuggguagagggggacaaggccauggcgaaaauggggccuuuucuggagguuaccacggcgcuucaggguauggaccagcaggcaguuuagcgccccugccugguagcuccggggugggaccaggcggcgucaucaggguucccgcccaucggccucuaccagugccgcccccugcugggggagccccagcaguacccgguccuucuggccucgggggagccggcggucuggcugggcuuacauucccauggauggauucgggccgccgauuugcaaaggaccgucugacugccgcuuugucacccuucagcggaacgagaaggauuggccacccguaccagaaccggaccccucccaaacgcaagaaaccaagaacaaguuuuuccaggucucaggugcucgagcuggaacggcgcuuccugcgacagaaguaucucgccagcgcggagagagcagccuuagcuaaagcccugaggaugacugaugcacaagucaagaccugguuucagaaucggcguacaaaguggcgcagacagaccgcugaggaaagggaggccgaacggcaccgagcggggcgccuuuugcugcaucuacagcaagacgcccucccuagaccccugaggccaccccuuccuccagauccgcugugcuugcacaacuccucacucuucgcacugcagaauuuacagcccugggcugaggacaacaaaguggccaguguuagcggacuggcuucuguggucuga

SEQ ID NO: 63849 - RNA, 876 nt, Artificial Sequence
  derived and/or modified sequence opt3 from TLX3__Homo_sapiens__NP_066305
auggaggcccccgcuagcgcacagaccccucacccacaugaaccgaucuccuucggcauugaccaaauacugaacucucccgaucaggacucagccccugcgccaagagggcccgauggagcuaguuaccucgguggcccuccagggggaaggcccggcgccacauauccuagccuuccagcauccuuugccggucugggggcuccguucgaggacgcaggaucuuacucggugaauuugucauuagcccccgcuggcgucauccggguuccugcccaccgcccacugcccggcgcggugccuccaccccuaccgagcgcacucccugccaugcccaguguaccaacuguguccucucuugggggacugaacuuuccuuggauggaaagcucccgacguuucgucaaggauagauuuacggcugccgcagcucugacccccuucacagugacuaggcggauuggucauccauaucagaaucgcacacccccuaaaagaaagaaaccaaggaccucauuuagucggguucagaucugcgaguuggaaaagcgcuuccaccgacaaaaauaccucgccagcgcggagagagccgcacuggcuaagucucugaagaugaccgacgcccaggugaaaacuugguuucagaacaggcggacaaaguggcgucgccagaccgcugaggaaagagaggccgaaaggcaacaggcaucccggcucauguuacagcugcagcaugaugccuuccaaaaaucacuuaaugacagcauucagccggaucccuugugucugcacaacaguucucuauuugcucuccagaaucugcaaccuugggaggaggacuccagcaaggucccagcggugacgucgcuuguauga

SEQ ID NO: 63850 - RNA, 609 nt, Artificial Sequence
  derived and/or modified sequence opt3 from TM4SF1__Homo_sapiens__NP_055035
augugcuacggcaagugugccagaugcaucgggcacagccuggugggacucgcacuucuguguauugcugccaacauauuguuauauuuccccaauggugagaccaaauacgcguccgaaaaccaucugucuagguuugucugguucuuuucaggcaucguugggggaggccuacucaugcugcuuccugcuuucguguuuauuggucuggagcaggacgauugcugugggugcuguggacacgaaaauugcggcaagcggugugccauguugaguagcguacucgcagcccugaucggcauugcuggguccggauauugcgugaucgucgcagcccugggucucgcugagggcccauuaugucuggacucucuugggcaauggaacuacacauucgccucgacugaaggacaguauuugcuggauacgucaaccuggagcgagugcacagagccgaaacauauaguggaauggaauguuagucuauuuuccauccuccuggcgcuuggcgguauugaguucauccugugcuugauucaggugaucaacgggguccucggaggcauauguggcuuuugcuguucucaccagcaacaguacgacugcuga

SEQ ID NO: 63851 - RNA, 690 nt, Artificial Sequence
  derived and/or modified sequence opt3 from TM4SF20__Homo_sapiens__NP_079071
augaccugcugugagggcuggacaagcugcaacggguucucccugcucgugcuucuguuguuaggagucguucugaaugccaucccccuaauugugucucucguagaagaggaccaguuuucacaaaacccuauaaguuguuucgaauggugguuuccagguaucauuggcgcugggcugauggcaaucccggccacuacgaugagccuuaccgcgagaaagagggcuugcuguaauaaccggacaggaauguuccuguccucuuuguuuucggugauuacugucaucggcgcccucuacugcaugcugauaucaauccaggcacugcucaaaggucccuuaauguguaauagcccuaguaacuccaaugccaacugcgaguucucucugaagaauauuagcgauauccacccagaauccuuuaaccuucagugguucuuuaaugacucaugugcucccccuaccggguucaacaaaccaacaaguaaugauaccauggcaagcggauggcgcgccucuuccuuucauuucgacucagaggagaacaagcaccgauugauucauuuuagcguguuccugggccuacuccugguuggcauccuugaagugcuguucggguugagucagauagucauuggauuucucgguugccuguguggcgugucuaaacguagaucccaaaucguauga

SEQ ID NO: 63852 - RNA, 609 nt, Artificial Sequence
  derived and/or modified sequence opt3 from TM4SF4__Homo_sapiens__NP_004608
augugcaccggcgggugugccagaugccugggagguacacucaucccccuugcuuucuuuggcuuccuggcaaacauuuuguuauuuuucccugggggaaaggugauagacgauaaugaccaccugagccaggagaucugguuuuucggcgguauucuaggguccggaguccucaugaucuuuccagcccugguuuuccuuggccugaaaaacaaugauuguugcggcuguugcgggaacgaaggaugugguaagagguuugcgauguucacuucuacgauuuuugcugugguaggcuucuugggggccggauacucauuuaucauaagugcaaucagcauuaauaaaggcccgaagugccucauggccaacuccaccugggguuaucccuuccaugacggggauuaccugaaugacgaggcucuguggaacaaaugucgggaaccucucaauguggucccauggaacuuaacacuguucucuauccuuuuggugguuggaggcauucaaauggugcugugcgcaauccaggucgugaauggccuacucgggacucuguguggagauugccagugcugugguugcuguggcggggacggacccguauga

SEQ ID NO: 63853 - RNA, 594 nt, Artificial Sequence
  derived and/or modified sequence opt3 from TM4SF5__Homo_sapiens__NP_003954
augugcaccggcaagugugccagaugcguggggcugagccucaucacacuuugucuggucugcauuguugcuaacgcauuguuacuggugcccaauggagagacuuccuggacgaacaccaaucaccuaucucuccagguauggcugauggguggcuucauagggggaggccuuauggugcuguguccugguaucgccgcggucagggcugggggaaaaggcugcuguggcgccgggugcuguggaaaccggugccgcauguugcgaucaguguuuaguagcgcauucgguguucucggcgccauuuacugucuguccgugucuggggcuggacugcguaauggcccaagaugccucaugaacggugaauggggguaucauuuugaggacacagcaggagccuacuuacugaauaggacucuuugggaucggugcgaagcuccgccccgcgucgugccuuggaacguaaccuuguucucgcugcuaguugccgcgucaugucucgagaucgugcugugcggcauucaacuugucaaugcaacaaucggcguguuuuguggggacugcagaaagaaacaggauaccccacacuga

SEQ ID NO: 63854 - RNA, 1134 nt, Artificial Sequence
  derived and/or modified sequence opt3 from TM6SF2__Homo_sapiens__NP_001001524
auggacauucccccucuggccggcaagaucgcugcacucagccuuuccgcccugccagugucuuacgcguugaaccacgucucagcuuuaagucauccgcuguggguugcccuaaugagcgcacucauacuggggcuucuguucguggccguauauuccuugucucacggagaggugucguacgauccccucuaugcugucuuugcaguguucgccuuuaccucaguuguggaccugaucauugcucugcaggaagauagcuacgucguggguuucauggaguuuuauacaaaagaaggcgagccuuaccucagaacugcccaugggguauucaucugcuauugggacggaacgguucacuacuuacuguaccuugcgauggcaggcgccauuuguaggcggaagcgcuaucgaaauuuugguuuguacuggcuggggaguuucgcuauguccauccuaguguuucucaccggaaacauacugggcaaauauucuagcgaaauccguccagccuucuuucuuacaauucccuaccuguuggucccuugcugggcaggcaugaagguguucucccaaccaagagcucucacuagguguaccgccaauauggugcaggaggagcagcggaaagggcuguuacagcgccccgcggaucuggcccucgucaucuaucuuauucuggcaggauuuuucacauuguucagaggucuaguugugcuggacugcccuaccgaugcuuguuuuguauacaucuaucaauacgaaccauaccucagggacccgguggccuaucccaagguccagaugcugauguacauguucuaugugcuuccuuuuugcggccuggcugccuacgcauugacuuucccaggguguucauggcuccccgauugggcccugguuuuugcuggaggcauaggucaggcgcaguucagucauaugggggcaagcaugcacuuacggacaccuuuuaccuaucgcgugccagaggacacguggggaugcuucuuugucuguaaccugcuauacgcccucggcccccaucugcuugcuuaucgaugcuugcaauggccggccuucuuucaccagccucccccaucugauccucuggcacuccacaagaaacagcauuga

SEQ ID NO: 63855 - RNA, 1176 nt, Artificial Sequence
  derived and/or modified sequence opt3 from TM7SF2__Homo_sapiens__NP_001264162
auggcccccacccagggcccuagagcuccacuggaguucgggggaccgcucggugcagccgcgcuucuguuguuacugcccgcuacaauguuucaccuacuccuggccgcaaggagcggcccugcccggcuucuggggccacccgcuuccuugccuggacucgaagugcuguggucuccacgcgcacugcucuuauggcuggccuggcuuggcuugcaagcugcccuguaccuacuccccgcgcgaaaggucgcagagggucaggaacugaaagacaagucacgucuuagauauccuaucaacggguuccaggcccugguuuugacugcucuccuggugggauuaggcaugagugccggccugccacucggggcacuuccggagaugcuguugccccuagcuuuuguagccacgcugaccgcguucauuuuuagccucuuccuguacaugaaagcccagguggcaccugucuccgcucuugccccaggagguaauucuggcaaccccauauaugacuuuuuccuggggagggaauugaauccucggaucugcuuuuucgauuuuaaguacuucugugagcuccgcccaggacugauuggcuggguguuaaucaaccuggcucuacucaugaaagaggccgaacugagagguucgcccucacuugcaaugugguugguuaauggguuucaacugcucuaugugggagaugcccuguggcaugaggaagcuguccuuacaacuauggacauuacccacgauggcuucggcuucaugcuggcguuuggggacauggcaugggugccguucacauacagcuugcaggcccaguuucuccugcaucacccucagcccuuaggacugccaauggcuaguguaaucugccuaauaaacggucucgagaccaucuccacugccacaggcaggaagcugcuuguuucugggugguggggaauggugcggcauccuaauuauuugggcgaucugauuauggcacucgccuggagccugcccuguggugucucccacuuacugccauacuucuaccuuuuguauuuuaccgcucuccuggugcaccgcgaggcccgagacgaaagacaaugccuacagaaguacgggcuggcauggcaggaguauuguaggcgggugcccuaccguaucaugccuuauauuuacuga

SEQ ID NO: 63856 - RNA, 1992 nt, Artificial Sequence
  derived and/or modified sequence opt3 from TM9SF2__Homo_sapiens__NP_004791
augagcgccagacugcccgugcucuccccuccaagguggccgcggcuucuguuguuaucucugcuacuccugggcgcuguccccgggccucgccgaucaggagcauucuaccuuccaggucuggcccccguuaacuuuugcgacgaggaaaagaaaagugaugaguguaaggcggaaaucgaguuguucgugaaucgucucgacagcguagaauccgugcugccuuaugaguacaccgcuuuugauuucugccaggccucugagggcaaaagaccaucggaaaaccuggggcaaguccucuuuggagagaggauugaacccucaccuuauaaguucacauuuaauaaaaaggagacuuguaaguuagugugcacgaaaaccuaccacacagagaaggcagaagacaaacagaagcuggaguuccuuaaaaagagcauguugcugaacuaucagcaucacuggauaguugauaauaugccagugacuugguguuacgacgucgaagauggccagcgguuuugcaacccggguuuccccaucggguguuauauuaccgacaagggacaugccaaagaugcuugcgugaucaguuccgacuuucacgagcgcgauacauucuacauuuuuaaucauguagacaucaagauauacuaucacguuguggaaaccggcucuaugggcgcaaggcuagucgccgcuaaacucgagccuaagagcuucaaacacacucauaucgauaagccagacuguuccgggcccccuauggacauuucaaacaaagccaguggagagaucaagauugcguacacauauagcgugucuuucgaagaggaugacaagaucagaugggcaucccggugggauuacauacuggaaucaaugccacacacccauauucaaugguuuagcaucaugaauagucuugugauuguccuguucuugucugguaugguugccaugaucaugcuccgcacgcugcacaaagacaucgcucgauauaaccagauggauuccacugaggacgcccaggaagaguuuggcuggaaguuagugcacggggauauuuucagacccccgaggaaaggaaugcugcucagcguauuucuuggcucggguacccagauacugaucaugacauucgugacuuuguuuuucgcaugccuaggguuucugucuccugcuaaucggggagcccucaugaccugugcggucgugcuguggguucuucugggcacacccgccggcuacguggcagcucguuucuauaaguccuuugggggagagaaauggaagaccaacgucuugcucacgucauuccugugcccagguauuguguuugccgacuucuucaucaugaauuuaauacuguggggcgaagggaguagcgcugccauuccuuuuggaacucuaguagcaauccucgcccugugguucugcaucuccguuccccuuacauuuauuggcgcuuacuucgguuuuaagaaaaacgcgaucgagcauccagugcgcaccaaucaaauucccagacagauaccugaacagucuuucuacacuaagccauugccggggaucauuaugggcggaauccugcccuuuggcuguaucuucauucagcucuuuuucauacugaacagcaucuggucacaccaaauguauuacauguuuggguuccuuuuucuggucuucauuaucuuggugauuacaugcagugaggcaaccauccuccuguguuauuuccauuuaugcgccgaagauuaccacuggcaguggagguccuuucugacgagcggauucaccgcugucuauuuucuaauauacgccgugcauuauuucuuuucuaaacuccagaucacagguacugcaucaaccauucuguacuucggcuacacaaugaucaugguucuuaucuuuuucuuguuuacugggaccauuggauucuuugccuguuucugguucgugacaaagauauauaguguagucaaaguggacuga

SEQ ID NO: 63857 - RNA, 1929 nt, Artificial Sequence
  derived and/or modified sequence opt3 from TM9SF4__Homo_sapiens__NP_055557
auggccaccgcuauggacuggcugcccuggagccuccuucuguucuccuugaugugcgagacaucugcauuuuacgugccuggcgucgccccaaucaacuuccaccagaaugauccgguugaaauuaaggcggugaaauuaacuucaaguagaacgcaacugcccuaugaguacuauagccuaccuuuuugucagccauccaagauaaccuacaaagcugaaaaccucggggagguacugaggggagaccggaucgugaauacacccuuccagguccuuaugaacucugaaaagaaaugcgaggugcuguguucgcagucaaauaagccuguuacuuugaccguggagcaaagccgccucgucgccgaacgaauuacagaggauuauuacgugcaucugaucgcagacaaccugccaguagccacccgucucgaauuauauaguaauagagauuccgacgauaagaaaaaggagaaagacguucaguuugagcacgguuacaggcugggcuucacugaugugaacaagauuuaccuucauaaucacuugucuuuuauccuguauuaccaucgggaagacauggaggaagaucaggagcacacauaucgcgucgugagauucgaagugauaccccagagcaucaggcuagaggaccucaaagcugaugagaaguccucaugcacccugccugaagggacgaacaguagcccacaagagauugacccgacuaaggaaaaucagcuuuacuuuaccuauucuguccacugggaggaauccgacaucaaaugggcaucacggugggauacauaccugacuaugagcgacguucagauucauugguucaguaucauaaacucugugguaguggucuuuuucuuguccggaauuuugagcaugaucauuauccgcacccugcgaaaggauaucgccaauuauaacaaagaggacgauauugaggacacaauggaagagucgggcuggaaguuagugcacggugauguuuuuagacccccucaguacccaaugauacugucuucccuccuugggucaggaauccaacuguucuguaugauuuugaucgugauauucgucgcuaugcuaggcaugcugagucccagcuccaggggcgcccucaugaccacggcgugcuuucuguucauguuuauggggguguucggagguuuuucugcaggccggcuuuaccguacucugaaagggcaucgcuggaagaaaggagccuucuguacagcuaccuuguauccuggcguaguuuuugguauuugcuucgugcucaauuguuuuaucugggggaagcacagcucaggagccgucccauuccccacuaugguggcacuguuaugcaugugguuuggcaucagucugccgcuagucuaccucggcuauuacuucggguuuagaaagcagccuuaugacaaccccgugaggacaaaccagauuccacggcaaaucccugaacagcgaugguacaugaaucgcuucguugguauucugauggcuggaauacuucccuucggcgccauguuuaucgaguuguucuuuauuuucuccgcgaucugggaaaaccaguuuuauuaccuguucggguuucucuuccugguguuuaucauucuuguagucagcuguucucagauaucaaucgugaugguuuacuuccaacugugcgccgaggauuauagauggugguggaggaauuuucucgugaguggaggcagcgcauucuacguccucguguaugcuaucuuuuacuucguaaacaaacuggacauuguggaguucauuccauccuuacuguauuuugguuacaccgcccuaaugguucucucuuucuggcugcuuacggggaccaucggcuuuuaugcugccuacauguucguccggaagauauacgcagccgugaaaaucgauuga

SEQ ID NO: 63858 - RNA, 858 nt, Artificial Sequence
  derived and/or modified sequence opt3 from TMBIM4__Homo_sapiens__NP_001269535
auggccgaccccgauccuagauacccaaggagcuccaucgaggacgauuucaacuaugggucuucaguggcuagugcaaccguccacauucggaugguucugcagcgcgacugcacauuuagcaagcaauacaugcgaauaccguccgcccccucugcgacucucaauaucauucguuucuuucaucuuagacagucggggaggucaggaauggugaacaucuucuauaaagguccuacguuucugcggaagguauacagcauuuugaguuuacaggugcugcuaaccacagucacuuccaccguguuccucuauuuugaaucuguucgcacauucgugcacgagagcccagcucugauccuucuguuugccuugggcucccucgggcugauauucgcacugauccucaauagacauaaauaccccuuaaaccuguaucuuuuguuuggauucacccugcuagaagcccucacugucgcugugguaguuacauuuuacgauguguacauuauccugcaggcauucauucuuaccacgacugucuucuuuggccugaccguguauacauugcaaucaaagaaagacuucaguaaguuuggugccggccucuucgcucuguuauggauccugugucucagcggauuucuuaaguucuuuuucuacucugagauaauggaacugguguuggccgcggcaggcgcccuacuguuuugcggcuucauuaucuaugauacucacucccucaugcauaaacugucaccugaggaguacguccuugcugccauuagccuguauuuggacaucaucaaucucuuucugcacuuacugagguuccuagaagcaguuaacaagaaauga

SEQ ID NO: 63859 - RNA, 714 nt, Artificial Sequence
  derived and/or modified sequence opt3 from TMBIM6__Homo_sapiens__NP_003208
augaacaucuucgacagaaagauuaauuuugaugcccugcucaaauucagccacauaacccccuccacacagcaacaucuuaagaaaguguacgcuucuuuugcacugugcauguucgucgccgcggcuggcgccuauguucacauggugacucauuuuauccaggcaggguuguuaucagcccugggaagucuaauucucaugaucuggcugauggcuacgccucacagccaugagaccgaacagaagaggcuuggucuguuggcaggcuucgccuuucucacagggguaggacugggcccagcucuggaguucuguauugccgugaacccguccauccuccccacugcguuuauggguaccgcaaugauauucacaugcuuuaccuuaucugcccuguacgcucggcgccgaucguaucuuuuccucgggggaauccugaugucagcccuaagccuccugcuucugaguuccuugggcaaugucuuuuucggcucuauuugguuguuccaggcaaaccuguacgugggguuaguugugauguguggauuuguccuguucgacacucaacucaucauugaaaaagcugagcacggugaucaggacuauaucuggcacugcauagaucuuuuucuggacuucauuacaguguuucguaaguugaugaugauccuagccaugaaugaaaaggauaaaaagaaagagaagaaauga

SEQ ID NO: 63860 - RNA, 2283 nt, Artificial Sequence
  derived and/or modified sequence opt3 from TMC1__Homo_sapiens__NP_619636
augagccccaagaaagugcagaucaaggucgaggaaaaagaggacgaaaccgaggaauccucuucagaggaggaagaggaaguugaggauaagcugccuagaagggagagucuccggccaaaacgcaagcgaacacgugacgugauuaacgaagaugacccggagcccgaaccugaggaugaagagacuagaaaggccagggagaaagaacggcgcagaaggcuuaagcggggcgcugaggaagaggaaauagacgaggaggaacuggagcgcuugaaagcagaauuagaugagaagcgacaaaucauugccacgguaaaaugcaagccauggaagauggagaaaaagaucgaggugcugaaagaggcgaagaaauucgucagcgaaaaugagggggcucuaggaaaggguaaaggcaagagaugguuugccuucaagaugaugauggccaaaaagugggcaaaauuucucagggacuucgaaaacuuuaaggcugcaugugugcccugggagaauaaaauuaaggccaucgagucccaguucgggucuucgguugcuucauacuuucuguuccuucgguggauguauggagugaacaugguccuguuuauauugaccuucagccucaucaugcugccugaauaccuguggggccucccauaugguaguuuaccccguaagacagugccucgcgccgaggaagcguccgcagccaauuuugggguacuguacgauuucaacggacuugcucaguauucuguuuuguuuuacggcuauuacgacaauaaaagaacuauuggcuggaugaacuucaggcugccacuaagcuacuuccucguggggaucaugugcauuggauauuccuuucuggucgugcuuaaggccaugaccaaaaauaucggugaugacggcgggggagaugacaacacauucaauuuuucauggaagguguucaccaguugggacuaccugauaggcaacccggagacugcagauaauaaauuuaacagcauuacaaugaauuucaaggaagcuaucaccgaggagaaggccgcgcaggucgaagagaacguucacuugauucgguuucuccgauuccuggccaacuuuuucguguuuuuaacgcugggugggucuggauaucucaucuucugggcaguaaaacgcucccaagaauuugcucagcaggaccccgauacucuuggcuggugggagaagaaugaaaugaacauggugaugucacuguugggcauguucuguccuacccuauucgaccuguuugccgagcucgaggauuaccauccacugaucgcucuuaaauggcuguuggggagaauuuucgcccuccuguuaggaaaucuguaugucuuuauacuagcacucauggacgaaaucaacaauaagauugaggaagagaaacuggugaaggccaacaucacacuuugggaagcuaauaugauaaaggcguacaacgcaucuuucagugaaaauucuacuggucccccauuuuucguucacccugccgaugugcccaggggcccgugcugggagaccauggucgggcaggaauuugugcgguugacaguauccgacguucugaccacguaugugacuauucucaucggagauuuccugcgcgcuuguuuugucagauucugcaacuacuguuggugcugggaccuugaguacggcuauccuagcuacacagaauuugauaucucggguaaugugcuggccuugauuuucaaccaagggaugaucuggaugggcagcuuuuucgcacccucccucccaggaauuaauauacugagguuacauaccucaauguauuuccaguguugggccgucaugugcuguaacgugccugaggcucguguuuuuaaagccagucggagcaauaacuucuaccugggcaugcuacuccugaucuuguuucuuuccacuaugcccgugcuguauaugauuguaucucucccacccagcuucgacugcgggccuuuuucaggaaagaaccgaauguucgaggucaucggugaaacacuggagcacgacuuuccaaguuggauggcaaaaaucuuaagacagcuguccaauccgggccuugugauugcgguuauauuggugaugguccucgcuaucuacuaucugaacgccaccgcaaaggggcagaaagccgcuaaucuagaucugaagaaaaagaugaagaugcaagcccucgaaaacaaaaugaggaauaagaaaauggcagcugcccgcgcggccgcugcagccggacggcaguga

SEQ ID NO: 63861 - RNA, 2721 nt, Artificial Sequence
  derived and/or modified sequence opt3 from TMC2__Homo_sapiens__NP_542789
augagccaccaggugaagggccugaaagaggaagccagagggggagucaaggguaggguuaaauccggcucuccccauaccggggaccggcucggacgccgaucaaguagcaagcgugcucuuaaagcagagggcacaccugguagaagaggggcccaaaggucccagaaggaacgcgcgggaggcucuccaucgccgggcucacccagaaggaagcagacugggcggcgccgacacagagaggaacugggagagcaggagaggggugaagcugagcggacgugcgaaggccgucgcaaaagagaugagagggccagcuuccaagagcggaccgcagccccuaagcgagaaaaagagaucccacgcagagaagagaagaguaaaaggcagaagaagccccgguccucuagcuuggcuuccucagcaagugggggagagagcuuaucugaggaggaacuggcccagauucuagaacagguggaagagaaaaagaaacucauagcuacaaugcgcuccaagccuuggccaauggccaaaaagcugacugaacuuagagaggcgcaagaguuuguagaaaaauacgagggcgcacuggguaaggggaagggaaaacaguuguaugccuacaagaugcucauggcuaaaaagugggugaaauucaagagggacuuugauaacuucaagacccaguguauccccugggaaaugaaaauuaaggacaucgagucacauuuuggcagcagugucgccucuuauuucauuuuucugcguuggauguacggcgugaaucugguucucuucggguuaaucuuuggacuggugauaaucccugaaguccuuauggguaugccauauggcuccauuccgcggaaaacagugccccgagcagaggaggaaaaggcuauggauuucagcguauugugggacuuugagggguacaucaaauauucggcccuguucuacggauacuauaacaaucagcggaccauuggcuggcuaagguaccgccucccuauggcguauuuuaugguuggugugucugucuucggguacucccugaucauagugauucggucaauggccaguaacacucaaggcagcacaggagaaggcgaguccgauaauuucaccuuuucuuucaagauguuuacgagcugggacuaucuuaucgggaacucagagacugcagauaauaaguacgcuaguauuaccacauccuucaaagaaagcaucguggacgagcaggaaucuaacaaggaggaaaauauccaccugacuagauuuuugaggguccucgccaacuuccugauuauaugcuguuuaugcggaucagguuaucugaucuacuuuguugugaaacgcagucagcaauucagcaagaugcagaauguauccugguacgagcgaaacgagguggaaauugucaugucucuccuuggcauguuuuguccaccccuguucgagaccaucgcugccuuggaaaauuaucauccucggacagggcuaaaauggcagcugggacguauauuugcacucuuccugggcaaccuuuacaccuuucuguuggcccucauggaugacgugcaccugaaguuagcuaaugaggaaacgauuaagaacaucacucacuggacacuguucaacuauuacaauucgagcgguuggaacgaguccguuccaagacccccgcuacauccugcggaugugcccagggggucaugcugggagaccgcagucggcaucgaguucaugcgccucacugugagugacaugcugguaacauauauuaccauccuuuugggagacuuucugcgggccuguuucguuagauuuaugaauuacugcugguguugggaucucgaagcuggcuucccaucuuaugccgaauuugacauuagcgggaacgugcugggacuuauauucaaucaggguaugaucuggaugggcuccuuuuacgcaccugggcuggucggaauuaacguguugaggcuccugacgucaauguacuuccaaugcugggccgucaugagcucuaaugugccccacgagcgaguuuuuaaggcuucccgcaguaacaauuucuauaugggcuuacugcuacucgugcuguuucuuagcuugcugccaguagccuacaccaucaugucucugcccccuuccuucgauugugguccauuuucagggaaaaaccggauguaugacguccuccaggaaacaaucgagaaugauuucccgacuuucuuaggcaaaauuuuugcauuccuggcgaaccccggacuuauaaucccugcuauuuugcucauguuucuggccaucuacuaucuaaauagugugagcaagucgcuguccagagcaaacgcccagcucaggaaaaagauucagguucugcgugagguggaaaaaucucauaagagcgucaagggcaaagcuaccgcccgcgacucagaggauacaccaaagaguuccucuaaaaaugcaacucaacuucaguugaccaaggaagagacaacucccccuagcgcuucccagucacaggccauggacaaaaaggcgcaagggccaggaaccagcaacagugccucucggacgacacugcccgcuuccggccacuuaccgaucagcagaccuccagguauagggcccgauucgggacacgcaccuucacagacccaucccuggaggucugccaguggcaaguccgcucagcgaccaccucacuga

SEQ ID NO: 63862 - RNA, 3303 nt, Artificial Sequence
  derived and/or modified sequence opt3 from TMC3__Homo_sapiens__NP_001074001
augaagaccagcaaagccucccagagauacaggggcauccggcgcaacgcuucucaaugcuaucuguaccaggagucacuccuucugaguaauuuggacgauagcuucuccgcagacgaaacaggggauucuaacgaccccgagcagauuuuucagaauauacaauuccagaaggauuuaauggccaacauccgaugucguccuuggacuaugggacagaaacugagagcgcuaaggcaggcuaagaauauugugcucaaauuugaaggucggcugacgcgcaccagaggcuaucaagccgcaggggccgagcuuuggaggaaguucgcucggcuggcaugcaacuuugucguuaucuucauuccaugggaaaugcgcaucaagaaaauagagucgcacuuuggaucaggcguggccagcuacuucaucuuuuugcgauggcuuuucgguauuaauaucguacugacaauuaugacuggggcuuuuaucgugauaccggagcugauugccggacagcccuucggcaguaccgcgagaaagacaaucccuaaagaacaggucuccucugcacaggaccucgauaccguguggagcuuaggcggguaucugcaauacuccguucucuuuuauggauacuacgguagggagcggaagauuggccgugccggguaucgcuugccacuggcuuacuuccuagugggaauggccgucuucgcauauucauuuaucauccuccugaaaaagauggcuaagaacaguagaacuagccuugccucugcguccaaugaaaacuacacauucuguuggaggguguuuugcgccugggacuaucugauuggcaaucccgaggcagcugagucaaaaaccgccgcuauaguaaacagcauccgggaagccauuuuggaggaacaggagaagaaaaagaguaaaaaucucgcaguuacgaucugucugcgaauaauugccaacaucuuagugcugcucucucuugcugguuccaucuaccugauuuauuucgucguggaucgcagccagaaguuggaacaaucgaaaaaggagcuaacucugugggagaagaaugaagugucugucguugugucccucguaaccaugaucgcgccuucagcauuugaccugauugccgcucuugagauguaccauccaagaacaacucugagguuccaguuggcccgggugcucguccuguacuuagggaaccuguauagucuaauaaucgcacuccuggauaaagugaacagcauguccauugaagagauggccaccaagaauaacacaucucacuggaucgacagcaccacguuuuucgcuacucgcacagcccccgaagaggagaaauggucaaccaguagaccuggaaugggccuuaggcguaauaacacuugggcauuggaagagacauccaucagcgcguacaccaugccacugauuaaggcuaauaaaacgucucuccauacccagucaccgcaggaucaaugcugggaaacauauguuggccaggagaugcugaaacuuaguauaaucgacaugcuguuuacuguggccagcauuuugcucaucgacuucuuucgggggcuguucguccgauacuuauccgauuauugguguugggaccuggaaucuaaguuucccgaguacggagaguucaagauugcagaaaacgugcuacaccucguauauaaucaggguaugaucuggaugggcgccuucuuuucgccuugccugccagcuuucaacguucuuaaguugauagggcugauguaccucagaagcugggccgugcugaccuguaaugucccccaucagcaaguguuuagggcaucccgcucaaacaauuucuacuuagcuaugcugcuuuuuauguuguuccucugcaugcugccuacaaucuuugccauuguccgguauaaaccaagucuaaacuguggacccuucucuggccaggagaagaucuacgauauugugagcgaaacuaucgagaaagacuuuccgguuugguucgguuccgugguagggcacauaucaagcccugucgugauucugcccgcgguucuccugcuuuuuauguugaucuauuaccugcagucuauugccagauccuuaaagcucaguaaucaccagcugaagaugcaaauccagaacgcuaggagcgaggauaaaaagaaaguggcacagauggucgaagcccgcauacagacccaagaggaaucuacaaagaaacuuccaaaugacuccgaucugaccucacaguugaguagcgcucauucgggcacuccucagaacaacggaaauguggcccacuucgacuccggcucuagcaagucagggcgaaucgagacgguagcacaaaguaugccccaguccccacggcccggagaucgugcgccuucuagcccacucccgggugugcccaaguccagacuggaacaugagacaaacagguaucuacacggccugugcgccucaaccagcgaccuccaccgcaaucggaguagaacuccuaugaccuuuacaacccauauugaggauguucacucugaaccacuguucaggaaagacuuccagcagaucaaucccccucaucgagggccacaggcuuccacucuuuuggcccaaggaccccgcccgcacgcaccucgguacuaugucauuaacgagugcgacagcuacaagaaaaagcaucugaacguguggccagaaagacacuuuaaaaucgaugcuucgggcgacauaguggaguuauaccccaggaauguccgucaguaugccucacgcguuccucggcagcccccaucuccucaacucagugaagaggaggaagagacacccuccagagauuggauuaagaggagccugccaccgcgaucucuuaucgaccugcggcgcgcaccucacuucuacaucggugaaagaagcgagucccagacgagggaucccgaacaucaggggcgggugcacuauaaaucauggaacgaggacuuugagggccaucuagaacgaccagccuacgugcccagaaagccucgcaguaggaauuuccaguauccacaacccccucucaagccgcguggaaaaccacgguuugagcccagccugaccgaaucugauuccguaucagcugcgaguagcuccgaccagcagaacucuucggccgaucaauacuugcaggucacucacagccagggcagauucccuaggucaguggggcagccaucccgccgaaaggcaaaaaguggacaagagcugacaguugacuuagaugaccucauuuguucugauguguga

SEQ ID NO: 63863 - RNA, 3021 nt, Artificial Sequence
  derived and/or modified sequence opt3 from TMC5__Homo_sapiens__NP_001098718
augagcgccuacuauagaaacaauugguccgaggaagaccccgauuacccugacuauucuggcucacagaacaggacccaaggguaccugaagacacagggauauccagaugugccggguccccucaauaacccugacuacccaggcacucggaguaaucccuauagcgucgcuucccgcacgcgaccugauuacccagggucucuugcagagcccaacuacccucguucgcugucaaauccagacuauagcggaaccagaaguaacgccuacuccgcggcuucuaggacaagcccggaucaccccacuuccuugccugaaccagacuauucagaguuccagagucaucccuaccaccgggccagcucucgccagccugauuauccaggcucccaaagaaaucccgacuuugcagguucaagcaguucugggaacuacgccggauccaggacccauccggaucacuucggcagcuuagaaccugacuaucccggcgcucagucuaauucggaucauccagggccucgggcaaaccugaaucaccccggaucccgcaaaaaccuagagcacacaucauuucgaaucaauccauacgccgacagucucgguaagcccgacuacccuggcgcugauauucagccaaacagcccgcccuucuuuggggagccugacuauccauccgccgaagauaaccagaaucugcccucuaccuggagagagccugacuacagcgaugcggaaaacggacaugacuauggcucaagugagacuccaaaaaugacaagggguguucuuucccggaccagcucuauacaacccucauuccgucaccgcagugaugacccgguggggagccuguggggagagaaugauuacccugaaggcaucgagauggcauccauggaaauggccaacucuuauggccauucguugccaggggcucccggaagcgguuacguaaauccugccuaugugggcgaguccgggcccguccacgcauacggaaacccaccucucucagaaugcgacuggcacaagaguccccagggccagaaacugauugcuucucugaucccaaugacgagcagagauaggauuaaggccauccggaaucagccgcgaacuauggaggagaagcgcaaccucagaaaaauaguggacaaggaaaaauccaagcaaacccauaggaucuuacagcugaauuguugcauucagugucuuaacucaaucagccgggcguaccgcagaucuaaaaauuccuugagugagauucugaacagcaucucucuauggcaaaagacacucaagauaauuggugggaaauuuggcacuuccguucugucauauuucaauuuucuuagguggcuguugaaguucaacaucuuuaguuucauucucaauuuuagcuucaucaucauuccucaguucaccguggccaaaaagaacacacugcaguuuaccggauuagaguucuuuacgggcgucggguacuuccgugacacugugauguauuacggauuuuauacaaacucgaccauacagcacgguaauuccggcgcaucuuacaacaugcaacuggcuuauaucuucacuauuggggccugccucacaaccuguuucuucagccuucuguuuucaauggcuaaauacuuccggaauaacuuuaucaauccccauauauacaguggaggcauuacgaaguugaucuucugcugggauuuuaccguaacacacgaaaaagccguuaagcuaaagcagaaaaaccuguccacugaaauccgagagaaucucucugagcugagacaggaaaacagcaaacuuaccuucaaucagcuguugacaagguucuccgcauauaugguggccugggucgugucaacugguguggcuauugcguguugcgcagccgucuacuaucucgcugaguacaaccuggaauuuuuaaagacccauagcaauccaggggccguucugcuacuccccuucgugguaaguuguaucaaccuggcagugccuugcauuuauucuauguuucgccuugucgagcgguacgaaaugccaagacacgagguguauguuuugcugauaaggaauaucuuccucaagauuuccaucaucggcauucuguguuacuacuggcuuaacacaguggcccugagcggagaggaaugcugggagaccuugauaggccaagacaucuaucgccuccuguuaauggauuuugucuucucgcugguaaauucauuucuaggggaauuucuccgacggauuaucggaaugcagcugauuacuucucuugguuugcaggaguuugacaucgcucguaacgugcuggagcucauauacgcccagacgcugguuuggaucggcauuuucuuuugccccuuacugccuuucauccaaaugauuaugcuuuuuaucauguucuauaguaaaaacauauccuugaugaugaauuuccagccgccaagcaaggcauggagagcgucucagaugaugacauuuuucauuuuucuccuguucuuucccagcuucaccggggugcuauguacucuggcuaucaccauuuggaggcucaagccuuccgccgauugcggaccauuucgcggccugccccuuuucauccacucaauauacaguuggaucgacacauugagcacccggccugguuaucugugggucguguggauuuacagaaacuuaaucgggucuguccacuuuuucuuuauucucacucugaucgugcuuauaauuacauaucuguacuggcagaucacggaaggcaggaaaaucaugauucgauugcuccaugagcaaaucauuaaugaaggaaaggauaaaauguuccugauagagaagcuaaucaaacugcaggacauggaaaagaaggcaaacccguccucacucguucuggagcgccgggagguggaacagcaaggcuuccuucauuugggggagcacgauggaagucuggacuuaagaagcaggcguuccguacaggaaggcaauccccgcgccuga

SEQ ID NO: 63864 - RNA, 2418 nt, Artificial Sequence
  derived and/or modified sequence opt3 from TMC6__Homo_sapiens__NP_009198
auggcccagccccuggcuuucauccucgacgugccugagaccccaggcgaucaagggcagggaccgagccccuacgacgaauccgagguccacgauucuuuucagcagcuuauucaagaacagucacagugcacagcacaggagggucuggaauugcaacagagagagagggagguuacuggcaguagccagcagacguuauggcggccugaagggacccaauccacagccacucugcgcauacuagcgucuaugccaucgcgaaccaucggacguucaagaggcgcuauuaucagccaguauuacaacaggacagugcagcuccggugucgcaguuccagaccccugcuugguaauuucguaaggucugccuggccuagccugcgguuguaugaccucgagcuggauccaaccgcacuggaagaggaggaaaagcaaucccucuuagugaaagagcugcagucacuugccgucgcucagcgcgaccauauguugcgagggaugccccugagucuagcagaaaagagaagccucagggagaaaucucggacuccucguggaaaguggcgcggccagccaggcuccgggggagugugcucauguugcgguagacugagguacgccuguguucuugcucugcacagcuugggccucgcccuguuaagugcgcugcaagcacucaugccguggcgguaugcccuuaaacgaauugggggacaguuuggaucuuccgugcugagcuacuucuuguuucuaaagacacugcucgcuuucaacgcccugcuucuguugcuccuggucgcauuuaucauggguccccagguggcuuucccuccagccuuacccgggccugcgccaguaugcaccggacuggaacuacucacgggcgccggcuguuuuacucauaccguuauguauuacgggcacuacucgaaugcaacacugaaccagcccugcggaucuccgcuugaugguucccaauguacuccucgcgugggcggguugcccuauaauaugccacuggcuuaccucucaaccgucggagugaguuucuuuauaacaugcaucacccugguguauagcauggcccauuccuucggcgagucuuacagagucgguagcacgucagggauucacgcuaucacuguguuuuguaguugggacuauaaggugacacagaaaagggccucccggcuucagcaggauaacauucgcaccagacugaaggaguugcucgcagaauggcaacugaggcacagcccucguucuguaugcggccgguuacgacaggccgcugugcugggccuagucuggcuccugugccuuggcacugcguuggggugugcaguggccguucauguguucucagaguucaugauccagagucccgaagcugccggacaggaggcaguccugcucgugcugccauuaguaguuggucugcuuaauuugggcgcccccuaccucugcagagugcuggcugcccuagaaccucacgacagcccaguccuggagguguaugucgcaauauguaggaaccucauucugaaacuugcgaucuuggggacacugugcuaccauugguuaggacgccgggugggcguucuccaaggucaguguugggaggauuuuguggggcaggaacuguacagauuccuuguaauggacuuuguccugauguugcucgauacccuguucggcgagcuaguguggaggauuaucuccgaaaagaaacugaagcgccgacggaagccggaguuugacaucgcucguaauguucucgaacugauuuauggacaaacgcuuaccugguugggcgugcuguucucucccuuacucccugccguccagauaaucaaacugcuucugguguuuuacguaaagaaaacaucgcuacucgcaaacugccaggccccaagaaggcccuggcuggcuagccacauguccacuguguucuugacccuguuauguuuuccugccuuccucggggcagcuguuuuucugugcuaugccgucuggcagguuaagccaucaaguacauguggacccuuccgcacucuugacaccauguacgaggcgggucgggugugggucagacaccuggaggccgcuggcccgaggguuucuugguugccuugggugcaucgauaucucauggaaaauacauuuuucguguuccugguaagcgcacuacugcuugccgucauuuaccucaacauccaagugguucgcgggcagcggaaagugauaugccuguugaaggagcagauuuccaaugaaggagaggauaaaaucuuucugaucaacaaguuacacucaauuuaugagagaaaggaaagggaggaacguagccgcgucggcaccacugaggaagcugccgcaccacccgcgcuccugacggacgagcaggaugccuga

SEQ ID NO: 63865 - RNA, 2181 nt, Artificial Sequence
  derived and/or modified sequence opt3 from TMC8__Homo_sapiens__NP_689681
augcugcuccccagaagcguguccucugagagggccccuggcgucccagaaccggaggaacuuugggaggcugaaauggagcggcugcgcgggucaggaacccccguucgagguuugccuuacgcaaugauggacaagcguuuaaucuggcagcugagagagccagccggcgugcaaacacuaagguggcagcgguggcagcgcagaaggcagacuguagaacggcgccuccgagaggcggcucaaagacuggccagggggcuuggacugugggaaggcgcauuguaugagauugguggacucuucgggacgggcauacggaguuacuuuaccuuccugcguuuucugcucuuacugaaccuuuugagccugcuacucacagccuccuucgugcugcuuccccuggucugguugcgcccuccagaucccggcccuacucucaaucugaccuuacagugcccagggucuagacagucgccgcccggagugcugagguuucacaaccagcucuggcauguucuuacaggucgggcuuucaccaauacuuaucuguuuuacggcgcauaucgaguggggccugagucaagcagugucuacuccauccgcuuggccuaucuacugucuccacucgcuugucugcuucugugcuucuguggaacauugagaaggauggugaaaggccucccccaaaagacccuguuaggucagggguaccaggccccucugagcgcgaaaguauuuuccucaugggacuucugcauucggguucaggaagcagccacgaucaagaaacacgagauuaguaacgaauuuaagguggagcuagaagagggacgcagauuccaacucaugcagcagcaaacuagggcucagaccgccugucgucugcuuagcuacuugcgggucaaugugcugaacggccuccugguggucggcgcaaucucugcuauauuuugggccacaaaguauucccaggauaauaaagaggaaucacuuuuccuguugcuccaguaccugccacccgggguuaucgcguuagugaacuuccugggaccgcuacucuuuacuuuccugguacaacuugagaauuauccucccaacaccgaagugaauuugacacugauuuggugcgucgugcucaagcuggccagcuuagguauguuuaguguuucucugggccagaccauccuuuguauugggcgagacaaauccagcugcgagucguacggauauaacgugugugauuaccagugcugggaaaauucugucggcgaggaguuguauaagcucuccaucuucaacuuucugcuaacgguggcauucgcuuuucugguaacucucccaagaaggcugcuuguugaccgcuucucaggucgguuuugggccugguuggaaagagaggaguuccuggugccuaaaaaugucuuagauauaguggcugggcagacagucaccuggaugggccucuuuuacuguccccugcuuccacuguugaacaguguguuccucuuucugacuuucuacauuaagaaguauacacuacugaaaaacagcagggccuccucucgccccuuccgagcaagcucaaguaccuuuuucuuucaacucguucugcuuuugggacuguuacucgccgcugugccucugggcuacguagucuccagcauccauucuucaugggacugcgggcuuuucacgaauuauagugcgccauggcaagugguuccggaacugguggcacuaggacugcccccuauuggucagcgggcccuccacuacuugggcagccaugcuuuuuccuucccacuguuaaucaugcucucucugguccuuaccgugugcguaucgcagacacaggccaacgcacgugccauccacagacugaggaagcaguugguguggcagguucaggaaaaauggcaccucgucgaggaucugagccgccuacugcccgagccugggccauccgacucacccggaccgaaguauccugcuagucaagccucucggccacagagcuuuugucccggcugcccuugucccgguuccccagggcaucaggcaccuagacccggcccaucagugguggaugcggcuggacuuaggagcccgugcccuggccaacacggggcccccgcaucugcccgacgcuuccgguuuccauccggagcugaacucuga

SEQ ID NO: 63866 - RNA, 1443 nt, Artificial Sequence
  derived and/or modified sequence opt3 from TMCC1__Homo_sapiens__XP_006713615
auguggugcggcuguaccugccuguucugugagagccacuuuuccgaaacagugaagaucgagagacucgaagucucuucacuugcccagacgaguagcgcuguugcauccucuacugacgggucgauucauaccgauucaguggacggaacacccgauccucaaaggacuaaagccgcgauagcucaucugcagcagaagaucuugaaauuaaccgagcagauuaagaucgcccaaacagcacgggacgauaacguagccgaauaccugaaacuagcuaauagcgcagacaagcagcaggccgcucgcauuaaacagguguucgagaaaaagaaccaaaagagugcccagaccauccuccagcugcagaagaaacuugagcacuaucaccgaaagcugcgugaagucgagcaaaaugguauaccaagacagccgaaggauguguuuagggacaugcaucagggcuugaaagauguuggggcgaaggugacuggauucuccgaaggcgucguggacucuguaaaagguggguuuagcuccuucucacaagcaacacacagugccgcuggagccguugugagcaagccccgggagaucgcaucucucauucgcaacaaauuuggcuccgcugauaauaucccuaaccugaaggacucacuggaggaaggccaggucgaugacgccgggaaagcgcucggagugauuagcaauuuccagaguucuccaaaguacgguuccgaggaagacugcagcucggccaccucuggcuccgugggggcaaacucaacgacuggaggcaucgcugucggugccaguagcuccaagaccaauacauuagauaugcagucuagcggguuugacgcucugcuucacgagauacaagaaauuagagagacucaggccagguuggaggaaucauucgagacccugaaagaacauuaucagcgggauuacagucuaaucaugcagacacuccaagaggaacgcuaucgaugugagagacuggaggaacagcuuaacgaccugaccgaguugcaccagaaugaaauucucaaccugaagcaggaguuagcauccauggaagagaaaaucgccuaccaaagcuaugagagggcucgggauauccaggaagcgcuggaggcaugccagacgcguauuucuaagauggaacuccagcaacagcagcaacagguugugcagcuugagggacuggagaaugccacugcucgcaacuugcuaggcaaacugauaaauauccuccuggccguaauggcagugcuucuggucuuugugucaacaguugccaacugugugguccccuugaugaagaccagaaacaggacuuucaguacacucuuucuggugguauucauugcuuucuuauggaagcauugggacgcccuguuuagcuacguugaacgguucuuuuccucuccucgauga

SEQ ID NO: 63867 - RNA, 1896 nt, Artificial Sequence
  derived and/or modified sequence opt3 from TMCC2__Homo_sapiens__NP_001229854
auguucggccacgggcugaagcaucucuuucacagcagaaggcggucccgcgagcgagaacaucagaccucucaagacucacagcagcaccagcaacagcagggaaugagugaucaugacagccccgaugagaaagaacguuccccugagaugcacagagugucuuacgccaugucgcuucacgaccugccagcuaggccgacagcauucaaccgggucuugcagcaaauccgcucaagacccagcauuaagaggggugccaguuuacauuccucuagcggcgggggauccucaggcaguagcucucggcgcacuaaauccucaagccuggaaccucagcgagguaguccacaccuacucagaaaggcgccccaggauucuucccuggcugccauacuucaucagcaccaaugcaggccucggagcucgucuacgaccgacacagcacuguugcucgccgauggguccaauguuuaucugcuggcugaggaggcagaaggaaucggcgacaaaguggauaagggcgaccucguagccuuaucacugccagcugggcacggagauacugacggucccauuagucuugaugugccugacggcgccccagacccgcagcguaccaaggcggcaaucgaucauuugcaccagaaaauucugaagaucacagagcaaauaaaaaucgaacaggaggcccgcgacgauaacgucgcugaguaccuaaagcucgccaauaacgcagacaaacaacaggugagcagaauuaagcagguuuuugaaaagaaaaaucagaaguccgcucagaccaucgcccagcugcauaaaaagcuggagcacuauaggcggcgacuuaaagaaauugagcaaaacgggcccucucgccagccuaaggauguguugagagacaugcagcagggacucaaagaugucggcgcgaaugugagggccgguaucagcggguucggaggcggcguaguugaaggggugaagggaucacugagugguuuaucccaagcaacucauacagcugucgugagcaagccacgggaguuugccucucugauacgcaacaaauucggcucagcugacaauauugcccaccucaaggauccccuugaggacgggccuccagaagaggcagccagagcucugaguggaagcgcgaccuugguguccucucccaaauacggcucggaugacgaauguagcuccgcaucagccaguucugcuggugccgggagcaacuccggcgcaggaccgggcggggcccuaggaucaccuaagagcaaugcucuguauggugcccccggcaaccucgacgcacugcuugaggaacugagggagaucaaagaggggcagucucacuuggaagauuccauggaggaccucaagacgcagcugcagcgugauuacacuuauaugacccaaugcuuacaggaggaacgguaccgauacgaaagacuggaggagcagcuaaaugaccucacagaacugcaucaaaacgagaugacuaaucuuaagcaggaauuggcgaguauggaggagaaagucgcuuaucagagcuacgaaagggcccgcgauauucaggaggcaguugaaucuugucugacccgggugacaaagcucgagcugcaacagcagcagcaacagguagugcagcuugaaggagucgagaacgccaacgcuagagcccuguugggcaaauuuaucaaugugauccucgcacugauggcuguuuuacugguguucgucuccaccauugccaacuuuauaacgccacuaaugaagacuaggcuccgcaucacaucaaccacucugcuuguguugguacuguuccuccuguggaaacacugggacaguuuaacauaucugcuugagcauguuuugcucccuagcuga

SEQ ID NO: 63868 - RNA, 1434 nt, Artificial Sequence
  derived and/or modified sequence opt3 from TMCC3__Homo_sapiens__NP_065749
augcccggcagcgacaccgcccugacaguggauagaacuuacuccgacccugggaggcaccaucggugcaagucucgcgucgagcgacacgauaugaacacgcucucacuuccacugaauauccguagaggagguagugacaccaacuugaauuucgauguuccggacggcauuuuagauuuucauaaagugaagcugacagcugacagccuaaaacagaagauacucaaaguaacugaacaaaucaagauugagcagaccuccagggaugggaacguggcagaauaucugaaacuugucaauaacgccgacaagcagcaggcgggacggaucaagcaaguguucgagaaaaagaaucagaaaucugcucacucgauugcccagcugcagaagaaguuggaacaauaccaucgcaaacucagagagaucgagcagaacggcgcaucaaggagcaguaaggauauauccaaagaccaccugaaggauauccaccggucucugaaagacgcccauguuaagagccgcacagcuccccacuguauggaauccucaaaaagugguaugccuggggugagccucaccccacccgucuuuguguucaauaagucucgagaguuugcaaacuuaauuagaaauaaguucggauccgccgacaacaucgcucaucugaaaaauucacuugaagaguuuaggccugaggccagcgcgcgggcauauggcggcagugccacuauuguaaacaagccaaaauacgggucugaugacgaaugcuccagcggaacaucggguucugcugauuccaauggcaaccagucauucggggccggaggcgcaaguaccuuggacagccaggguaagcuggcuguuauccuagaggaacuccgugagauaaaagauacgcaagcccagcuggcggaagacauugaggcccuuaaggugcaguuuaagcgcgaguauggguucaucucccaaacucugcaggaagagagauacagguaugaacgguuggaggaucagcuccacgaccugaccgauuuacaccagcaugaaacagcaaaccugaaacaagagcucgcuucuauugaggaaaaggucgccuaccaggcuuacgagcgaagccgcgacauccaggaagcccuugagucaugucagacuagaaucaguaaacuggaauugcaccaacaggagcagcaggcacuacaaaccgauacagugaaugccaaggugcugcucggaaggugcauuaacgucauacuggcuuuuaugaccguuauccuuguguguguauccacgauugcgaaauucgugagccccaugaugaagucucggugccauauccugggcacauuuuucgcagucacuuugcucgccauauucuguaagaauugggaccacauucugugcgcuaucgagcgcaugaucauuccuagauga

SEQ ID NO: 63869 - RNA, 720 nt, Artificial Sequence
  derived and/or modified sequence opt3 from TMCO1__Homo_sapiens__NP_061899
augcccagaaagaggaaaugcgaccugcgggccgugcgcgucggccuccuucugggaggggguggcguuuacgggagccgauuccguuuuaccuucccuggauguagagcuuuguccccauggagggugcggguacagcgcagaaggugcgagaugucuacaauguuugcagauacuuuacugaucguguucauuucagucuguacggcccuacucgcggaaggcauaaccugggugcugguuuaucggacagacaaguacaaacgccuuaaggcugagguggaaaaacaaaguaagaagcuggagaaaaagaaagaaacuaucaccgagagcgccggucgacagcagaagaaaaagauugagagacaggaagagaaguugaaaaacaauaacagggaucucuccaugguccggaugaagucuauguuugcaaucggguucugcuuuacagcccugaugggaauguucaauucgauuuuugacggccgugugguagcuaaacugccguucacuccccucucauauauccaaggcuuaagccaccgcaaccugcuuggggaugacaccacagauuguaguuuuauauucuuguacauccugugcaccauguccauuagacagaauauccagaagauucuaggacucgcaccuucuagggccgcuacgaaacaggccgguggcuuucuggggccacccccuccaagcggaaaguucuccuga

SEQ ID NO: 63870 - RNA, 1905 nt, Artificial Sequence
  derived and/or modified sequence opt3 from TMCO4__Homo_sapiens__XP_011539488
auggccauguggaacagacccugccagaggcugccucaacagccacucguggcugagccgaccgcagaaggcgagccccaccuuccuacagggcgggaacugacugaggccaaucgcuucgcguacgcugccuuguguggaaucagcuuaucccagcuguuuccagaacccgagcauucuucauucugcacggaguuuauggcaggucuaguccaguggcucgaacugagugaggccguucuuccuaccaugacagcuuucgcaagcggcuuagggggagaaggcgccgacguguuuguacaaauuuugcucaaggauccaauacugaaagacgaucccacugugaucacccaggaccugcucuccuucucuuuaaaggauggucacuaugacgcucgagcccguguccuggugugucauaugacaucgcuuuugcagguuccucuggaggagcuagaugugcucgaagagauguuucuggaaucacuuaaagagauuaaggaagaggagagcgaaauggcggaggcaaguaggaaaaagaaggaaaacagacggaaauggaagcgcuaccuguugaucgggcucgccaccgucggaggcggcacugugauugggguaacaggaggucuggcugccccauuaguugcagcuggcgccgcgaccaucauaggguccgccggagcagcugcccugggcucugcugccgguaucgcaauuaugacgagccucuucggggccgcuggagcgggccuuacuggcuauaaaaugaagaaaagagugggggcaaucgaggaauuuaccuuccugccguugacagagggaaggcagcuacacauuacuaucgccgucaccgguuggcuggcuuccggcaaguaccggacauuuucagcccccugggcagcccucgcucauagucgcgagcaauauugccuggccugggaagcaaaguaccuuauggagcuggggaaugcguuggaaaccauacucagcggacuggcuaacaugguggcccaggaggcauuaaaauauacggugcugucuggcauugucgccgcucuaacuuggccugccucccuccugucaguugcaaaugugaucgacaacccaugggguguaugucuucaccgaagcgcugaaguggggaagcacuuggcccauauucugcucaguagacagcagggcaggcggcccgucacacugaucggauucucucuuggcgcgcgugugaucuacuuuugccugcaagagauggcccaggagaaagauugucaggggauuauagaagacguuaucuugcucggagcuccuguggagggugaagcaaagcacugggagccauuccgcaaagucguguccggcagaauuaucaauggguacugcaggggagauuggcugcugagcuucguauaucggaccucgucuguucaacugcgaguggccggccuacagcccguccuccugcaggaccgcagaguggagaacgucgaucuuacuuccgugguuucaggucauuuggacuacgcuaagcagauggacgccauacugaaagcaguggggauuaggacaaagccgggcugggaugaaaagggacuccuguuagcgccuggcugucugcccagugaggaaccacggcaagccgcugccgcagcuagcuccggggagaccccucaccagguaggacagacgcagggucccaucucuggcgacaccagcaaacuugccaugucaacagauccaagucaagcacagguccccgugggguuggaccaguccgaaggagccagccucccugcugcggccucuccagagcgcccgcccaucugcucacacggcauggauccuaauccacuggguugucccgacugcgcaugcaagacucaggggccuaguaccggccuagauuga

SEQ ID NO: 63871 - RNA, 867 nt, Artificial Sequence
  derived and/or modified sequence opt3 from TMCO5A__Homo_sapiens__XP_005254225
auggagaucagcagacuggcccaguccaagaggaacauuauaucucucaauauggaccuugaacgggauacccaacgcaucgacgaggcuaaccagaaacuguuguuaaagauucaggaacgagaggauaaaauccagcgucuggaaucagagauuauccaaacaagaggccuaguggaggacgaagagugggaaaaggagaauaggacuacgauggagcgggaacgcgcacuccaggagcuggaagaggaaaccgccagacuugagaggaaaaacaagacacugguccacaguauaacugaguugcagcagaagcucacccggaaaagccaaaagaucacaaauugugaacaguccucucccgauggggcgcuggaggaaaccaaaguuaagcugcagcagcucgaggcuucguacgccugucaagaaaaagaguuacugaaggugaugaaggaguaugcauucguaacucagcuuugcgaagaccaggccuuguacauuaaaaaguaucaagagacacugaaaaagaucgaagaggaacuagaggcucucuuucuggagcgcgaagugucaaaacuugucagcaugaacccuguggagaaggaacauaccagucagaauaacgagggaacgccaacucagaaaaccgcacgacuguucuccaagaagaucuuuuguugcuuguucuuuauuacacucuucuuuauaagacuguuaucuuacauguucuuucacguuagguucauuaauccggaucugcucgugaacguccuucccaaagugcugggucggagcacuuuguggaagcuacguugcuuuuucuuuccuucccugacccucgagacagaagacaugcugccacauuga

SEQ ID NO: 63872 - RNA, 660 nt, Artificial Sequence
  derived and/or modified sequence opt3 from TMED10__Homo_sapiens__NP_006818
augagcggccuguccgggcccccugccagaaggggaccauucccgcucgcacuucuguuguuauuucugcuagguccccggcucgugcuggcuaucucuuuccaccuuccuauuaacucacgcaagugccugcgagaggaaauacauaaagacuugcucgucaccggcgccuacgagaucagugaucagagcgggggagcgggcggucugcguucccaccugaagauuacagacucugcugggcauauccucuauucgaaagaagaugccacuaagggaaaauuugcauucacgaccgaggacuacgauauguuugaaguuuguuucgagucaaagggcacaggcaggauuccagaccaguuagugauccuggauaugaagcacgggguagaggccaaaaauuaugaagagauagcuaagguggaaaaacuuaagcccuuggaggucgagcugagacggcuagaagaccucagcgagaguaucgugaacgauuuugcauacaugaaaaagcgcgaagaggaaaugagagacacuaaugaguccaccaacacaaggguucuguauuucucuauuuuuagcauguucugccuuaucggacuggccaccuggcaaguguuuuacuugcggcgcuucuuuaaggcuaaaaagcucauugaguga

SEQ ID NO: 63873 - RNA, 684 nt, Artificial Sequence
  derived and/or modified sequence opt3 from TMED1__Homo_sapiens__NP_006849
augauggccgcuggcgcagcccuggcgcucgcucuuuggcuguugaugcccccuguggaggucgggggagccgguccaccgcccauccaggacggcgaguucaccuuuuuacugccugcagggagaaagcaaugcuucuaccagagcgccccagcuaacgcaucccuagaaacagaauaucagguuauuggaggcgccggucucgauguggacuuuacucuggagucuccccaggggguacuucuggugucagaaaguaggaaagcugauggaguccacacgguggagccuaccgaggccggcgacuacaaguuguguuucgauaauagcuuuuccacaauaucugaaaaacucguuuucuuugagcugaucuucgacucgcugcaagaugacgaagagguggagggcugggcggaagcagucgagccagaagagaugcucgaugugaagauggaagacauuaaagagucaaucgagacuaugcggacccgcuuagaacgaagcauucagaugcugacacuuuugcgugccuuugaggcuagagauaggaaccugcaggaagggaaucuagagcggguaaacuucuggagugccguuaauguggcaguccuccugcuuguggcugugcugcaggucugcaccuugaagcgcuuuuuccaagacaagagacccguuccuacuuga

SEQ ID NO: 63874 - RNA, 606 nt, Artificial Sequence
  derived and/or modified sequence opt3 from TMED2__Homo_sapiens__NP_006806
auggugacccuggccgagcuccuuguccuguuggcugcauuacuggccacaguuagcggcuacuucguguccaucgacgcgcacgcugaagagugcuuuuucgaaagaguaacuucugggacgaagaugggacuaauuuuugagguggccgaagguggcuuccucgauauagacgucgagaucaccgggcccgauaacaaaggaauuuauaagggcgacagggagucaagugguaaauacacauuugcagcccauauggaugggacuuauaaguucuguuuuagcaaucggauguccaccaugacaccuaaaaucgugauguucaccauugacaucggagaagcuccaaagggccaggauauggagacugaagcacaccaaaacaagcuggaggagaugauaaaugaacuugccguugcuaugacagccgugaaacaugagcaggaauacauggagguccgcgaacgaauccaccgugcgauuaacgacaauaccaacucuagagugguacuguggucguuuuucgaggcauugguucucguggccaugacgcugggccagaucuauuaccugaagagguuuuucgagguccggcgcgugguguga

SEQ ID NO: 63875 - RNA, 468 nt, Artificial Sequence
  derived and/or modified sequence opt3 from TMED3__Homo_sapiens__NP_001288132
augggcagcaccgugcccagauccgccucuguccugcuccuucuguuguuacugaggcgggcugagcagccuugcggggcagaacuaacauucgagcucccagacaacgccaagcaauguuuucacgaagagguugaacagggagugaaauucucacuggauuaccagguaaucacugguggccauuaugacguggauugcuacgucgaggacccgcaggggaauacgauuuaucgcgagaccaagaaacaauacgauaguuuuacauaucgagcggaagugaagggaguuuaccaguucuguuuuagcaacgaguucuccacuuuuucucacaaaaccguguauuucgacuuucaggucggcgaugaacccccuauacuuccagacauggguaaucgugugacagcucugacccaggggcccucggccucaccuacuccaacacccccuuugagaguaccaguuuga

SEQ ID NO: 63876 - RNA, 684 nt, Artificial Sequence
  derived and/or modified sequence opt3 from TMED4__Homo_sapiens__NP_872353
auggccggcgugggggcuggaccccugagagcaauggguaggcaggcccuccuucuguuggcguuaugcgcuaccggcgcccaagggcuguacuuccacaucggagagacagaaaagcgguguuuuauugaggaaauaccugacgagacuauggucaucggcaacuaucgcacgcagaugugggauaaacagaaggaaguuuuccuaccaagcaccccgggucucgggaugcauguggagguaaaagaccccgauggaaaggugguccugucccgacaguacggcucugagggccguuuuacauucacuucacacaccccuggggaccaucaaauuugccuucacaguaauagcacaagaauggcacuguuugccggagguaaauugagggugcaucucgauauccagguuggcgaacacgcuaacaauuauccagagauugcagccaaggacaagcugaccgaacugcagcuccgggcucgccaguuacuggaucaaguggagcagauccagaaagagcaggacuaccaaagauauagggaggaacgguuccgccuuacuuccgaaucuacaaaccagcgagucuugugguggucgauagcccagaccgugauccugauucuaacggggaucuggcaaaugagacaccucaagucauuuuucgaggcgaaaaagcugguauga

SEQ ID NO: 63877 - RNA, 675 nt, Artificial Sequence
  derived and/or modified sequence opt3 from TMED7__Homo_sapiens__NP_861974
augcccagaccuggcagcgcccagaggugggcugcaguggccgggcgguggggaugccgccugcucgcgcuucuguuguuagucccagguccgggcggggcuuccgagaucaccuucgaacugcccgacaacgccaagcaauguuuuuacgaggauauugcacagggaacaaaaugcacucuagaguuccagguuauaacgggcggucacuaugacguggauugucgacucgaagacccugaugggaagguacuguacaaagaaaugaagaaacaguaugacucuuuuaccuucacagccucaaagaauggaacuuacaaguuuugcuucaguaacgaguuuagcaccuucacacauaaaaccguguauuuugauuuccaagucggcgaggacccaccccuuuuuccuuccgaaaaucgugugucugcucugacucagauggagucggcauguguuucaauccacgaagccuugaaaagcgugauugauuaccagacacauuucagacucagggaggcucagggccggagucgcgccgaggaccugaacaccagagucgcguauugguccgugggggaagcacugauccucuuaguaguuucuauuggacaaguguuucugcuuaagagcuucuucuccgauaagaggacgacuaccacacgggucgguucauga

SEQ ID NO: 63878 - RNA, 1215 nt, Artificial Sequence
  derived and/or modified sequence opt3 from TMED7-TICAM2__Homo_sapiens__NP_001157940
augcccagaccuggcagcgcccagaggugggcugcaguggccgggcgguggggaugccgccugcucgcgcuucuguuguuagucccagguccgggcggggcuuccgagaucaccuucgaacugcccgacaacgccaagcaauguuuuuacgaggauauugcacagggaacaaaaugcacucuagaguuccagguuauaacgggcggucacuaugacguggauugucgacucgaagacccugaugggaagguacuguacaaagaaaugaagaaacaguaugacucuuuuaccuucacagccucaaagaauggaacuuacaaguuuugcuucaguaacgaguuuagcaccuucacacauaaaaccguguauuuugauuuccaagucggcgaggacccaccccuuuuuccuuccgaaaaucgugugucugcucugacucagauggagucggcauguguuucaauccacgaagcccucaagagcgugauugauuaccagacacauuucagauugagggaggcucagggccggagucgcgccgaggaccugaacaccagagucgcguauuggcacuccguggauacgucuccaggguaccaugaaagcgacuccaaaaagucagaggaucugagucucugcaauguagcagaacacagcaacacuaccgagggacccacagguaaacaagaaggcgcccagucuguugaggagauguuugaagaggaagcugaggaagagguguucuuaaaguucgucauccugcacgccgaggacgacacugaugaagcacuuagggugcagaauuugcugcaggacgauuuugggauuaagccuggaaucauauucgcugagaugccauguggccggcaacaucuacagaaccucgacgaugccgugaaugguuccgcguggaccauccugcuucugacagaaaacuuuuugcgcgacaccuggugcaauuuccaguuuuacacgucacucaugaacagcgucaaucgacaacacaaauauaacaguguuauuccgaugagaccccugaauaacccuuuaccaagggagcggacucccuucgcccugcagacaaucaacgcacucgaagaggagucucguggguuuccuacccagguggaacgcauuuuccaggaguccguauacaagacucaacagacaaucuggaaagaaaccagaaauauggugcagaggcaguuuauagcuuga

SEQ ID NO: 63879 - RNA, 708 nt, Artificial Sequence
  derived and/or modified sequence opt3 from TMED9__Homo_sapiens__NP_059980
auggccguggagcugggcguccuccuuguuagacccaggccugggaccggacugggucgggugaugcgcacauuguuacugguacuauggcucgcuacucgaggcagcgcacuguacuuccacaucggggaaacggagaagaaaugcuuuauugaagagauaccagacgaaaccauggugaucggaaacuaucguacacagcuuuacgauaagcaaagagaggaguaucagccggccacucccggccuggguauguucgucgaagugaaagacccugaggauaagguuauuuuggcgaggcaguacggguccgaaggacgguuuaccuucacaucucauaccccaggcgagcaccagaucugucuccauucaaauaguacuaaauuuagccuguucgcuggcgggaugcugcgcgugcaccucgacauucaagucggagagcaugccaacgauuaugcagaaaucgccgcuaaggacaaguuauccgagcugcagcuuagagugaggcaguugguagaacagguugagcaaauacagaaagaacagaauuaccagcgguggcgcgaggagcgauuuagacaaacaucugaaucgaccaaccagagggugcugugguggucaauccuacagacgcucauucuggucgcaaucgguguguggcaaaugcggcaccuuaagagcuucuuugaggccaaaaagcugguguga

SEQ ID NO: 63880 - RNA, 1143 nt, Artificial Sequence
  derived and/or modified sequence opt3 from TMEFF1__Homo_sapiens__NP_003683
augggcgccgcugcagccgaggcgccccugagacucccugcugccccaccgcuugcauucugcuguuacaccagcgugcuguuguuauuugccuucucccugcccgggucuagggcuucaaaccagccuccaggagguggcgggggaaguggcggugacugccccgggggaaagggcaaaagcaucaauuguuccgaacuaaacguccgggagucugauguucgcgugugcgacgaaucgucauguaaguauggcgggguaugcaaagaggauggagacggucucaagugugcaugccaauuucagugucacacaaauuacauuccugugugcggcagcaacggggauacuuaucagaaugaauguuuccugcgacgugccgcuugcaaacaucagaaggagauaacggucaucgccagaggaccaugcuacagugacaacggcuccgguucuggggagggagaagaggaaggcagcggcgcggaggugcacaggaagcauuccaaaugugggcccugcaaguauaaagcagagugugaugaagacgccgagaauguuggaugcguguguaacauugauugcucagguuacaguuuuaauccugucugugcuagcgacggaucuuccuauaacaauccaugcuucgugcgggaagccucauguaucaagcaagagcagauugauauccgccaccuugggcauugcaccgacacagaugacacuagccuguugggcaaaaaggacgauggccuccaguacagaccggacguaaaggaugcaagugaccagagggaagauguuuacauagguaaccacaugcccuguccugagaaucugaacggguauugcauccacggcaaaugcgaguuuauuuacucuacccaaaaggcuuccugucggugcgaaagcggauauacaggccagcauugugagaaaaccgacuucucgauccuguacguggucccaucucgccagaagcucacucacguguuaauugccgcgaucauaggggccgugcagauugcaaucauugucgcuaucguuaugugcaucacacgaaaaugucccaagaauaacagaggaaggcggcaaaaacagaaccugggucauuuuaccuccgauacgucaagucguaugguguga

SEQ ID NO: 63881 - RNA, 1125 nt, Artificial Sequence
  derived and/or modified sequence opt3 from TMEFF2__Homo_sapiens__NP_057276
auggugcugugggagagccccagacagugcuccucuuggacccucugugaaggcuucugcuggcuucuguuguuaccugucaugcugcuaaucguugccaggccagugaagcucgcugcauuuccgacaucacugagugacugucaaacucccacgggguggaacugcagcggauacgaugaccgggagaaugaucuuuuccugugugacaccaacacaugcaaauuugauggugaauguuugcgcauuggcgacacuguaaccugcgugugucaguucaagugcaauaacgauuaugucccuguguguggguccaauggagagucuuaccagaacgaaugcuaucuccgacaggccgcgugcaaacaacagucggagauacugguugugucagagggcagcugugcuacagacgccgguaguggguccggagauggcguccacgaaggcucuggggagaccagccagaaggaaacuuccacaugcgacaucugucaguuuggagcagagugcgaugaggacgccgaagaugugugguguguaugcaauauugacuguucacaaaccaacuucaauccacugugcgcuagugacgguaaaagcuacgauaacgcaugucagaucaaggaggccucuugccagaagcaggagaaaauugaaguuaugucccucggccguugucaagacaauacgacuaccacaacuaagucagaagaugggcauuaugcuagaaccgacuacgccgagaacgcgaauaaauuagaggaaagcgcaagggagcaccauauccccugcccugaacacuauaacggauuuugcaugcauggcaagugugagcacaguauaaauaugcaggaaccaucuugccggugugaugccgguuacacagggcagcacugcgagaaaaaggacuacuccgugcuguaugucgugcccggaccugugcgcuuccaauacguccuuaucgcugccguuauuggcaccauccagauugcagugaucuguguaguggucuugugcauaacgagaaaguguccaaggagcaaccggauucaucgccagaaacagaacacuggccacuauucgucugauaauacaacccgagcuuccacuagacugaucuga

SEQ ID NO: 63882 - RNA, 405 nt, Artificial Sequence
  derived and/or modified sequence opt3 from TMEM100__Homo_sapiens__NP_060756
augaccgaggaacccaucaaggagauucugggcgccccuaaagcucacauggcagccacaauggaaaagagcccaaaauccgagguggucauaacuacgguuccgcucgugucugaaauccagcuuauggcggcuaccgggggaacagagcugucaugcuacagauguauuauccccuucgccguaguggucuuuauugcagguaucgugguuacugccguggcuuauaguuucaacagccauggcuccauaaucucuauuuuuggguuggucguguuaucgucaggacuguuccuacucgcaagcagugcccugugcuggaagguaaggcaacgguccaaaaaggcuaagcgccgagagucucagaccgcccuuguugcgaaucagcguagccuguuugcauga

SEQ ID NO: 63883 - RNA, 774 nt, Artificial Sequence
  derived and/or modified sequence opt3 from TMEM101__Homo_sapiens__XP_011523653
auggccagcaagaucggcuccagaagguggaugcugcagcucauuaugcaacuugggucugugcuguugacccggugccccuucuggggauguuuuucacaguuaaugcuguacgcugagcgcgcagaagcccgacguaaaccugacauaccagucccguaucuauacuucgauaugggugcggcuguucucugcgccaguuuuaugagcuucggcgugaagagaaggugguuugcacugggggccgcuuuacagcuggcaaucuccacauaugccgcuuacauuggaggcuauguacacuacggugacugguugaaagugcggauguauucucgcacugucgccaucauugggggauuccucgugcuggcgucgggcgcaggcgagcuguacagaaggaagccccggucacgcagccuccagaguacggggcaaguuuuucuuggaaucuaccugauauguguggccuauucccuucagcauucuaaagaagaucgauuggcuuaccugaaccaccuaccugguggcgagcucaugauccagcuguucuuuguccuuuaugggauucuggccuuggcauuccucagcggauacuaugugacccuggcugcccagaucuuagcgguacugcucccacccguuaugcuucugauugacggcaauguggccuacuggcauaacacaagaagggucgaauuuuggaaucaaaugaaguugcuaggugaguccguggggaucuucggaacugcagugauacuggcuaccgauggcuga

SEQ ID NO: 63884 - RNA, 390 nt, Artificial Sequence
  derived and/or modified sequence opt3 from TMEM105__Homo_sapiens__NP_848615
augcugcucaaggugagaagggccagccuuaaacccccugcuaccccacaccagggcgcauuccgggccgggaacgucaucggacaacugauuuacuuguuaacauggucccuguuuacugcguggcuacgcccgcccacgcuccugcaggguccucgaaccucuccacagggcucacccccucguaguccauggggagacugcgcugagcccagcugucuuugcgaaaugaagauaagaaggcggcgccaugaggggccugccuggggccaguccgguuuccuggcagggggauugcaccucguuccaucuucgcugucacuggccgcuuguggcgugguaagaaugaaaggccucugggggaggggagcagguauccggggccgcuga

SEQ ID NO: 63885 - RNA, 825 nt, Artificial Sequence
  derived and/or modified sequence opt3 from TMEM106B__Homo_sapiens__XP_005249846
augggcaagagccugucccaccucccccuucauucuucaaaagaggacgccuacgauggggugaccagugaaaacaugagaaauggacuggucaacagcgagguucacaaugaagacgguaggaacggcgaugugucccaguucccuuauguagaguuuacagggcgggacucugugacuugcccaacgugucaaggaaccggccgcaucccgcgaggucaggaaaaucaguuggucgcuuuaauucccuacucggaucagcgucugagaccuaggcggacaaagcuauaugugauggcaucaguuuucgugugccuccugcuuagcgggcuggccgucuuuuucuuguuuccacgcaguauagacgugaaauacaucggaguaaaguccgcguauguuucuuacgaugugcagaaaagaacuauuuaucucaacaucaccaauacacugaacauuaccaauaacaauuacuacagcgucgagguggagaacaucacugcucaagugcaguucuccaagacagucauaggcaaggccaggcugaauaacaucaccauuaucggcccccucgacaugaaacagauugauuauacgguuccuacugugaucgcagaagagaugucauacauguaugacuuuuguaccuuaauaaguauuaagguacauaauaucgugcugaugaugcaagucacagugacuaccacauacuucgggcacagcgaacagauuucucaggagcgguaucaguacguugauugcggacgcaacaccacguaucaacuuggucaguccgaguacuugaacgugcugcagccacaacaguga

SEQ ID NO: 63886 - RNA, 318 nt, Artificial Sequence
  derived and/or modified sequence opt3 from TMEM108__Homo_sapiens__NP_001269794
augaagagaagccugcaggcccucuacugccaacuucugaccguguuguuaacagucuguugcaugaaaaggaagaaaaagacugcuaaccccgagaauaaccuguccuauuggaauaacacgaucaccauggacuacuucaaucggcacgcaguugaacuaccucgcgagauucagucucucgaaacaucagaggaucagcugagugaaccacgaagcccggccaacggcgacuaucgugauacugggauggugcuuguaaaucccuuuugucaggagacccuguucgugggaaacgaccaagucuccgagauauga

SEQ ID NO: 63887 - RNA, 429 nt, Artificial Sequence
  derived and/or modified sequence opt3 from TMEM114__Homo_sapiens__NP_001277026
augaaccccuucagacuggagaaugugaccgucagcgaauccucuaggcagcuccuuacaaugcacggcacuuuuguuauccuguugccuuuaucacugauucuaaugguguucgggggaaugacggguuuucucaguuuccugcuucaagccuaccuguugcuccugcugaccggcauacucuuuuuauucggggcuaugguaacacuggcaggaaucagcguguauauugccuacuccgcggcugccuuucgggaggcacuuugcuugcuggaagagaaggcccuacucgaccaggucgauaucucuuucggcuggucgcuggcucuugguuggauuucauuuaucgcagaacuguugacuggggccgcuuuccucgccgcggcacgcgagcugagcuuacgacguagacaggaccaggccauauga

SEQ ID NO: 63888 - RNA, 1056 nt, Artificial Sequence
  derived and/or modified sequence opt3 from TMEM115__Homo_sapiens__NP_008955
augcagagagcccugcccggcgccaggcaacaccucggggcaauccuugccagcgcguccguggucguuaaggcucugugcgccgcaguguuguucuuauaccugcuaucuuuugccguagacaccggaugucucgcugugacaccugguuaucuguucccaccgaacuuuuggauuuggacucuugcaacgcauggccugauggagcagcacgucugggauguggccauaucauugaccacaguuguggucgcugggcggcuccuggaaccccuguggggagcccucgaguuacugaucuucuuuagugugguaaauguuagcgugggccuuuugggugcguucgcauaccugcuaacuuauauggccuccuuuaaccucgucuaccuguucaccgugcgcauucauggggcucuuggauuucugggcggcguguuggucgcccucaaacagacaaugggggacugcguugugcugcgaguaccucaggugcgugucucugugaugccaauguuacugcucgcacuucuguugcuacugagacucgcuacccugcuucaaucgcccgcccuggcgucauauggauucgguuugcucagcaguuggguuuaccugagguuuuaucagcggcacucccgcggcagaggggauauggccgaccauuucgcauuugcuacuuucuucccugaaaucuuacagccaguggucggacugcuagccaaucucgugcacucucugcuuguaaagguuaaaauuugucagaagacagugaaaagguacgaugucggcgcucccagcuccaucaccauaucauugccugguacggacccacaagaugccgagcggcgccgacagcuggcacucaaggcccugaacgaaagacuuaagaggguggaggaccagaguaucuggccgagcauggaugacgaugaggaagagucuggggcuaaagucgacucaccccugccuuccgauaaggcgccaacucccccuggaaaaggcgcagccccagaaagcaguuugauuaccuuugaggcugcucccccgacacucuga

SEQ ID NO: 63889 - RNA, 1233 nt, Artificial Sequence
  derived and/or modified sequence opt3 from TMEM117__Homo_sapiens__NP_001273141
auggcuaccugccacagccauagaacaaacuccuggcagaucucugugcccucagccuucgucuggaguguugcaccuauuaagaaugugagcaggcgguccuggguaguggacgauaacguccugcaacacaauucucucucgcuucauauauuuucacacauccagcaugacagcaguaacggcugggagcacggggugacugauaugaugcugcaggacaaaccauacccggauuggggaaaguccgcccgcgcguucuggaaaaaggguaauguucgaauuacguuguuuuggaccguguuauucacacugacuucugucgugguucuaguaaucaccacagacuggauuagcugggauaaacucaaccguggcuuucugcccuccgacgaagugucaagagcuuuccuugccaguuuuauccuggucuucgauuugcucauagugaugcaggacugggaguuuccucacuucaugggggauguggacgucaaucugccaggacugcauacuccccacaugcaauuuaagaucccuuucuuucagaagauuuucaaagaagaguauaggauccauauuaccggcaagugguucaacuacgguaucauauuucucguuuuaauucuggaucuuaauauguggaaaaaccagaucuucuauaagccacacgaauacgggcaguauauuggacccggccagaaaaucuacacagugaaggacagcgagucuuugaaggaccugaaucggaccaaacuauccugggaguggcgcucaaaccacacgaauccuagaacuaacaagaccuauguagaaggcgauauguuucuccauagcagguucaucggggcaagucuggacgugaaaugucuugccuuugucccaucucugauugcuuucgugugguuuggauucuuuauaugguucuuuggucgguucuugaagaaugagccgcgcauggaaaaccaagauaaaacauacacucgaaugaagagaaaaucccccagcgagcacucgaaggacaugggcaucaccagggagaacacacaggcaucuguugaagauccucucaaugacccaucccuggugugcauucggucagauuuuaacgagaucgucuacaagaguagccauuuaaccuccgaaaaucugucuagccagcucaacgagucaacgagugccacugaagcugaccaagaucccacaaccuccaaaagcacuccuacaaauuga

SEQ ID NO: 63890 - RNA, 579 nt, Artificial Sequence
  derived and/or modified sequence opt3 from TMEM11__Homo_sapiens__NP_003867
auggccgcuuggggcagaaggcggcuggggcccggaagcuccgguggcucugcacgcgagcgagugucacucagugccaccgacugcuacaucguccacgaaauuuauaacggggagaaugcgcaggaucaauucgaauacgagcuugaacaggcucuggaggcccaguauaaguacauaguuaucgagccuacacguauuggagacgaaacugcaagauggaucacggugggcaacuguuugcauaaaaccgccguauuagcugguacagcaugccuguuuacuccacuagcccucccgcuggauuauagccacuacauuucccuucccgcuggggugcugucuuuggccuguugcacccucuauggaaucucguggcaguucgacccuuguugcaaguaccaagucgaguacgaugcguauaaacugucaaggcugccacuccauacauuaaccagcaguacucccgugguucuggugcggaaggacgaucuucaccgcaaaagauugcauaauacaauagcacuggccgcucuagucuacugugugaagaagaucuaugaacucuacgccguauga

SEQ ID NO: 63891 - RNA, 378 nt, Artificial Sequence
  derived and/or modified sequence opt3 from TMEM126A__Homo_sapiens__NP_001231664
auggccggcauccccuuccugaccacagaccucacuuacagaugcuuugugagcuucccucuuaacacgggggaucuggacugugagaccugcacaauuacuagguccggauugaccgguuuagucauaggcgggcuguauccaguuuuucuagcuaucccggugaauggaggccucgcagcccgguaccagucugcgcugcuuccccacaaggguaacauucugucauauuggauccgcacaaguaaaccuguauuccgaaagauguuguuuccaauucuccugcaaaccauguucagcgcuuaccugggguccgaacaguauaaacucuuaaucaaggcccugcagcuuucugagcccggaaaagaaauacauuga

SEQ ID NO: 63892 - RNA, 717 nt, Artificial Sequence
  derived and/or modified sequence opt3 from TMEM127__Homo_sapiens__NP_001180233
auguacgcccccggcggggcuggacugccugguggcagaaggcggcgcagcccagggggauccgcacucccgaagcagcccgagcgaucucuugccucagcgcugccuggcgcuuugaguaucaccgccuuaugcacagcacuggccgaaccagcuuggcuacacauucauggugggacuuguagccgucaagagcucggaguguccgacguccugggcuauguucaccccgaucuucugaaagacuucugcaugaacccucagacgguguugcuccugagaguaauagcagccuuuuguuuccugggcauccucugcucuuuaucggcuuuucugcuugauguguucgggccaaagcaucccgccuugaaaauuaccaggcgguacgcguuugcacacauccugacaguccuacagugugccacugugauuggauucucauauugggcuagcgaacucauccuggcccagcaacagcagcauaagaaauaccacgguagucagguuuaugugaccuuugcagucuccuucuaccuuguggcuggcgccgggggagcgucuauacuggccacagcagcuaauuugcuccgccacuauccuaccgaggaagaggagcaagcccuggaauuacugagcgagauggaagagaacgagccauacccggcugaauacgagguaaucaaucaguuucagcccccuccagccuauacucccuga

SEQ ID NO: 63893 - RNA, 498 nt, Artificial Sequence
  derived and/or modified sequence opt3 from TMEM128__Homo_sapiens__NP_001284480
auggacaguuccagagccaggcagcaacugcggcgccgauuccuccuucugcccgaugcugaggcacaguuggaccgugaaggcgaugccgggccugagaccucuacagcgguggaaaagaaagagaagccauuaccgagacugaacauccacucaggauuuuggauucuagcuaguauagucguuacuuacuauguggacuucuuuaaaacgcucaaggaaaauuuccauaccagcuccugguuucugugcgguucugcccuucuguugguaucgcucucaaucgcauucuacuguauuguguaucuggagugguacugcggcaucggggaguaugaugucaaauaccccgcccugauuccuaucacaacugcuagcuuuauagcagccggaaucuguuucaacauugcucucuggcacguguggagcuuuuucaccccauuacugcuuuuuacacaguucaugggcguugugauguuuaucaccuugcuggguuga

SEQ ID NO: 63894 - RNA, 3075 nt, Artificial Sequence
  derived and/or modified sequence opt3 from TMEM132A__Homo_sapiens__NP_060340
augugcgccagaauggcuggcaggaccacagcagcgccccgggggccuuacggaccauggcugugucuccuuguggcccuggcuuuggacgucguucgcguggauugcggucaggccccguuagaccccguauaucugccugcagcccuagagcuccuggaugcuccagaacacuuccgagugcaacaggucggccauuaucccccugcaaacagcucccuuucuucacguagugagacuuuucuguugcuccagccauggcccagagcccagccucugcugagggcuagcuacccaccguucgccacgcaacaggugguucccccucgggugaccgaaccacaccagcgccccgucccuugggacgugagagcgguauccguugaggcagccgugacaccagcugaacccuacgccaggguccucuuucauuuaaaggggcaggauuggccgccuggaucuggcucgcugcccugugcacggcuucacgcuacucauccagccgguaccgcgcaccaagccugccgcuuccagccuucauugggggcaugugugguggagcuggagcuacccagccacugguuuagucaggcuuccacaacccgagccgaacucgcuuauacucuggagccagccgcagaaggacccggcggcugcgggucuggagaggagaaugacccuggugaacaggcccuuccagucggcgggguugagcugagaccggcugaucccccucaauaccaggaagugccauuggacgaggcgguaacacucagggugcccgauaugccuguccggccaggacagcuguucagcgcaaccuuacugcuccgucauaacuuuacggccucccuucugacuuugcgcaucaaagugaagaaaggccuacacguuaccgcugccagacccgcacaaccgacacuguggacugccaagcucgacagguucaaagguucacggcaucacaccacacugauuaccugucaccgagcugggcuuacggaaccugauaguagcucuccacuggaguuguccgaguuucucuggguggacuucgucguggaaaauucaacuggaggcggcguagccguuacacgccccgugaccuggcagcuggaguauccugggcaggcacccgaagcggagaaggauaagauggucugggaaauauuagugagcgagagagacaucagggcucugauuccacuagccaaagcagaggaacucgucaacacugccccucugacaggagugccccagcauguuccagugcggcuuguaaccgucgacgguggcggggcuuugguggagguuacggaacacgugggaugcgagagugccaauacccaaguccuccaggugucugaagcaugugaugcuguauuuguggccggcaaggagucccgcggugcgagagggguuagggucgacuucugguggcgucggcugcgagccagccugagacuuacagugugggcuccgcuguugccucucaggaucgagcugacugauaccacauuagaacaggugcgcggcuggcggguccccggaccagcagagggccccgccgaaccugcugccgaggcaucggacgaggcggaaagaagggcccgcgggugccaucugcaguaccaacgagcuggaguucgguuucuagccccauucgcagcucacccccucgaugguggccguagacugacucaucuuuuggggccugacuggcugcucgaugugucucaccugguggccccgcacgcaaggguauuagacucccgcgucgccucacuggagggaggccgggugguuguggguagagaaccaggggucaccaguauugaggugaggagcccccuuuccgauucuaucuugggcgaacaggcucucgcgguuacagacgauaaagugagcguacuggagcuacgaguccagccugugaugggaauaucacugacccucagucgcggcacugcccauccaggggaggugacggcaacauguugggcucaguccgcccugcccgccccuaagcaagaagucgcucuuagcuuguggcugucuuucucagaccacaccguugcaccggccgaguuauacgaccggagagaucucggacugagugugagcgcggaagaacccggugcuauccuuccagccgaagaacagggcgcacagcuggggguaguggucuccggagccggcgcugaggguuugccucuccauguggcacugcaucccccagaaccuugcaggcgugggcgccaccggguuccccuagccucuggcacugcguggcugggacucccaccggcuucgaccccugcccccgcacugccaagcucccccgccuggucaccuccagcuacagaggccaccaugggcgggaaaagacagguggcaggaagugucggcgguaacacuggggugaggggaaaguuugaacgagcugaggaagaggcccggaaggaggaaacagaggcgcgcgaagaggaggaagaggaagaggaagagaugguucccgccccucaacacgugacggagcuugaauugggcauguaugcacuguuaggugucuucugcguagcuauuuuuaucuuccucgugaauggcguuguguuuguccugagauaccagaggaaagagccgccagacucugccaccgaucccacuagcccucagccccacaacuggguguggcuugggacagaccaagaggagcugucccggcagcuagaucgacagucaccaggaccucccaagggcgaagggagcuguccaugcgagucuggaggcgguggggaggcuccuacccucgcaccgggacccccaggcgguacaacuuccaguagcucuacccuggccagaaaagaagccggcgggcgcaggaagcguguagaguucgugacguuugcuccugcgcccccagcacaguccccugaggagcccgucggagccccggcuguucaaucaauuuugguggccggcgaagaggacauccggugggugugugaggauauggggcugaaagacccagaagaguuaagaaauuauauggaaaggauacgcggaaguagcuga

SEQ ID NO: 63895 - RNA, 3237 nt, Artificial Sequence
  derived and/or modified sequence opt3 from TMEM132B__Homo_sapiens__NP_443139
auguucggcgccgcuagcagaauggacaccacagcagugugcacugggggagucacggaguccagggguaucguugauucucugcagaaguuuucaagucuccccgccuaccuuccuaccaaccugcacauuagcaaugcggaagaguccuucuuuuugaaagaagcuaaccaagacuuaacacgcaauucuucgcugcaggcccggguggagccauucuuuauauaucgagcacguacuccgcccaucauuaacgccucauacggcccuuucagcguagaaaagaucauuccacaggagcuacuccugaccaguacagcuuuugggaauauggauaaauuccccuuuaacuggaaacuuaaaucccauauccuggacucuagcauauauuccaauagaccuaaggugcagaccuuguucuacgucacuggaaugggcugggaugacucagaucucacagaggaccugccaugugugaagauguuugcauuccccgaagccagggagguugcugccaguugccggcugcaaggugcgccugggcucuguguggcagaauuagagcugcuuccagagugguuuagcucuggauuggaucuggaaccggaggaagagauccccgcccuacucggcggcaccacgauggaacuguucuucacucuuuauccugcugacaaagccgggcagugcccacuggaggaggaaggaaagugggagaacaauauucacuccgguuuggaaucaccccagcaggcauuuccugcucgcgagagaaucggcagcgucgugguauacccaacccaagaugaccucaaauggagucugguuucuuuagaugaaaacguggucauuuccgugccccugaaucucgugagggagggggacacagccacuuuccuugucagccugaccucgucuuccguugcggaccaguuuacauugcggaucaaggccgcagcuggagugaaaauaaccgccguacgcgugucaagugaggaucagugggcuguccaggaagagauugacaacggcagcacgcaaacuuccgccacacuaaccuguaugggucaucgaccggauacucagucuagagugaaugggagcuucuaugaaauccugcagguugacuuuggaauugauaacucaagugaccucgcaggcgcccaacagaucacauggcaaguggaguacccuaucgaagauuccaugagcgagcuggucgugucugagauuuucguaucacagaccacguuuguuggcauagugccccuugcuauggacaccgaaguccugaauacagcgaucuugacugggaagccagugagugucccugugaagguugugggaguacaggaggaugguagcgucguggacguuuccgaaucuguggagugcaaaucggcagaugaggacgucauuaaggugagcaacaacugugacuccaucuucguaaauggcaaagaaaugaagucaaaaguggauaccauaguuaacuuuacacaccagcauuucaccagucaguuugaggucaccgugugggcccccaggcucccacugcagauugaaaucucugacacagaguuaagccaaaucaagggguggcggauucccguggcugccaaucgucgcccuaccagagaauccgaugacgaggaugacgaggaaaagaagggaaggggcugcucacugcaguaccagcacgcaacuguccggguucuaacgcaguucguggccgagagcccagaucucggucaacugacauauaugcuugggccggacuggcaguuugauaucaccgacuuggugacugaguucaugaagguagaagaacccaaaauugcucagcugcaggauggccgaacccucgccggacgcgagccuggcauaacaaccguccaagugcugucuccacuuuccgacaguauccuggcagagaagacuguuauuguguuggaugacagagucacaaucgcggaacucggggugcagcugguugcuggaaugagcuuaucucugcagccccacagggccgacaaacgggcaaucguguccacggccgcugcccuagauguacuccaaucaccucagcaggaggcaauugucaguagcuggauacuguucucggacgguuccgugaccccacuugauaucuacgaccccaaggauuauucugugacugucagcucauuggacgaaaugguugugaguguacaggcuaaccuggaguccaaauggccgauuguggucgccgaaggcgaggggcaaggaccucucaucaagcuggagaugaugauuucugaaccaugucagaagacaaaacgcaagagcguguuagcgguuggcaaagguaaugugaaggucaaauuugagcccuccucagaugaacaucaagggggcagcaacgacaucgagggaauaaauagagaguacaaggaucaccugaguaacucuaucgaaagggagggcaaucaggaacgugccgugcaggagugguuccaucgggggaccccuguuggacaggaagaguccacaaacaagagcacuacuccccagucgccaauggaggguaaaaauaaacuuuugaagucaggcgggccugacgcuuuuacgucuuuccccacccagggaaagaguccagauccgaacaauccuuccgaccucacagugacuagccgaggccugaccgaucuagaaauugguauguaugcacugcucugcgucuuuugucuggccauccuuguauucuugauuaacugcguggcuuuugccuggaaauacagacacaagagguucgcaguuucugagcaagggaauaucccccacagccaugacuggguguggcugggcaacgaagucgaguuacucgaaaacccaguggacauaacacugcccuccgaggagugcacuaccaugauugaucgcggacuucaguuugaggaacggaauuuccuguugaacggcucaagucagaagacguuucacagccaacuccugagaccuucugacuauguauacgaaaaagagaucaagaaugaaccaaugaacuccucagggcccaaaaggaagcgcgugaaauucacaaguuacaccacuauucuaccugaggauggaggcccguauacaaauagcauccuguuugacuccgaugacaacauaaagugggucugucaggauaugggucucggggacucucaggauuuccgagacuacauggagucgcugcaggaucaaauguga

SEQ ID NO: 63896 - RNA, 3327 nt, Artificial Sequence
  derived and/or modified sequence opt3 from TMEM132C__Homo_sapiens__NP_001129575
augagaagcgagggcgccgcucccgggccugcagccccacugugcggagcgcucucccuucuguugggugcuuuacugggcaaggugaucgaagggcacggagucaccgacaacauucagagguucucuucacuaccgcccuaccucccuguuaguuaucauauacugcgggccgagacauccuuuuuccuuaaagaagcaaaucaagaucuguugcgcaacuccucucuccaggcccgaguggagucguuuuucacuuacaagacgcgucagccacccguacugaaugcuucauauggcccuuuuagcguggaaaaagucgugccacuggaccucauguuaaccaguaacuuccugggucccacaaauaaguuuuccuucgauuggaaacuuaaggcacacaucuugagagacaagguuuaccugucuaggccuaaagugcagguccuauuucauauuauggggcgggauugggacgaucacggagccggcgagaagcucccaugucugcgcguguucgcuuuuagagagacuagggaaguacggggcagcugccgccuuaaaggggaccugggauuguguguugccgagcucgaacuguuauccucaugguucagugcgccgaccgugggugcaggccgaaagaaaagcauggaucaacccgaggggacaccugucgagcuguauuacaccgugcauccaggaaacgaaagaggcgacugcgccgguggggauuuuaggaagggaaaugcuauccggcccggcaaggacggccucgaggaaacuacaucucaccuucagcguauugggaccgugggacuguaucgcgcccaggauuccgcacaguugucagagcuaagacuggacgguaacgucguuaucuggcucccuagcaggccagugaaacaaggcgaaguagugacggcuuacgucacuauaaguucuaauuccagcguggaccuguucauccuucgggccaagguuaaaaagggggugaacauucugucggcgcagacccgagagccccgccaguggggagucaaacaggaggugggcucuggugggaagcacguaacagccacuguugcaugucaaagauugggcccguccccuaggaaucggucaaguagccucuucaacgaagugguccagaugaauuuugagaucgcuuccuucucuagccugucaggaacccagcccauuacauggcaaguggaauacccacgcaaaggcaccacggauaucgccgucagugagauauuugugucccagaaggacuuaguugggauugugccucuggcuauggauacugaaauccuaaacacagccguacucaccggaaagacugucgcaaugcccauuaaagugguuagcguggaggaaaauucugccgucauggacaucucagaaaguguggagugcaagagcacagaugaagacguaaucaaaguguccgagagaugugauuauauuuucguuaacgguaaggaaauaaaaggcaagauggacgcugucgugaacuuuaccuaccaguaucugucugcgccacuuugcgugacggucuggguucccagguugccucugcagaucgaggugucggauaccgagcucagccaaauuaagggguggcgugugccaaucguaacaaauaaacggccgacucgagaauccgaggacgaagaugaggaggaaagaaggggacgcggcugugcacugcaguaccagcaugccaccguccgggugcuuacacaguucguuucagagggugcugggcccuggggccaaccuaacuaucuguugaguccaaauuggcaguuugacauaacucaccucguggccgacuucaugaagcuggaggagccccaugucgcaaccuuacaggauucuagagugcugguuggaagggaagugggcaugacaaccauucagguacuaagcccucucuccgacucaauccuggccgagaaaacuaucacgguccuugaugacaaggugagcgugacagauuuggcuauucaacuggucgccgggcucucuguugcacuguacccaaacgcggagaauagcaaagcugugaccgccguagugacugcagaagaggucuuacgcacccccaagcaggaagccguguuuaguacauggcugcaguucagcgacggaucuguuaccccgcuugauaucuaugacacuaaggauuuuuccuuggcugccacaucacaggacgaggcaguggucagugugccucaaccacgaagcccccgguggccuguuguggucgcugaaggugagggccaggggccccucauucguguagauaugacgauagccgaggcgugccagaaaucgaagagaaaauccauccuggccgugggaguuggcaacgugagggucaaguucggucaaaaugacgcugauucuagcccagggggcgacuacgaagaggacgaaauuaaaaaccacgcaucagaucgccggcagaagggacagcaccaugagagaaccggccaggacgggcaccuauacggaaguuccccuguggaaagggaggagggcgcccugcgacgcgcuacuacaaccgcccggucucuccuggauaauaagguagugaaaaacagcagagcagacggugggaggcuugcgggagaaggccaauugcagaauauccccaucgauuuuacaaacuucccagcccaugucgaccugccgaaggcugguuccggcuuagaggaaaaugaucucguucagacuccucgugggcugucagaccuugagauuggaauguaugcccuguugggcguguucugucucgcaauacugguguuucuaaucaacugcgcuaccuucgcccugaaauaccgccacaagcaggucccccucgaggggcaagcaagcaugacgcauagucacgauuggguguggcugggaaaugaagccgagcuuuuggaaucuaugggcgacgcuccacccccucaggaugagcacaccacaauuaucgaccgggguccaggggcgugcgaagaguccaaccaucuguuacucaacggaggcagccacaaacauguucagucgcagauucacagaucagccgauucugguggcaggcaagggcgagagcagaagcaggacccccugcacaguccuacuuccaaacggaagaagguaaaauuuaccacauucacuaccaucccgccagacgauagcugucccacggucaauucuauagugagcuccaacgacgaagauaucaagugggugugccaagacguugcagugggagcuccuaaagagcuucgcaauuaucuggaaaagcuaaaagauaaggccuga

SEQ ID NO: 63897 - RNA, 3300 nt, Artificial Sequence
  derived and/or modified sequence opt3 from TMEM132D__Homo_sapiens__NP_597705
augugccccagcgagaugggcacccuguggcaccauugguccccugugcucaucucucuugccgcucuguucucaaaggucacagaagggagaggaauuuuggagaguauacagagguuuagcuuacugccaacuuaccuaccgguuacguaucacaucaacaaugcagacguguccuucuuucucaaagaagccaaccaagauauuaugcgcaauucuucgcugcagucacggguagagagcuuccuuaucuacaagagucgacgucugcccguguugaacgcguccuaugguccuuuuucuauugaacaggucgugccacaggaccucaugcugcccagcaauccuuucggcuuuaccaacaaauucucccugaauuggaagcucaaagcucauaucuuaagagauaagguuuaccugucaaggccaaaggugcaaguccuuuuucacauaauggggcgggacugggaugaccgcagugccggagagaaauugcccugucugagaguguucgcauuuagggagacacgggaaguacgcggcagcugccgacuacagggugaucucgggcuguguguugccgagcuugaacuguugucuuccugguucucaccuccaacuguggucgcuggaagaaggaaaagcguggaccagccggagggcacccccguggagcucuauuacacaguccauccuggcggggaacggggagauugcguucgugaggacgcacgcagaaguaacgguaucaggaccggccacucugauauugacgaauccgggccaccccugcagcggaucggaagcaucuuuuuauaucaaacucaccgaaaaccuucgcugcgcgagcucagacuugauaauucuguggccauucauuacauaccaaagacaguaaggaaaggcgacgugcugaccuuccccgucuccauuucacggaacaguacggaagaccgcuucacuuugagagcuaaggugaagaaagguguuaauaucauuggggugagggccagcuccccgucuaucugggaugucaaggagcguaccgacuacacaggaaaauaugcgccugcagugaucguaugucagaagaaagccgcuggcagcgagaacucagccgauggcgcaaguuacgaaguuaugcagauugacguggaggucgaggaacccggggaucuaccagcuacucagcuggugaccuggcaagucgaauauccuggagagauaacauccgaccucggugugagcaagaucuacguuucucccaaagaucugauuggcgugguaccacuugccauggaggcggaaauccugaauaccgccauauugacggggaagacugucgcagugcccguuaagguggucucaguggaggacgauggaacaguaaccgaacuccuggagaguguggaaugccggagcuccgacgaggauguuauuaaagucucugaccgaugugacuauguguuugugaacggcaaggagaugaaagguaaggucaauguuguggugaacuucacuuaccagcacuuaucgagcccucuggaaaugacaguaugggucccaagacuaccgcuccagaucgagguguccgauaccgaacugaaccaaaucaaaggguggaggguucccauugugucaagucgccggccugcuggcgacucugaggaggaagaggaugacgaaagaaggggacgcggcugcacgcuucaguaucagcaugccaugguccgaguguugacccaguuuguugcugaggccgcagggccaggaggucaccuggcccaccuccugggcagcgauuggcaaguggacaucacagaacuuauuaaugauuucaugcagguagaggagccccggauagcuaagcugcaagggggacagaucuugaugggccaagaacucgguaugacuaccauucagauccuguccccuuuaucagacacaauccuggcggagaagacuauuaccguccuagaugaaaaagugacaauaaccgaccucggggugcagcuggucacuggccuuagcuugucucugcagcucuccccaggaaguaaccgugcaaucuuugccacggcuguugcccaagagcuguuacagagacccaagcaggaagcagccauuagcuguugggugcaguucucugauggcuccguaacaccgcuggacaucuacgaugggaaagacuuuucacuuauggcuaccaguuuggacgagaagguggucagcauucaucaagauccuaaauucaaguggccaaucauagccgcagagacugaaggacaggguacccucgugaagguugagauggugaucucggaauccugccagaaaucuaagaggaaaagcguccuggcggugggcacagcuaauauuaagguuaaauuugggcaaaacgacgccaaucccaacaccucagauagucgccacacuggagcaggcgugcauauggagaauaacgucuccgaccggagaccuaagaagcccucucaggaaugggguagccaggaggggcaguacuauggcuccucaagcaugggacuaauggagggcagggggacaacgaccgaucgaaguauccugcaaaagaagaaaggacaggaaucucuccuggacgauaauucccaccuucagacuauuccaagcgacuugacaucguucccugcccagguagaucugccccgcucaaacggcgagauggacgguaaugauuuaaugcaggcuucuaaggggcucagugaccuggaaaucggaauguacgcccuucugggcguguuuuguuuggcaauacucguuuuccugauuaacugcgugaccuuugcucuaaaauaucggcauaagcaggucccauucgaggagcaggaagguaugucccacagccacgauugggugggccugucuaauagaacagagcuccuggaaaaccauaucaauuucgccagcucccaggacgagcaaauuacugcgaucgacagggggauggauuuugaagagucaaaauaccuuuugaguaccaacagccagaagucuauaaacggacagcuguucaagccguuaggcccuaucauuaucgacgggaaagaucaaaaguccgagcccccaacgucacccaccaguaaacguaagcgcguaaaauuuacaacuuucaccgccgugagcuccgacgaugaauauccuacaagaaauucuauugucaugucgagcgaggacgauaucaaguggguuugccaggaccucgauccaggagacuguaaggaacugcacaacuacauggagcggcuucaugaaaauguguga

SEQ ID NO: 63898 - RNA, 3225 nt, Artificial Sequence
  derived and/or modified sequence opt3 from TMEM132E__Homo_sapiens__NP_001291367
auggcccccggcaugagcgggagaggaggugcugcacugcucugccuuuccgcccuguuggcgcacgcuucuggcaggucacauccugccaguccaagcccgcccgggccucaggcauccccaguguuacccgucucuuaccggcugucgcacacccgccuagccuucuuucuccgagaggcucguccuccaucacccgcaguugccaacagcagucugcaaagauccgaaccuuucgugguauuucagacaaaggagcuuccagugcugaaugucucuuugggaccguucagcacuucccaggugguugcuagggaacuccugcagcccucaaguacgcuggacaucccugagcggcucaccgugaacuggaaaguccgcgccuuuauugugagaagccauguaccagcgucucaacccguugugcaggucuuauucuauguggcaggcagggauugggacgauuuuggugugacagaacggcugccuuguguccgccuucacgccuuccgagacgcuagagagguuaaguccucaugcagguugagcgggggacuggccacuugucuagugcgggcagagcucccacuggcuugguuugggcccccggccccugcggcacccccaaccgcccgucgcaaaaguccugauggccuugaacccgaggcuacaggcgaaucucagcaggccgagcuguacuauaccuugcaugcuccagacgccuccggagguugcggcgggagcagaaggggagcaggccccgguguaggggcccgggcugagucgccuacucaacacccacuccugcgaauaggaucuaucuccuuauuccgcccgcccccuagaaggacacugcaggaacaccggcucgauucaaaucuuaugauucgccugccagacagacccuugaagccuggcgaggugcuaaguauccugcucuaccuggcgccaaacagcuccucucccagcucaccgagugucgaacauuuuacccuuagggugaaagcaaagaagggcguuacgcuguuggggacuaaaucccguagcggacaguggcacgugaccucugagcuccugacaggugccaagcauucaacugcuaccgucgauguggccugggcacagaguacaccuuuaccaccccgggaaggccaagggccucuggagauucuacagcucgacuucgagauggaaaauuuuaccagccaguccguaaaacgaagaaucauguggcacauagauuauaggggacacggcgcccugcccgaccuugagcgcgcuguuacggaauugacugugauccaacgggauguccaggccauucugccacucgcaauggacacagagaucauuaacaccgcgauccugacugguagaacaguggcuauaccugucaaggugauugccaucgaaguuaaugggcuugugcuggacauuucugcauugguagagugugagucggauaacgaagacaucaucaaagucagcuccucaugcgauuacguguucguuaguggcaaggagucuaggggaagcaugaaugcccgcgugaccuuccgauaugacguccucaacgcuccccuggaaaugacgguguggguaccaaaguuaccgcugcauauugagcuauccgaugcccggcucucacaggugaaaggcuggcguguuccuauacugcccgacagaaggagcguccgcgaaucugaggaugaggacgaagaggaagaggagcggagacaguccgcaaguaggggguguacccuucaauaccagcacgcuacauugcaaguguuuacucaguuccauaccacaagcucugaaggaacugaucaaguggucaccaugcuggguccagacuggcucguugaggugacagaucugguguccgacuuuaugcgaguaggcgacccccgcgucgcccacaugguggauucaaguaccuuagcggggcuggaaccuggaacuacgccauucaagguugugagcccccuuacagaggccgucuugggcgaaacccuccugacugugaccgaggagaaaguuucgaucacacagcuacaggcucaggugguagcaucccuggcccucucucugcggccuagcccggguucaagucauaccauucuugcuacuacagccgcacaacagacguuguccuuucugaagcaggaagcguuacucucucuguggcuuagcuacuccgacgggaccacugccccacugucauuguauagccccagagauuacggccuccuggucaguucucuagacgagcacguggcuacagugacccaggauagggccuucccucuggucguugcagaagcugagggauccggcgaacuccugcgugccgagcuuacaaucgcagagagcugccagaaaacuaagcgcaaaucgguguuggccaccacgccaguagggcugcgggugcacuuuggaagagacgaagaggaucccaccuaugacuacccugguccgucacagcccggcccagggggaggcgaagaugaggcuaggggugcggggccucccggcucugccuuaccagcaccugaagcucccggaccaggcacagccaguccggucgugccucccacugaggacuuccucccacugcccaccggguuucuucagguuccucgaggacugacagaucuagagauaggcauguaugcccuccuggguguguucuguuuggcuauucuggucuuuuuaaucaauugcaucguguucguucuccgguaccgccauaagcggauuccacccgaagggcaaacuuccauggaccacagccaucacuggguguuucugggaaacggccagccucuuaggguccagggugagcugucuccgccagcaggcaaucccuuggaaaccguaccugccuucugucacggggaucaucacagcuccggaucaagucagacgagcgugcaaucucagguucauggcagaggggacggauccucaggcgguagugcgcgagaccaggcugaggaucccgccagcuccccaacaucuaagagaaaacgcgugaaguucaccacuuuuacaacccucccuucggaggaacuggcauaugacagcguccccgccggggaggaagaugaggaagaggaggaagaccuaggauggggcugcccagauguggcugguccuacuaggccgaccgcacccccagaccugcacaacuacaugcgucggaucaaagagauugccuga

SEQ ID NO: 63899 - RNA, 543 nt, Artificial Sequence
  derived and/or modified sequence opt3 from TMEM134__Homo_sapiens__NP_001072118
augagcgccgcuagaccccaguucuccaucgacgaugcauuugagcugucucucgaagacggcgggccuggaccagagucaagugguguggccagguucggcccgcuucacuuugaacggcgcgcgcgauucgaggucgcugaugaagacaagcaaagccgucugagauaccagaacuuggagaaugaugaggacggggcccaggcaucccccgaaccugauggaggcguugguaccagggacucuucgcggacaucaauucgcagcagucagugguccuuuucuacuauaagcuccucaacgcaaagaaguuauaauaccugcuguagcuggacacagcauccauuaauccagaaaaacaggcgggugguacuggccucuuuccuacuccugcuucugggguugggaguguccucagcuaucuuuuucguccccggcuuucuccugcuggugccuggcguuuaccacgugauuuucauuuauugcgcagucaaggggcaucgcggauuucaguucuuuuaccucccauauuucgagaaauga

SEQ ID NO: 63900 - RNA, 1311 nt, Artificial Sequence
  derived and/or modified sequence opt3 from TMEM135__Homo_sapiens__NP_001162195
auggccgcucugagcaaguccaucccccacaacugcuacgagauuggccauaccuggcacccuucuuguagagugucauuccuccagauaacagggggagcacuugaagagagucugaaaaucuaugccccauuguacuuaauugcggcuauccugaggaagcggaaacuagacuauuaccuccauaagcugcuuccggaaauucugcaaagcgccuccuuuuugacugcaaauggugcccucuauauggcuuucuuuugcauccugcgcaaaauacugggcaaguucuacucuuggacgcccggguuuggagcagcccucccugcuucguaugucgccaucuuaauugagcgaaagucacguagaggccugcuuaccaucuacauggcgaacuugguucugcuauucuguauuacagcagccauguacauguuuuucuuuaggugcaaagauggucucaagggguucacuuuuagcgcucugcgguucaucgugggaaaagaagagauaccaacccacaguuuuucccccgaggccgcauaugcuaagguagaacagaaacgcgagcagcaugaagagaagccuggcagaaugaauaugauuggccuugugaggaaguucgucgacucuaucuguaaacacgggccacggcaccgcugcuguaagcauuacgaggauaacugcauuagcuauuguaucaaaggauucauccgaauguuuuccguggguuaccugauucagugcuguuugagaauacccucagccuucaggcaccucuuuacacaaccuagucggcuguuaagccuguucuauaauaaggaaaacuuucagcucggcgcguuccuugggucuuuuguuuccaucuacaaaggaaccucaugcuuccugcguuggauucgcaauuuggacgaugagcuacaugccaucauagcaggcuuucuggcugguauuagcaugauguucuauaagaguacuacaaucucuauguaccucgccuccaaacugguggaaaccauguacuuuaaggggaucgaggcuggaaaggucccauauuucccgcacgccgacacgauuaucuacagcauuucgacugcaauaugcuuucaggccgcugugauggaaguacagacccuuagacccucuuauuggaaauuccuguugaggcucacaaagggcaaauucgcgguuaugaaccggaaggugcuggaugucuuuggcacuggggcauccaaacacuuccaagacuuuaucccucgauuagauccacgcuacaccacagugacccccgagcugccuacggaguucucauga

SEQ ID NO: 63901 - RNA, 489 nt, Artificial Sequence
  derived and/or modified sequence opt3 from TMEM138__Homo_sapiens__NP_057548
augcugcagaccagcaacuacucccucgugcuuucucugcaauucuuguuacugucauaugaccuauuugucaauaguuucagcgagcuccugcagaagacacccguuauccagcuugugcuguuuauuauacaggauaucgccguauuguucaacauuaucauuaucuuucucauguucuuuaauacuuucguguuucaagcuggccuggucaaccuccuguuccacaaauuuaaggggacgauaaucuuaaccgcaguguacuucgcccuguccauuucucuucauguuugggugaugaauuugagauggaaaaacucaaauucguuuaucuggacagacggacugcagaugcuauucgucuuccagaggcucgcggcugugcuguauugcuacuuuuauaagcggacugccguacgccuuggugauccucacuucuaccaggacagccugugguugcgaaaagaauuuaugcaaguucguagauga

SEQ ID NO: 63902 - RNA, 702 nt, Artificial Sequence
  derived and/or modified sequence opt3 from TMEM150B__Homo_sapiens__XP_011525158
auguggggcuaccugagccucaugcccguguuccuugccgucugggcuaucuccgggguuuggauuguguuugcaauagccguaaccaacagaacaguggaccugucuaagggauucccuuauaucucaauuugcgguaguuuuccaccgcagagcuguaucuucucccaagucuugaauaugggcgcggcuuuagccgcauggauuugcaucgugagguaccaccagcugcgggauuggggaguucgccgauggcccaaccagcuaauacucuggacugggcugcuuugugcccugggcacgucuguggucgguaauuuucaggagaaaaaccaacguccuacccauuuggcuggggcauuccucgccuuuauccugggaaauguguauuucuggcugcagcucuuacuguggagacuuaagagguugccacagcccggcgcugccuggauuggcccucugcggcuagggcucugcucgguauguacaauccugauuguugcgaugaucgugcuucacgcaugcucacugcgcagcgucagugccgcuugugaaugggugguggccauguugcucuuugcacuguucggauuacuggcugucgacuuuuccgcccucgagucuugcacucuuuguguucagccauggcccagccuguccccuccaccggcgucacccauaaguuugccugugcaacuauga

SEQ ID NO: 63903 - RNA, 1407 nt, Artificial Sequence
  derived and/or modified sequence opt3 from TMEM151A__Homo_sapiens__NP_694998
augcccgaggacggcgccggggauggaggugaagugccugcucugaucccagacggcgagccgcucagagaggaacagaggccccuuaagcaaagccugggguccucuuugugccgggaaucacacuggaaauguuuacugcuaacccuccugauucaugcaugcggagccgucguugcguggugucgccuugcuacagugccucgacugguauugggcccagaggccgcacucgcccguggugcugggggacccccuccaacuuaccccgcaaguccuugcagcgauggcuaucuguacauaccacuggccuucgugucccucuuauaucugcuuuacuuggcugaguguuggcacugccaugucagaucuugucaggccccgaggacggacgcgcacaccgugcuggcacuaauccggcgccuccagcaggcucccccuugcguuugguggaaggccacaucguaucauuacgugagaaggacucggcaaauuacccgcuaucgaaacggcgaugccuacacaaccacucaggucuaccacgaaagagcagacucaaggacagcuagaggggaguuugauuauagcgcccacggagugcgugacguaaguaaagaacugguuggucuugcggagcaugccgcaacccgccugagauucacgaaguguuuuuccuucggcucugcugaggccgaagcuagcuacuugacucagagggcccgguuuuucuccgcaaaugaggggcucgaugacuaucuggaagcccgagagggaaugcacuuaaaagauguggacuuucgcgaaucacugauggucuucgcugauccaagaagucccccuugguacgcgagggcauggguguuuuggcucgugagcgccgcuacccuuucuuggccacugcgggucguugccgcauauggcacagcccaugugcacuaccagguagagaaguuguucggugcuuccucacccccgccuggggccgugcccagcggaccaccucuaagucgcgucgcaacuguggacuuuaccgagcuggaauggcacaucugcucuaacagacaacucguucccuccuauagcgaggcgguggucaugggcgcuggcucgggggccuaccugaggggaugucagcguugccggcgaucuguguccucaaauagucuuccacccgcaagaccuagcgguccaaggcugccguucucccgcucucgguugagccucggcgccgggggacgggcuacacccggcguauuuaggucacugaguggugggccuuuaggccgccgaggagaagacaccgagccacuggaauccccucccugcuacgaggaugcccuauauuucccaguucucauugugcauggcgacagcgggugucagggagauggucagggcgcacuguga

SEQ ID NO: 63904 - RNA, 1701 nt, Artificial Sequence
  derived and/or modified sequence opt3 from TMEM151B__Homo_sapiens__NP_001131032
augagcccucccggcuccgccgcuggggagucugcagccggagguggcgggggaggcggugggccaggagugucagaagaacugaccgcggcugccgcagccgcugcagccgacgaaggcccggcuagagaggaacagaggcccauccaaccuaguuucacaaagagccucugccgggagucccacuggaaaugucuucuguugucuuuacugauguacggcugccuaggggccgucgcguggugucauguuacuacggugacccgccucacauuuucgucagcauaucagggaaacagccugauguaccacgauaguccaugcuccaaugguuauguauacauuccccuugccuuccuguugaugcucuaugcuguguaccuggucgaguguuggcauugccaggcccgacacgaacugcagcaucguguggacguuucuagcgugagagagagggucggccggaugcaacaggcaacuccuuguauaugguggaaggcuaucuccuaucacuacgugcgcagaaccaggcagguaacacgguaccgcaacggggaugccuauaccacuacacagguuuaccacgaacgagugaauacccaugucgcggaggccgaguuugacuaugcaagaugcggagugagggaugugucaaaaacgcucgucggcuuagaaggugcuccagccacucggcugcguuucaccaaguguuuuaguuucgcuagcguugaggccgaaaacgcauaccuuugccaacgcgccagauuuuucgcugagaaugaaggguuggacgauuauauggaggcgagggagggaaugcaccugaaaaacguggacuuucgggaguucaugguagcauuucccgauccugcccgaccaccgugguacgcuuguucuuccgccuucugggcagccgcucuacucacacugucauggccccuucgcgugcuggccgaguauagaacugcauacgcgcauuaccacgucgaaaaguuguuuggccucgagggcccugggagcgcuaguucugccggagguggccuguccccaagcgacgaauuacugcccccucucacccacaggcuuccacgggugaauacaguugauucgaccgagcuggaguggcauauucgcucuaaccagcaguuggugcccuccuauucagaagcaguccuaauggaccuggccgggcucggaacgagaugcggcggugcugggggcggauacgccccgaguugcagguauggcggggugggagguccuggcgcagcugggguagcccccuaccgucggagcugugagcacugccagcgagcgguuuccucuagcucaaucuucaguagauccgcccugagcauuugugcuucuccaagggcaggaccuggccccggugggggcgccggaugcggcgggucacgcuucagucuuggacggcuguaugguagcagaagguccuguuuguggcgcucucgaucgggcagcgugaaugaggcuuccugcccaacugaacaaacacggcucucaagucaggccucuaugggggaugacgaagacgaugacgaggaggaagcaggacccccuccaccguaccaugaugcgcuguauuuucccgucuuaaucgugcaccgucaggagggcugucugggucauagccacagaccucuacacaggcauggguccugcgucgaaaccucacucuga

SEQ ID NO: 63905 - RNA, 552 nt, Artificial Sequence
  derived and/or modified sequence opt3 from TMEM154__Homo_sapiens__NP_689893
augcaggcccccagagcugcacugguguucgcccucgucaucgcgcuuguuccugugggcagggggaacuacgaggaacuggagaauagcggagacaccacaguagaauccgagcggccaaacaaggugacuauuccgucuacguuugcugccgucaccauaaaagaaacauugaaugcaaacaucaauucaacuaacuucgcccccgaugagaaucaauuagaguuuauucugauggugcuaaucccucucauucugcuuguucuguugcuccugaguguggucuuccuggcuaccuauuacaagcgcaaacgaacaaagcaggaaccaagcucccaggguucucagucggcacuccaaaccuaugaguuaggcucagaaaacgugaaaguacccaucuuugaggaggacacuccuagcguuauggaaauagagauggaggaacuggauaaguggaugaauaguaugaaccguaaugccgacuucgaaugccuuccaacauugaaggaggagaaagaauccaaccacaaucccucugauagcgaguccuga

SEQ ID NO: 63906 - RNA, 903 nt, Artificial Sequence
  derived and/or modified sequence opt3 from TMEM158__Homo_sapiens__NP_056259
augcugccccuccuugccgcucuguuggcagccgcgugcccuuuaccaccggugagaggcggggcugccgacgcacccggacugcuaggugucccuagcaacgccuccguuaaugcuucuucagcagaugagccaaucgcccccaggcuccuggcuagugccgcgccuggcccacccgaacggccugggccagaggaagcagccgcugccgcagcuccguguaacauuagcgugcagcgccaaaugcuuuccucucuguugguacgauggggacgucccagaggcuuccagugcgaccuccugcuguuuucgaccaaugcccacgguagggcguucuuugccgcagcuuuccaucggguggggccuccacucuuaauagagcaccugggacuugccgcuggcggcgcccagcaggauuugcgccugugugucgggugcggaugggugagagguaggcggacaggccgccuacgacccgcagccgcuccuucagcggcagccgcuacugccggggcaccaacggcccuccccgcuuacccggccgcagaaccucccggaccacuguggcuucaaggcgagccucugcauuuuuguugcuuggacuucagccucgaggaacugcagggugagcccggguggagauuaaacaggaagccaaucgaaaguacccugguugcguguuuuaugacacucgugauugucgugugguccguagcugcccuuaucuggcccguuccuauuaucgcaggauuccugccaaauggcauggagcagcggcguacuaccgccucuacaaccgcugccacuccggcagcugugcccgccggcacaaccgcggccgcugcagccgcugccgcagcggccgcugccgcagcugucacgagcgggguggccacuaaauga

SEQ ID NO: 63907 - RNA, 567 nt, Artificial Sequence
  derived and/or modified sequence opt3 from TMEM160__Homo_sapiens__NP_060324
augggcgggggaugguggugggccagagcugcaaggcuggcccggcuccgcuuccgacguagccuucugcccccucagagaccaagguccgguggcgcgcgggggucuuuugcuccgggacacggcccccgcgccggugcaucaccuccacccgugagugaguuggacagagccgaugcuugguuacugaggaaggcacaugaaaccgccuuccuaagcugguuucggaacgggcuccuggcuuccggaaucggcgucauuucuuucaugcaaucggacaugggccgcgaggccgcguacggguuuuuccuucugggagguuugugcguuguguggggcucagcaagcuaugccguagggcucgcugcccugcgaggaccuaugcagcugacacucggcggugcagcugugggggccggagcggucuuagccgcaagucugcuuugggcuugugccgugggcuuguacaugggccagcuggaacuagauguugagcucgugccagaagacgaugggacugcuuccgccgagggacccgacgaggcagguagaccuccaccggaauga

SEQ ID NO: 63908 - RNA, 1464 nt, Artificial Sequence
  derived and/or modified sequence opt3 from TMEM161B__Homo_sapiens__NP_699185
augggcgugaucgggauucagcuggucguuaccauggugauggccagcguaaugcaaaagauaaucccccacuacucccucgcuagauggcuucugugcaacggaucuuugaggugguaucagcauccuacagaggaagaguuacggauucuggcagguaaacagcagaagggcaaaacuaagaaagaccgcaaguacaaugggcacaucgaaucaaagccacuaacgauuccgaaagauaucgaccuccaucuggagaccaagagugugacagaagucgauacucuugcccugcacuauuuccccgaguaccaaugguugguggacuuuaccguugcggcuacaguggucuaucucgugaccgagguauacuauaacuucaugaaaccuacucaggaaaugaauauaagccugguuuggugucugcucguguuauccuuugccaucaagguccuguucucucuuacaacccauuacuuuaaaguggaggauggaggcgaacgaucggugugcgucacguucgguuucuucuuuuucguuaaggcaauggccguguugauuguaacugagaacuaccuggaguuugggcuagaaaccggauucacaaauuuuucagacagcgcuaugcaguuccucgagaagcagggccuggaaagucaauccccagugucuaaacuuacuuucaaguuuuuccuggcaaucuuuuguagcuucauuggcgccuuuuugaccuuccccgggcuccgucuggcucagaugcacuuagaugcccugaaccucgcgacagagaaaaucacccagacgcuucugcacauaaacuuuuuggcaccucuauucaugguccugcucugggugaagccaauuacuaaagacuauaucaugaaucccccucugggaaaggaauccauuccacuuaugacagaggccaccuuugauacucugagauuguggcucaucauccuguuaugcgcucugaggcuagccaugaugcggucacaucuccaggcauaccugaaucuugcucaaaaauguguugaccagaugaagaaggaggccggucgcauuaguacaguggaauugcagaaaauggucgcgagaguguucuauuaccugugcguaauagcccuccaauauguugcaccgcuggugaugcuucugcacaccacguugcuccugaagaccuuaggcaaccauagcugggggaucuaccccgagucuauuuccacacugccugucgauaauucacuacucagcaacaguguguauucugaacugccauccgcugagggaaaaaugaaggucacugugacccagaucacaguugcccuuagcucguugaaaaauauauuuacuccccugcucuuuaggggccuguuaucuuuucugaccugguggauugcugccugucuuuucuccacaucauuguucggucucuuuuaccaccaguaccugaccguggcauga

SEQ ID NO: 63909 - RNA, 870 nt, Artificial Sequence
  derived and/or modified sequence opt3 from TMEM163__Homo_sapiens__NP_112185
auggagcccgccgcuggcauccagagaaggagcucccaagggccuaccgugccaccgcccccucggggacacgcaccacccgccgcggcuccugguccagcaccccugucuucaccuguccgcgaaccaccgcagcucgaggaggaacgacagguucguauuagugaaagcggccaguucuccgacgggcuugaggauagaggacuguuggagucuucgacaagguuaaagccccaugaagcccaaaacuaccggaaaaaggcccugugggugucaugguuuagcauaaucguaacucuagcucucgcaguggccgcuuucacggucagugugaugcgcuauuccgccucugcguuuggcuucgcauuugacgccauucuggauguucuuagcuccgcuaucgugcuguggagauacucaaaugccgcagcuguccacagugcccauagggaguauauugcgugcgugaucuuggguguaauauuccuccugagcucuaucuguauuguugugaaagccauccacgaccuguccacccggcucuuaccugaagucgaugacuuucuguucucagugagcauucuuagugggaucuugugcucuauacuggcagugcuaaaguuuaugcucggaaaaguccugacaucccgcgcucuuauuacugauggcuucaacagccugguuggcggggugaugggauuuucgaucuugcucucugccgagguauucaagcaugacuccgcugugugguaccuggaugguucaauuggcgucuuaaucgggcugaccaucuuugccuauggagugaagcuccuuauugacaugguuccacgagugagacagacaaggcacuacgagauguucgaauga

SEQ ID NO: 63910 - RNA, 975 nt, Artificial Sequence
  derived and/or modified sequence opt3 from TMEM165__Homo_sapiens__NP_060945
auggccgcugcagcccccggcaacgggagagcgagcgcuccuaggcugcuccuucuguucuuggugccauuacugugggccccggcagccguccgggcuggacccgacgaggaucuaucccaccgcaauaaggaaccuccagcacccgcccagcaacuccagccucagccaguugcugugcagggucccgagccugcccgaguagagaaaaucuuuaccccagcggcaccggugcauacaaacaaggaggaccccgccacucaaacgaaucugggcuucauucacgcuuuugucgccgcaauaucugugaucauuguuucagaacuuggggauaaaaccuucuuuaucgcugccauuauggcgaugcguuacaacagacugacaguguuggccggagcaaugcucgcucugggccugaugacuugccucagugucuuauucgguuaugccaccacagugaucccuaggguauacaccuauuacguuagcacugugcuguuugcuauauucgggauccggaugcuucgcgagggauugaagauguccccagacgagggccaggaagaacuggaagagguccaggccgagcucaaaaagaaggaugaagaguuucagagaacaaaacuacugaauggccccggggacguggaaaccggaacgucuauuacugugccucaaaagaaauggcuucauuucaucucgccaauuuuuguccaggcacugaccuugacauuccucgccgaguggggugauaggucacagcugacuaccaucguuuuagcugcgcgggaagaccccuauggcguggcaguagggggaacagugggccacugucugugcaccggucucgccgucauagggggacgcaugauugcucagaagaucagcgugcgaacgguuacuauuaucggcggcaucguguuucuugccuucgcauucagugcccuguuuauuuccccggauucuggguucuga

SEQ ID NO: 63911 - RNA, 894 nt, Artificial Sequence
  derived and/or modified sequence opt3 from TMEM169__Homo_sapiens__NP_001135784
auggaggaacccaccgccguggagggccagguccaacugccuagcccacaccaggggucccucagaaaggcuguugcagccgcgcuugcucuggacggagaaucuacaaugggucauaggaaaaagaaacggaaggagucacgcccggaaaguaucauuauauaccgaagcgauaacgagaaaacugacgaggaacccggcgaguccgaagggggagaucagccuaaggaggaggaaggcgacgauuucuuggacuauccaguggaugacgauauguggaauuuaccccuggacucucguuacguaacgcuaaccgguacaaucacuagagggaagaaaaagggacagaugguggauauucacgucacccucacagagaaagaacugcaagagcuuaccaagccuaaagaaucgucaagggagacuacaccagagggccggauggccugccagaugggcgcagaccgcgggccccaugugguucuguggaccuugaucugucucccuguggucuuuauucugagcuucgugguaaguuuuuauuacggaacgaucacuugguauaacauauuccugguuuacaaugaagagagaaccuuuuggcacaagaucuccuauugcccaugucucguguuauucuacccgguccugauuauggccauggcuucuagccuugguuuguacgcagccguggugcagcuguccuggucaugggaggcuugguggcaggccgcgagggauauggaaaagggcuuuugcggguggcuauguaguaaacucggacuggaagacugcagccccuauucuaucgucgagcuucuggaguccgacaacauuucaagcacauugaguaauaaggauccuauccaagaaguugagacuucuaccguguga

SEQ ID NO: 63912 - RNA, 435 nt, Artificial Sequence
  derived and/or modified sequence opt3 from TMEM170A__Homo_sapiens__NP_660297
auggagagagaaggcagcgggggauccgguggcucugccgggcugcuccagcaaauccuuucacugaaggugguccccaggguuggaaacggcaccuugugcccuaauaguacaucguuauguuccuucccagagaugugguacgguguguuucugugggcucuaguaucuagccucuucuuucacgugccggcagggcugcuugcccuguucacuuugcggcaucacaaauauggacgcuuuaugucagucagcauucuccugaugggcauagugggccccaucacggcggggauucugaccagugcugccaucgcaggaguuuaccgagccgcugguaaggaaaugauuccuuucgaggcacucacauuaggcacugggcagaccuuuugcgugcuggucguguccuuccuucguaucuuggccacacuguga

SEQ ID NO: 63913 - RNA, 972 nt, Artificial Sequence
  derived and/or modified sequence opt3 from TMEM171__Homo_sapiens__NP_001154814
augagccccgccgcugcagccgagccugacggcgaucagcaagacagacacguguccaagcugaucuucugcuuuuucgucuuuggggcgguucuccuuugugugggaguacuguugucuauuuucgguuuucaggcuugccaguacaaaccauuaccggauugucccauggugcugaaggucgccggcccugcaugcgccgugguugggcuaggagcugugauacucgcaaggucacgggcccagcugcaacuucgcgcuggccugcagcgaggucagcagauggacccagaucgugccuucaucuguggggaaaguagacaauuugcgcagugcuugauuuucggauuucucuuccugaccagcggcaugcugaucuccguccucggcauuugggugcccggguguggaucuaacugggcacaggagccuuuaaaugaaacagacacuggugauucggagccaaggaugugcggcuuucugucacuucagaucauggggcccuugauaguacugguuggacuauguuucuuuguggucgcccaugugaaaaagcggaacacgcucaaugcuggccaagacgccagcgaacgcgaggagggucagauccagauuauggaaccugugcaagucaccguuggggauagugugaucauuuucccaccgcccccuccacccuauuucccugaguccucugcaagcgcuguagccgaauccccaggaacaaacucacugcuucccaaugagaacccgccuaguuacuauagcaucuuuaauuacggcacucccaccucugagggcgcggccuccgaaagagacugcgagucaauauauacaauuagcgggaccaacaguucuuccgaagcaagccacacuccacaucugccuucggaguugcccccaagguacgaagagaaagagaaugcugccgcuacauuccucccccugucuuccgaaccuucaccaccguga

SEQ ID NO: 63914 - RNA, 1140 nt, Artificial Sequence
  derived and/or modified sequence opt3 from TMEM173__Homo_sapiens__NP_938023
augccccacagcucccugcauccuucuaucccaugcccgagaggccacggggcccagaaggcugcacucgugcuucugucagccuguuuggucaccuuauggggacugggugagcccccugaacauacacuaagguaccucguucugcaccuugcgagucugcaauugggccuccugcugaacggggugugcagccucgcugaggaauuacggcauauucacucccgcuaucgaggaucuuacuggcguacuguaagagccugucugggcugcccacuuaggcggggugcauugcugcuacucucgauauauuucuacuauucacugcccaaugccguggggccuccauuuacguggaugcuugcucuguugggacucagccaggcacugaacaucuuacugggccucaaaggccuugcccccgcugagauuagugccgucugugaaaaggggaauuucaacguggcgcacggacuggcaugguccuacuauaucgguuacuugcgccuaauucugccugagcuccaggccagaaucaggaccuacaaucagcauuauaacaaucugcuucggggcgcuguuucucaacgccuguacauauugcucccacuggacugcggggugccggauaacuuaagcauggccgaccccaauauccgauuucuggauaaacuaccucagcagacaggagaccacgcaggcauuaaggauagagucuauuccaacucaaucuacgagcuccuggaaaauggucagagggcugggacuugugugcuugaguaugccaccccauugcaaacacuguucgcgaugagucaguacagccaggccggauuuucucgggaagaccgucucgagcaggcaaaacuguucugccgcacccuugaggauauucuggcugacgcccccgaaucccaaaacaauuguagauugaucgcuuaucaggagccugccgaugacagcucauuuagucucucucaggaaguacugaggcauuuacggcaagaggaaaaggaggagguuacugugggcucccugaagacaagcgcagucccaucgaccucuacgaugucccaggaacccgagcuacucauaucaggcauggaaaaaccgcugccucuucgaacugauuucaguuga

SEQ ID NO: 63915 - RNA, 1269 nt, Artificial Sequence
  derived and/or modified sequence opt3 from TMEM175__Homo_sapiens__NP_001284354
augaccuuccugaucgugacagucgccugggcugcacacacuagacucuuucagguugugggcaagacggacgauacccuugcccuguugaacuuagcgugcaugaugacaauuacuuuccugcccuacaccuuuagccuaaugguaacauucccugacgugccacucgggauauuucuguucugugucugcgugaucgcuauuggaguugugcaagcccuuaucgucgguuaugcauuucacuucccgcaccuguugucuccccagauucagagguccgcccaucgggcucucuaccgccgacacgugcugggcaucguacugcaggggccugcacucuguuuugccgcugccauauucucauuauuuuucguuccacugaguuaucuuuugauggugaccgucauccugcuacccuacgugagcaaggugacuggauggugccgugauagacuccugggccauagggagccuuccgcgcacccagucgaaguguuuucuuucgaccuucacgagccccugucgaaggaacggguugaggcauucucagaugguguauaugccauuguggcuacauugcucauccuggacauuugugaagauaaugucccugacccaaaagaugugaaggagcgcuuuagcgggaguuuaguugccgcacuguccgcuaccggaccgagauuccucgccuacuuuggcucuuucgcgacggugggccuucugugguuugcccaucacagcuuguuccuacaugucaggaaagcaacucgggcuauggggcugcucaacacccugucccuugccuuugugggaggucugcccuuggcuuaucaacagacaucagccuucgcacgccagccucgagacgagcucgaaagaguaaggguuaguugcacuaucauauuucuggccagcauuuuccaguuagcuauguggaccacagcgcugcuacaccaagcagagacccuccagccaucugugugguuuggcgggcgggaacacguccugauguucgccaaacuugcuuuguaccccugugccucccugcucgcauuugccucaacgugccugcuuagccguuucagugugggaaucuuccaucugaugcagauugcugucccuugugccuuuuugcuccugcgcuuacuggugggccuagcacucgcgacucugagaguucuuagggguuuggcucggccagagcaucccccgccugcccccacagggcaggaugacccacaaucucagcugcucccugcacccugcuga

SEQ ID NO: 63916 - RNA, 702 nt, Artificial Sequence
  derived and/or modified sequence opt3 from TMEM176B__Homo_sapiens__NP_001094784
augacccagaacacagugaucgucaauggcguugccauggcuagcagacccucccaaccuacucacgugaacguacauauucaccaggagucugcacugacgcagcuccuuaaggccgggggaucacugaaaaaguucuuguuucauccaggugacaccgugccgaguacagcgaggauaggcuacgaacaguuagcucugggggucaucgccgcaggagccggcgcuauugugcacgagaaacaucccgguaagcuagcaggguauaucagcucccuccugacucuugccggauucgcuaccgccauggcggcaguugugcugugcgucaauucuuuuauuuggcaaacagaaccuuucuuguacaucgauaccgugugugaccggucggauccaguauuucccacuacaggcuaucgcuggaugcgacguucacaggagaaccaguggcagaaagaagagugcagagccuacaugcaaaugcucaggaagcuguucaccgcuauacgggcccuguuucucgcaguuuguguguuaaaggucaucgugagccuggugagucuuggcgucggguugcgcaaucugugcggacaguccucucagccucuaaacgaggaagguagcgagaaaagacuccugggcgaaaauuccguuccacccucaccuaguagggagcagacgagcacugcuauugugcuuuga

SEQ ID NO: 63917 - RNA, 894 nt, Artificial Sequence
  derived and/or modified sequence opt3 from TMEM178A__Homo_sapiens__NP_689603
auggagcccagagcccuggugaccgcucucagccuuggccuguccuugugcucuuuagggcugcuagucacagcaaucuucacugaccacugguacgaaacggauccuaggcggcauaaggagucaugugaacgcagucgagccggagcggacccaccggaucagaaaaaccgucucaugccccugagccaccuuccucugagagacuccccacccuuggguaggcggcuccugccuggcgggccaggacgcgcugaucccgagucuuggagaucgcugcucggcuuaggugggcuggacgccgaaugcggaaggccucuuuuugcaaccuauucaggcuuguggcggaaguguuacuuccugggcauugaucgcgacauagauacacuaauccucaaagggauugcccaacgaugcacugcuaucaaguaucauuuuagccagccaauuagacugaggaauaucccguucaaccuuaccaaaacaauacagcaggacgaguggcaccuguugcaucuccggcguaucaccgcaggauuucuggguauggccguugcuguguuacuguguggcugcauuguagccacugugaguuucuuuugggaggaaucccucacacaacacgucgcggggcuucuguucuugaugaccggaaucuuuuguacgauuucucuaugcacuuacgcagccagcaucuccuaugaucugaaucgccuccccaagcugauauacucacuuccugcugacguggagcacggcuauaguuggagcauuuucugugccuggugcucucuggguuuuaucguugcagcugggggauuguguauugccuacccauucaucuccagaaccaagaucgcgcagcucaaaucaggcagggauagcacaguguga

SEQ ID NO: 63918 - RNA, 690 nt, Artificial Sequence
  derived and/or modified sequence opt3 from TMEM182__Homo_sapiens__NP_653233
augagacugaacaucgccauuuucuuuggcgcucucuucggggcacuuggagugcuguuguuuuuagucgccuucgguagcgacuacuggcugcuagcgaccgagguuggaaggugcuccggggaaaagaauauagagaacgugacauuucaccaugaaggauucuuuuggcgguguugguucaauggcaucguagaggaaaacgauucuaauauuuggaaauuuugguauacuaaccagcccccuucaaagaauugcacgcacgcuuaccucaguccauauccguucaugcgcggugagcauaacagcaccuccuacgacucugccgugaucuaucgaggguuuugggcaguccugaugcuucugggagugguugccguggucauugcuucguucuugaucauaugugcagcccccuuugcuucacacuuccucuacaaagccggcggcgggagcuauaucgcggcaggcauucuguucagucuggugguaaugcucuacguuaucugggugcaagccgucgcugauauggaguccuaccguaauaugaagaugaaagacugcuuagauuuuacaccuucugugcuguaugguuggagcuucuuucuugccccagcaggcauuuucuuuuccuugcuggcugggcuacucuuccugguggucggaagacauauccagauacaccacuga

SEQ ID NO: 63919 - RNA, 1131 nt, Artificial Sequence
  derived and/or modified sequence opt3 from TMEM183A__Homo_sapiens__NP_612400
auggccagaggccccgggccucugggaaggccacggccggacaccguggcuaugcccaagcgcgguaaacgacucaaguuccgugcacacgaugccugcagcggcagagucacaguugcggacuacgcuaacuccgauccugccgugguaaggucugggcgggugaaaaaggcagucgccaaugcugugcagcaagagguuaaaucacuuuguggacuggaagcaagucaggugccagccgaggaggcuuugagcggcgccggugaacccugcgacaucauugauuccucugacgaaauggaugcgcaggaggagucgauacaugaacgcacugucucaagaaagaagaaaagcaagaggcacaaagaggaauuagacggggcaggaggcgaggaguauccuauggauaucuggcugcuacucgccaguuacauucggccagaagacaucgugaacuuuucccugauuuguaagaaugcuuggacgguaaccugcacagccgcauucuggacucgccuuuaucgaagacauuacacccuggaugcuucuuugccccucaggcugcggccugagagcauggaaaaacugcguugucuccgcgccugcguuaucagauccuuauaucacauguacgagccauuugcggccaggauaucaaagaacccggcaauccccgaaaguacaccuagcacccugaaaaauucuaagugucuuuuguucuggugccggaagauugugggcaaccgacaggagccaaugugggaguuuaauuucaaauuuaagaaacaaucaccccgccugaaguccaaauguacugggggacuacagccuccaguccaguaugaagacgugcauacaaaccccgaucaggacugcugucuccugcaagugaccacgcuuaauuucaucuuuauuccgaucgucauggguaugauauucacucuguuuaccauuaacguuagcacagacaugagacaccacagggugcgguugguauuccaggauaguccugugcauggcgggcgcaagcucagaucugagcagggaguccaggugauccuggaccccguucacuccgugagguuauuugauugguggcauccacaauacccuuucagccugcgugcuuga

SEQ ID NO: 63920 - RNA, 1317 nt, Artificial Sequence
  derived and/or modified sequence opt3 from TMEM184C__Homo_sapiens__NP_060711
augcccugcaccuguacauggagaaacuggaggcaguggauccggccucugguggccgucauuuaccucguuagcauagugguagcugugccacuuugcgucugggagcugcaaaaguuggaagugggcauccacacuaaagcaugguucauugccgggaucuuuuuacugcuaacgauuccgaucucccucuggguuauacugcagcaucuugugcacuauacccagcccgagcugcagaagccuaucauucgcaucuuguggauggucccaauuuacucucucgacucauggaucgcgcugaaauaucccggaauagcuauuuacguggauacaugucgagaaugcuaugaggccuacguaaucuauaauuucauggguuuucugacuaacuaccucaccaaucguuacccuaacuuaguucugauucuugaagcaaaggaccaacagaaacauuucccacccuuguguugcuguccuccaugggccaugggcgaggugcugcuauuuagaugcaagcucgggguccugcaguauacaguggugaggccguucaccacuaucgucgcucuuaucugugagcuguugggaauuuacgaugaaggcaauuuuaguuucagcaacgcauggacauaucucguuauaaucaauaacaugucccagcuguuugccauguacugcuuacuacucuucuauaaggugcuuaaagaggaacugucucccauucaaccuguagguaaguuuuugugugugaaacuggucguguucguuucguuuuggcaggcuguggucaucgcccugcucgugaagguagggguuauaucagagaaacacaccugggaguggcagacgguggaagcggucgcaacuggacugcaggacuucauuaucugcaucgagauguuccuugccgcuauugcccaucacuacaccuuuagcuauaagccauacgugcaagaagcagaggaaggcaguugcuucgauuccuuucuggcuaugugggacgucucugauauccgggacgauauuagcgaacaggugcgccacguuggcagaacagugagggggcauccccggaagaaauuguucccugaggaccaggaucaaaaugaacacacuucccuccugucaaguagcucucaggacgccauauccaucgcgucaagcaugccacccaguccgaugggacauuaccaggguuuuggccacaccguaacaccucagaccacgcccacuacagccaagauuucugaugagaucuuauccgacaccaucggggagaaaaaggagccaagcgacaaaucggucgauucuuga

SEQ ID NO: 63921 - RNA, 876 nt, Artificial Sequence
  derived and/or modified sequence opt3 from TMEM185A__Homo_sapiens__NP_001167563
augaaccugagaggccucuuccaggacuuuaaucccagggccgagggggaaaccugcguggaguucaaggcuaugcuuaucgcagucgguauucaccuguuguuacugauguuugaaguucuagugugugaucggauagagcgcggaagccauuucuggcuccugguauuuaugccucuuuucuuuguguccccagucucuguggccgcgugcguuuggggcuuccgacacgaccguucacuggaauuggagauccucuguagugugaacauucugcaauuuaucuucauugcucugagacucgauaaaaucauacauuggccgugguuagucgugugcguaccccuguggauccuuaugagcuuuuugugucugguugugcuauacuauauugucugguccgugcuuuuccugaggucuauggacgugaucgccgagcagcggcgcacacacauuacuauggcacuuucguggaugacgaucgucguuccucuguugaccuuugaaauacuccuggugcauaaguuagaugggcacaaugccuucucaugcauuccaaucuucguaccccuguggcucagccuuauuacacugauggcuacuaccuuuggacagaaaggcgguaaccacuggugguucgggaucagaaaggacuuuugucaguucuugcuagagaucuuuccuuuccugagggaauacggaaauauuaguuaugaucuccaucacgaggacaacgaggaaacagaggaaaccccagugcccgagccuccaaaaauagcaccgauguuucggaagaaggcccgcgucgugaucacucaaucccccggcaaauacguucugccuccacccaagcucaauauugaaaugccugauuga

SEQ ID NO: 63922 - RNA, 786 nt, Artificial Sequence
  derived and/or modified sequence opt3 from TMEM187__Homo_sapiens__XP_011529501
augaaccccgaguggggccaggccuucgugcacgucgcuguugcagggggacugugcgccguggcgguauuuaccgguaucuucgacagcguguccguccaagugggcuacgaacauuaugcugaggccccuguugcagggcucccagccuuucuugcuaugccguucaauucucuggugaacauggcauacacauuguuaggacugucauggcuacacagaggcggugccauggggcucggacccagguaucugaaggaugucuuugcugccauggcgcuucuguacggcccugugcagugguugcggcucuggacucaguggcgccgagcagccguacuggaccaguggcugacgcucccaauuuucgcuuggcccguugccugguguuuauaucuggaucguggcuggagaccuugguuguuucuuagucuggaaugcgugagccuagcauccuacgggcucgcucugcuucauccacaaggauucgaggucgcccugggugcgcacgugguggccgcagucggccaggcuuugaggacccaucggcacuaugggucuacaacuucggccaccuaccucgcucugggaguuuuaucaugucugggcuuugugguacucaaacuuugcgaccaccagcuggcccgcuggagauuguuccagugucuaacaggucauuuuuggagcaaggugugcgauguccugcaauuccacuuugcauuccucuuccugacccauuuuaauacucaccccagguuccacccuagugggggaaaaacacgguga

SEQ ID NO: 63923 - RNA, 804 nt, Artificial Sequence
  derived and/or modified sequence opt3 from TMEM189__Homo_sapiens__NP_001155977
auggccggcgcugaggacuggcccgggcagcaacuggaacucgaugaggacgaagcaagcugcuguagauggggagcccagcacgcgggugcuagggagcuugccgcacuguacuccccuggcaagcgguugcaggaauggugcucugugaucuuauguuucucacugauugcccauaaccuaguccaccuccugcuucuggcucgcugggaggauaccccauugguuauacucggggugguagcaggagcccugaucgcugacuuucugaguggccucgugcauuggggugccgauacaugggggagcgucgaguuaccgauugcguucauccgacccuuucgugaacaccauauugacccuacugcaaucacgagacacgauuucauagagaccaauggagacaacugccuggugacacuuuugccacugcuaaauauggccuauaaauuuaggacucacucccccgaagcucucgagcagcuguacccuugggaguguuucguguuuugccuuaucauuuucggcaccuuuacaaaccaaauccauaaguggucucacaccuauuucggccugccacgguggguuacuuugcuccaggauuggcaugucauucugccccgcaaacaccacagaauccaucacgugucgccucaugaaacauacuuuuguauaaccacggggugguuaaauuauccacuggagaagauuggauucuggaggcggcucgaagaccuuauccagggucugacuggcgagaaaccgcgcgccgaugacaugaagugggcacagaagauuaaauga

SEQ ID NO: 63924 - RNA, 1113 nt, Artificial Sequence
  derived and/or modified sequence opt3 from TMEM189-UBE2V1__Homo_sapiens__NP_954673
auggccggcgcugaggacuggcccgggcagcaacuggaacucgaugaggacgaagcaagcugcuguagauggggagcccagcacgcgggugcuagggagcuugccgcacuguacuccccuggcaagcgguugcaggaauggugcucugugaucuuauguuucucacugauugcccauaaccuaguccaccuccugcuucuggcucgcugggaggauaccccauugguuauacucggggugguagcaggagcccugaucgcugacuuucugaguggccucgugcauuggggugccgauacaugggggagcgucgaguuaccgauugugggaaaggcguucauccgacccuuucgugaacaccauauugacccuacugcaaucacgagacacgauuucauagagaccaauggcgacaacugccugguuacacuuuugccacugcuaaauauggccuauaaguuuaggacucacucccccgaagcucucgagcagcuguacccuugggaguguuucguguuuugccuuaucauuuucggcaccuuuacaaaccaaauccauaaauggucucacaccuauuucgggcugccacggugggucacuuugcuccaggauuggcaugugauucugccccgcaagcaccacagaauccaucacguaucgccucaugaaacauacuuuuguauaaccacgggaguuaaagugccaaggaauuuccgguuacuggaggaacucgaggaaggucagaagggcgucggggacggaacugugucauggggccuugaggaugacgaggauaugacccugacacgcuggacugguaugauuaucgggccgccccgaaccauuuaugaaaacagaaucuacagcuugaagaucgagugcggaccuaaauauccagaagcacccccuuuugugagguucgucacaaagauuaauaugaacggcguuaauaguuccaacggcgugguagacccacgggccauaucugugcuagcuaaauggcagaauagcuacuccaucaaggucgugcugcaagagcuccgucgccugaugaugucaaaagaaaacaugaaacuuccccagccgccugaggggcaguguuacaguaauuga

SEQ ID NO: 63925 - RNA, 423 nt, Artificial Sequence
  derived and/or modified sequence opt3 from TMEM18__Homo_sapiens__NP_690047
augcccagcgccuucuccgugucuucauuuccugucaguaucccagcuguucugacccagacagacuggacugagccguggcucaugggccuugcaacguuccacgcccugugcguguuguuaaccugucugagcuccagaucuuacaggcuacaaauugggcauuuucucugccugguaauacuuguguauugugcggaauacaucaacgaggcugccgcaaugaauuggcggcuguucucgaaguaucaguacuuugauucacgcggaauguucauuagcaucgucuuuagugcccccuugcucgugaacgcuaugauuaucguugugaugugggucuggaaaacacugaaugugaugacugaccugaagaacgcacaggaacgacguaaagagaagaaaagaaggcggaaggaagauuga

SEQ ID NO: 63926 - RNA, 627 nt, Artificial Sequence
  derived and/or modified sequence opt3 from TMEM199__Homo_sapiens__NP_689677
auggccagcucccugcucgcuggcgagagacuugugagggcacuggggcccggaggugaauuggagccugaacgguuaccacgcaagcugcgagccgagcuagaagcggcucucggcaaaaagcacaaagggggagacucuucaaguggcccgcagcgucuggucagcuucagacuuaucagggaucugcaucaacacuugcgggagcgcgacuccaagcucuaccugcaugagcugcucgaagguucugagauuuauuuacccgaaguugugaaaccuccaagaaaccccgagcugguagccaggcuugagaagauaaagauccaguuggcaaaugaagaguacaaacggauuacccgcaacgugacaugccaggauacucgacacgggggaacgcugucggaccuaggcaagcaggucagaucacucaaagcccuggugaucaccauuuuuaauuucaucguuacaguggucgcugcauuuguguguacuuaucuuggcagccaauacauauucaccgaaauggccaguaggguacuggcugccuugaucguugcguccguggucgggcucgcagagcuguaugugauggugcgggccauggaaggagaguuaggugagcuguga

SEQ ID NO: 63927 - RNA, 1476 nt, Artificial Sequence
  derived and/or modified sequence opt3 from TMEM200A__Homo_sapiens__NP_001245206
augaucgccaccggcggggugauuacaggacuggcugcacucaagagacaggacagcgccaggucccaacagcacgucaaccuuucucccaguccugcgacucaggagaaaaagccaauacggcgccgaccgcgugcugauguugugguagugagagguaaaaucaggcuguacucacccagcggcuucuuuuugauuuuagggguccugaucuccauuaucggaauagccauggcagugcuaggcuauuggccucagaaggaacauuucaucgacgccgagacgacccucucuacaaaugaaacucaaguuauucggaacgagggugggguggucgugcgcuuuuucgaacagcaucugcacucggauaaaaugaagaugcuuggaccauuuaccaugggcaucggcauuuucaucuuuauaugcgcuaaugcaauucugcacgagaacagagacaaggagacaaaaaucauucauaugagggauaucuacucaaccguaaucgacauucacacuuugcggauaaaggaacagcgccagaugaaugggauguauacaggacucaugggugagaccgaaguuaaacaaaacggcagcaguugugccucccgacuggcugccaauacgaucgcgucuuucagcggguuuagauccucauucaggauggauaguagcguggaggaggacgaacugaugcucaacgagggaaagucuuccggccacuuaaugcccccucugcuuucagauagcagugucucuguguuugguuuguacccacccccuuccaaaacuaccgacgauaagacaagcgggucgaagaaaugcgaaacuaagucuauuguguccucaaguaucagcgcauucacccugccagucauaaaacuaaauaacuguguuauugacgagccguccaucgauaauaucacagaagacgccgacaaccucaagucucggagccguaaucugucaauggauagucuugugguaccccugccuaacaccuccgagagcuuucagccagugucuacggucuugccccgcaauaacucaauuggagagagucucagcucccaguauaaaucuucgauggcucugggcccuggcgccgggcaguuacugagcccaggagcagcuagaaggcaauucgguuccaacacuucacuccaucuucugaguucucacagcaaguccuuggaccuagaucggggccccucaacacugaccgugcaggccgaacagcgaaaacauccgagcuggccucgccucgacagaaauaacucuaagggguacaugaagcuggagaauaaagaagaucccauggacaggcuucugguuccacaaguggcgaucaagaaagauuucacuaacaaggagaaauugcucaugauuucccggagucacaauaaccugagcuuugaacacgacgaguucuuaucuaauaaccugaagcgcggaacauccgagaccagauuuuga

SEQ ID NO: 63928 - RNA, 570 nt, Artificial Sequence
  derived and/or modified sequence opt3 from TMEM205__Homo_sapiens__NP_001138888
auggaggaaggcgggaaccugggaggucucaucaagauggugcaccuucuggucuugagcggcgccugggggaugcagauguggguuaccuucguguccggauuuuuacuguucagaucucuacccaggcauacauuuggccucguacaaucaaaacuguucccuuuuuacuuccacauuaguauggguugcgcuuuuauaaaucuuuguauccuggcaagccagcaugccugggcgcaguugacuuucugggaggcuucccagcucuaucugcuguuucucucuuuaacgcuggccaccgugaacgcacgguggcuugaaccacgcacaacugccgcuaugugggcauugcaaaccgucgagaaggaacgagggcugggaggcgaggugccgggcucgcaccaggggcccgacccuuaccgucagcuaagagagaaagauccaaaguauucagcccucaggcagaauuucuuucgguaccauggacugagcagucuuugcaaccuggguuguguuuuguccaauggccucugccuggcuggguuagcccuggaaauucgcucucucuga

SEQ ID NO: 63929 - RNA, 441 nt, Artificial Sequence
  derived and/or modified sequence opt3 from TMEM207__Homo_sapiens__NP_997199
augagcagauccaggcuguucucugugaccucagccaucaguacaauuggcauacucugccuuccccuguuucaguuggucuuaagcgaccugccuugugaggaagaugagaugugcguuaacuacaaugaccaacacccaaacgggugguauaucuggauucuacuccugcuugugcugguagcugcauugcucuguggagccgugguccugugccugcaguguuggcuccggcgcccgcgaaucgauucccaccguagaacuauggcgguguucgcuguuggugacuuagauucuauuuacggcacggaagccgcagugucgcccaccgucgggauccaucugcagacacagacuccugaccuuuauccagugcccgccccuugcuuuggaccauugggcucacccccuccauacgaggaaauaguaaagaccacauga

SEQ ID NO: 63930 - RNA, 1560 nt, Artificial Sequence
  derived and/or modified sequence opt3 from TMEM209__Homo_sapiens__NP_001288092
augaugcagggcgaggcccaccccagcgcuucccugaucgacagaaccauuaagaugaggaaagaaacagaggcacggaaggugguccucgccugggggcuucugaacguuucuauggcgggaaugauauacacugaaaugacggguaaauugaucucaaguuauuacaaugugaccuauuggccuuuaugguacauugagcuggcucuagccagccucuucucccugaacgcacuuuuugauuucuggcgcuauuuuaaguacacaguagccccaacuucucugguggucucgccgggccaacagaccuugcucgggcugaaaacagcugugguucagaccacucccccucaugaccuggcagccacacagaucccacccgcuccuccaucacccagcauucaaggacagagugugcucuccuauucuccuagccgauccccaucaaccaguccgaaguucacgacuagcugcaugaccggcuacucuccccaguuacagggucuguccucagggggaagcggcaguuacucuccuggcgucacauauuccccagugagcggguacaauaaacuugccucguuuucucccuccccuccaucacccuauccgacuaccguaggaccuguugaaaguagcgguuugcguuccagauacaggucuagccccacaguguauaacucaccaaccgauaaggaggacuacaugacggaucugcggacucuagacacauuccuccgcagugaggaagagaagcaacacagagucaaacugggcuccccugauagcaccucucccucaaguagcccaacuuuuuggaauuauuccaggucuaugggggacuacgcgcagacacuuaagaaauuccaguaccagcuggcaugucggucgcaagcccccugcgcuaacaaggaugaagccgacuugagcuccaagcaggcagcugaggaggugugggcccgcguggcgaugaaucgacagcuccuggaucauauggacucauggaccgccaaauuuagaaacuggaucaaugaaacgauauuagucccucugguucaagagaucgaaagugugucuacccagaugaggcggaugggauguccagagcuccagauuggcgaacuuagccagggugggugcauguccucauuccguuggaaccgcggaggcgauuuuaagggcagaaaaugggacacagaccugccgacugauagcgcaaucauuaugcacguauucuguaccuauuuggacucuaggcuacccccucauccaaaguaccccgaugggaaaacauuuacuucccaacacuucgugcagaccccuaauaagccagacgucacaaacgagaauguguucugcaucuaucagagugcuauaaaucccccgcacuacgagcugauuuaucagcggcauguuuacaaccucccuaaaggacgaaacaacauguuucacacccugcuuauguuccuguauaucauuaagacuaaggaaagcgguauguugggccgcgugaaucucgggcugucuggagucaacaucuuauggaucuuuggcgaguga

SEQ ID NO: 63931 - RNA, 324 nt, Artificial Sequence
  derived and/or modified sequence opt3 from TMEM213__Homo_sapiens__NP_001078898
augcagagacugcccgccgcuaccagggcaacacucauccuuagccuggccuucgcguccuugcacucugcuugcucagccgaggcaaguagcuccaacucuucgucauuaacugcccaucacccugacccaggcacgcuggaacaaugucuaaauguggauuuuugcccgcaggcugcacgguguugccgcaccggggucgacgaguacggauggauugccgcugccguugguuggagccucugguuccugacacuuauacuguuguguguggauaagcucaugaaacugacucccgacgaaccuaaggaucugcaggcguga

SEQ ID NO: 63932 - RNA, 708 nt, Artificial Sequence
  derived and/or modified sequence opt3 from TMEM215__Homo_sapiens__NP_997723
augagacccgacgauaucaacccuaggaccggccugguggucgcccucguuagcguguuccuuguauuuggguucauguuuacaguguccggaaugaagggugagacucugggcaauauuccauuguuagcuauagggccggcaaucugccugcccggaauugccgcgaucgcucuagcccggaaaacggaaggcuguaccaaguggccugagaacgaacuccuguggguccgcaaacuuccaugcuuccgaaagcccaaagacaaggaggugguugaacuguugcguacaccuucugaucucgagucagguaaggggaguagcgacgagcuggccaaaaaggcaggacugagaggcaaaccacccccucagucccaaggcgaagugucugucgcuucgucaauuaauagcccaacuccgaccgaggaaggggagugucagagucucgugcagaacggacaccaggaggaaacauccagguacuuagaugguuauugccccucuggcagcucccugaccuacucagcacuugacguaaaguguagugcccgggaucgcagcgagugcccugaaccagaggacucuaucuuuuucguuccccaagauuccauaaucguguguucauauaaacagaauagcccuuacgacagauauugcuguuacauuaaccagauccaggggaggugggaucaugaaacuauugucuga

SEQ ID NO: 63933 - RNA, 438 nt, Artificial Sequence
  derived and/or modified sequence opt3 from TMEM216__Homo_sapiens__NP_001167461
augcugcccagaggccucaagauggccccuagggggaaacggcuuagcuccaccccacuggagaucuuguucuuuuuaaacggaugguacaaugcuacauauuuccugcuagaacucuuuauuuuccuguacaagggugugcuucugccguaucccacugcaaacuugguccucgacguugugaugcugcugcucuacuuaggcauagagguaauccgccuguuuuucgggacgaaaggaaaucuuugccagcgaaagaugccuuugucuauuucaguggcccugaccuuuccaagugcgaugauggcuagcuauuaccuacuccugcaaacauauguccuucgucuggaagccaucaugaacggcauucucuuguucuuuugugguuccgagcuguuacuggaagugcucacucuugcagccuucucuagaaucuga

SEQ ID NO: 63934 - RNA, 636 nt, Artificial Sequence
  derived and/or modified sequence opt3 from TMEM217__Homo_sapiens__NP_001273330
augaagcagcaacaguggugcggcaugaccgccaaaauggggacagugcugagcggagucuucacuaucauggcuguugacauguaccucauuuuugagcagaagcaccuugguaacggcuccuguacggaaauaacccccaaauauagaggggcaucuaauaucauuaacaauuucaucauuugcuggucauuuaagaucgugcuguucuugaguuuuauaacaaucuuaauuagcuguuuccugcuauacuccguauaugcccagaucuuuaggggacucgugauuuacaucgucuggauauucuuuuaugagacugcgaacgugguuauucaaauccugaccaauaacgauuucgacauuaaagaagugcggaucaugcgcugguuuggccuugucucucgaacagugaugcauugcuucuggauguuuuucguaaucaauuacgcucacauuaccuauaagaaccguucgcaggguaauauaaucucauacaagagaaggauuagcacugccgagauccugcauagucggaacaaacgcuuguccauaucuagcggguucuccggaucacaccucgaaagucaguacuuugagagacagaggcgguguagcggcaagacaucuauuaaauga

SEQ ID NO: 63935 - RNA, 723 nt, Artificial Sequence
  derived and/or modified sequence opt3 from TMEM219__Homo_sapiens__NP_001077082
augggcaacugccaggccgggcacaaucugcaucucugucuugcucaccaucccccucuggugugcgcaaccuugaucuuacugcuacucggacugagcggucuuggccugggguccuucuugcucacacacagaacuggacugaggucuccagacauuccgcaagauugggucucauuucugcggaguuucggccagcucacguuauguccccgcaacgguaccguuacagggaaguggcgaggaagccaugugguaggccugcuuacuaccuugaauuuuggcgacgggccugaucguaacaaaacaagaaccuuccaggccacugugcugggaucccagaugggucuaaaggggucuucggcgggccaacucguccugauaacagcuagggugaccacggagcggacugccggaaccugccuuuacuuuucagcaguuccaggcauccugcccagcagucagccuccaauuuccuguucugaagagggugccgggaaugcuacauugagcccccgcaugggagaagagugcguguccgucuggucacacgaaggccucgugcugacuaaauuacugaccagugaggagcucgcacuuuguggcagcagacuguugguacuagggucuuuccugcuccuguuuugcggacuucuguguugcguuacagccauguguuuccacccuaggcgggaaucccauuggucacgcacccgauuguga

SEQ ID NO: 63936 - RNA, 483 nt, Artificial Sequence
  derived and/or modified sequence opt3 from TMEM220__Homo_sapiens__NP_001004313
auggcccccgcucuguggagagcaugcaacggccucauggccgcguucuuugcucuugccgcacuggugcaggucaaugacccugaugccgagguuugggugguaguguacaccaucccagcugucuugacauuacugguggggcuaaacccggaaguuacuggaaaugugauuuggaaaagcauauccgcaauccacauucucuucuguacggucugggccgugggucuggcuucuuaucuucugcauaggacccaacagaacaucuugcacgaggaagagggccgggaacucucagggcugguaauuaucacagccuggauaauccugugccauaguagcuccaagaaucccguuggaggccgcauucagcucgcgaucgcaauugugaucacuuuauuuccuuucauaucuugggucuacauuuauaucaacaaggagaugcgaucgucauggccaacccacuguaaaacagugauuuga

SEQ ID NO: 63937 - RNA, 1143 nt, Artificial Sequence
  derived and/or modified sequence opt3 from TMEM229A__Homo_sapiens__NP_001129474
auggccggcagcgacguggauuccgaggggcccgcuagaaggggaggugcagcccggcgcccuggcgcgccagggggaccgggcucugaagcugccgcagguugccccgagccucugucaaccgccgaagcuccagcagagagugccacacuccccgcuuggaugcgacuuuacuucuaugggaugcacggaaucacucuggacgucuugguuagcuccgcccguagauuugcgaggucuccugauuuacggaugcugggcuucucgucaccauaccgcugucuacuccauagccugacgcacuuugcacuugaaaagguguaucugcagcaaagaaggugccccaacgccuucguauuuaauuucuugcucuacccuagugcucaugugggccugcagacccuggccgggcaggcacucuuacugucccuuggagguggcgcuggggucgccguggcgccaggagccuuggaccuggcacuacaguauguucucgcucuguaccacugucaaguguuucuuaaacgguuccugcgcuugcgauauggcagacagaggcggcgucagcagcaacagcagcagcaacagcagcaacagcagcgcagaggugcccucccggugcccccuggggcuagggucccaacagccgcaggagcccggcgacgcagacccaggggcccucggggcgcugggggagcgccaucucagggucugcccgauuuaccgcgcuuucuguucuuuggcaugcauggguuccucgacgagauauuuuucacuuucuuuuucaacguacuuggacaaggcgaugguaccacaagcgggcacaccucccuguggucauuuuucauguacggcaguugcagcuuuguuguggagaaguuguacuuccaccuacauuauucuagaggauggggcacuuggaaaagggucccuauuuacgugaucuuuauuuaugugugggaacuguccugggggcucggacugcguacauguggugcaugcucaugggacuacagccacuauccccuuaauuucaugggccugaucaccuugauguaccucccaggguggauuuuucugagugucuaucaggauuuaaucucuaacguucuguggcgggugcaguacguaccugccaauuga

SEQ ID NO: 63938 - RNA, 1110 nt, Artificial Sequence
  derived and/or modified sequence opt3 from TMEM231__Homo_sapiens__NP_001070884
auggccacccggaggagccagacauggucccccggcucucggucagcuugcgagcgcuguaguuggcgaagcauguccucuucgcugacucguucaagcgcagugacggccagagggagugcgccuaagccaaggugcuccuguugcuggccgcuccggucucgcaccagcagaagguguugguggcccuccggagcuacagucucacuuccucggccacugugccacgaagcaccccgcgcccgaagugccagagcugguuugccuaacagguuaccaacugcacuguucaauagcggcuuuuggcuaaaacggucuuccuacgaggaacaacccaccguucguuuccagcaucaggugcuccugguagcccuucuggggccugagucagacggauuuuuggcuuggagcacauucccagccuuuaaccgccuccagggcgauagacugagggugccgcuggucaguacccgggaagaggaccgaaaucaagaugguaagacugacaugcuccacuucaaauuagagcugccccuucagucuacagaacauguguuggggguucagcugauccuaaccuuuuccuaucgccuccacagaauggcgacgcuggugaugcagagcauggcauuccuucaaucgucuuuuccugucccaggaucccagcuguacgugaacggcgauuugaggcuccagcagaagcaaccccugucauguggcggguuagacgcccgguauaauauuaguguaauaaacggaacuagcccuuucgcuuacgauuaugaccugacccauaucguugccgcauaccaggagcgcaaugugacaacuguccucaacgauccaaaucccauuuggcuuguggguagagcugccgacgcgccguuugugaucaacgccauuaucagguauccugucgaaguuauauccuaccagcccggcuucugggagauggugaaauuugcauggguacaauacgugucuauccuguugauuuuccuaugggucuucgagcguaucaagauuuuuguguuccagaaucagguugugaccacaaucccagucaccgugacgccuagaggggaucugugcaaggaacaccucagcuga

SEQ ID NO: 63939 - RNA, 330 nt, Artificial Sequence
  derived and/or modified sequence opt3 from TMEM233__Homo_sapiens__NP_001130006
augagccaguacgcccccuccccugacuucaagagagcucuggauucuucaccagaggcaaacaccgaagacgauaaaacagaggaagacgugccgaugcccaagaauuaucucuggcuuacuaucgucaguugcuuuuguccugccuacccaauuaacauaguugcgcugguguucagcaucauguccuuaaauucuuauaacgauggcgacuacgagggggcuaggcgguugggacgcaaugccaaauggguagcaauugccucgaucauuaucggucugcuaauaaucggcauuucaugcgcugugcacuuuacgcgaaacgcauga

SEQ ID NO: 63940 - RNA, 1227 nt, Artificial Sequence
  derived and/or modified sequence opt3 from TMEM237__Homo_sapiens__NP_001037850
augagaaccgacagcggcgccaggcuggaggaagggcaccuccggcccccucgcgcuuuaccaccggugcccucccaggaugacaucccucugucucgaccaaagaaaaagaaaccccguacaaagaacacuccugcaucagccaguuuggagggauuagcgcaaacggcugguagaaggccaagcgaaggcaaugagcccuccaccaaagaacugaaggagcauccugaggccccaguccagcggcgccagaagaaaacaagacuaccgcucgaacuggagacuucuucgacccagaagaaaucaagcaguuccucucuucugaggaacgaaaaugggauugaugcagagcccgccgaggaagcuguuauacaaaagccucggcgcaaaacaaagaagacccagccagcagaguugcaguacgccaacgaacucggaguggaggacgaagauaucauuacugacgagcagacaaccguagagcaacagagcguguucacggcucccacuggcaucucccagccugucgguaaaguguuuguugaaaagucacgaagauuccaggccgcggauaggagugagcugauuaaaaccacagaaaauaucgacgugagcauggaugucaagccaucuuggacuacccgggacguggcacugacaguacaccgugccuuucgcaugauaggacucuucucccauggguuuuuagcuggcugcgccguuuggaacaucguggucauuuaugugcuggcaggcgaucaacuuucaaauuugagcaaccugcuacagcaguacaaaacccucgcuuaucccuuccaaagucugcuuuaccuguugcucgcccugucuacgaucuccgcguuugacagaauugauuucgccaagaucagcguggcaauaaggaauuuucuugcucuggacccgacugcccucgcuucguuccuuuauuuuacagcccugauuuugucucuaucccagcagaugaccucagaccggauccaccuguacacuccuaguagcgucaacgggucccucugggaggcaggaauugaggaacagauccugcaacccuggaucguugugaaucuuguaguggcccuguuggucggucucucuuggcuguucuuaagcuaucgaccaggcauggaucugucagaggaacuaauguuuaguuccgagguggaagaguacccugacaaagaaaaggagauuaaggcuagcucuuga

SEQ ID NO: 63941 - RNA, 891 nt, Artificial Sequence
  derived and/or modified sequence opt3 from TMEM241__Homo_sapiens__NP_116322
augugcgugagaaggagccuggucggccucaccuucuguacaugcuaccuugccuccuaucugacuaacaaguacguuuugucuguguuaaaauuuacguaucccacccuguuccagggguggcaaacacuaaucggaggucuccugcuucacguaucauggaagcugggcuggguggagauuaauaguagcucccggucucaugucuugguguggcucccugcuucgguucuguuuguggggauaaucuacgcaggaucacgcgcccugagccgacucgcgauuccagucuucuuaacucugcacaacguggcugaaguaaucauuuguggcuaucagaaaugcuuucagaaggagaaaaccaguccggccaagaucuguuccgcacuuuugcugcuagccgcugcagguugccuccccuucaaugacucucaguuuaacccugauggguacuucugggccauaauccaucugcuuuguguuggagcuuauaagauucugcagaaaagccaaaagccauccgccuugucagacaucgaucagcaguaccucaauuacauuuuuagugugguccuguuagcguucgcaagccaccccacaggcgaccuguuuucugugcucgauuucccuuuucuuuauuucuaccguuuccauggcuccugcugugccucaggguuucugggauucuuuuugauguucagcaccgugaaacuaaagaaccugcucgcuccaggucaaugcgccgcauggaucuuuuucgcuaaaauaauuacugccggccugaguauccuucuguuugacgcgauuuugacaucugccaccacggggugucuccuguuaggagcacugggcgaagcucuacucgucuucuccgagagaaagagcucguga

SEQ ID NO: 63942 - RNA, 387 nt, Artificial Sequence
  derived and/or modified sequence opt3 from TMEM244__Homo_sapiens__NP_001010876
auggcccuccaggugagagucgcucccagcaagguugugcugcaaaaauuccuucugugcguaaucuuguuuuacaccguguauuacgucuccuuaucuaugggcugugugauguucgaaguucacgaacugaacgugcuagcaccuuuugacuucaagacaaauccaucauggcucaacauuaauuauaaaguccugcuugugaguacugagguaacguacuuuguuugcgggcuguucuuugugccggucguggaagagugggugugggauuaugccauaagcgucaccaucuugcauguugcgauuacauccacugugaugcucgaguucccccugaccucucacuggugggcugcccugggaaucucgaagcucuuaguauga

SEQ ID NO: 63943 - RNA, 2640 nt, Artificial Sequence
  derived and/or modified sequence opt3 from TMEM245__Homo_sapiens__NP_114401
auggccgacggcgggggacccaaggaugcuccuagccugagauccucuccagguccggcacccagggugccucgggccgucggcccaucagggggaggcggugagacaccccgcaccgcggcucucgcccuucgauucgacaaaccuaucaagcaggcauuuuacaacacuggggccguucuguucgugugcuuguguugcggagcugcaguauuaguguauuuuauucuggaagccuuccuacguccacuccugugggcuguccuuuguggcacguuucugcaccccuucaaaaguagcuugaccagacucggcaggcauuggcugcaacggcugcaccgcgcccauacaccuauagugcucgcggcauuacugcuuccauugugcuuuguugauuacgggguggaggcccugggagaacaggcucuaagaaggcggcgccuccugcuucuguugggugccggcgggccgcuccuguauggauuauacugucugggcuccuaucucgguguccaggugcuucugguacacgcagcuacuuugaucugccgagggcuagacuacuucucuucgcuguggauuuggacccucguugugggauauguccugacagugucauuuaaguggaaugccagcaccgagagauaccuuagggcggugaguauccccgucuggauuauccuguuguuccaucucgccucccuggcaggcucuuggcggauaccuguguuuuuaguuaucguauuccugaugagcgugggcacucuauacgaaaaacagaacgggaaggaguccucaggagcugagcucccaggucaagucauuaguauggccgcuagcacacuggccaaucuugcaaucucuauuaccggcuaugaauccucaagcgaggaucagcccaguacgcagccugccgaagcuguggaccguggggagucugcgccaacuuuguccaccagccccucgccgucuuccccuucacccacaaguccaagcccuacucugggacgcagaaggcccgagaucggcaccuuucuccggaagaaaaagacauccgauauauacuucguuucucuggugugggcaauugucgugaugcagaucuggcuuaaccuguggauuguacaauugcucccaguucccaucgccguguggauccugaaaaaguuagucauucacuucgguguggucgacuuucuggaaaaacgauaucacguguggugggggauaaucgagagcuuccuaaaggaacgccagggcgcucucgccccuuggccaauuguuggacugggcaaguuucuuuugaaaguggauucaaagcuguggcauuggcucaauaaaaagaugaucauauggcuggagaaaauguuagacaagauuaucaguaucuucauuaucuuucugcuuguaauugggaccuugcuccuggcacuacugcucacggccaaaguccaccaggaauccgugcauaugauagagguuacuagcaaccugaucaaugagacacuugcuaaccacccggaaugggccaauugguugcccgaggcacaggugguccaaagagcgcugaacucugcugccaauaacguguaccaguauggaagggaauggauuacccacaaguuacauaagauccucggugauaaaguaaauaacacugcagugaucgagaagcagguucuggaacuuugggaccggcuguaccacucaugguucgucaaaaaugugacacauaguggccgccacaaggggcaaaaauugcaugugagcagacagaacuccuggcucggagauauucuggacuggcaggacauagucucuuuuguucacgagaacaucgagaccuuccuaucgauucuggaaagccucuggaucgugauguccaggaaugugucacugcuuuuuacgaccguaacaacuuugcugaccauuuuauucuauaguggcacagcccuccugaacuuuguccuuucucugaucauauuccuaacuacccucuuuuaccuguugagcuccucagaugaguacuauaagccugugaaguggguuaucagccugacaccauuaucucagcccgguccuuccaguaauauuaucgggcaaagcguggaagaggcuauucguggcgucuucgacgccucucucaaaauggcaggauucuacggccuguauaccuggcuuacucacacgauguuugggaucaacauaguguucauuccauccgcucuggccgcgaucuugggagccguucccuuucucgguacauacugggcugcagugccggccguacuggaucuauggcugacccagggccuuggguguaaggcuauucuccuguugaucuuccaucuguuaccuacuuauuuugucgacaccgccauauacucagauaucaguggaggcggucacccauaucucacagggcuggcaguggcgggcggagccuacuaccuuggccuggaaggggcuauuaucggacccauuuugcucugcauccugguggucgccagcaauauauauucggcaaugcuaguuuccccuaccaacucugugcccacuccaaaucagacaccuuggcccgcucagccacaacggacguuccgagacauuagcgaggaucugaaaucaaguguaggcuga

SEQ ID NO: 63944 - RNA, 1863 nt, Artificial Sequence
  derived and/or modified sequence opt3 from TMEM259__Homo_sapiens__NP_001028198
augagcgagcacguggaacccgccgcuccuggcccagggccgaacggagguggcgggggacccgccccugcaagaggcccaaggacccccaaucugaacccuaauccacucaucaacguccgggaccgccuuuuccaugcgcuguuuuucaagauggcuguuacauacucccgauuguuucccccugccuuccguagauuauuugaguucuuugugcugcuaaaagcacucuucguacuguuugugcuugccuauauucacauagucuucucuaggucaccaaucaauugccuggaacaugugcgggauaaguggccgcgcgaggguauuuugagaguugaagugaggcacaacaguagccgggcucccgucuuucuccaguucugugacuccgggggacgcggcucuuuuccuggccuggcaguggagccagggucgaaucuggauauggaggacgaagaggaagaggagcucacuauggaaauguucggaaacucaagcaucaaauucgaguuagauauugaacccaagguauuuaaaccuccaaguuccacggaggcccugaaugacucucaagaguuccccuuuccggaaaccccuacaaagguuuggccccaggaugaguacaucguggaauauagccuugaguacgguuucuugcgacugucccaggcuacuagacagaggcuaucaauaccagucaugguggugacccucgacccuacacgggaucaaugcuuuggcgaccguuucagucgccugcuucuggaugaauuuuugggguaugacgauauccucaugagcucugucaagggacuggccgagaacgaagagaauaaaggcuucuuaagaaacguuguguccggugagcauuacagguuuguaucaauguggauggcgcggaccagcuaucuggcagccuucgcuauuauggugaucuuuacucucagugucucuaugcuucugcgauacucccaccaccagauuuucguguuuaucguugacuugcuacagaugcuggaaaugaauauggccauagcauuccccgcugccccacuccugacagugauucuugcgcuggucgggauggaggccaucaugagcgaguucuuuaacgacaccacgacugcauucuacauuaucuugaucguguggcucgcugaucaguaugacgccauuuguugccauaccucgacaucuaagcgccacuggcugagauuuuucuacuuauaucauuuugcuuucuacgccuaucacuacagguuuaauggacaauauuccucacuggcacucguaaccaguuggcuauucauacagcacagcaugaucuacuuuuuccaucacuacgaacugcccgccauucuucagcagguucggauccaagaaauguugcugcaggcuccuccacucggcccgggcacucccacagcgcugccugaugacaugaacaacaauuccggggcaccagccaccgcucccgauucugccggacagccuccagcacuuggucccgugagcccgggcgccucagggaguccuggaccagucgcugccgcacccuccagccugguggcggcugccgcaucugucgccgcugccgcaggcggugacuugggguggauggcugagacggccgcgauaauuacugaugccucauuucucaguggccugagcgcuuccuuacuggagcgcagaccugcaucuccccuaggaccagccggcgggcucccucaugcuccccaagacucggugccaccgagcgauuccgccgcaucagacacaaccccucugggagcggccguugguggccccaguccagcuucuauggcccccacugaagcaccuagcgaggugggguccuga

SEQ ID NO: 63945 - RNA, 969 nt, Artificial Sequence
  derived and/or modified sequence opt3 from TMEM25__Homo_sapiens__NP_001137507
auggcccugcccccuggcccagcugcacucagacacacccuucuguuguuaccggcccugcuaagcuccggguggggagagcucgaaccccagaucgacggucaaacaugggcggagagggcucugcgggaaaacgagcgccaugccuucacuugccgaguggcaggcgggccuggaacgccacgucuugccugguaccuggauggccaguugcaggaggcuucuaccucaagacuccugagugucgguggggaagcauuuagcggaggcacauccacuuucaccguuacagcccacagggcucagcaugagcugaauuguucucuccaagacccccggucgggccgcucagccaacgcgagcgugauuuuaaauguacaguuuaagccugaaauagcacaggugggggccaaauaucaggaggcucaaggaccaggucugcuugucguguuguucgcccugguuagagcaaaucccccugcuaacgugaccuggaucgaucaggacggcccagucacugugaacacaagugauuuucuaguacucgacgcccagaauuacccguggcugaccaaccacacgguucagcuucaacugagguccuuggcgcauaaucucucuguggucgccacuaacgaugugggggugaccagcgcaucccugcccgcuccuggaccaucacggcaccccaguuuaauuagcucugacuccaauaaccugaagcucaauaacguccgccuuccucgagaaaauaugucacugccaagcaacuugcagcuaaacgaucugacacccgacaguagagccguuaaaccggcugauaggcagauggcccaaaauaacucucggccugagcuccuggaccccgagccaggcggucuucugacuucccagggguucauccguuugccugugcucggauauauuuaccgcguaagcucggugucuuccgaugaaaucuggcuguga

SEQ ID NO: 63946 - RNA, 339 nt, Artificial Sequence
  derived and/or modified sequence opt3 from TMEM261__Homo_sapiens__NP_219500
augggcagcagacugucccagcccuucgagucuuacaucaccgccccuccagggacagcugcagccccggcgaagcccgcuccuccagccacucccggagcaccuacgucaccagccgaacacaggcuccuuaaaaccugcuggaguugucgggugcugagcgguuugggcuuaaugggggcuggaggcuaugucuacuggguugcacgcaagcccaugaaaauggguuauccuccauccccguggacaauuacucaaauggugauagggcugucuaucgccaccuggggaauuguagugauggcugaccccaagggcaaagccuaccgagucguguga

SEQ ID NO: 63947 - RNA, 669 nt, Artificial Sequence
  derived and/or modified sequence opt3 from TMEM27__Homo_sapiens__NP_065716
augcuguggcuccuuuucuuucuggugaccgccauccacgcugaguugugccagcccggcgcagaaaacgccuucaaggucagauuaagcauuaggacagcgcugggggacaaggcuuacgccugggauacuaaugaggaauaucuauuuaaagcaaugguugccuucuccaugcggaaagugccuaaccgcgaggcuacggaaauaucucauguacuccuguguaaugugacccaacgagucucauuuugguucgugguuacagacccaaguaagaaccacacucuuccggcaguggagguccagagcgccauccguaugaauaaaaacagaauuaauaacgccuuuuuccugaaugaucagaccuuggaguuucucaagauccccuccacacuggcuccuccaauggaccccucugugccuauuuggaucauaaucuucggaguaaucuuuugcauuauuaucguugcgauagcacugcucauuuuaucggguaucuggcagaggcggcgcaagaacaaagaaccaucagagguggaugacgccgaagauaagugugagaauaugauuaccaucgagaacggcauccccagcgacccucuggauaugaaagggggacauauuaaugacgcuuucaugacugaagaugagagacuuacaccauuguga

SEQ ID NO: 63948 - RNA, 3963 nt, Artificial Sequence
  derived and/or modified sequence opt3 from TMEM2__Homo_sapiens__NP_001129292
auguacgccaccgacagcagaggccacucccccgcuuuccugcagccucaaaacggcaauucuaggcauccaucaggauaugugccggguaaggucguuccccuccggccuccacccccuccaaaaagucaggcaagcgccaaguuuacauccauccgccgagaggaucgugcgacuuucgcuuuuucucccgaggaacagcaggcccaaagagaaucgcagaaacagaagaggcacaaaaacacguucauuugcuuugcaauaaccucauucagcuuuuucaucgcccuugcuauuauccugggcauuaguuccaaguacgcaccugacgagaauuguccagaucagaacccgcgguugcgcaauugggaccccgggcaagauucugccaagcaagugguaaucaaagaaggagacauguuaagacugacaagcgaugcuacugugcauuccauagucauccaggacggcggucuacucguguuuggggauaacaaggacggaucaaggaauauuacccugcggacacacuauauccuuauucaggauggcggcgcccugcauaucggggcggagaaaugccgcuacaagaguaaagcaaccauaacuuuguauggaaagagcgacgagggugaaucuaugccuacauucggcaagaaauuuauugggguugaggccggaggcacccucgaacugcacggugcucgaaaggccuccuggacgcugcucgcaagaacuuuaaacucaagcgggcugccauucggaaguuacaccuuugagaaagauuucucuaggggccuuaaugugcgggucaucgaccaagacacagcuaagauuuuggaguccgaacguuucgauacucacgaguaucgcaacgaaagcagaaggcugcaggaguuucuacgguuccaggaccccggccgaaucguggccaucgcgguaggggauucggccgcaaaaucucuccugcaaggaaccauucagaugauacaggaacgccuugguuccgagcugauccagggcuugggguacagacaggcuugggcccucguuggagugauugacggcgguucaacaaguuguaaugagagcgucaggaacuacgaaaaucauuccucugggggcaaggcucuggcccagcgggaguuuuauaccguggauggacagaaauucagcgugacggcauacucagaauggaucgaggaaacuccucaguuuuuacacaugggcgagauaauugacggggucgauaugcgcgccgagguuggaauccugacaagaaacaucgugauucaaggugaaguagaggacaguugcuaugcugaaaaucagugucaguucuuugauuacgacaccuucggcgggcauaucaugauuaugaagaacuuuacuuccgugcaccucagcuaugucgagcuuaagcacaugggacagcaacagaugggcagguacccagugcauuuccaccugugcggugauguugacuauaaagggggcuaccgucaugcgacauuuguggacggauugucuauacaccauucauucagucgguguaucaccguccacggcacgaacgggcuacugauuaaggauaccaucggauuugacacacucggucacugcuucuuccuggaagauggcaucgagcagcgaaauacucuuuuucauaaccugggguugcucaccaaacccggaacacuguuaccgacugacagaaauaacagcauguguaccacaaugagggauaagguguucggcaauuacauuccuguacccgcaaccgacugcauggccguuuccacuuuuuggauagcucacccaaacaauaaccugaucaauaacgccgcagccgguucucaggaugcugggauuugguaucuauuccauaaagagccuacgggcgaaucgagcggacuccaacugcuugccaagcccgaguugacaccacugggcaucuuuuacaauaaccgcgugcacuccaauuucaaggcagggcucuuuauugacaaaggagucaagaccacuaacucaagugcggcugauccccgggaauaucugugucuugacaauucugccagauucaggccucaccaggaugcaaacccagagaaaccgcgcguggccgcucugaucgaccgauugauagccuuuaagaacaaugauaacggcgcauggguccgggguggggacaucauugugcagaauagcgcuuucgccgacaacggaaucggccucaccuuugcguccgaugguucauuccccagcgacgaggggucuucccaagaaguuagugagagccuguuugugggggaaucucguaauuacggauuccagggcgggcagaacaaauauguaggaacaggcgguauugaucagaagccuagaaccuuaccaaggaaucgcacuuuccccauccggggguuucaaauauacgacggaccuauucaucugacaagauccacguucaagaaauaugucccaacccccgauagguacucaagugccaucggcuuucuaaugaagaacagcuggcagauuacuccgcgaaauaacaucucgcucgugaaauucgguccucacguuucccugaauguguuuuucggcaagccagggcccugguuugaggacugcgaaauggauggagacaaaaacucuauauuccaugauaucgacggcagcgucacaggguacaaggaugcuuaugugggacgcauggacaauuaccuuauucggcacccuucaugcguaaacgugaguaaguggaaugcaguuaucuguuccggcaccuaugcccaggucuacgugcagacauggucuacucaaaacuugagcaugaccauuacgagagaugaguaucccuccaacccaauggugcugagggguaucaaucagaaagcugccuuuccucaguaccagcccgucguuaugcucgagaagggguauaccauacauuggaacggaccagcaccgcguacaacuuuccuguacuuagugaauuuuaacaaaaaugacuggauucgcgugggccugugcuacccuucaaacaccagcuuccaaguaacauucgguuaucuucagcggcagaauggcaguuugucuaagaucgaagaguacgaacccguccacucccucgaggaacugcaaagaaaacagagcgagaggaaguuuuauuucgacucgucaacugggcuacuguuucucuaccugaaagcgaagucucaccgacauggacacaguuauuguuccagccagggcugcgagcgggugaagauccaggccgcuaccgauucuaaagacauuagcaacuguauggccaaggcauacccacaauauuaccgcaaacccuccguugugaagagaaugccugcuaugcuuacgggguugugccagggauguggcacaaggcaggucguguucaccucagauccacauaaaaguuaccugcccguucaguuucaaagcccugacaaggccgaaacucagcggggugauccgucugugaucuccguaaaugggacagacuucaccuuucgaucagcaggagucuuacuccuggugguggauccaugcaguguccccuucagacuuacugagaagaccguuuuuccucuggccgacgugagccgcauugaagaguauuugaaaacaggcauaccacccagguccaucguacuccugucuacgcguggcgaaauuaagcagcuaaacaucucgcaucugcucgugccucuggggcuugcuaaaccggcgcacuuguacgauaagggaagcaccauuuuccuggguuuuucaggcaauuucaaacccuccuggacuaaguuauuuacaaguccagccgggcagggacucggcguccuggagcaauucaucccucuucagcuggacgaguaugguuguccccgggcaaccacagugagaaggcgcgaucuagaacuccugaagcaggcuucuaaagcccacuga

SEQ ID NO: 63949 - RNA, 978 nt, Artificial Sequence
  derived and/or modified sequence opt3 from TMEM30A__Homo_sapiens__NP_001137430
auggccaugaacuacaaugcuaaggacgagguggauggcgggcccccuugcgcaccaggagguaccgccaaaacaagaaggccggacaacacugcguucaagcagcaacggcugcccgcuuggcagccuauccucacggccggcaccguccuuccaauauuuuucauuaucgggcugauuuuuauccccauuggaaucggcauauucguuacaagcaauaacauccgcgaaauugaggguaauguguuuauguauuacggguuguccaacuucuaucagaaucaccgacguuacguaaaaucuagagaugacucacaguuaaacggagauaguagcgcacugcuaaauccuuccaaggaaugugagccauauaggcggaacgaagacaaacccaucgccccuugcggcgcuauugcaaauucuauguuuaacgauacucucgagcuguuccuuaucggcaaugacucguacccaauaccgauugcccugaagaagaaagggaucgcuugguggaccgauaagaacgugaaauuucgcaaucccccuggaggugacaacuuggaggaaagauucaagggcacaaccaaaccagucaacuggcucaagcccguguauaugcuggauucagacccugauaauaacggguuuauuaaugaggacuucaucguuuggaugaggacugccgcgcugccaacauuucggaagcucuaccgcuuaaucgaacgaaaaagcgaccugcaucccacccuuccggcaggaagauacaguuugaacgugacguauaauuacccuguccacuauuucgauggcaggaagcggaugauucuguccacuauaucuuggaugggugggaaaaaccccuuccuaggaaucgccuacauugcugugggcagcaucuccuuucuccugggcguaguucuucuggugauaaaucauaaguaucguaacucaaguaauaccgccgacauuacaaucuga

SEQ ID NO: 63950 - RNA, 1056 nt, Artificial Sequence
  derived and/or modified sequence opt3 from TMEM30B__Homo_sapiens__NP_001017970
augaccuggagcgccacagcuagaggcgcacaccagcccgacaacacugccuucacgcaacagaggcugccugcguggcagccacuccuuuccgcuucuaucgcccugccguuguuuuucugcgcaggguuagccuuuauuggacugggucuaggccucuacuauucaaguaaugggauaaaggagcuggaauacgauuauaccggagaccccggcacagguaacuguagcgugugcgcugcagccgggcagggacgggcucuaccuccacccuguuccugcgccugguacuucucucugccugaguuguuucaaggcccagucuaucucuacuaugaacugacuaauuucuaccagaacaaucgccgauacggcguuucgcgugaugacgcgcagcugucagggcuccccagcgcauuaagacauccugugaacgagugugccccauaucagaggagugcugccggacugccgaucgcacccugcggugcuauugccaauucccuuuuuaacgauucuuucagcuuguggcaccaacggcagccuggcgggccauacguagaagugccccuggaccgcuccggaaucgcgugguggaccgauuaucaugucaaauuuagaaauccuccacuugugaacggcucacucgcccuggcauuccaggguacagcucccccgccuaauuggaggcggcccguuuacgagcuuaguccagacccuaacaauaccggguuuauuaaccaggauuucguggucuggaugcgcacugccgcucugcccacauuucgaaaguuguaugccagaaucaggcaaggaaauuacagcgcaggccucccacggggcgccuaucgugugaacauaaccuacaacuaccccguacgcgcuuucgggggacacaaacuguuaaucuucucuuccauuucauggauggguggcaagaauccuuuucuggggaucgcguaucucguugugggaagccuuuguauucugacgggcuucgucauguuggugguguacaucagauaucaggaccaggaugacgaugacgaggaauga

SEQ ID NO: 63951 - RNA, 573 nt, Artificial Sequence
  derived and/or modified sequence opt3 from TMEM37__Homo_sapiens__NP_899063
augaccgccgugggcguccaggcucaaagaccccuggggcagaggcagccucggcgcagcuucuuugaguccuucauccgaacacucauuauaacuugcguugcacuugccgugguacugucuucagugaguaucugugacggacacugguuguuagcggaagaucgucuguuuggucuauggcauuucugcacgaccacaaaccagacuauuuguuuuagagaccucggccaagcucacgucccagggcuggccgugggaaugggccuuguuaggagcgugggugcacuggccgucguggcugcaaucuucggguuggaguuucucaugguaucccagcugugcgaagauaagcauucucaguguaaauggguuaugggaucgauucugcucuuagugucauucguccugagcaguggcggccuuuugggguuugugauccugcuacggaaucaggugacccucauaggauucacacugauguuuuggugcgaguucaccgccuccuuucuucuguucuugaacgcuaucucuggucuccacauuaauagcaucacucauccgugggaauga

SEQ ID NO: 63952 - RNA, 900 nt, Artificial Sequence
  derived and/or modified sequence opt3 from TMEM38A__Homo_sapiens__NP_076979
auggagcugcucagcgcccuuucccugggcgaauuggcuuuaucuuucucaagagugccccuguuuccugucuucgaccuaaguuacuuuaucguuagcauucucuaucugaaguacgagccaggggcaguggaacuuuccaggcggcacccgauagccucuuggcugugcgcgauguugcauuguuucggaucguauauccucgcugaucugcugcucggugagcccuuaauugacuacuuuucaaacaauagcaguauccugcuugccuccgcaguaugguauuugauuuucuuuugcccucuggaucuauucuacaaaugugugugcuuucucccagucaagcugaucuucguggccaugaaagaaguugugcgcguccgaaagauagcugugggcauccaccaugcacaccaucacuaucaccaugggugguuuguaaugauugccaccggauggguuaaaggcucugguguggcucuuaugagcaacuucgagcagcuguugcguggggucuggaagcccgagacaaaugaaauccuccacauguccuuuccuacuaaggccucacuguacggagcgauuuuauucacgcugcaacagaccagauggcucccagugaguaaagcaagccuuaucuucauauuuacacuguucauggugucuuguaaggucuuuuugacugccacccauucccacucaagccccuucgacgcucuagagggcuacauuugcccuguucuguuuggcagugccugugggggagaucaccaucacgacaaccaugguggcucucacuccgggggaggcccaggugcacagcauagcgcuaugccggccaaaucgaaggaggaacucucugagggguccaggaaaaagaaggcgaaaaaggccgauuga

SEQ ID NO: 63953 - RNA, 876 nt, Artificial Sequence
  derived and/or modified sequence opt3 from TMEM38B__Homo_sapiens__NP_060582
auggacagccccugggaugagcuggcccucgcuuucuccagaaccucuauguuuccuuucuuugacaucgcacacuaccuugugucagucauggccguuaagaggcagccaggcgcggcugcccuggcauggaaaaacccgauuaguagcugguucacagccauguugcauugcuuugggggagguauauuauccugucugcuacucgcugaacccccucugaaguuccuugcaaaucacacuaacauccuguuggccucuucgauuugguauaucacguuuuucugcccacaugaucucgugucacaaggcuacagcuaucugcccguacagcugcucgcuagugggaugaaagaggugacccggacauggaagauugucggaggcgugacucacgccaauuccuacuauaaaaacgguuggaucguuaugauagcgaucgggugggcacgcggagccggcggcaccauuaucacaaauuuugaacgauuagugaagggggacuggaagccugagggagaugaauggcugaaaaugucuuacccagcuaaggucacccuuuuggguagcgugauuuucacuuuucagcauacacagcaccuggccaucuccaaacacaaccuaauguuccucuauaccauauuuauuguagcaacgaagaucacuaugaugaccacacaaacuucaaccaugacauucgcucccuucgaggacacccugaguuggaugcuuuuuggcuggcagcagccuuucagcucuugugagaaaaaguccgaagccaagucaccaagcaaugggguuggaagucuggcgucuaaaccgguggaugucgccuccgacaacgugaagaaaaagcauacgaaaaagaaugaguga

SEQ ID NO: 63954 - RNA, 1467 nt, Artificial Sequence
  derived and/or modified sequence opt3 from TMEM39A__Homo_sapiens__NP_060736
augcccggcgggagaaggggaccuagccggcagcaacugucccgcucugcccucccaucacuucagacccugguggguggcgggugcggaaacggcacagguuugcgaaaucguaacgggagugcuaucggauuaccgguucccccuauuacugcacugauaacgccaggccccgucagacacugucagaucccugaccuaccaguggauggcagccuccuguucgaguuucuuuucuuuauuuaccuguugguagcccucuucauccaguauauuaauaucuacaagaccguguggugguaucccuacaaccauccugcguccugcacaucucugaauuuucaccugauagacuaucaucucgcugccuucaucacugucauguuagcaaggcggcuggugugggcccuuauuucggaagcuaccaaagcaggggccgcuucaaugauccacuacaugguuuugauuagcgcccgccuggugcuacucacacuguguggauggguccuuugcuggacccuggugaacuuguuuagaagucauuccguacucaaucuguuauuccuggguuauccauuuggcguuuacgugccgcucuguugcuuccaccaagauucuagggcgcaccuucuguugacugacuacaacuaugucgugcagcaugaggcaguggaagagagcgccuccacagucgggggacuagcuaagucaaaagauuuucugagucuccugcuugaaagccugaaggagcaguucaauaacgccacccccaucccuacgcacucuuguccauugucccccgaccucauacggaaugagguugaaugccugaaagcagauuuuaaccaucgcauuaaggagguguuauucaauucacuguucagcgcuuacuauguagccuuucuaccucucuguuucgugaagaguacucaguacuaugacaugcgauggucuugcgaacaccugaucauggucuggauuaacgcguuugugaugcuuaccacacaauugcugccauccaaauacugugaucuccugcacaagagcgccgcacaucuuggcaaauggcagaagcuggagcacgguucguauucuaaugcuccccagcauaucugguccgagaacacuaucuggccgcaggggguuuuggugagacacucaaggugccucuaccgggccaugggaccuuacaacgucgcugugcccagugacguaagccaugcccguuucuauuuucuguuccaccgcccauuaagacugcuaaaucuccugauucuuauagaaggcuccguuguguuuuaccaauuguauucucugcucaggagcgagaaauggaaccacacccugucaauggcauuaauccuguucugcaauuacuauguccuuuuuaaguugcuccgggaucgaauugugcugggccgcgccuacaguuauccucuaaacuccuacgaacugaaggcuaauuga

SEQ ID NO: 63955 - RNA, 750 nt, Artificial Sequence
  derived and/or modified sequence opt3 from TMEM40__Homo_sapiens__NP_001271335
auggccgaggcuggcgcagggagccugucccuccccggagguaaggccauggaaaccucugcgucaaguagccagccucaagacaacucccaggugcacagagagacagaagaugucgacuacggcgagacugauuuccauaaacaggacgggaaggcuggacuuuuuagccaggaacaauaugagaggaauaaaucgucaagcaguuccucuagcuccucaaguucuucuuccucaagcaguucuuccagcucgucugaguccaacgaugaagaccagcagccacgggccacgggcaagcaccgccgaucacugggugcaggguacccgcauggaaauggcagucccggcccugggcacggagagccagauguuuugaaagacgaauuacagcuguauggugaugcccccggcgaggugguaccuagcggggaguccggacuacguagaaggggcucugacccagcuagcggugaaguggaggcaucacaacuccggcgccugaacaucaagaaggaugacgaguucuuucauuucguccuucugugcuuugccauuggggcuuugcucguguguuaccacuauuacgccgauugguucaugagucugggaguuggccugcucaccuuugcguccuuagaaacagugggcauauauuucgggcuggucuacagaauccacagcgugcuucagggauuuauucccuuguuccagaaauuuaggcugacugguuuccggaagaccgacuga

SEQ ID NO: 63956 - RNA, 1203 nt, Artificial Sequence
  derived and/or modified sequence opt3 from TMEM43__Homo_sapiens__NP_077310
auggccgcuaacuacagcuccaccucuacaagaagggagcacgugaaggucaaaacuucaagucagcccggcuuccuggaacggcucagcgagacguccgggggaauguuuguuggucuuauggcauuccuguugucuuuuuauuuaaucuucaccaaugaaggccgcgcccugaagacagcgacuucgcuagcugaggggcucucacuggugguaagcccugacaguauucauuccguggccccagaaaacgagggacgacuuguccacauaaucggcgcacugcguaccucuaaauugcucagcgauccgaauuacggugugcaucugcccgccguuaagcugagaaggcacguggagauguaucaaugggucgaaacagaggaaucccgggaguacaccgaggacggacaggugaaaaaggaaacucgcuauucauacaacacagaguggagaagugaaauuaucaauagcaagaacuuugauagggagauugggcauaaaaauccuucugcuauggcaguagaauccuucauggccaccgcuccauuuguucagaucggccgguucuuucucucaagcggcuuaauagacaagguggauaacuucaaaagucugucucuuuccaaguuggaggacccccacgucgauaucauucgccgaggggacuuuuucuaucacagcgagaauccuaaauacccagaagugggagaucugagagugucguuuucuuacgccggucuauccggcgacgaucccgaccucgggccugcgcaugucguuacggugaucgcaaggcagcggggagaucaacugguaccauucucaacuaagaguggcgacacccuucuguugcuccaccauggugacuucagcgccgaggaaguguuucaccgugagcugcgcuccaacucuaugaagacauggggguuaagagcugccggauggauggcaauguucaugggccugaaucucaugacuaggauucuuuauacccuggucgauugguuuccgguguuccgggacuugguuaacaucggccuaaaagccuuugcuuucugcguggcgacaagccugacccuccugacggucgccgcaggguggcuguuuuaccgaccccuuugggcuuugcucauagccggacuggcuuuagugccuauucugguagcccgcacuagaguuccagcaaagaaacuagaauga

SEQ ID NO: 63957 - RNA, 828 nt, Artificial Sequence
  derived and/or modified sequence opt3 from TMEM45A__Homo_sapiens__NP_060474
augggcaacuucagagggcacgcccugcccggaaccuuuuucuuuaucauuggucucugguggugcacaaagagcauacuuaaauacaucuguaagaaacagaagaggacuugcuaucugggcuccaaaacguuguucuaccgguuagagauucuggaagggaucaccauugugggaauggcucuaacaggcauggcuggugagcaauuuaucccugggggaccacaucucaugcuguaugacuacaagcagggccacuggaaucagcuucugggcuggcaucacuucacuauguauuucuucuuuggguugcucggagucgccgauauacuguguuucaccaucucuucacugccgguuagucucacaaaguuaaugcugagcaacgcgcuuuuuguggaagcauucaucuuuuacaaucauacccacggucgcgagauguuggacauuuucguacaccagcugcuagugcucgucguguuccugacuggccuuguugccuuucuggaauuuuuggugcgaaacaauguccuccuggaguuacugcguuccucucucauucuucugcaagggucgugguuuuuccagaucggauuuguguuguaucccccuucaggcgguccagcaugggaucuaauggaccaugagaacauacuguuccucacaauuugcuuuuguuggcacuacgccguaaccaucguuauuguggggaugaauuacgcuuucaucacguggcuggucaaaagcagacuuaagaggcugugcaguuccgaagugggauugcucaaaaacgcagagcgggaacaggagucugaggaagagauguga

SEQ ID NO: 63958 - RNA, 546 nt, Artificial Sequence
  derived and/or modified sequence opt3 from TMEM47__Homo_sapiens__NP_113630
auggccagcgcuggcuccgggauggaggaagugagagucucuguucugaccccucucaaacuugugggacugguaugcaucuucuuggcauuaugucuggaccuaggugccgugcucucacccgcgugggucacagcugaucaccaguacuaucugagucuuugggagagcugcaggaagccagccucccuggacauuuggcauugugaaucuacuuugucgucagauuggcaaauagcaacgcucgcccugcugcucggcggggcugcaaucauuuuaaucgccuuucuggugggacuuauuagcaucugcguuggcagucggcgccgauucuaccguccgguggcugucauguuguuugccgcggugguacugcagguuuguucccuagugcucuaucccauaaaguucaucgagaccgucucucugaaaauuuaccacgaauuuaacugggguuaugggcuugcauggggagccacaaucuucagcuuuggcggcgcuauucuguacugcuugaauccuaagaacuaugaggacuacuacuga

SEQ ID NO: 63959 - RNA, 477 nt, Artificial Sequence
  derived and/or modified sequence opt3 from TMEM50B__Homo_sapiens__NP_006125
auggccggcuuccuggacaacuuuagauggcccgagugcgaauguaucgauuggagcgagaggcggaaugcuguggcauccgucguugccgggauucucuucuuuaccggaugguggauaaugaucgacgcggcugugguauacccuaagccagaacagcuuaaccacgccuuccauacaugcgguguguuuucuacucuggcauucuuuaugauuaaugccgucucaaacgcucaagugcgcggcgauaguuaugagagcggguguuugggacgaacgggcgcacguguuugguuauucaucgguuuuaugcugauguucgggucccuaauugccucuauguggauccucuuuggagcuuacgugacccagaauacagacgucuauccgggccuggccguguucuuucagaacgcgcuuauauucuucucgacucugaucuacaaauuuggcagaaccgaagaguuguggacauga

SEQ ID NO: 63960 - RNA, 774 nt, Artificial Sequence
  derived and/or modified sequence opt3 from TMEM55A__Homo_sapiens__NP_061180
auggccgcugacggcguggaugagagaagcccccugcucuccgcaucucacucagggaacgucaccccuacagccccaccguaccuucaggaaaguagccccagggcggagcugccuccacccuauacugcuaucgccuccccugacgcaucugguauuccaguuauaaauugccgggugugucaaucguugaucaacuuagauggaaagcugcaucagcacguagugaaaugcacggucuguaaugaagccacccccauuaagaacccuccaacaggcaaaaaguacgugcgcugcccguguaauugccuacucaucuguaaagacacuucacgacguauugggugccccagaccuaacuguaggcggaucauaaaucugggaccaguuaugcuuaucagcgaggaacagcccgcucagccugcacugccaauucaacccgagggcacccgcguggucugcggucauugugggaacacauucuuguggauggagcucagauuuaauacccuggccaagugcccgcacugcaagaaaaucaguuccgugggaucugcucugccuaggcggcgcuguugcgccuauauuacuaucggcaugauauguauuuucaucggcguagggcucacaguuggaacccccgauuuugcgcgaagauucagggcaacguacgugagcugggccauugcuuauuuacugggucuuaucugcuugauccgggccuguuacuggggcgcaauucgugucuccuauccagaacauucauuugcuuga

SEQ ID NO: 63961 - RNA, 1464 nt, Artificial Sequence
  derived and/or modified sequence opt3 from TMEM57__Homo_sapiens__XP_011540006
augagacugaggaagcagaaagaggugcaaaaggaaaacgaguucuacaugcagcuccuucagcaggcccugcccccugaacaacagauguugcagaaacaggagaaggaagcugaggaggcagccaaaggcuuaccagacauggauagcuccauccugauucaccauaaugggggaauaccggcgaacaagaagcuaucuaccacacuccccgaaaucgaguaucgggaaaaagguaaggagaaagacaaggaugcuaaaaagcacaaucugggcauuaacaauaacaauauccuucaaccugucgacucaaagauucaggagaucgaauacauggagaaccauauaaauaguaaacgccugaacaaugauuugguugggagcacugaaaaccuccugaaggaggacuccugcacggccucuucgaaaaauuauaagaacgcaucaggagugguaaauagcaguccacgaucccacucugccaccaacggcagcauccccuccucaaguagcaaaaacgaaaagaaacagaaguguacaucuaaguccccuucaacucauaaagaucugauggagaauugcauuccaaacaaucagcucagcaagcccgacgcuuuagugcgucuggagcaagauaucaaaaaguugaaagcagaccuucaggccaguagacaggucgaacaagagcugaggucucagauuuccagccuaucgucuaccgaacgggguauccgcuccgagauggggcagcucagacaggaaaacgagcugcuucaaaauaagcugcacaacgcugugcagaugaagcagaaagauaagcagaauauaucacaauuggagaaaaagcucaaagccgaacaggaggcgaggaguuuuguugaaaagcagcugauggaggaaaagaaacggaagaaauuagaggaggcaacagccgcucgcgccguggcauucgcugccgcgagccgaggagaauguaccgagacucugagaaacaggauucgggaacucgaggccgagggcaagaaacuuacaauggacaugaaggucaaggaagaucagauccgugagcuggaauugaaagugcaagagcuacgcaaguacaaagaaaaugagaaggacaccgagguacugauguccgcacucucugcuaugcaggacaaaacgcagcaccuggaaaacagccuuucagccgagacuagaauuaagcuggauuuguuuagugcucucggcgacgccaaaaggcagcuggaaaucgcacaagggcagaucuuacagaaggaucaagagauuaaggaccugaaacagaagauagccgaaguuauggcugugaugccuuccaucaccuauagcgcggcaacaucuccacuaucaccggucaguccccauuacagcuccaaauucguggagacuucuccuucgggacucgauccaaaugccagcguguaucagccccugaagaaauga

SEQ ID NO: 63962 - RNA, 1332 nt, Artificial Sequence
  derived and/or modified sequence opt3 from TMEM5__Homo_sapiens__NP_055069
augagacugaccaggaagcggcucugcagcuuccuuaucgcccuguacuguuuguuuuccuuauaugcugcauaccacguguucuuuggccgccgacgucaggcccccgcggggucuccuagaggacugaggaaaggugcugccccagcacgggagcgcagaggcagggaacaaucaacacuagagagugaagaguggaacccgugggaaggggacgagaagaaugagcagcagcaucgguucaaaacuagccuccagauucuggauaaguccacgaaaggaaagaccgaccuuucuguccaaauauggggcaaggccgcuaucggucuguauuugugggaacacauuuuugaggggcuccuggaucccucggacguuacagcacaguggcgcgaaggaaaaucaaucgugggccgaacucaguacagcuucauuaccggcccugccguaaucccaggguauuuuaguguggaugucaacaaugugguucugauacucaacggaagagagaaggcuaaaaucuucuacgccacacagugguuacuguaugcgcaaaaucuugugcagauucagaaguugcagcaucuggcagucgugcuacucgguaacgagcacugcgacaaugaauggaucaaccccuuucugaaaaggaauggcggguucguagagcuucuguuuauuaucuacgauuccccuuggauaaacgacguugauguguuccaauggccauugggagucgccaccuaccggaauuuucccgugguggaggcuucuuggagcaugcuccaugacgaacguccuuaucuguguaacuucuuaggcacuauuuacgaaaauuccucacgccaggcccugaugaacauccucaagaaggaugguaaugacaaacuuugcugggucagugcaagagagcacuggcagccacaagagacaaacgaaagccugaagaacuaucaggaugcuuugcuacagucugaccugacccucuguccgguuggggugaauacggagugcuacaggauuuaugaagccuguuccuacggaucaauccccguaguggaggacgucaugacugcgggcaacugcggcaauaccagcgugcaccauggggccccucugcagcuucugaaaaguaugggagcaccauucaucuuuauuaagaacuggaaagaauugcccgcuguucucgagaaggagaaaacaauaauccugcaagaaaagauugagcggcgaaagauguuacugcagugguaucagcacuucaaaacugaacuaaagaugaaauuuaccaauauccucgagucuuccuuccugaugaacaauaagagcuga

SEQ ID NO: 63963 - RNA, 402 nt, Artificial Sequence
  derived and/or modified sequence opt3 from TMEM60__Homo_sapiens__NP_116325
augagaaugagccuggcccagagggugcuccuuaccuggcuguucacauuguuauuucugaucaugcuaguccucaagcuggacgagaaagcucccuggaacugguuccuuauuuuuauaccuguuuggaucuucgauacuauucuguuggugcuccugaucguaaagauggcaggccggugcaaauccggguuugacccacgccacggaucucauaauauuaagaaaaaggccugguaccugaucgcgaugcucuuaaagcuggcuuucugucuugccuugugcgcaaaacuggaacaauuuacgaccaugaaccuaucauauguguucauaccgcucugggcccugcuugcuggugcacugacagaguugggcuacaaugucuuuuucgugcgagauuga

SEQ ID NO: 63964 - RNA, 1932 nt, Artificial Sequence
  derived and/or modified sequence opt3 from TMEM62__Homo_sapiens__NP_079232
auggccgcugugcuggcacucagagucguugccggccuugcggcugccgcacugguggccauguuguuagagcacuacgggcuggcuggacagcccagcccucuaccaaggccggcacccccucggcgcccacaucccgccccugguccaggcgacuccaacaucuucugggggcuccaaauuucugauauacaccugucacgauuucgugaccccggcagagcuguagaucuugaaaaguucugcagugagaccaucgacauuauccagccugcccugguguuggcgacaggagaucucacugacgcaaaaacgaaggaacagcuggguagcaggcagcaugaggucgaauggcaaaccuaucaggggauucugaaaaagacacgggugauggagaaaacuaaguggcucgauaucaagggaaaucacgacgccuuuaacauaccauccuuagauucuaucaaaaauuacuaucgcaaguacucggcuguuagaagggacggcucauuccauuaugugcacagcaccccguuuggcaacuacaguuucauuugugucgaugccacagugaaucccgggccuaaacggccauauaacuuuuucggaauccuggacaagaaaaagauggaggaacuuuugcugcuagcaaaggaguccucucgcagcaaucacaccauuugguuuggucauuucacuacauccaccauccucucacccaguccuggcauacgaagcauuaugucuuccgcuaucgccuaccugugcgggcaccuucauacgcugggaggcuugaugccaguacuccacacuagacacuuucaggguacccuggaauuagagguuggggauuggaaagacaacaggcgguaccguauuuucgcguuugaccaugaucuguucucauucgccgaccucaucuuuggaaaguggcccgugguccuuaucacaaauccgaaaagccuguuguauaguuguggcgagcacgaaccucuagagcgccugcuccauucuacucacauuagagugcuggcauucucccuuagcucgauaaccucugugacagucaagaucgauggcguucaucuggggcaggcugugcacguauccggacccauuuuuguguugaaauggaacccaaggaauuacucaagugguacccacaacaucgaagucauagugcaagacagcgccggccgguccaagucuguucaucacauuuucagcgugcaggagaauaaccaucucucauuugauccucuggcuaguuucaucuuacgaacggaccacuauaucauggcccgcguccuguuugugcuaauuguacucucccagcugacuauccuuauuauauucagauacaggggguaucccgaauugaaagagccaagcggauuuaucaaucugacaucuuucucacuccacguucugaguaagauuaacaucuuuuacuauagcgugcuucuguugacccucuacacuguccugggccccugguucuuuggugagaucauugaugggaaguucggcugcuguuucuccuuuggaauauucgugaacggccauuuucugcaggggucuaucacauucauuaucggaauuuuacaacuagcauuuuucaauaucccucucauggccuacaugugcuggucgcugcuucagcgguguuuuggucacaacuuccgcagccauuugcaccagagaaaauaucugaagauaaugccaguccaucuccugauguuacugcuuuacaucuggcaaguguauuccugcuacuuuuuguaugcuaccuacggcacgcucgcguuccuguuuucaccgcuaaggaccuggcugacacuccugacucccguucuuauucguuauguguggaccuugaauaguacaaaauucgggaucuuuaugguacagcugaagucucacuuaagcuccuga

SEQ ID NO: 63965 - RNA, 2424 nt, Artificial Sequence
  derived and/or modified sequence opt3 from TMEM63A__Homo_sapiens__NP_055513
augauggacagccccuuccuggagcucuggcaguccaaggccgugucuaucagagaacaacuuggccugggggauaggccuaacgacucauacugcuauaauagugcuaaaaacagcaccgucuugcagggaguuacauuugguggcauuccaacuguguuacugauagauguauccuguuuccuauuucucauccugguguucucuauuauccggcgccgauuuugggacuacgggcguauugcacuugucucggaggccgauucagaaagcagauuccagaggcugaguuccacgucuagcuccggacagcaagacuuugagaaugaauugggcugcuguccguggcucaccgcgaucuuccggcugcacgaugaccagauacuggaguggugcggugaggaugcuauccauuaucucucauuucagcgccacauuaucuucuuacuggugguugugaguuuucuuagcuugugugucauucugcccgugaaccuaucuggggaccuccuggauaaggacccuuacuccuucggaagaacaacuaucgccaaucuucagaccgauaacgaccuguuguggcuccauacaauauuugcaguaauuuaucuguucuuaaccguuggcuucaugaggcaccauacucaaucaaucaaauacaaggaagagaaucuggugcggcgcacacucuuuauuaccggccuuccacgagacgccagaaaagaaacggucgagagccacuucagggaugcuuaucccacuugcgaggugguggacguccagcuguguuacaacguugcaaaguugaucuaccuaugcaaggagaaaaagaaaaccgaaaagagucugacauauuacacuaaucuccaggugaaaaccgggcagcggacacugaucaacccuaagccauguggacaauuuugcuguugcgaaguacuugguugcgagugggaagaugccauuucuuauuacacccguaugaaggaccgccuguuggagagaauaacggaggaagagaggcacgugcaggaucagccccucggcauggcuuucgucacuuuucaagaaaaauccauggccacauauauccugaaggacuucaaugcguguaaaugccagagcuuacaguguaagggggagccucagccaucgucucauucccgggaacuguacaccucaaaauggacugugacauuugcagccgauccggaggacauuugcuggaagaaccuaaguauccaaggacuccgaugguggcugcaguggcuuggcauaaauuucaccuuguuucugggucucuucuuucugacgacccccagcauuauccuuuccacaauggauaaauucaacguuacuaagccuauccacgcucugaauaacccaauuaucucucaguuuuuccccaccuugcuccuguggagcuucucagccuuacugccuaguauuguguauuacuccacacuacucgagagccauuggacuaagucuggggaaaaccagauaaugaugaccaaagucuacaucuuucugauuuucauggugcuuaucuugccaucacugggacucacaagucuggacuuuuucuuucgcugguuauucgauaagaccagcuccgaggcaucuaucagacuggaauguguauuucuucccgaccaaggcgcuuucuuuguuaauuaugugauugccucggcguucauaggcaacgggauggaguugcucaggcugccgggacuaauccuguacacuuuucggaugauuauggccaaaacggcagcugaccgcagaaaugucaagcagaaccaggccuuccaguaugaauuuggugcuauguacgccuggaugcucugcguguucacagucaucguggcauauagcauuaccuguccuaucauagcccccuucggccugaucuacauucuuuugaaacacaugguugauaggcacaaucuguauuuuguguacuuaccagcuaagcucgagaaggggauccauuucgcggcaguaaaccaagcccuggcugccccuauucuuugccuguuuugguuguacuucuuuuccuuccuccgucugggaaugaaagcacccgccacucuauuuaccuuccugguccuccugcuuacaaucuuggugugucuggcucauaccugcuuuggcuguuucaagcacuuaucaccacucaauuauaaaacugaggaacccgccagugacaaggguucugaggcagaagcgcacaugccuccaccguuuacacccuacguuccucggauacugaacgggcuugcuagcgagcgaacggcccuguccccacagcagcagcaacagcagaccuauggcgcaauucauaauaucucaggaacuauucccggccaaugccuagcccagagcgcuacagggucuguggccgcagcuccucaggaggccuga

SEQ ID NO: 63966 - RNA, 2745 nt, Artificial Sequence
  derived and/or modified sequence opt3 from TMEM67__Homo_sapiens__NP_001135773
augagccugucccacuggcccuacuucagacucgugcuuaacuuuaggccucaggucaucugccugccacaaccgcccaagguuuugggcuaucgguuagagccuccacaucugacccuagccuguacacucgaagggauguacaauauuauagaggaaauccuggagcgcgacauuaacggaacucuucugucucaggcuacgugcgaauugugugaugguaaugagaacucauucauggugguaaaugcacucggcgaccgaugcgugcguugugagcccaccuuugucaacacaaguagaagcugcgccuguuccgaaccuaauauccugacugggggacugugcuucucuucgaccggcaacuuuccacucaggcggauuucagcggcucgcuauggugagguggggaugagcuuaacaagugaaugguucgccaaauaccugcaguccucugcagccgcuuguuggguuuaugcaaaucuuaccagcugccaggccuugggaaacaugugugugaugaauaugaacuccuacgauuuugcuacuuucgacgccugcggccuguuucaauucaucuuugagaauacagcgggccuaucaaccguccacaguauuagcuucuggagacagaaccuccccuggcuguuuuauggggaucagcuuggacuggcaccucagguguugucuuccacgucacucccaacuaauuucagcuucaagggugagaaccaaaacaccaaacugaaguuuguagccgcuaguuacgacaucaggggcaauuucuuaaaauggcagacacuggaagggggaguucuccagcuuugcccggauacugagacccggcugaacgccgcauacucuuuuggcacaaccuaucagcaaaauugugaaauucccaucuccaagauuuugaucgacuucccuacgccaauauuuuacgauguguaucuagaguacacugacgaaaaccagcaucaguauauucuggcuguccccgugcucaaucugaaccuucaacacaauaagaucuucgugaaccaggauagcaauucggguaaauggcuguugacacgccgaauuuuucucgucgacgccguuucugggagagagaacgaucugggaacccagccuagggugauccggguagcgacucagaucuccuuaucagugcaucuggucccaaauacaauuaacggcaauauauaucccccgcuaaucaccauugccuacagugacaucgacauaaaggaugcaaacagccaauccgugaaaguuucuuucagcgugacguacgagauggaccacggcgaagcucacguccagaccgauauugcccucggggugcugggaggucuugcuguauuggccucacugcucaagacagcaggcuggaaacgucgcaucgggaguccuaugaucgaccugcagacuguugugaaguuucuugucuacuaugccggagaucuggcuaauguguucuuuauuaucaccgucggcacagguuuguacuggcucauuuucuuuaaggcgcagaaauccgugagcguucuguuacccaugccaauacaagaggaaagauucgugacuuauguagggugcgcauucgcccugaaggcucuacaguuucuccauaaacugaucucucagauuaccaucgacgucuucuuuaucgauugggagaggccuaagggcaaagugcuuaaggccguugaaggagagggcggggugcggucagcaacaguccccgugaguauuuggcgaaccuacuucguagccaacgaguggaacgaaauacagacugugcgcaaaaucaauagcuuguuucaaguucugacgguccucuucuuucuggagguggugggauucaagaacuuagcucugauggacuccucuucgagccuuuccagaaauccacccucauauauugccccuuacaguuguaucuugagguaugcagucucugcggcucucuggcuggccauugguaucauacagguuguguuuuucgcaguguuuuacgaacgguucaucgaggauaagauucgccaguuuguagaccuaugcagcauguccaacaucucagucuuccugcucagccacaaauguuucggcuacuauauucaugggagaucugugcacggacacgccgauacaaauauggaagagaugaacaugaaucugaagagggaggcugaaaaccuuugcucccagcguggcuugguuccaaauaccgacggucaaacuuuugagaucgccauaaguaaccagaugcggcagcauuacgaccgaauacacgaaacccugaucaggaaaaaugggccggcaagauuacucucuagcuccgcuucaacauucgagcaaaguauuaaggccuaucauaugaugaacaaauuucugggcagcuucaucgaucacgugcauaaggagauggacuacuuuauaaaggauaaacuucuguuggaacgcauccucggaauggaguucauggaacccauggagaagucgaucuuuuauaaugacgaaggcuacuccuucucuagcguccuguauuacgggaacgaggcgacccuacugauuuuugaucuccuguucuuuugugugguugaccuugccugccagaauuucauuuuggcuucauuccugacuuacuuacagcaggagaucuuucgguauauaagaaacacagugggacagaaaaaccucgcaaguaagacgcugguagaucaaagguuccuuauuuga

SEQ ID NO: 63967 - RNA, 324 nt, Artificial Sequence
  derived and/or modified sequence opt3 from TMEM70__Homo_sapiens__NP_001035703
augcuguuccucgcccuuggcagccccugggcuguggagcugccuuugugcgggagaaggaccgcauuaugugccgcggcugcccugcggggaccacgcgcauccgucucucgagccucaaguagcuccgguccgucuggccccguugcuggguggucgacaggaccuucaggcgcagcccgucuacucagaaggccaggucgggcucagauccccguguacugggaaggguauguacgcuuucugaacacuccuagcgacaagagugaggauggaagacuuauuuacacgggcaauauggccagggcgguguucggcaaauga

SEQ ID NO: 63968 - RNA, 771 nt, Artificial Sequence
  derived and/or modified sequence opt3 from TMEM74B__Homo_sapiens__NP_001291677
augcccccugcccagggcuacgaguucgcugcagccaaggggccaagagacgaacugggaccgagcuuucccauggcguccccuccaggucucgagcuuaaaacccugucuaacggcccccaagcuccuaggcggucagccccauuggggcccguggcaccuacacgcgaaggagucgagaaugccugcuucaguagcgaggaacacgagacucauuuucagaacccaggcaauacgcgauuagguuccucuccgucgcccccugggggaguuucaagccugccacguagucagagagaugaccuaucccuccacucugaagagggccccgcucuggaaccugugagcaggccaguagauuauggcuucguguccgcacuugucuuucuggugucagggaucuugcucguugugaccgccuacgcuauuccccgggaggcccgcgucaacccggacacagugacugcgagagagauggaaaggcuggagauguauuacgcacggcugggaagucaucucgaucgcuguauaaucgccgguuuaggccugcuuaccguagggggaauguugcugagcguucuacucauggugucucugugcaagggcgaacuuuaucgaagaaggacauucgucccugguaaagggucccggaagaccuacggaucaauuaaucugcguaugcgccaguugaacggcgacggcgggcaagcucucguggagaaugaagugguccagguuagcgagacaagucacacucugcagagaucuuga

SEQ ID NO: 63969 - RNA, 1185 nt, Artificial Sequence
  derived and/or modified sequence opt3 from TMEM79__Homo_sapiens__NP_115699
augaccgagcaggaaacacuggcccuccuugaggugaagagaagcgacucccccgaaaaaucuucaccucaagcucuggucccaaacggcaggcagccggagggggaaggaggugcagagagucccggcgccgagagcuugcggguuggguccucugcgggaucgccuacugcuaucgaaggcgccgaggaugguuuagacucaacggugagcgaagcagccacccugccaugggggacaggaccccagccuagugcuccauuccccgauccuccaggcuggcgcgacauugagccggagcccccugaauccgagccacuaacuaagcucgaggaacugcccgaagaugacgcaaaucuucugccugagaaagccgcucgagccuuuguaccaauagauuugcagugcaucgagcgucaaccccaggaagaccucauugugagaugugaggcgggcgaaggggagugcaggaccuucaugccgccucgggucacacaccccgauccaaccgaacgcaagugggcagaggccgugguuagaccucccggauguucuugcgguggcugugggagcugcggagacagggaguggcugcgggcuguggccuccgucggcgcagcucugauccucuuuccauguuuacuguacggugccuaugcguuccuucccuuugaugugccucgcuugccaacuaugucaagucgacugauuuacacacuaagaugcgggguauucgccaccuuuccgaucguucucggaauacugguguauggccuuagccuguuguguuucucugcacucaggcccuuuggcgaaccucggcgugaggucgaaauccaucgcagauacguggcucaguccgugcagcuguucauuuuauacuuuuucaaccuggccguccucucaacguaucuuccacaagacacucugaaauugcuaccccugcucaccgggcuguuugcuguuagcaggcuuaucuauuggcugacauucgccgugggacggaguuuccgagguuuuggcuacggguugacuuuccucccucuguuaucuaugcugauguggaaucuauacuauauguuuguaguggagccagaacgcaugcucaccgcaacagaguccagacuggauuaccccgaccacgccaggagcgcuucggacuaucggccgcgcccuuggggauga

SEQ ID NO: 63970 - RNA, 546 nt, Artificial Sequence
  derived and/or modified sequence opt3 from TMEM87A__Homo_sapiens__NP_001103973
auggccgcugcagccuggcuacaggugcuccccgucauccuucuguuguuaggcgcgcacccuagcccacuguccuucuuuucugcugggccggccaccguugcagccgcugacagaucaaaguggcauauucccauaccuagugguaaaaacuacuucagcuuuggaaagauccuauucaggaauacaacuauuuuucucaaauucgauggcgagccaugcgaccugucccuuaacaucacgugguaucugaagucugcagauuguuacaaugaaauuuauaacuuuaaagccgaggaaguggaguuguaccucgaaaagcugaaggagaaacgggggcugucgggaaaguaucaaaccucaagcaaacucuuccagaauugcagugaguuauuuaagacacagacuuucuccggcgacuuuaugcaccgccugccccuuuugggugaaaaacaggaggcuaaggaaaacgggaccaaucugacauucaucggagauaagaccauacaaaugccuuuucugaaaaagcauuuccucgacuguuga

SEQ ID NO: 63971 - RNA, 480 nt, Artificial Sequence
  derived and/or modified sequence opt3 from TMEM88__Homo_sapiens__NP_981956
auggccgacgugcccggcgcucagagagcagucccuggggauggaccagagccgagggacccccuggauugcugggccugugcgguucucgugaccgcucaaaaccuucugguagccgcauucaauuuguuacugcuagugcucguccuggguacaauccuucugccugccgugacuauguugggcuuuggguuccucugccacagccaguuucugcggucccaggcuccacccuguacggcacaucugcgcgacccuggauucaccgcccucuuaguuacaggcuuucugcuuuuggugccacugcuaguccucgcucuggccucuuaccgacgucuuugccugagauugaggcucgcggauugucuggugcccuauucacgggcauuauaccgcagaaggcgggccccucagccacgccaaauucgagcuaguccggguagccaggccguacccacuuccgggaagguuuggguguga

SEQ ID NO: 63972 - RNA, 480 nt, Artificial Sequence
  derived and/or modified sequence opt3 from TMEM89__Homo_sapiens__NP_001008270
augcugcacgugcucgccagccuuccccuguuguuacugcuagucaccuccgcuucuacacaugcauggucaagaccucucugguaccagguuggccuggaccuucaaccaugggggugccagccgaagaguguggagggauguagggguggccugagcugccccggguauugguugggaccuggcgccucccggaucuacccaguagcggcugugaugauuacuacgaccaugcucaugauaugucgcaaaauccugcagggucgacguagaucucaggccacaaagggggaacacccccaagucacuaccgagccuugcggaccauggaaaaggcgggcacccauuucggaucauacacugcuccgcggcguguuacacaugcuggacgcccuuuugguucauaucgaaggccaccugagacaccuagcuacccagaggcagauucagaucaaggggacuucaacacaaagcggauga

SEQ ID NO: 63973 - RNA, 1419 nt, Artificial Sequence
  derived and/or modified sequence opt3 from TMEM8B__Homo_sapiens__NP_001036055
augaacaugccccagagccugggcaaucaaccucucccaccggagcccccuucccuugggaccccagccgaaggacccgguacaacuucuccuccagagcacugcuggcccgugagaccuacgcugaggaacgaauuggacaccuucucaguccauuuuuacaucuucuuuggcccaaguguugcuuuaccgcccgagcggccugcaguguucgccaugcgccugcuaccaguacucgauagcgggggagugcugucccuugaacugcaguugaaugcgucuucgguccgacaggagaacgugacaguuuuuggcugucucacucacgaggugccccugucacugggugacgcugccgugaccugcagcaaggaaagucucgcaggguucuuacuguccgucucugccacaacccguguagcuagacuuaggauuccuuuuccacagacuggaacaugguucuuggcacugcggagccuauguggcguuggcccccgcuuugugagaugcaggaaugccaccgcugagguccggaugcgcacguuccucuccccguguguggaugacugcgggccuuauggacaauguaaacugcuucgaacucauaacuaccuguaugccgcgugcgaauguaaggcagguuggagaggcugggggugcaccgauucagccgacgcuuugacauacggauuucagcuccugaguacuuuacugcucugucuuagcaaucugauguucuugcccccagugguccuagccauaaggucucgguauguucuggaggcagcuguguacaccuuuacaauguucuucuccaccuuuuaucacgccugcgaucagccuggcaucguaguguucugcauuauggacuacgauguccuccaguuuugugacuuccuggguucacuuaugagcguguggguuacggugaucgcgauggcccgucugcaacccgucgugaaacagguauuguaccuccugggggcaauguuacugaguauggcucuacagcucgaucgccauggacuguggaaccuuuugggcccaucucuguuugcccucggcauucuggcuacugccuggacaguuagauccgugaggcggcgacacugcuaucccccuaccuggcgcagauggcuuuucuaccuguguccagggagcuugaucgcaggaucggccguccuccuguaugcuuuuguggagacuagggacaauuacuucuauauacacucuaucuggcauauguuaauugcggguuccgucggcuuucugcuaccgccccgggcaaagacagaucacggggugccuucaggagcccgcgcuagaggcugcgguuaccagcucuguaucaacgaacaagaggaacuggggcuuguuggcccaggaggcgccaccgugaguagcauuugcgcauccuga

SEQ ID NO: 63974 - RNA, 531 nt, Artificial Sequence
  derived and/or modified sequence opt3 from TMEM95__Homo_sapiens__NP_001307365
auguggagacuggcccucggcgggguguuccuugcugcagcccaggcgugcgucuuuuguaggcugcccgcucacgacuugagcggacgguuagcccgccugugcucccaaauggaggcacgacagaaggaauguggugccucuccugauuucucagcuuuugcacuagacgagguuaguaugaacaaagugaccgaaaagacacaucguguacucagagugauggagaucaaagaagccgucagcucccugccaucuuacuggucguggcuuaggaagacuaaacugccggaguauacgcgggaggcuuugugucccccugccugccgcggcucaaccacacucuacaauugcagcacuuguaaggggaccgaagugaguugcuggccaagaaagagguguuuccccggaucccaggaucugugggaggcgaaaauucugcucuuaucuauauuuggcgcauuccugcuuuuggguguucugagccuacucguggaaucccaccaucugcaggccaagucagggcuuuga

SEQ ID NO: 63975 - RNA, 531 nt, Artificial Sequence
  derived and/or modified sequence opt3 from TMEM97__Homo_sapiens__NP_055388
augggcgcccccgcuaccagaaggugcguggaguggcugcucgggcuuuacuuccugagccacaucccuauuacauuguuuauggacuuacaggcaguccugccacgggaacuauauccgguugaguuccgcaaccuccugaagugguacgccaaagaauuuaaggauccccuucugcaagagccuccagcgugguucaaauccuuuuuguucugugaacucguguuucagcugcccuucuuuccuauagcuacuuaugccuuccugaagggaucuugcaaauggauccgaacgccagcaauuaucuacucaguacauaccaugacaacucucauucccaucuuaaguaccuuucuguucgaggacuuuagcaaggccuccgguuucaagggccagcguccugagacacuucacgaaagauugacccuggugucugucuaugcuccauaccuacucauaccguucauccugcuuauuuuuaugcugaggucgcccuauuacaaauacgaggaaaagcggaaaaagaaauga

SEQ ID NO: 63976 - RNA, 681 nt, Artificial Sequence
  derived and/or modified sequence opt3 from TMEM98__Homo_sapiens__NP_001288675
auggagaccguggucaucguugccauuggcgugcuggcuacaauauuccucgccagcuuugcagcgcuuguacuggugugcagacagagguacugucggccccgcgacuuguuacaacgauaugauuccaagccuaucgucgaccugauuggggcuauggaaacucagucugagccaucagaacuagagcucgaugacgugguuaucacgaacccgcacauugaagccauccuggagaaugaggauuggauagaagacgcaaguggacuuaugagccauugcaucgccauucugaaaaucugucacaccuugacagagaagcucguggcuaugacuauggguuccggcgcaaaaaugaagaccucugccucggucucagauauuaucgugguagcuaaacguauaagccccagaguugacgauguggucaagaguauguacccuccacuggaccccaagcugcucgaugccaggacaaccgcguuacugcuuuccgugucucauuuggugcuggucacucggaacgcaugccaccuaacagggggacucgacuggauugaucagagccuguccgccgcugaggaacaucuugagguucugcgcgaagccgcauuggcuucagagccugacaaaggccucccaggucccgaaggguuccugcaggagcaaagugccaucuga

SEQ ID NO: 63977 - RNA, 3282 nt, Artificial Sequence
  derived and/or modified sequence opt3 from TMF1__Homo_sapiens__NP_009045
augagcugguucaacgccucccagcugucuucauuugcuaagcaagcacucagucaggcccagaaaagcaucgacagagugcuugauauucaggaggaagaacccuccauaugggcggaaaccaucccuuacggcgagccagggauuucuucgccggucucaggagguugggacacaagcacuuggggccugaagaguaauacggaaccccaauccccuccaaucgcuucucccaaagccauuaccaagccuguuaggcggacagugguagaugagagcgagaacuucuuuuccgcauucuugucaccaacugacgugcagaccauccagaaaagucccgucgugagcaagccuccagccaagucucagcgcccggaagaggaaguuaaauccucauuacacgagagccugcauauagggcaaagucgaacacccgagaccacugaaucucaggugaaggauuccagccuaugcgucucgggagagacacucgcugcaggcaccucuuccccuaaaacggaagguaagcacgaggaaacugugaauaaagagucagacaugaagguaccaaccguuagucugaaggugagcgaguccgucaucgaugugaaaacaacuauggaaucuauuagcaacaccucaacacagagucuuaccgccgagacgaaggacaucgcucuggaacccaaagagcagaagcaugaagaucgucaauccaauacuccuagcccacccgugucuacauuuucaagugggaccagcacuacauccgacauugaggucuuggaucacgagucuguuaucucggaaagcuccgccucaaguagacaggagaccacggacucuaaaagcucccuccaucugaugcagaccucauuccaacugcucagcgcgucugcauguccggaauauaacagguuagaugacuuucagaagcugacagaguccugcuguaguagcgacgccuucgaacggauagauucuuuuuccgugcagucacuugacagucgcagcguaucggagauuaauuccgaugacgaguugucuggaaaaggcuacgcucuggugccuaucauugucaacagcucaacucccaagaguaagaccguggaauccgccgagggcaaaucugaagagguuaaugagacacuggugaucccaacugaagaggcagaaauggaggaaagcgggagauccgcuaccccugucaacugcgagcagcccgauauccucgugucaagcacaccaauuaaugagggacaaaccguacuggacaagguugccgaacagugugagcccgcggaaagucagccugaggcccuuucugaaaaagaggaugugugcaagacugucgaguuccugaacgaaaaauuggagaagagggaagcacagcuccuguccuuaagcaaggagaaagcucugcucgaagaggccuuugacaaucuuaaggaugagauguuccgggugaaagaagagucgucaucuauaaguucccugaaggacgaauuuacgcaacgcaucgcugaggccgagaaaaagguccaguuggcauguaaggaacgagaugccgcuaaaaaggagauuaaaaacaucaaggaagaacuagcgacaagacugaauagcucugaaaccgcagaccuccugaaagagaaggacgagcagauaaggggucuuauggaagagggcgaaaagcugagcaaacagcaauugcacaacuccaacauuaucaagaaacuccgggccaaggauaaagagaaugaaaacaugguggcuaagcugaauaaaaagguuaaggaguuagaggaggagcugcagcaccuaaaacaggugcucgacgggaaggaagagguagaaaaacagcaucgugagaacaucaagaaacuaaauucaauggucgagcgccaagaaaaggaucuuggaagacuucagguggacauggaugagcuggaagagaagaacaggaguauucaggccgcacucgacagcgccuauaaagagcugacugaucuucacaaggcuaaugccgcaaaagacucugaagcgcaagaggcugcccugucccgggaaaugaaggcaaaagaggaauugucagccgcucucgagaaggcccaggaggaagcacgacagcagcaagagacccuggcuauccagguuggcgauuuacgccuggcccuacagagaacagaacaggcggccgcuaggaaggaggacuaccuccggcaugaaauuggugagcugcaacagcgccuucaggaggcagaaaacagaaaucaggaguugagucaaagcguguccucuaccacuaggccacugcuccgucagauagaaaaccugcaggccacauuagggucgcaaacgagcucaugggagaaacuggaaaagaaucuuuccgaucgguugggagagagucagacccuccuggcugccgcagucgagcgagaaagagcggccacugaggaacuacuggcuaacaaaauccagaugucuagcauggagucccaaaauucacuccugaggcaggagaacucucgcuuccaggcccagcuugaaagcgagaagaaucgguugugcaaacuggaagacgagaacaacagauaucagguggaauuagagaaucucaaggaugaguacguaaggacacuggaagagacccgcaaggagaaaacacuucugaacagucaauuggagauggaacgaaugaagguggagcaggagcggaaaaaggcaauuuucacucaggaaaccaucaaagagaaggaacguaaaccguuuuccguuagcucuacgcccaccaugucaagauccaguagcaucucgggcgucgacauggcuggccuccagacaucuuuccugucccaagacgagagccacgaucacucauuugggccuaugccaauuagugccaauggaucuaaccuauaugacgcagugaggaugggugccggcuccagcauaaucgaaaaucugcagucacagcucaagcugcgcgagggggagauuacucaucuucaguuggaaaucggaaaccuggagaagacccggaguauuauggcugaagaguuagugaaacucacaaaucaaaacgaugagcuggaagagaaggucaaagaaauccccaaguugagaacucagcugagggaccuagaucagcgauacaauaccauacuccaaauguacggcgagaaagcggaagaggccgaggaacugcgcuuggaccuggaggauguuaagaacauguauaagacgcagaucgacgaauuacuccggcagagccuguccuga

SEQ ID NO: 63978 - RNA, 471 nt, Artificial Sequence
  derived and/or modified sequence opt3 from TMIE__Homo_sapiens__NP_671729
auggccggcuggcccggggcuggaccucugugcgugcucgguggcgcagcccuuggggucugucuggcgggaguugcuggccaguugguggagccaagcaccgccccgcccaagccuaaaccacccccuuuaacaaaggaaacuguaguguucugggacaugagacuguggcacgucguggguaucuuuucccuauucguucucucuauuauaaucacgcugugcuguguguuuaacugcagggucccacggacccgcaaagagauugaagcacgauaccuucaacguaaggccgcuaaaauguauacagauaagcuggagacugugcccccuuugaaugaacucaccgagguaccaggggaggacaagaaaaagaaaaagaaaaagaagaaagauucaguugacacaguggcaaucaaggucgaagaggaugagaaaaacgaagccaagaaaaagaaaggagagaaguga

SEQ ID NO: 63979 - RNA, 849 nt, Artificial Sequence
  derived and/or modified sequence opt3 from TMIGD2__Homo_sapiens__NP_653216
augggcagccccgggauggugcugggacuccuuguccagaucugggcccugcaagaggcuuccucuuugucaguucagcaggguccuaacuuacuacaggugagacaaggcagucaggcaacccugguaugccagguggaccaggccacagcgugggaaaggcuccgggucaaguggacuaaagauggggcuauucugugucaaccauacauaacgaauggaagccuuucccugggcgugugcgguccgcaggggcgcuugucuuggcaggcccccucgcaccucacccugcagcuggacccuguuucacucaaccauagcggagcauauguguguugggccgcugucgagaucccagaauuagaggaagcagagggcaauauuacacgacuguucguggaucccgacgauccuacucaaaaccguaauagaaucgccaguuuuccaggcuuccuuuuuguauugcuggggguuggauccauggguguggcugccauugucuggggcgcgugguucugggggaggcggucuugccagcagcgcgacagcggaaacucccccggcaaugcauuuuacucaaacgugcuauauagaccuaggggugccccaaagaaaagugaggauuguagcggggaaggaaaggaccaacggggccagucuaucuacuccaccucauucccgcagcccgcuccucgccagccacaccucgccagccgacccugcccuaguccaagacccuguccgucuccuaggcccggccauccaguguccaugguccggguuagcccucgucccucgccaacacaacagccccgcccuaaaggguuuccaaaggugggagaggaauga

SEQ ID NO: 63980 - RNA, 537 nt, Artificial Sequence
  derived and/or modified sequence opt3 from TMIGD3__Homo_sapiens__NP_001289609
auggagggcagccccgccgggccuaucgaacagaaggaggcuagaugggaauccucuugggaggaacaaccagacuggacccugggaugccucucaccggagagucacacaaaccauguggcacuuagggauacugguaaucagcugauugucacgaugagcuguuugaccaaagaggacacaggcugguacuggugcgggauacagcgggauuucgcccgcgacgauauggacuuuacugaauuaaucguuaccgaugacaagggaacacuggcgaacgauuucugguccggcaaagaccuaucugguaauaagacccgaucguguaaagcucccaaggugguacguaaggccgauagaucaaggacuagcauucucaucauuugcauccugauaacagggcuuggaaucauuagugugaucucccaccugaccaaacggcgcagaucucagaggaaccggcgcgucggcaauacguugaagccuuuuagccgagugcucacuccaaaagagauggcacccaccgaacaaauguga

SEQ ID NO: 63981 - RNA, 1131 nt, Artificial Sequence
  derived and/or modified sequence opt3 from TMLHE__Homo_sapiens__NP_001171726
augugguaccacagacugagccaucuccacuccaggcuucaggaccuguugaagggcggggugaucuaucccgccuuaccucaaccaaacuucaaaucucugcuaccgcucgcuguccauuggcaccauaccgcaucaaagagucugacaugcgccuggcagcagcacgaggaucacuuugaacuuaaauacgcgaauacuguuaugcgguucgacuauguguggcugcgcgaucauugucgaagcgcuuccugcuacaacucuaagacgcaccagcguucguuggacaccgccucaguagaucucuguauuaaacccaagacaauaagacuggacgagacuacccuguuuuucacauggccugauggacaugugaccaaguaugaccucaauugguuagucaaaaacagcuacgaaggucaaaagcagaaagugauccagccaaggauucuguggaaugcagagaucuaucagcaagcccagguucccaguguggauugccaguccuuucuugaaacuaacgagggcuugaagaaauuccugcagaauuuucuacucuacgggauugcuuucgucgagaacgugccuccaacacaagaacacaccgagaagcuggcagaacggaucucucuuauacgcgagacgaucuacggaagaaugugguauuuuacuagcgacuucuccaggggcgauaccgccuacacaaagcuggcuuuggaccggcacacugauaccacauauuuucaggagcccugugguauucagguauuccauugccucaaacacgaagggaccggaggccgcacgcuguuaguugacggcuuuuacgccgcggagcaagugcugcagaaggcaccugaagaguucgaacuccuuucaaaagucccacugaagcaugaguauaucgaggacgugggggaaugucacaaucauaugauuggaaucgguccgguguugaacauauaccccuggaauaaagagcuauaucugauucgacucuucaaggaaaaacagaacacugucaauagacaguggaacaguagccugcaaugcgauaucccugagaggauucuuacauaccggcacuuuguuucuggcaccuccaucgaacaccgugggucacugaucuga

SEQ ID NO: 63982 - RNA, 1080 nt, Artificial Sequence
  derived and/or modified sequence opt3 from TMOD1__Homo_sapiens__NP_001159588
augagcuacagaagggagcuggaaaaguaucgggaccucgaugaggacgaaauccuuggcgcccugaccgaggaagaguugcgcacauuagagaacgaacuggaugagcuagaccccgauaaugcucuccugccugcagggcuucgacagaaagaccaaacuacgaaggccccaaccggaccguucaaacgugaggaacuguuggaucaccucgagaagcaggcgaaagaauuuaaggacagagaggaucuggugcccuacacaggugaaaagaggggcaaagucuggguuccuaagcagaaaccacuggaccccgugcucgaguccguaacuuuagaaccugagcuggaggaagcucuugccaacgcaucugaugccgaguugugcgacauugcugcaauacuggggaugcauacccuaaugucaaaucagcaauauuaccaggcccucaguagcuccucuaucaugaacaaggaaggacuuaauucggugauuaaaccaacacaguauaagcccgucccugaugaggaaccaaacucaaccgacguggaggagacucuggaacggaucaagaauaacgacccgaaacuggaggaaguuaauuugaacaauauucgcaacauccccauaccuacacucaaggcuuacgccgaggcgcugaaagaaaauagcuaugugaagaaauucaguaucgucggcaccagauccaacgauccaguggcauacgccuuagcugagaugcugaaggagaauaaaguacucaagacgcuuaacguugaaucuaacuuuauuagcggugccgggauccugagguugguggaggcacuacccuacaauacuucccuggucgaaaugaagauugacaaccagucacaaccucucggaaauaaaguggagauggagaucgugaguaugcuggaaaagaacgcuacccuucugaaauucggcuaucacuuuacacagcagggcccacgguugcgcgccagcaaugcgaugaugaacaauaacgaucucguccgaaagagaaggcuggccgacuuaacugggcccauaauuccgaaaugucggucuggaguuuga

SEQ ID NO: 63983 - RNA, 948 nt, Artificial Sequence
  derived and/or modified sequence opt3 from TMOD2__Homo_sapiens__NP_001136357
auggcccugcccuuccagaaggagcucgaaaaauacaagaacaucgacgaggaugaacuucugggcaaauugagcgaggaagaguuaaagcaacuggagaaugugcuagacgaucucgacccugaauccgcuaugcugccagcaggguuuagacagaaagaucagacccagaaggccgcgacaggaccguucgacagggagcaccuucugauguauuuggaaaaggaggcucucgagcaaaaagaucgggaagacuuuguccccuucacuggugagaagaaaggccgcguuuuuauuccuaaggaaaaaccaauagagacgcgaaaggaagagaaggugacccuggaucccgagcuggaagaggcccucgcaucugccucagacacagaauuauacgaucuggcugcaguacuuggggugcauaacuugcugaauaacccuaaauucgacgaggaaacugccaauaacaagggaggcaaagguccaguccguaaugugguuaagggggagaaagugaagcccgucuuugaggaaccuccaaacccgaccaauguggagaucagucuacagcagaugaaagcuaacgaucccagccuccaggaaguaaaucugaacaauauuaaggccuucgcggacaugcuuaagguuaacaaaacacugaccuccuugaauaucgagucuaacuuuauuacuggaacaggcauccucgcacugguggaagccuuaaaggagaacgacacccugacggagauaaaaaucgauaaucaaagacagcagcucggcacugcugucgaaauggagauugcccagaugcuugaagagaacucgaggauccugaaguucggguaucaauuuaccaaacagggaccucggacacgcguggcagcugccauuacuaagaauaacgacuuggugagaaagaaaagggucgaggcggaucggcgcuga

SEQ ID NO: 63984 - RNA, 1059 nt, Artificial Sequence
  derived and/or modified sequence opt3 from TMOD3__Homo_sapiens__NP_055362
auggcccugcccuucagaaaggaccucgagaaauacaaggaucuugacgaagaugagcuguugggcaacuuaagcgaaaccgagcugaaacagcuagaaacagugcucgacgaucuggacccugagaaugcacuucugccagcuggguuuaggcaaaagaaccagacuuccaaaucuacgaccggaccguucgaucgggagcacuugcucucauaucuggaaaaggaggcccuggaacauaaggaccgcgaggauuacguccccuauacaggugagaaaaagggcaaaaucuuuauuccuaagcagaaaccaguucagacuuucaccgaagagaaggugagucucgaccccgaauuagaggaagcgcugacaagcgcuuccgauaccgagcuuugcgacuuggccgcaauacuggggaugcacaaucuaaucacuaacacaaaguuuuguaauauuaugggaucuucgaacggcguagaucaagagcauuucucaaauguggucaaaggugaaaagauccucccuguguuugacgagccacccaacccuaccaauguugaagagagccugaaacgaacgaaggaaaacgacgcccaccuuguggaggucaaucugaacaauauuaaaaacaucccaauaccgacuuugaaggauuucgcuaaagcacucgagaccaauacacaugugaagugcuuuagucuggccgcuacucguuccaacgaccccguagccaccgcguucgcagaaauguuaaagguuaacaaaacacugaagucucucaauguggagagcaacuuuaucaccggggucggcauucuugcccugaucgaugcuuugagagacaaugaaacgcuagccgagcugaaaauugauaaccagaggcagcagcucggaacugcaguggaacuggagauggcuaagaugcuugaggaaaauacaaacauccugaaauucggcuaccaauuuacccagcaggggccucggacucgcgccgcgaaugccauaacaaagaacaaugacuuggugagaaagaggcgggucgagggagaucaccaguga

SEQ ID NO: 63985 - RNA, 1038 nt, Artificial Sequence
  derived and/or modified sequence opt3 from TMOD4__Homo_sapiens__NP_037485
augagcuccuaccagaaggagcuggaaaaauauagagacaucgaugaggacgaaauucucaggacccuuucucccgaggaacuggagcaauuggauugcgaguuacaggaaauggacccugagaacaugcugcuaccagccggccuccggcagcgcgaucagacaaagaaaucaccgacugggccccuggaccgagaagcacuucugcaauacuuggagcagcaggcucucgaggugaaggaacgugaugaccuggucccuuucacgggagagaaaaaggguaagccauauauacagcccaaaagagaaaucccugccgaggaacaaauuacccuggagccagagcucgaagaggcguuagcucacgccacagaugcagaaaugugugacaucgccgcuauucuggauauguacacucuuaugaguaauaagcaguauuacgacgcauugugcagcggcgagaucuguaacaccgaagggauauccucuguugugcagcccgauaaauauaagccuguaccagacgagccgcccaauccuacaaacaucgaggaaauucugaaaagggugcggucgaaugacaaggagcuagaagaggucaaccucaauaacauccaggauauuccaauccccaugcugucagaacuuugcgaggccaugaaggcuaauaccuacgugcgcagcuuuagucugguugccacuagauccggagacccuauagcgaacgcaguggccgauauguugagggagaaucggucucuccaaagccugaacauugaauccaauuucaucucaaguacaggcuuaauggcuguccugaaagccgugcgcgagaacgcaacccucacggaacuucgaguagacaaucagagacaguggccaggugaugcuguugagauggagauggccacugugcuggaacaaugucccagcauugucagguuuggguaccauuucacccagcagggaccgcgggcgcgugccgcacaggcuaugacacgcaacaacgaguugagaaggcaacagaagaaacgguga

SEQ ID NO: 63986 - RNA, 1365 nt, Artificial Sequence
  derived and/or modified sequence opt3 from TMPO__Homo_sapiens__NP_001027454
augcccgaguuccuggaagacccuagcgugcucaccaaggauaaacuuaaguccgagcuggucgccaacaauguuacauugccagcuggcgaacagagaaaagacguguacguacaauuauaucugcagcaccuaacugcaaggaaccggccgccccucccugccgggaccaauucuaagggaccacccgauuuuucaagugacgaggaacgcgagccuacgccagugcuggguagcggcgcggcugccgcagggcgaucccgugccgcugucggaagaaaagcaacaaagaagacugauaaacccaggcaggaggacaaggaugaccuugaugugaccgaacugacaaacgaggacuugcucgaucagcugguuaaauacggcgugaauccugguccaaucgucgggaccacucggaagcuguaugagaaaaagcucuuaaagcugcgcgagcaaggaacagagucuagaucgucaaccccgcuucccacgauuagcaguuccgccgaaaacacuaggcagaauggcucuaacgacagcgaucgguacuccgacaaugaggaagacucaaaaauagaguugaagcuggaaaaacgcgagccucuaaagggccgagcuaaaaccccagugacacucaagcagagaaggguagagcauaaccagaguuauagccaagccgggaucacugaaaccgaguggacaucuggauccucaaaagguggcccccugcaggcgcuuacccgggaaagcacgcgugggagucgcagaacuccuaggaagcggguugagacaucugaacacuuccgaauugauggaccagugaucuccgagagcacccccauugcagagacuaucauggccucgucuaaugaaucccuggucgugaaccgcgugacaggcaauuuuaagcaugcuucaccgauauugccuaucaccgaguucagugacauucccagaagggccccuaaaaagccacucacgcgggcagaagucggugagaaaaccgaagaacgcagaguugagagggauauccugaaggaaauguuucccuacgaggcuagcacaccaacugggauuuccgccucuugccgucggcccaucaaaggagcggccggccgaccuuuagaacugagcgacuucagaauggaggagucauuuaguuccaaguaugugccaaaguacguaccgcucgcagaugugaaaagcgaaaagaccaaaaagggcaggucuauacccgucuggauuaaaauccuucuguucgugguuguggcugucuuuuuguuccuaguguaccaggccauggagacaaaccagguaaauccuuuuucaaacuuccugcacguugacccacgcaagaguaacuga

SEQ ID NO: 63987 - RNA, 1257 nt, Artificial Sequence
  derived and/or modified sequence opt3 from TMPRSS11A__Homo_sapiens__NP_001107859
augauguacagaaccgugggcuucgggacaaggagccggaaccugaagcccuggaugaucgccguccucauuguucuuucccugacugugguagcugugacgauaggauuguuaguccacuuucugguguucgaccagaaaaaggaguauuaccaugguucuuuuaaaauccuagauccucaaauuaauaacaauuucggccagucaaacaccuaucagcucaaggaccugcgcgaaacaacugagaaucuuguugaugaaaucuuuauugacagugcauggaaaaagaacuacaucaagaaucaggugguccgacugaccccagaggaagauggggugaaaguagacguuauaaugguguuccaauuuccgagcacagagcagcgugccgucagagagaagaaaauccaguccauuuugaaccagaagaucaggaaucuccgggcgcugcccauuaacgcuucuucggugcaagugaaugccaugucaagcaguaccggagaacugacuguccaggcauccugcggcaaacgcguugugccucucaacguaaauagaaucgccucuggugugauagcuccaaaggcagccuggcccuggcaggcuagcuuacaguaugauaacauucaccaauguggggccacacugaucuccaauaccuggcuugucacggcggcacauugcuuccagaaguacaaaaacccucaccaguggacugugucauuuggaaccaagauuaacccacccuugaugaaaaggaauguucggcgcuucaucauccaugagaaguaucgaagugccgcuagagaauacgacauugccgugguccaagugagcucuaggguaacauuuuccgaugacauacggcagaucugucugccugaggcaucagcuagcuuccagccaaaccuaacuguucacauuaccggcuuuggcgcccucuacuaugggggagagagucagaaugaucugcgugaagcgcgcgugaaaaucauaucugacgaugucugcaagcaaccccagguguacgguaacgacauuaaaccgggcauguucugugccggguauauggagggaaucuacgacgcaugcagaggcgauuccggugggccucuugucacaagggaccugaaggauaccugguauuugaucggaauugugagcuggggcgacaauuguggccagaaggauaaaccagggguuuacacucaggugacguauuaccggaacuggaucgcuucgaagacaggaauuuga

SEQ ID NO: 63988 - RNA, 1251 nt, Artificial Sequence
  derived and/or modified sequence opt3 from TMPRSS11B__Homo_sapiens__NP_872308
auguacagacacggcaucagcucccagaggucuuggccccuguggaccacaauuuucauauuucucgggguggccgcuauccuuggagucacuauuggucuguugguucauuucuuagcaguggagaagacguauuacuaucaaggcgacuuucacaucucagggguaaccuacaacgauaauugcgaaaacgccgcgagucaggcuagcacaaaucuguccaaagacauugagacuaagaugcuaaacgccuuccaaaauucuucgaucuauaaagaauacgugaagucagaggucauaaaacuccugccuaacgcaaauggaagcaacgugcagcuucagcugaaguuuaaguucccaccggccgaaggcguuaguaugcggaccaaaaucaaggcuaaauugcaucagaugcucaagaauaacauggcauccuggaaugccgugcccgcuucuauuaaacugauggagaucagcaaggccgcguccgagaugcugacaaacaauuguugcggucgccaggucgcaaacucaauuaucaccgggaauaagauagugaacggaaaaaguagccucgaaggcgccuggccuuggcaggcuucuaugcaauggaagggccgacacuauuguggggccuccuuaauuucaagccguuggcugcuuagugcagcucauugcuuugccaaaaagaacaauucuaaagauuggacuguaaacuucggaaucguugugaauaagccauacaugacaagaaaaguccagaacauuaucuuucacgagaauuacuccagccccgguuugcacgacgauaucgcgcuggugcagcuagccgaagaggugucguucaccgaguauauuaggaagauaugucucccugaagcaaagaugaaacugucugagaacgacaaugucguugugacgggcugggggacucuuuacaugaacggauccuuuccaguaauccugcaggaagauuucuugaagauuaucgacaauaaaauaugcaacgcuucauaugccuacaguggcuuugugaccgauacaaugcucugugcugguuucaugagcggggaggccgacgcaugccaaaaugauuccggaggcccccuggccuauccugacucucggaacauuuggcauuuagucggcaucgugagcuggggagaugggugugguaagaaaaauaagccaggcguuuacacucgcgugaccucauauagaaacuggaucacaaguaagaccgggcuguga

SEQ ID NO: 63989 - RNA, 1257 nt, Artificial Sequence
  derived and/or modified sequence opt3 from TMPRSS11D__Homo_sapiens__NP_004253
auguacagacccgccagggugaccagcacaucccgguuccugaacccuuaugucguuugcuuuaucgugguagcuggcguggucauucucgcagugacuauagcccuucugguuuacuucuuggcguuugaccagaagucuuauuucuaccgcucaaguuuucaauuacugaauguggaguauaacagccagcuaaauuccccagcuacgcaggaauaccgaacccucucugggcguaucgagucgcugauuacaaaaacuuucaaggaaucaaaccuuagaaaucaguuuaucagggcccacgucgcaaaacugcggcaagauggaagcggugugcgcgccgacguaguuaugaaguuccaguuuaccagaaacaauaacggcgcuaguaugaaauccaggauugagucuguguugcggcagaugcucaauaacagcgggaaucuggaaaucaacccguccacagagauaaccucacugacugaucaggcagccgcuaauuggcucaucaacgaguguggagccggccccgacuuaauuacacugagugaacaacgcauccuuggugggaccgaggcggaagagggaagcuggccuuggcaggucucuuugcgacugaauaacgcacaucacugcggcggcucccuaauuaacaauauguggauccucacggccgcucauuguuucagaucaaacagcaauccaagggauuggauagccaccagugggauuucuacuacauuucccaagcugcggaugcgugugcgcaacauccuuauucacaauaacuauaaguccgcaacucaugagaaugacaucgcucuggugagauuggaaaacagcgucaccuucacaaaagauauccacucgguuugccucccugccgcgacccagaauauuccacccggaucuacggccuacgugacugguuggggcgcacaggaguacgcugggcacacaguaccugaacugaggcaaggacaggugcggauaaucuccaacgacgucuguaaugccccacauucauauaacggcgcuauuuuaagugguaugcugugcgccggggugccgcagggaggcguugaugcaugucaaggcgacagcgggggaccccucgugcaggaggauucccgacgccuuugguuuaucgucgguauagugucuuggggcgaccagugcgggcugccugauaagccaggaguauacaccagaguuacugccuauuuggacuggauuaggcagcaaacaggcaucuga

SEQ ID NO: 63990 - RNA, 1272 nt, Artificial Sequence
  derived and/or modified sequence opt3 from TMPRSS11E__Homo_sapiens__NP_054777
augauguacagacccgacguggucagggcccggaagcgcguuugcugggagccuugggugaucggccugguaauuuucauaagccucaucgugcuugcugucuguauugggcugaccgugcacuauguucgauacaaccagaaaaagacauauaauuacuauuccacuuugucuuuuacgaccgauaaauuauacgcagaguucggacgugaagccucaaacaauuuuacagaaaugagucaaagacuggagagcauggugaagaacgcguucuauaaauccccacuaagggaagaguuugucaagucucaggugaucaaguucucgcagcagaaacaugguguacucgcucacaugcugcuuauuugccgguuucauucaacugaggacccggaaaccguugauaagaucgugcaacuggucuugcacgagaaacuccaggacgccguggggcccccuaagguggauccacauagcgucaaaauaaagaagaucaauaaaacagaaaccgacaguuaccugaaccacuguugcggcacucgcagauccaagacacugggacagucucucaggauuguuggcgguaccgagguggaggaaggggaguggcccuggcaggccagcuuacaaugggauggaucccaccgguguggcgcaacgcugaucaaugcuacuuggcuuguaucagcagcccauugcuucaccacauacaaaaacccugcucgcuggacugccaguuuuggcgugaccauuaagccaagcaaaaugaagcgaggguugagaaggaucauaguccacgaaaaauauaagcaucccucucacgacuacgauauuucccuggcggagcuaucaagcccugugccauauacaaaugcaguucaccgggugugucucccggacgccaguuacgaguuccagcccggagaugucauguuugugaccgguuucggcgcucugaagaacgacggguauucucagaaucaucuucgucaggcccaaguaacgcugaucgaugcaacuacaugcaacgaaccucaggcuuacaaugacgccauuaccccacgcauguugugugcgggaucccucgagggcaaaacugacgccugccagggugauagcgggggaccccugguuucgucugacgcaagagauaucugguauuuagcuggcaucguguccuggggcgacgaaugugccaagccuaacaaaccaggggucuacacaagggugaccgcucugcgggauuggauuacgucaaagaccggaauauga

SEQ ID NO: 63991 - RNA, 1704 nt, Artificial Sequence
  derived and/or modified sequence opt3 from TMPRSS13__Homo_sapiens__NP_001070731
auggagagagacagccacggcaacgccucccccgcuaggaccccuucugcaggggccucaccagcgcaggcuaguccggccggaacacccccuggucgggcaagcccagcccaggcuucccccgcacaggccucuccugcuggcacuccacccgggcgcgccucgccugcgcaggcaucaccagccggaacgccgcccggccgagcuagcccuggucgugccaguccagcacaggcuucccccgcccaagcgucuccugccagagcaagcccagcucuggccucccucucaaggaguagcucugggcgguccucaagcgcucgcagugccucugugaccacaucccccacuagagucuaccuuguuagggcaaccccggugggagccguaccuauccggagcucgcccgcucgcucugcgccagcaacacgagccaccagagaauccccuggcacuucacugcccaaguucacauggagggagggccagaaacaguugccauuaauugggugcgugcugcuacucauagcucuggucgugagucuuaucauucuguuucaguucuggcaaggacauaccgguauccgguauaaggaacagcgugagagcugucccaaacacgccguucgcugcgauggcguggucgacuguaaguugaaauccgaugaacucgggugcgugagauuugacugggauaagucucugcugaagauuuacagcggaucaagucaucaguggcucccuaucuguuccagcaauuggaacgacucuuauucagagaaaacgugccagcaauuaggcuucgagagugcacacaggacuaccgaaguagcccaucgggauuuugcuaauagcuucuccauacugcgauacaacucuacaauccaggagucgcuucaccgcagcgaauguccaucccagagauauauuucauugcaaugcagucacuguggucugagggccaugacugggcggaucguuggaggcgcacuagcgucugacagcaaguggccguggcaagugucccuccauuuuggcaccacacacauuugcgggggaacccugaucgaugcucaguggguccuuacggccgcacauuguuucuuugugacucgcgagaaagugcuggaggguuggaaggucuacgccggcacaucaaauuugcaccagcuccccgaagcugccagcauagcagagauuaucauuaacucuaauuauaccgacgaagaggaugacuacgauaucgcucugaugagauuauccaaaccucugacucucagugcccacauccauccagcgugccuucccaugcacgggcaaacauucagccugaacgaaaccugcuggauuacgggauuuggcaagaccagggagacagacgacaagacuucuccuuucuugcgugagguucaggugaaucuaauagauuuuaaaaaguguaacgacuaccugguauaugauuccuaccucaccccacggaugaugugcgccggugaccugcgagggggcagagauucaugucagggagacaguggcgggccccuugugugcgaacagaauaacaggugguaucuggcuggagucacaagcugggguacuggcugugggcaacgcaauaaaccgggaguguacaccaagguuacagagguguugccuuggaucuauucgaaaauggaauccgagguccgguucagaaagucuuga

SEQ ID NO: 63992 - RNA, 3060 nt, Artificial Sequence
  derived and/or modified sequence opt3 from TMPRSS15__Homo_sapiens__NP_002763
augggcagcaagagagggaucuccucuaggcaccauucacugaguagcuacgagauuauguucgccgcucucuuugcaauacuugugguccugugcgccggauugaucgcgguuuccuguuuaaccauuaaagaaucucagcggggugcugcccugggccaaucgcacgaggcacgcgccacauucaagaucacuucaggggugacguauaaccccaaucuacaggacaaacucagcguagauuuuaaggugcuggcuuucgaccuucagcagaugauugaugaaaucuuucugaguuccaacuugaaaaaugaguacaagaacucucgaguccuccaauucgaaaauggaagcauaaucgugguuuuugaccuguucuuugcacaguggguguccgaugagaacgucaaggaggaacugauucagggccucgaggccaauaaaucaagucaguuagugaccuuccauaucgaccugaacagcguagauauucuugacaaguugacaacuaccucucaccuggcuacaccugguaauguuuccaucgaaugccuaccagggucaagcccguguaccgaugcccucacuugcauaaaagcggaccuguuuugugauggagaggugaacugccccgacggcagugaugaggacaauaagaugugugcaacagucugcgacggccguuuccuucugaccgggucuuccgggagcuuucaagccacgcauuauccuaaaccaucggaaacuucuguggugugucaguggauuaucagagucaaccaggguuuguccauuaagcucucauucgaugacuucaauaccuacuauacagauauccuggacaucuacgagggcguugggaguagcaagauuuuaagggcuuccauaugggaaacuaaccccggaaccauccggaucuuuucuaaucaggugacagccaccuuccugauugagagcgaugaaucagacuauguaggcuuuaacgcaacguacacugcuuucaacaguuccgagcucaauaacuacgagaaaauaaauugcaacuuugaagaugguuucuguuuuugggugcaagaccuuaaugaugacaacgagugggaacgcauucaggggagcacauucucuccuuuuaccggaccaaauuucgaucacacuuuuggcaacgccucaggcuucuauaucaguacacccaccgggccuggagguagacaggagagggucggccuguugagccuaccacuggacccgacgcucgaacccgcgugccuguccuuuugguaccacauguauggggagaaugugcauaaacuuucuaucaacauuucgaaugaccaaaacauggagaagaccguuuuccagaaggaaggaaauuacggcgauaacuggaauuauggucaggugacacugaacgagacugucaaauucaagguggccuuuaacgcauucaaaaauaagaucuugagcgacauugcucucgaugacauaucccugaccuacgggaucugcaacggcucauuauauccugaaccaacacugguacccacuccuccacccgagcuaccgaccgauuguggaggcccuuuugaacucugggagcccaauacaaccuucaguucuacuaacuuuccaaauagcuacccuaaccuggccuucugcguuuggauucuuaaugcucagaaggggaaaaacauccaauugcacuuucaggaguucgaccuggaaaauaucaacgauguggucgagauucgggacggagaagaggccgauucccuccugcuugcaguguacacgggucccggcccagucaaggacguguuuucaacaaccaaucgcaugacuguucuguugauaaccaacgaugugcucgcccgagggggauucaaagcuaauuuuacaaccggcuaucaucuggguauccccgagccuuguaaggcggaccacuuccagugcaaaaacggggaauguguaccauuagucaaucugugcgauggccaccuacauugugaggacggaagcgacgaagcagauugcgugagauuuuucaacggcacuacaaacaauaacgggcucguuagguuccggauucagucuaucuggcacacggccugugcugagaauuggaccacucaaauuuccaacgacgugugccagcugcuuggauuggguaguggcaauagcucuaagccgaucuuuuccacagaugggggacccuucgucaagcugaacaccgccccugacggccaucucauacugacaccaucacagcaguguuuacaagauagucugauccgucuucagugcaaucacaaaagcugcgguaagaaauuggcagcccaggacauuacucccaagaucgugggaggcucgaacgcuaaagaaggagccuggccuuggguagugggccucuacuaugggggacgccugcuauguggcgcaucccugguuucuagcgauuggcucgucucagcggcucauugcguguacgguagaaaucuggagccaaguaaguggaccgccauucuuggguugcacaugaaguccaaccugacgucuccccagaccgugccgagguuaaucgacgagauagucauuaauccucacuauaaccggcgacgcaaagauaaugacaucgcaaugaugcaucucgaauuuaagguuaacuacacagauuauauucaaccaaucugucugcccgaggaaaaucagguguucccucccggaagaaacugcagcauagccggcugggguacugugguauaccagggcaccacagcuaacauccuucaagaggccgacgucccacuguuguccaaugaaaggugucagcagcagaugccugaguacaacauuacugagaauaugaucugcgcaggguaugaagagggaggcauugauucaugucaaggggacagcggaggcccccucaugugccaggaaaacaaucggugguuucuggcuggugugaccaguuucggguacaaaugugcccuaccaaaccgcccgggaguuuaugcgagagugucuagguuuacggaguggauccaguccuuccugcacuga

SEQ ID NO: 63993 - RNA, 1590 nt, Artificial Sequence
  derived and/or modified sequence opt3 from TMPRSS2__Homo_sapiens__NP_001128571
augcccccugccccaccgggcggggagagcggaugcgaagagagaggugcugcaggccacaucgaacauuccagguaccugucucuccuugacgccguggauaacucaaaaauggcgcugaauagugggucucccccugcuauuggaccauauuacgagaaccacggcuaucagcccgaaaauccuuacccagcccaacccaccgucguuccuacaguguaugagguacauccagcacaguacuauccgucccccgugccucaguacgccccacgggucuugacucaggcuucuaaccccgugguuuguacgcaaccuaaaucgccaucagguaccgugugcacaagcaagacuaaaaaggcauuauguauaacccugacacuagggaccuuccucgucggagccgcucuggccgcgggccuucuguggaaauuuaugggcaguaagugcuccaauucugggaucgagugugacagcuccggaacuugcauuaaccccucaaauuggugugauggugugagucacugcccgggcggggaagacgagaaccgcuguguacgauuguacggaccuaauuucauccuccagguuuauagcucucagcguaaguccuggcaucccgugugccaggaugacuggaacgaaaauuacggcagagcagccuguagggauauggguuauaaaaacaauuuuuacucaagccaagggauugucgacgauaguggaucuacauccuucaugaagcugaacaccagcgcuggcaauguggacaucuauaaaaagcuguaccacucggaugccugcagcuccaaagcaguggucucacuccggugcauagcuuguggcguuaacuuaaacaguagccgccaguccagaaucgugggaggggagucugcccugccaggugcguggccuuggcagguaagccuucacgugcagaauguccaugugugcggcgggucaauuaucacgcccgaguggauuguuacugccgcacacuguguggaaaagccauugaacaaucccuggcauuggaccgcuuuugccggaauccugaggcaaaguuucauguuuuauggcgcugguuaccaggucgagaaggugauaucccacccuaacuacgacagcaaaacaaagaauaacgauauugcccuaaugaaacuccagaagccacugacuuucaaugaccuuguaaaaccgguuugccugcccaacccugggaugauguugcaaccagaacagcucuguuggaucucuggcuggggagcaaccgaggaaaagggcaaaacaucagaggugcugaaugccgcuaaggucuuacugauugagacccagcggugcaacagucgcuauguguacgacaaucucaucacgcccgcgaugaucugugcaggguuucuucagggaaacgucgauagcugccaaggugacuccggcgggccucuggugacuucuaagaauaacauuuggugguugauaggagauacaucguggggcagcgguugugccaaggcuuaucgaccagggguuuacggcaaugugaugguauucaccgacuggaucuauagacagaugagggccgauggauga

SEQ ID NO: 63994 - RNA, 1362 nt, Artificial Sequence
  derived and/or modified sequence opt3 from TMPRSS3__Homo_sapiens__NP_001243246
augggcgagaacgaucccccugccguggaagcuccauucagcuuuagaucccuguucgggcucgacgaccuuaagaucucuccggucgcacccgaugccgacgcgguugcugcccagauucugucauuguuaccucugaaauuuuucccaauaaucgugauuggaaucauugcacuaauccucgcccuggcuauaggucuuggcauccacuuugauugcagugggaaguacaggugucggagcuccuucaaaugcauugagcugaucgcacgcugugacggaguaucugauugcaaggacggcgaagaugaguaucgaugugugcgugucggugggcaaaaugccguguugcagguuuuuaccgcugccucguggaaaacaaugugcucagacgauuggaagggacauuacgcgaacguggcaugugcccagcucggcuuccccagcuaugucaguuccgacaaucugagagugucuagccuggaaggccaguuuagggaggaguucguauccauugaucaccucuuaccugacgacaagguuacugcucugcaucacucaguguacguccgggaagggugcgccaguggacauguggugacgcuucaauguaccgcaugcggucaccgcagaggcuauagcucuaggaucgucgggggaaacauguccuugcugucacaguggccauggcaggcuagccuacaguuucaaggcuaccaccucuguggugggaguguuauaacaccccuguggauuaucacugccgcgcauugcguguaugaucuuuaccugccuaaaucuuggaccauucagguaggauuggugucccuccuggacaauccagccccgagccacuuagucgagaagaucguguaccauucgaaauauaagcccaaacggcugggcaacgauaucgcacucaugaaacuugcuggcccucugacauucaaugaaaugauucagccaguuugcuugcccaacucugaggagaauuuuccugacgggaagguguguuggaccuccggauggggugccacugaagauggcggggacgcuucaccaguccuaaaccacgccgcagugccccugauaaguaauaagaucugcaaccaccgcgauguauacggaggcauuaucagcccguccaugcucugugccgguuaucugacagggggcguugacucuugccagggagauagcggcgggccucuugugugucaagagcgaagacuguggaaguuggucggagcuaccucauucgguauaggcugcgcggaagugaauaaacccggggucuacacgagggugaccaguuuccucgacuggauucaugagcagauggaacgggaucugaagacuuga

SEQ ID NO: 63995 - RNA, 1299 nt, Artificial Sequence
  derived and/or modified sequence opt3 from TMPRSS4__Homo_sapiens__NP_001077416
augcugcaggaccccgauagcgaccaaccucucaacucccuugaugugaagccacugagaaaaccgaggauccccauggagaccuuccggaaggucggcauuccuauaaucauugccuuguuaucucuggcuucaaucauuaucguugugguacuaauaaaagugauccucgacaaguacuauuuucugugcgggcagccacuucacuucauuccccgcaaacagcugugugauggagaauuggacugcccucucggugaggaugaagaacauugugucaagaguuuuccagaaggccccgcaguggccguucgacugagcaaggaccguuccacacuccaggugcuggauucugcgacugggaauugguucucggcuugcuuugacaacuucacggaggccuuagcagagaccgccuguagacaaaugggauacucaagggcugucgaaaucggcccugaucaggaccuggaugugguagagauuacagaaaauagccaggagcuucggaugcgcaacaguuccgguccaugcuugucugggagccugguuucccuacacugucucgcaugcggaaaaucacugaagacuccgagaguggucggcggcgaggaagccaguguggacagcuggcccuggcaagugucuauccaguaugacaaacagcaugucugugggggauccauacuugauccucacuggguucugaccgcugcccauugcuuuaggaagcacacagacguguucaauuggaaaguacgggcggguucagauaaguugggcagcuuuccaagucucgcaguggccaagauuaucauuaucgaguucaaccccauguacccuaaagacaaugauaucgcucugaugaaguuacaguuuccacugaccuucucugggacuguccgccccauuugucucccguuuuucgacgaggagcuuaccccugccacaccccuguggauaaucggauggggcuucacgaaacagaacggugggaagauguccgauauuuugcuacaagcaagcgugcagguuaucgacucgacucgaugcaaugcugaugacgccuaucagggagaagugaccgagaaaaugaugugcgcgggcauaccagagggcggggucgauacaugucaaggagacucugguggcccucugauguaccaguccgaccaguggcacgugguagggauuguuucauggggauauggcugcggugggcccaguacuccaggcguguacaccaaggucagcgccuaccucaacuggaucuauaauguguggaaagcagaacuguga

SEQ ID NO: 63996 - RNA, 2436 nt, Artificial Sequence
  derived and/or modified sequence opt3 from TMPRSS6__Homo_sapiens__NP_705837
augcugcuccuuuuccacagcaagagaaugcccguggccgaggcuccucaggucgcaggcgggcaaggagacgguggcgauggggaagaggccgaaccagagggaauguuuaaagcgugcgaagacuccaagaggaaagcucggggcuaccugcgcuugguuccguuauucgugcugcuagcccuccugguacuugcaucugccggugugcuguugugguauuuucucggguacaaggcugaggucauggugucacagguuuauaguggaagccugcgagugcugaaccgucauuucucccaggaucucaccagaagggagucuucggcauuucggucagaaacagccaaagcucagaagauguuaaaggagcugaucacuagcacgcgccuuggcaccuacuauaauaguuccucugucuacagcuucggcgaagggcccuugacaugcuuuuucugguuuauucugcaaauaccugagcacagaaggcuaaugcucuccccagaggugguacaggcccugcuuguugaagaacuguugucaacugugaacaguagcgcggcaguccccuaucgggccgaauacgagguggacccugaaggacucgugauccuggaggcuucugucaaagauauugccgcauuaaauuccacccuggguuguuaccgcuauucauacguuggccaggggcagguacuccgacuuaagggaccagaccaucuggcuagcaguuguuuguggcaccuacaaggccccaaagaucugaugcucaagcugagacuugaguggacacuggccgaaugcagggaccgguuggcgauguaugauguagccgguccucucgagaaacgucugaucaccucuguguacggguguucccgccaggaaccagucguggagguuuuagcaagcggagcuauuauggccguggucuggaagaagggccugcauucguauuacgacccguucgugcuaucuguacagcccguuguguuucaggcuugcgaagucaaccucacucuggauaauagacuugacucccaaggcguguugucaacaccuuauuucccaaguuacuacagcccccagacccacuguuccuggcaccugacggucccuucucucgauuaugggcuggcccuuugguuugacgcauacgcccugaggcggcagaaauaugacuugccaugcacucaaggacaguggaccauccagaaccgacgccucuguggucugagaauauuacagcccuacgcugagaggaucccggugguugcgacagcaggcauuacuaucaauuucaccagccaaauuucacugacagggccuggagugcggguacauuauggccuauacaaccagagugaucccugcccaggugaguuccucuguuccgucaaugggcugugcgugccugccugcgacggcguuaaggauugucccaacggacuugacgaacgcaauugcguguguagagcuaccuuucagugcaaagaggauagcacguguaucucuuugccaaaggucugcgacggccagcccgauugucugaacgggucagacgaggagcaaugccaggaaggagugccuugugguacuuucacauuucagugcgaggauaggaguugugugaaaaagccaaauccgcagugcgacggccgucccgauugccgggacgggagcgacgaggaacacugugauugcggacuccaaggcccuuccucucgaauaguggguggggccguuucgagcgagggcgaauggccauggcaggcaucccugcaggucagaggaaggcauauuuguggcggggccuuaaucgcugaccgcugggugauuaccgccgcacacugcuuccaggaggauucaauggcgaguacugugcuguggacagucuuucuuggaaaaguuuggcaaaacucucgguggcccggugaggugagcuucaagguguccagauugcuccugcacccuuaucaugaagaggacucacacgauuacgacguagcucuacugcagcucgaucauccagucgugaggagcgccgcaguucgccccgugugucugccggcccgaucucacuuuuucgaaccuggccuucauugcuggaucaccggguggggagcuuugcgggagggcgguccaaucuccaaugcccugcagaaggucgacgugcaauuaauuccccaggaucucuguagugaaguuuaccguuaucaggugacgccuagaaugcugugcgcaggguacaggaaaggcaagaaagacgcuugucagggagauagcggcgggccccuuguaugcaaggcccugucuggacgcugguuuuuggcgggccucgucuccuggggucugggguguggacggccaaacuauuucggcguguacaccagaauaacaggugugaucucauggauucaacaggucguuacuuga

SEQ ID NO: 63997 - RNA, 2154 nt, Artificial Sequence
  derived and/or modified sequence opt3 from TMPRSS7__Homo_sapiens__NP_001036040
auguucagaaucaccaacauugaguuucugcccgaauacaggcagaaggagagccgggaguuccucuccgugucucgcacaguccaacagguuauaaaucuuguguauacuacgucagccuuuaguaaauucuacgaacagagcguaguggcugacgucuccaacaauaagggcgggcuguuggugcacuuuuggaucguuuucgugaugccucgagcaaaaggacauaucuuuugcgaagauugugucgccgcgaucuuaaaggacucuauucagaccucgaucauaaaccguacaucaguggguagccugcaaggccuagcuguagauauggacaguguugugcucaaugauaaagggugcucccaguauuucuacgccgagcaccugucucuucauuauccacuggagaucagcgcagccuccggaagauugaugugucacuuuaagcucgucgcuauugugggcuaccugaucaggcugucaauuaagaguauccagauagaagcagacaacugcgugacugauagccucaccauuuaugacucuuuacugccgauccgguccucaauucuuuaccgcaucugugagcccacaagaaccuugaugagcuucgucaguacuaauaaccugaugcuaguuacauuuaaaucuccucauaucaggcggcucuccgguauucgcgccuacuucgaagugauaccagagcagaagugcgagaauaccguacuggugaaagauaucacgggguuugaaggaaagauuagcucgcccuauuacccuucuuauuacccacccaaauguaagugcacuuggaaguuccaaaccucccuuucaacacugggcaucgcuuugaaauucuauaacuacaguauaacuaagaaaagcaugaagggcugugagcacggguggugggaaauuaaugagcacauguauugcggauccuacauggaccaucagaccaucuuucgagucccuucuccacucgugcacauccagcugcaguguagcucaagauuaagugauaaaccgcugcucgccgaauacgguuccuauaacauuagccaacccugcccuguuggcucuuucaggugcucaagugggcuuugugugccacaggcgcagcggugcgacggagucaaugauuguuuugacgagagcgacgagcuguucugcgugucuccccaaccugcauguaacacauccucguuucgucagcauggcccauugaucugcgaugguuuccgcgacugugaaaaugggagagaugagcagaacugcacccagagcauucccuguaacaauaggacguuuaagugcggaaacgacauauguuuccggaaacaaaaugccaagugcgauggcacuguagacugcccggauggcuccgacgaagagggguguacaugcucacgaaguucuagcgcucuacaccgcaucauuggagguaccgauacucuggaaggcggguggccuuggcagguuucccuccacuuugugggaucagccuacuguggcgcaagcgucaucucuagagaguggcugcuuuccgcugcccauugcuuccacgguaacaggcugagugaccccacaccauggaccgcgcauuuggggauguaugugcagggcaaugccaaguuugucagcccugugcggcgcaucguugugcacgaguacuauaacucucagacguucgauuacgacauugcacuccugcaauuauccauagcuuggcccgaaacccugaaacagcuaauccagccaauuuguauucccccuacaggacagagaguaaggucaggcgagaagugcugggucacuggguggggacgucggcaugaagccgacaauaaagguagucucgugcugcaacaggcugagguugaacuuauugaucagaccuugugugugagcacauauggcaucauaacuucgcgaaugcugugcgccgggaucauguccggaaagagagacgcauguaaaggcgauucuggugggccacucagcugcaggcgcaagucagacggcaaguggauucugaccggaaucgucaguuggggccacggguccggacggccgaacuuucccgguguguacacaagaguaucuaauuucgugccuuggauucacaaauacguuccaagccuucuguga

SEQ ID NO: 63998 - RNA, 3180 nt, Artificial Sequence
  derived and/or modified sequence opt3 from TMPRSS9__Homo_sapiens__NP_892018
auggagcccaccguggccgacguccaccugguuccuagaacaacuaaggaagugccagcucucgaugcagccugcuguagggcggcuagcaucggcguaguggccacgucccuugucgugcugaccuuggggguuuuacuggcauuccuaucuacacagggauuucauguggaccacacugccgagcuccgggguauucgcuggaccucaagucugcgacgugaaacaagcgauuaccauagaacccuuacuccgacacuggaggcuuugcuccacuuccugcugaggccccuccaaaccuuaucccugggccuugaagaggaguugcugcagcgggggauacgcgcaagacuaagggaacauggaaucucucucgccgcuuauggcacgauugucucggccgagcugacuggucggcacaaagggccucuugcggaacgcgacuuuaagucaggacgaugcccaggcaacagcuucaguuguggcaauucccagugcgugaccaaaguaaaccccgagugugaugaccaggaggauugcucugacgggagcgaugaagcacacugugagugcggacugcaaccugccuggagaauggcugguaggaucguuggcgggauggaagccuccccaggagaguuucccuggcaggcaucauugcgggaaaauaaggagcauuucuguggcgcugccauuaucaacgcgcguuggcucgugagugccgcacacugcuuuaaugaguuccaggacccuacaaaaugggucgcuuacgugggugccacuuaucugagcgggucugaagcauccaccgugcgcgcccaggucguucaaauagugaagcauccauuauacaacgcagauacagccgacuuugauguagcugugcuggagcucaccucaccgcuucccuucggaagacacauccagccugucugucugccagcggcaacgcacauuuuucccccuagcaagaaaugcuugaucaguggcuggggcuaucuaaaggaagacuuccuggugaaaccagagguucuccagaaggccacuguggaacugcuugaccaggcucugugcgccucuuuguacgggcauucccucacagauaggauggucugugcaggauaucuggacgguaaaguggauagcugccaaggcgacucugggggacccuuaguaugugaggagccgucgggccgguuuuuccuggccgguauuguuuccugggggaucggcugcgcugaagcccgacgcccuggaguguacgcaagagucaccaggcuacgggauuggauacucgaggcgacuacaaaggcuucaaugccccuggccccaaccauggcuccugcccccgcugccccaaguacggcauggcccaccagcccugaauccccaguggucucuacaccgacuaagagcaugcaggcucuuucaaccgugcccuuggacuggguuacagugccuaaacugcaggaguguggcgcccgcccagcgauggaaaagcccacuagaguagucgggggauucggugccgcuaguggcgaggugccuuggcaaguuucccucaaagaggggagcaggcacuuuugcggagcaaccguggucggcgaucguuggcugcuuucugccgcucauuguuucaaucacacaaagguggaacagguacgggcccaucuggguaccgcaucauugcucgggcugggcggaaguccagugaaaauuggcuuacgaagaguuguccugcacccccuauacaacccggggauccucgacuuugaucuggcggugcuugaguuggccagcccucuggcuuucaauaaguauauucagccagugugccucccccuggccauccagaaauuuccugucggaaggaaguguaugaucuccgguuggggcaacacucaagaagggaaugcaacgaagcccgaguuacugcagaaggcuucuguuggaauuauagaccagaaaacaugcucggugcuuuacaacuucagcuugaccgaucgcaugaucugugccggcuuucucgaggguaaaguggacuccugccagggggacucaggcggaccacuggcaugcgaagaggccccuggcguauucuaucuagcugggauugucaguuggggaaucggcugugcgcaagugaagaaacccgguguuuacacucggauaaccagacugaagggguggauucucgaaaucaugucuagccagccacugccgauguccccucccucaacaaccaggaugcuugccacuacaagcccacgcacgaccgcaggauugacugugcccggcgcuacaccuucucgaccaacccccggugccgccucccgggucacaggccagccugcuaauaguacucugagcgcagugucuaccacggcccgugggcagaccccguuuccagaugcgcccgaggcuacaacucacacccaauuaccugacugcggacucgccccagcagcccugacaagaaucguuggcggguccgcugcaggaaggggcgaauggcccuggcaagugucacuuuggcugcgccggagagagcauagguguggugccguauuggucgcggagcgauggcuccugagugcugcccacugcuucgauguguauggggacccuaagcagugggcagccuuucuaggaacuccguuccugagcggcgcugaaggucagcucgagcgcguggcccggauuuacaaacaucccuuuuauaaccuguacacccuugauuacgacgucgcauugcuggaauuagcuggcccaguuagaaggucgcgucucgugcgcccuaucugucugcccgagccagccccucggcccccagaugggacgagaugcguaauuacaggauggggcuccgugagggaagggggaucuauggcgcgacagcuucagaaggccgcaguccggcugcuaagcgagcagaccugucgcagauucuauccggugcaaauaucaaguaggaugcucugcgcuggcuucccucagggugggguugacuccuguucuggagaugccggcgguccccuggcuugccgggagccaagcggccgauggguguugacuggggucacauccuggggauacggcugugggagaccccacuuuccuggaguguauacccgcguugcagccgugaggggcuggaucggucagcacauucaggaauga

SEQ ID NO: 63999 - RNA, 135 nt, Artificial Sequence
  derived and/or modified sequence opt3 from TMSB10__Homo_sapiens__NP_066926
auggccgacaagcccgauaugggcgagaucgcuagcuucgacaaagcaaagcugaaaaagaccgaaacacaggagaaaaacacucucccuacgaaggaaaccauugagcaagaaaagagauccgagauaucuuga

SEQ ID NO: 64000 - RNA, 138 nt, Artificial Sequence
  derived and/or modified sequence opt3 from TMSB15B__Homo_sapiens__NP_919305
augagcgacaagcccgaucuguccgagguggaaaaauucgacagaucuaagcucaaaaagaccaacacagaggagaaaaauacucuuccuucaaaggaaacgauccagcaagaaaaggagugcguccagaccaguuga

SEQ ID NO: 64001 - RNA, 135 nt, Artificial Sequence
  derived and/or modified sequence opt3 from TMSB4X__Homo_sapiens__NP_066932
augagcgacaagcccgauauggccgagaucgaaaaauucgacaaguccaaacugaagaaaaccgagacacaggaaaagaacccucucccaucuaaggagacuauugaacaagagaaacaggcuggcgagucauga

SEQ ID NO: 64002 - RNA, 2649 nt, Artificial Sequence
  derived and/or modified sequence opt3 from TMTC1__Homo_sapiens__NP_001180380
augguggucaccacaagcgccagaggcgggggaggugacaggacucccucccggcgccgaggcugcgggcuggcuccugcaggagccgcggcucuccuugccggcgcaucuugucugugcuacggucguucauugcagggggaguucguucacgaugacgugugggccaucguaaacaauccagaugugagaccgggagcucccuuaagguggggcauuuuuacgaacgacuucuggggcaaggggauggcagaaaauaccagucauaaaagcuaucggccucuguguguccuaacauuuaagcucaacauauuccugacuggaaugaauccauuuuacuuccacgccgugaacaucauucuucauugccugguuaccuuggugcucauguauacaugugauaaaaccgucuuuaagaaucgcggucuggcuuucgugacugcccugcucuuugcgguacaccccauccauacagaggcaguugccggcauuguggggagagcugacgucuuagccugccugcuuuucuugcuggcauuucuauccuacaacaggucucucgaucaaggaugugugggcgguucguucccuucaaccgugagcccauuuuuccugcuucugaguuuguuccucgggacgugcgcuaugcuggucaaagaaacuggaaucaccguuuuuggcguguguuuaguauaugaccuguucucccucucuaauaagcaggauaagagcuccaacggcgcccuuugcccccggucaccucagcagccagggaguccgcaacccagcucucugccuggacacccacaccgcgagaaugguaaacagcagcgauuuccccauaagggcgcguggggagggugucacuccccuuugccacccgaaccgaaaucaagcggcuucccugugagucccagagccgucuggucuaugaugagguuucuaacauacuccuaucugcucgcauucaacguguggcugcuucuggcuccaguuacuuugugcuacgacuggcaaguggguagcauaccucucgucgagaccaucugggauaugcggaaucuggccacaaucuuuuuagcugugguaauggcccugcuaucgcuccauugccuggcagccuucaagcgucuugagcacaaagaaguuuugguggggcugcucuuucuggucuuccccuuuauuccagcuucuaaccuuuucuuucgcgugggcuucgucguggcggagagaguucuguacaugcccuccaugggauauuguauuuuguucgugcacggccucucaaagcugugcaccugguuaaauagguguggggcaacgacucugaucguaaguacaguccuacuccugcuuuuguuuagcuggaagaccgugaaacaaaacgaaauauggcugucccgggagucucucuuccgaagcggaguucagacucugccucauaacgccaaggugcacuacaauuaugcuaacuuuuuaaaagaccagggucgcaauaaggaggccauuuaccauuauagaacagcacugaaacuuuacccaaggcacgccucagcuuugaacaaucucggcacccugacgcgggauaccgccgaagcaaagauguauuaccagcgcgcgcuacaacugcauccgcagcacaacagagcucucuucaaucuggggaaccuuuugaaaagucaggagaagaaggaagaggccaucacacuguuaaaagacuccauuaaguacggacccgaauuugcagacgccuauagcucucucgcuucacugcuugccgagcaagagagguucaaagaagcagaggaaaucuaccagacuggcaucaagaauugcccugauaguagcgaccugcacaacaauuauggugucuuuuugguggauaccgggcucccagagaaagcuguagcccauuaccagcaggcgauuaagcugucccccucucaccauguggccaugguuaaccuaggccgucuguaucggucgcucggagaaaauagcauggcugaggagugguacaagcgagcacugcaagucgcccacaaagcugaaauacuuuccccuuugggcgcccuguauuacaacacagggagauacgaggaagcauuacagaucuaucaggaggcggccgcucuccagccaucacaaagggaacugcgccuugcccuggcacaggugcuagcugugaugggacagacuaaggaggccgagaaaaugaccaaucacauugucagugaagagacagguugucucgaaugcuaccggcuguugucugcaaucuauagcaagcaggagaaccaugacaaagcccuggaugcuauagacaaggcguuacaacucaagcccaaagauccgaagguuauuuccgagcuguucuuuaccaaaggcaaccagcuuagagaacagaaucuguuggacaaggccuucgagucauacaggguggcagugcagcucaacccugaucaagcucaggccuggaugaauaugggagggauccagcacaucaaaggcaaguauguaagcgcccgcgcuuacuaugaacgagcacugcagcuagucccagacucuaagcugcuuaaagagaaccucgccaagcuggaucgguuggaaaaacgucugcaggaggugagagagaaggaccagacuuga

SEQ ID NO: 64003 - RNA, 2511 nt, Artificial Sequence
  derived and/or modified sequence opt3 from TMTC2__Homo_sapiens__NP_689801
augaucgccgagcuggugagcuccgcucucggccuugcacuguacuugaacaccuuaucugccgacuucugcuaugaugacucaagagcgauuaagacaaaucaggaucugcuacccgaaacuccuuggacgcacauauuuuacaacgacuucugggggacccuccugacacauaguggaagccacaaauccuauaggccacuuuguacucugucuuuucgguugaaucaugcuaucgguggccucaacccguggucguaccaccuggucaauguucugcuccaugccgcagugaccggguuauucacaucauuuagcaagauucugcuuggagauggcuauuggaccuucauggccgguuugauguuugcuagucaccccauccacacugaggcaguagccgggauugugggacgcgcugacgucggcgccucccuguucuuucuacucucucugcuuugcuacaucaaacauuguagcacacgaggcuauuccgcgcguaccugggggugguuccugggaucagguuugugcgcaggcuguaguaugcucuggaaggaacaaggggugacgguucuggccgugagcgcugucuacgauguguuuguauuccacagauuaaaaauaaagcagauccugccuacuauuuacaagaggaaaaaccucucucuuuuucuguccaucucauugcuaauuuucuggggaagcagucugcucggcgcccggcuguauuggauggguaauaagccacccucuuucuccaacagcgacaauccugcagcugauucggacucucuucugacccgcacauugacuuucuucuaccucccaaccaaaaaccugugguuacugcuaugccccgauacacucuccuuugacuggucaauggaugccguuccucugcuuaagaccgugugugacuggagaaauuugcauacggucgcguucuauacugggcugcuccugcuugccuacuauggacugaaaaguccaagcguggacagggagugcaacggcaagacagugaccaauggcaagcagaacgcaaaugggcacuccuguuugucugaugucgaauaccagaacagcgagacuaaaucaaguuuugcuuccaagguugagaacggaaucaaaaaugacgugagccaacggacacagcucccgucuaccgaaaacauaguagugcugucauuaagucugcuaauuauccccuucgucccugccacgaaucucuuuuucuauguggguuuuguuauugcugagcgcgugcuguacaucccaagcaugggcuucugccuuuugaucaccgucggggcccgagcacuguacgugaagguacagaaaagauuucucaagucccugauuuucuaugccacagcuacuuuaauaguguuuuacggacugaaaaccgcgaucaggaacggcgauuggcagaaugaagagaugcuuuaucggucugguauuaagguuaaccccgcaaaggccugggggaauuugggcaacguccucaaaucgcaaagcaagaucuccgaggcugaaucagccuaccguaaugcacuguauuaccgcaguaacauggccgacaugcuauauaaucugggacuccugcuucaggagaacucuagauucgcugaagccuugcacuacuacaaacuggcaauaggcagcaggccuacauuagcguccgcuuaucucaauacugggauuauccugaugaaccagggacggaccgaggaagcccgacgcacauuccuuaaguguucagagaucccagaugagaaucugaaagacccccaugcacacaagagcucugugaccuccugcuuguacaaccucgguaagcuguaucaugaacagggccacuacgaggaagcccuaagugucuauaaagaggcuauucaaaagaugccgagacaguuugccccucagagccuguacaacaugaugggggaagcauauaugaggcucucuaaacugcccgaggcugagcauugguacauggaaucccuucggucaaagacugaucacaucccagcccacuugacguacggaaaacuguuagcgcucacaggccgcaagagugaggccgaaaagcuguuccuuaaagcuauugagcuggacccuaccaaggguaauugcuauaugcauuacgggcaauuucuacucgaagaggcaagacugauagaggccgcugaaauggccaaaaaggcagcggaguuggauagcacugaauuugacgugguuuuuaacgccgcucacaugcugaggcaggccucguuaaaugaggcagcugagaaauauuacgaucucgccgcacgucugcggcccaacuauccagccgcucuuaugaaucugggcgcgaucuugcaucucaacggacgacugcagaaggccgaagcaaauuaccuaagagcucugcagcuuaagcccgacgacgugauuacccaauccaaccucaggaaacuguggaauaucauggagaagcagggcuugaaaacaucuaagaccuga

SEQ ID NO: 64004 - RNA, 2745 nt, Artificial Sequence
  derived and/or modified sequence opt3 from TMTC3__Homo_sapiens__NP_861448
auggccaacaucaaucugaaggagauuacccucauagugggcgucguuacagcuugcuacuggaacagccuuuucuguggguuuguguucgacgauguauccgcaauccuggacaauaaagauuugcaccccucuacuccuuuaaagacgcuguuucagaacgacuucuggggaaccccaaugucagaagagagaagucauaaaagcuauaggccgcuaacagugcucacuuuucggcugaauuaccuucuguccgaauugaagcccaugucuuaucaccuccugaacaugauuuuccaugccgucgugucgguuaucuuucugaaagugugcaaacucuucuuagauaauaagucaagcgucauugcgagucugcuuuuugcugugcacccuauccauaccgaggccguaacagguguugugggccgcgcagaauugcuguccucuauauucuuucuagccgcuuuccucagcuacacccgauccaaagggccagacaacucaaucauuuggacucccaucgcacugacagucuuucuuguggccguggcuacccuguguaaggagcaaggaauuacggucguuggcaucugcuguguguaugagguauucauagcccaggguuacacuuugccucuccugugcaccacagcggggcaguucuuacguggaaaaggcaguauuccauuuagcaugcugcagacucucgugaaacuuaucguccugauguucucuaccuugcuacuggugguuauuagagugcaagucauccagucccagcuccccguguuuacaagguucgauaauccugcagccguaucaccaaccccgacgcggcagcugacuuuuaacuaucuucugcccguuaaugcuugguugcuccugaacccuagcgaauuauguugcgacuggacaaugggcaccaucccacugauugagagucuacucgauauacgcaaucuggccacuuucacauuuuucuguuuucuugggauguugggaguguucucuaucagauacuccggugacagcucgaagaccguccugauggcacucugccugauggcacuucccuuuauuccugccucuaaccuguucuuuccagugggcuucgucguggcggaaaggguuuuguacgugcccuccaugggguucuguauccucguagcccacggauggcaaaagauaucaacgaagagugucuuuaaaaagcugagcuggauuugcuuauccauggugauccugacccacucucuaaaaacauuccaucggaauugggauugggagagcgaguauacucucuuuaugucagcacugaagguuaacaaaaacaaugcuaaacuuuggaacaaugugggccacgccuuggaaaacgagaagaauuucgaacgcgcucugaaguacuuucuccaggccacccauguccagccggacgauaucggugcacacaugaacguggggcgaacauauaagaaucugaacagaacuaaagaggccgaagagaguuacaugauggcuaaguccuuaaugccucagauuauccccggaaagaaguaugcggcaaggauugccccaaaucaccugaacguauacauaaaucuugcuaacuugauccgggccaaugagagccgucucgaagaggcagaccaacuguaucgccaggccauuucuaugagaccugacuucaaacaggcuuacaucucaaggggcgaacuacugcucaagaugaacaagccccugaaagccaaggaggcauaccuuaaagcguuggaacuggaucggaauaacgcugacuuaugguauaaccucgccaucgugcauauugagcugaaggagccaaaugaagcacuuaaaaacuuuaaucgagcccuggaguugaaccccaagcacaagcucgcucuguucaauagugccauaguuaugcaagaaagcggcgaggucaaacuacgcccugaagcaagaaagaggcugcucuccuacaucaacgaggagccacuggaugcuaauggguauuuuaaccuuggaauguuggccauggacgauaaaaaggacaaugaagcggagauuuggaugaaaaaggccaucaagcugcaggcugauuuccggucugcauuauuuaaccucgcccugcuuuacucgcagaccgcuaaagaacugaaggcccuaccgauucucgaggagcuguugcgcuauuaccccgaccauaucaaaggucugauauuaaagggcgauauccucaugaaucagaaaaaggacauucugggggcuaaaaagugcuucgaaagaauccuugagauggauccuagcaacgugcaaggaaagcacaaucuguguguggucuauuuugaagagaaagacuugcucaaggcggaaaggugccugcuagagacacuggcccuugcuccacaugaggaauacauucagcgucaccucaacaucguucgggacaaaauauccucaaguucuuucauugagcccaucuucccuaccagcaagauuuccucaguggaaggcaaaaagaucccaacugagagcgugaaggaaauacgaggugagucuagacagacgcagaucguaaaaacauccgauaauaagagucaaagcaaaucuaacaagcagcuggggaaaaacggcgacgaggaaacuccccacaagaccaccaaggauauuaaagagaucgaaaagaaaagggucgccgcauugaagcgccuggaggaaauugagcggaucuuaaauggagaguga

SEQ ID NO: 64005 - RNA, 843 nt, Artificial Sequence
  derived and/or modified sequence opt3 from TMX1__Homo_sapiens__NP_110382
auggcccccagcggcucccuggcugugccucucgcaguccuuguucuguuguuauggggagccccauggacccacgggagaaggucuaacgugcggguaaucacagacgagaauuggcgcgaacugcuagagggugauuggaugauugaguucuacgcgccguggugccccgcuugucagaaccuccaaccugaaugggaaucauuugccgaguggggcgaggaccuggaagugaauauagcaaaggucgaugugacugagcagccagggcuuaguggacgauucaucauuacggcccugcccaccaucuaucauugcaaagacggcgaauuucguagauaccaggguccuaggacaaagaaagauuucauuaacuuuaucagcgacaaggaguggaaauccauagagccaguuucuucgugguucgggcccggaucaguguugaugagcaguauguccgcucucuuucagcugucuauguggauccggacuugucacaauuauuucauugaagaucugggccucccugucuggggcagcuacaccguguuugcauuagccacacuguucuccgggcuuuugcugggacuaugcaugaucuuuguagcugacugucucugcccaucaaagcgcagaaggccgcaacccuauccuuacccaaguaagaaacugcuuagcgagucugcccagccccugaagaaaguugaagaggaacaggaggcggaugaggaagacguguccgaggaagaggcagaaucaaaggaggguaccaacaaagauuucccucagaaugccauucggcaacgcagcuugggcccaagucucgcuacugacaagucuuga

SEQ ID NO: 64006 - RNA, 777 nt, Artificial Sequence
  derived and/or modified sequence opt3 from TMX2__Homo_sapiens__NP_001137484
auggccgugcuggcuccccucaucgcacuugucuacagcguuccuagacuguccaggugguuggcccagccauauuacuuacugucugcgcuacucucagcugccuuccugcuugugcggaagcugccgcccuugugccacggccucccuacccaacgcgaggacgggaacccaugugauuuugacuggcgagaaguagagauucugauguuccugagugcaauagugaugaugaaaaaucguagaagcauguuucucaugacaugcaagcccccuuuauauaugggaccagaauacaucaaauauuucaacgauaagacuauugacgaggaacuggagagggauaaacgggucacguggaucguggaguuuuucgccaauugguccaacgacugucagucuuuugcucccauuuacgcagaucuuucguugaaguauaauugcaccggucugaacuucggcaagguugacguggggcgcuacacagaugucucaacuagauacaaagugagcaccaguccucuaacaaagcagcucccaacccugauccuuuuucagggaggcaaagaagccaugaggcggccgcaaauagacaagaaaggucgcgcuguauccuggacuuucucugaggaaaauguuauccgagaguuuaaccugaaugaguuguaucagagagccaagaagcucagcaaagcgggggauaacauucccgaggaacagccuguggcauccacaccaaccacggucucagacggagaaaauaagaaagauaaguga

SEQ ID NO: 64007 - RNA, 1365 nt, Artificial Sequence
  derived and/or modified sequence opt3 from TMX3__Homo_sapiens__NP_061895
auggccgcuuggaagaguuggaccgcacugagacucugcgccacaguggucguucuugacauggugguauguaaaggcuucguggaggaucuggacgaauccuuuaaggagaacaggaaugaugacaucugguuggucgauuucuacgcgcccuggugcgggcacuguaaaaaguuagaaccuauuuggaacgaggugggacuggaaaugaaaucuauagguucaccaguuaaggugggcaagauggacgcuacuagcuauagcuccaucgccucugaguuugggguccggggauacccgacgauuaaacuacucaagggcgaucuggcauauaauuaccgcgguccccgaaccaaagacgauaucauugaguucgcccaucgugugucgggggcucuuaucagaccucugccaucacagcaaauguuugaacacaugcagaagaggcaucggguauucuuuguuuaugugggaggcgagagccccuugaaagaaaaguacauagacgcagccagugagcucaucgucuauacauacuucuuuuccgcuucugaggaaguggugccugaguacgucacucugaaggaaaugccagccguucugguguucaaagaugagaccuauuuuguauacgacgaauaugaggauggcgaccucagcuccuggauuaaccgcgagagauuccagaauuacuuagcgauggacggguuucugcuuuaugaauugggagauacagguaagcugguggcacuagccgucaucgacgagaaaaacaccucaguggaacacacuaggcucaagaguauuauccaggagguugcucgggauuaccgcgaccuguuccaucgagauuuccaauuuggccacauggacgggaaugauuauauaaacacacuucugauggacgaauugaccgugcccacggucgugguacucaauacuagcaaccagcaguacuuccuguuagauagacagauuaaaaauguugaggacauggugcaauuuaucaacaauauucuggauggaaccgucgaggcccagggcggugacucuauccuccagaggcuuaagcggaucguguucgacgcaaaauccacaauugucucaauauuuaagagcaguccucugauggggugcuucuuguuuggacuaccacugggcgugaucucuauuauguguuacggcaucuauacugcugauaccgacgggggauacauagaggaacguuaugaaguuuccaagagcgagaacgaaaaucaggagcaaauugaggaaucgaaagagcagcaggaaccgucuuccgguggcucagugguacccacaguccaagagccuaaggaugugcucgagaaaaagaaagacuga

SEQ ID NO: 64008 - RNA, 6606 nt, Artificial Sequence
  derived and/or modified sequence opt3 from TNC__Homo_sapiens__NP_002151
augggcgccaugacccagcugcucgcugggguguuccuugcauuucuggccuuggcgacagagggaggugucuuaaagaaaguuaucagacacaagaggcaaagcggcgugaacgcuacucugcccgaagagaaucagccuguaguguucaaccaugucuacaauauuaaacuaccaguggggucccagugcucuguugaccucgaaucagccaguggagagaaggaucuggcaccgcccagcgaaccuuccgagucuuuucaggagcacacgguggacggcgaaaaccaaauagucuucacccaucggaucaauauuccacgccgagccugugguugcgcugcagcccccgaugugaaagagcuucugucgcguuuggaagagcucgagaaccugguaucaagccugagagaacaguguacagcuggggccggaugcugucuccagccugcgacuggcagguuagacacccggccauuuugcaguggccgcgggaauuucuccacagagggaugugguugcguuugugaacccggcuggaaggggccuaacugcucugagccagaauguccgggaaauugccaccugagaggcaggugcaucgauggucaguguauuugcgacgauggguuuaccggagaggacuguagccaacuugcaugccccuccgauuguaacgaccagggcaagugcgugaauggcgucuguaucugcuucgagggguaugccggagcugauuguucacgggaaauaugcccugugccauguagugaggaacaugguacuugcguggacggcuugugcgucugucacgauggguuugccggagacgacugcaacaaaccccugugucuaaauaacugcuacaaucgcggccgauguguugagaacgaaugcgugugugaugaggguuucacaggggaggacugcagcgaacucaucuguccuaacgauugcuuugacagaggcagguguauuaauggaaccugcuauugcgaggaaggcuucacgggggaggauuguggaaagccaacuugcccccacgcaugucauacccagggucggugcgaagagggccaguguguaugcgacgagggguuugcuggaguggauuguucugaaaaacguugcccggccgacugucacaaccgcggcagaugcgucgaugguaggugugagugcgacgauggguucacaggcgcggacugcggagaacugaaguguccuaauggcugcuccgggcauggacggugugugaacggucaaugcguuugugacgagggcuacacuggggaggauugcucacagcuucgaugucccaaugacugccacagccgcggaagauguguggaaggcaaaugcgucugugagcaggguuucaagggguaugauugcagugacaugucuugcccaaacgauugucaccaacauggcaggugcgugaauggaauguguguaugcgacgauggcuacaccggggaagacugucgggaucgccagugcccuagagacuguuccaacaggggacugugcguugauggccagugugugugcgaggacgguuuuacagggcccgauugugccgaauugagcugcccaaaugacugccacggacagggccguugugucaacggucaaugcgugugucaugagggcuucauggggaaggacugcaaagagcagcggugucccucggauugccacggacagggccgaugugucgacgggcagugcaucugucaugaaggauuuaccggccucgauugcggucaacacucuuguccuuccgacugcaauaaccuggggcagugugugucaggaagaugcauuugcaaugagggcuauaguggugaagauuguagcgagguuuccccaccgaaggacuuagugguaacggaagucacugaggagacagugaaccuggcaugggauaaugaaaugaggguuaccgaguaccucguggucuacacucccacacacgaaggcgggcuugagaugcaguuccgcgugccuggagaccagaccucuacgaucauacaagaacuggagccaggcguagaguauuuuauucggguguucgcuaucuuggaaaacaaaaagagcauucccguuucagccagagucgcuaccuaccuaccugccccagaggggcugaaauuuaagaguaucaaagaaacauccguggagguggagugggauccccucgacaucgcauucgaaacuugggagauuauauuuaggaacaugaauaaggaagaugagggagaaaucaccaagagccugcgccgaccggagacaucuuaucggcagacuggccuugccccuggucaggaguacgaaauuucacugcauaucgucaaaaacaauacccgugggccaggauugaagagaguuacaaccacuaggcucgacgcucccagucagauagaggugaaagaugugacggacacaaccgcgcugauuacuugguucaagccuuuagcagaaaucgacggcaucgagcugaccuaugguauuaaagauguacccggcgaccgcacaaccaucgaucuaacugaagacgagaaccaauacagcauugggaaucucaagccagauacagaguaugaagucucccugauaucucggagaggagacaugucgagcaacccugccaaggagacguuuaccacuggccuugaugcucccaggaauuugcgacgcgugucccagacagacaacucaaucacccuggaauggcggaaugggaaagccgcaauugauaguuacagaaucaaguacgccccaaucucuggaggcgaccacgcugagguugaugugccgaaaagccagcaagccacaacuaagaccacgcucaccggucugaggccugggacagaauauggaauuggcgucuccgcagugaaagaggacaaggagucaaaccccgcgacuauaaaugcugccaccgaacuugacacaccaaaggaucugcagguuagcgagacugcagaaaccucuuugacgcuccuguggaaaacacccuuagccaaguucgaccguuaccgccugaacuauucccuaccuaccggccaguggguggggguacagcucccacggaauacuacaaguuacguccugagaggacuugagcccggucaagaguauaacguguugcugaccgcugaaaaaggcaggcauaagagcaaaccugcccgagugaaggcaucuacugagcaggcuccggaacucgagaaucugaccgucacagaaguugggugggauggauuacggcugaacuggacggccgcggaccaggccuacgagcacuuuaucauucaggugcaagaggcuaacaagguagaagcagcccgcaaucuuaccgugccaggcuccuugagagcugucgauauccccggucucaaagccgcaacuccuuauacagugucaauuuacgggguuauccagggauacaggaccccagugcugagugcggaggccagcacaggcgaaacucccaaccuaggcgaggucgugguugcugaaguggggugggacgcccugaagcucaauuggaccgcaccugagggagcuuaugaguacuucuucauacagguccaggaagccgauacgguagaggcagcccaaaaccugacagugccggguggccuucggucgaccgacuugcccgggcugaaagcugcgacucacuauaccaucacaauucgaggaguuacucaggauuuuuccaccacaccauuaucuguggaaguccucacggaggaagugccugacaugggcaaucugaccguaacugaggugagcugggaugcccuuagacugaacuggacaacccccgacgguacuuacgaucaguucacaauccaaguccaggaggcagaccagguugaagaggcucauaauuugaccgugccagggucacuccgcaguauggaaauuccuggacugagggccggcacgcccuauacugugacccuacacggcgagguccgugggcauuccacacggccacuggccguggagguuguaaccgaagaccucccgcagcugggagaucuugcugugucugaggucgguugggacggcuugagacugaacuggacugcagccgauaaugcguacgaacacuuugugauccaaguucaggaggugaacaaggucgaagcugcccagaauuuaacacucccugggagccugagggcaguggacauacccggacuugaggccgcuaccccauaucgcguauccauuuacggcgucauccgagguuacagaacacccgugcugucagcagaggccagcacugcgaaagaaccugagauugggaaccuaaauguuagugauaucaccccagaaucuuucaaccucuccuggauggcuacggacggaauauuugagacauucaccaucgaaauuaucgauagcaaucggcuguuggagacuguggaguauaacauuucgggcgccgaaaggaccgcacauaucucaggccugcccccuucuacagacuuuauagucuacuuaagugggcucgccccguccauucgcacuaagaccaucagcgcuacggccacaaccgaggcacugccacuucuggaaaacuugacuaucucugauauuaaucccuauggauucacagugagcuggauggcuuccgagaacgccuuugacucauuccucguuaccguggucgauagugguaaacugcuagacccucaggaauuuacucugagcggcacacaacguaagcuugagcucagagggcugaucaccggaauuggcuacgaggugaugguaucugguuucacgcaggggcaccagacuaagcccuugcgggcggaaauagugaccgaggccgaaccagagguugauaaucuguuagucuccgacgcaacaccugacggauuuaggcucucauggaccgcugaugagggcguguucgacaacuucgugcugaaaauccgcgauacaaagaaacagagugaaccccuugagauuacucuguuggccccagaacgaaccagagacaucacgggccuccgggaggcuacagaauaugagauugagcuguacgggaucagcaagggaaggcgcucccaaacugucucugcaauagccaccacagccauggguucgccuaaagaaguaaucuuuagcgauauuaccgagaauucagcuacuguguccuggagagcgccgaccgcacagguugaaaguuucaggaucacauaugugcccauuacgggcgggacuccaucuauggucaccguggacggaacaaagacccagacucggcuaguuaagcugaucccuggcguggaguaccuugucagcauaauugccaugaaagguuuugaagaguccgagcccgugucagggucuuucacaaccgcucucgauggcccaagcggacugguaacggccaacaucacugacagugaagcauuggcccguuggcagccugcuaucgcgacaguggauuccuacguuauuagcuauaccggcgagaagguccccgaaauaacccgcacugugucugggaauacaguggaguacgccuuaaccgaccuggaaccggcaacagaguauacucuccgaaucuuugcugagaaaggaccacaaaagucauccacgauuaccgccaaauucacaacugaucuggacaguccuagagaccuuaccgcaacagaaguccagagcgagaccgcccuguugacuuggaggcccccacgggcuucgguuacggguuaccuacugguguaugaaucuguagauggcaccgugaaggaggucaucguggggcccgacacaacuuccuacagccucgccgaucugucaccuaguacccacuauacagcgaagauucaggcacuuaacggaccguuacgcucuaauaugauccaaaccauauuuacuacaaucggccugcucuaccccuucccaaaagacugcucccaggccauguugaacggugauacgaccagcgggcuguacacuauuuaucucaauggcgacaaggcugaggcccuggaaguuuuuugugauaugacaucagacggaggcggguggaucguguuccuuagaaggaaaaacggacgggagaauuuuuaccagaacuggaaggcuuaugcagccgguuucggcgaucgaagagaagaguucuggcugggguuggacaaucuaaacaaaauuaccgcucagggacaauacgaacugcgcgucgaucucagggaccauggcgagaccgccuuugcaguauaugauaaguucagugugggugacgcgaagacacgguacaaauuaaagguugagggguauagcggcacugccggagacuccauggcuuaccacaauggccguucuuuuagcacguucgauaaagacaccgauuccgccaucacaaacugcgcacugucauacaagggggcuuuuugguauagaaacugucauagggugaaucuuaugggacgcuacggcgacaacaaucacucucagggugucaacugguuccauuggaaagggcacgaacacaguauacaguuugccgagaugaagcugcggccuucgaauuuccgaaaccucgaaggaagaaggaaacgcgcauga

SEQ ID NO: 64009 - RNA, 951 nt, Artificial Sequence
  derived and/or modified sequence opt3 from TNFAIP1__Homo_sapiens__NP_066960
augagcggcgauaccugccugugucccgccuccggggcuaagccuaaacucucuggauucaaggguggcgggcuuggaaacaaauacgugcagcugaaugucggcgguucauuguauuacacaacuguuagagcauuaacgaggcacgacaccaugcugaaggccauguuuagugggcggauggaggugcuaacagacaaagaaggauggauccucauugaucgcugcggcaagcauuucggcacuauacugaacuaucuucgagacgauaccaucacacugccacaaaaucgucaggagauuaaggaauugauggcggaggcuaaauacuaucucauccaggggcugguaaacaugugucagagcgcccugcaagacaagaaagauuccuaccagccggugugcaauauucccaucauaaccucucucaaggaagaggagagauuaaucgaaucgucaacuaaaccugucgugaagcugcuuuauaacaggagcaauaacaaguacaguuacacauccaauucugacgaucacuugcugaaaaacauugagcuauuugacaagcucagccugcgguucaauggacgcguucuuuuuaucaaagaugugauuggugacgaaaucuguugcugguccuucuauggccaggggagaaagcuggcagaggucuguugcaccucaauaguguacgccacggagaaaaagcagacuaaaguagaauuuccagaggcuaggauuuaugaagagaccuugaacguucuccuguacgaaacaccccgggugccugauaauaguuuacuggaggcaacuagccgcucucgaucccaagccucaccaagcgaggacgaagagaccuucgaacucagagacaggguccggcguauccaugugaagcgcuauaguacauacgaugacagacagcuuggacaccagucuacccauagggauuga

SEQ ID NO: 64010 - RNA, 1965 nt, Artificial Sequence
  derived and/or modified sequence opt3 from TNFAIP2__Homo_sapiens__NP_006282
augagcgaggccuccucugaagaccuggugcccccucucgaggcuggcgcagccccauacagagaagaggaagaggcggcuaagaaaaagaaagagaagaaaaagaagucaaaagggcuugccaacgucuucugcguuuuuaccaaggguaaaaagaaaaagggacagccgaguagcgcagaacccgaggaugccgcuggcuccaggcaagggcuggacggaccuccacccacaguggaagaguugaaggcagccuuagagcggggccagcuggaagcugcccgcccucuacucgcgcuggagcgagaacuugcagccgcugccgcagcuggugggguaucugaggaagaacuggugcguagacagucgaaagucgaggccuuguaugaacuccugagggaucaggugcugggaguucuccggcgcccauuagaggcgcccccugaaagacugaggcaagcccuugcaguggucgcugagcaggaacgggaggaccgccaggccgcugccgcaggcccaggcacuucaggguuggccgcuacgcgaccgagaagguggcugcagcuauggcggcguggaguggcggaggcagccgaagaacgcaugggucaaagacccgcugccggcgcagaaguaccugagagcguuuuccuccaccuggggaggaccaugaaggaagaucuugaggccguggucgagcggcugaaaccauuguuucccgcugaguucggagugguggccgcauacgcggagaguuaucaucagcacuuugcugcccaucucgcagccgucgcucaguucgaacugugugagcgagacacauacauguuacugcucuggguucagaaucuuuauccuaacgauaucauuaauuccccaaagcuggugggcgaguugcaagguauggggcuaggaucucugcugcccccgcgccagauaagacuccuugaagccacuuuucugagcuccgaggcagcuaacguaagggaauugauggaccgggcccucgagcuggaagcgcgcagaugggccgaggaugugccuccccagagguuagacggccacugccauucagagcuggcuaucgauauuauccaaauuaccagucaggcacaggccaaagcugaaagcaucacacuagaccucggcucucagauaaagcguguccugcuuguggaguugccagccuuccugcgguccuaccaacgagcauuuaaugaguuccucgagagagggaaacagcugaccaacuauagggcgaauguuaucgccaacauuaauaacugucuuucauuucgcaugagcauggaacagaauuggcaagugccucaggauacucugaguuugcuccugggacccuuaggugagcugaagucucacggcuucgacacacuacuccagaaccugcacgaggaccuuaagccauuguuuaaacgguucacccauacgagaugggcugcccccgucgaaacucuggagaauaucauugcaaccguggauacaaggcucccugaguucuccgaacugcaggggugcuuucgcgaagaguuaauggaggcucugcaccuucauuugguaaaggaauacaucauacagcucagcaaaggacgacugguucuaaagacugccgagcaacagcagcagcuggcaggcuacauucucgccaacgcugacaccauccaacacuucuguacacagcacgguucgccagcgaccuggcugcagccggcccuucccacguuggcagaaauuauccggcugcaagauccuucugcuaucaaaauugagguggccacuuaugccacaugcuacccagacuuuuccaaggggcauuuaucagcuauacucgcaaucaagggcaaucugaguaacagcgaggucaaacguauuagauccauccuugaugugucuaugggagcccaggaacccagcaggccucuguucucauugauaaaggucggcuga

SEQ ID NO: 64011 - RNA, 2373 nt, Artificial Sequence
  derived and/or modified sequence opt3 from TNFAIP3__Homo_sapiens__NP_006281
auggccgagcaagugcugccccaagcucucuaccuuagcaacaugagaaaggcagucaaaaucagggaacggacuccugaggacauuuucaagccaacaaauggcauaauccaccauuuuaaaacuaugcaccgcuauacgcuggaaauguuccgaaccugccaguuuuguccgcaguuccgugagauuauccauaaggccuugauugauagaaacauccaggcgacauuagaaucccagaaaaagcugaauuggugcagggagguucggaagcuaguggcucucaaaacuaacggggacggaaauugucugaugcacgccaccucucaguacaugugggguguacaggauacagaccuugugcugcgcaaggcauuguuuucaacccucaaagagacugauacaagaaacuucaaguuuagguggcagcuggaaagucugaaaagccaagaguucgucgaaaccggccucugcuaugacacgcggaauuggaacgaugagugggacaauuuaauaaagauggccuccacugauacccccauggcucgcucugggcugcaguacaacucgcuugaggaaauccauauuuuuguguuguguaauauccugcgaagaccuauuaucguuauaucagacaagaugcuaaggagccucgagaguggauccaacuucgcaccacugaaagugggcgguauuuaucuuccccugcacuggccugcccaggaaugcuaccgguauccaaucgucuugggguacgauucucaccauuuugugccccucguaacacugaaggacagcggaccugagauucgugcuguuccauuagugaaucgcgauagaggcagguucgaagaccugaaaguccacuuucucacugacccggagaacgagaugaaggaaaaacuucugaaggaguacuugauggugaucgaaauccccgugcagggcugggaucaugggaccacacaccuaauuaaugccgcgaaacuggacgaggcaaaccucccuaaggaaauaaaccuggucgaugacuauuucgagcuuguucaacacgaguacaagaaauggcaggaaaauuccgagcagggacggcgagaaggucaugcccaaaacccaauggagcccucagugccucagcugaguuugauggauguaaagugugaaaccccaaauugccccuucuuuaugagcgugaacacgcagccgcucugucacgagugcucugagcgcagacagaaaaaucaaaacaagcugccuaaauuaaauuccaagcccggcccagaagggcugccuggaauggcucuaggcgccucaaggggugaggcauaugaaccccucgcuuggaacccagaggagagcacugggggaccccauagugccccuccaacagcgccgucucccuuccuguuuuccgaaaccacugccaugaagugucggagcccuggcugcccauucacacuuaauguccagcacaacggcuuuugcgagcgcugucauaaugcaagacaguugcacgcuucgcacgcccccgaccauaccaggcaccuggauccugggaaaugccaggcuugucuccaagacgugacgcguaccuucaacggaaucugcucuacauguuuuaagcggacuaccgccgaagcauccucaagucugagcacaucccuuccacccucuugccaucagcgaagcaaaucagauccgaguagacugguuagguccccuagcccacacucuugucaccgcgccgguaaugacgcucccgcgggcugcuugucacaggcagcccggacuccuggggauagaaccggaacaaguaaguguaggaaagcuggcugcguguacuucgguacccccgagaacaagggguuuuguacucucugcuucauugaauaucgcgagaauaagcauuuugccgcagccagcggcaaagucuccccaacggcuucucgauuccagaacacaaucccuugccugggacgggaguguggcaccuuagggucgacuauguuugaaggauacugccaaaaguguuucauagaggcccagaaccagcguuuccacgaagcaaaaagaaccgaggaacagcugaggagcucccaacgccgggacgugcccagaacaacccagucaaccaguaggccaaagugcgcgcgagcuucuuguaaaaauauucuagccugccgcagcgaggagcucuguauggaaugccagcauccgaaccaacggauggguccuggcgcacacagaggggagcccgccccagaagaucccccuaagcagaggugucgugcuccagccugcgaccauuuuggaaaugcaaaguguaacggcuauugcaaugagugcuuccaguuuaaacagauguacgguuga

SEQ ID NO: 64012 - RNA, 834 nt, Artificial Sequence
  derived and/or modified sequence opt3 from TNFAIP6__Homo_sapiens__NP_009046
augaucauucugauauaccucuuccuucuguugugggaggacacccagggcuggggguuuaaggauggaaucuuccacaacagcauuugguuagaaagagccgcugguguguaucauagggaggcacgguccggcaaauacaagcugacauaugccgaagcgaaagcugucugcgaguuugaagggggacaccuagccacuuacaagcaacucgaggcagcccgcaaaaucggcuuccauguuugugcugcagguuggauggccaaggggcgagugggauaucccauuguaaagccuggcccaaauugcggcuuugggaaaacgggaaucauagacuacgguauccgucugaacagaucugagaggugggaugcuuauuguuacaauccgcacgccaaggaaugcggcgggguguucaccgaccccaaacagauuuuuaagucaccuggauucccaaacgaguacgaagauaaucagaucuguuauuggcauauucggcuuaaauacggccagcgcauccaccugagcuuuuuggacuucgaucucgaggacgaucccgguugccuggcggacuaugucgagauauacgauaguuaugacgaugugcacggguuuguuggaagauacuguggcgacgaacugccugacgauauuaucuccacaggcaacgugaugacucucaaguucuuaucugacgcaucggucaccgccgggggauuucaaauuaaguauguggcuauggauccaguaucaaaaagcagucaggguaagaauacauccaccacuucuacaggcaacaaaaauuuccuggccgggagguucagccaucuuuga

SEQ ID NO: 64013 - RNA, 567 nt, Artificial Sequence
  derived and/or modified sequence opt3 from TNFAIP8__Homo_sapiens__NP_001071122
auggccaccgacguguucaacagcaagaaucuggcuguccaggcacagaaaaagauccucggcaaaaugguuuccaagucuauugccacaacucuuauagaugacacgucaagugaggugcuggaugaauuguacagaguaaccagggaguauacacaaaacaaaaaggaagcggagaagaucauuaaaaauuuaaucaagacugugauuaaacuggcuauccuauaccggaacaaucaguuuaaccaggacgaacucgcccugauggagaaguucaaaaagaagguccaccaacuugcaaugaccgugguuagcuuucaccagguggauuauacauucgaccgcaauguccugucccgauugcucaacgagugccgugaaaugcugcaccagauaauccagagacaucugaccgccaaaucucacgggagggugaauaacguauuugaucauuucucggacugugaguuucucgcugcauuauacaaucccuucggaaacuuuaagccucaucugcaaaaacuuugcgaugguauuaauaagauguuggacgaagagaacaucuga

SEQ ID NO: 64014 - RNA, 555 nt, Artificial Sequence
  derived and/or modified sequence opt3 from TNFAIP8L2__Homo_sapiens__NP_078851
auggagagcuucuccucuaagucacuggcccuccaggcugaaaagaaacuucugaguaaaauggcaggcagaagcguggcccacuuguuuaucgacgagaccuccucugaagucuuagaugagcuguacaggguuucgaaggaauauacacauucacggccccaagcgcagcgcgugauuaaagaccuaauaaagguagcuaucaagguggccguccuccaccgaaacgggagcuucggaccuagugagcuggcacuugccacucguuuuagacagaaacugaggcagggugcuaugacggcauuguccuucggcgagguggauuuuaccuucgaagccgcuguucucgccgggcugcugacagagugccgggacgugcucuuagaacuggucgagcaucaccuuacuccaaagucucauggacgcauuagacacguguuugaucacuucagcgacccgggcuugcugaccgcgcuauacggucccgauuuuacacaacaucucgggaaaaucugugacggacugaggaaacuucuggaugagggcaaguuguga

SEQ ID NO: 64015 - RNA, 879 nt, Artificial Sequence
  derived and/or modified sequence opt3 from TNFAIP8L3__Homo_sapiens__NP_997264
augggcaagcccagacagaacccuagcacccugguguccacacucugcgaggccgaaccaaaagggaagcugugggucaauggauacgcugguacucaaggcacgagggacgcaacccugcagacacgguugaucccguuaucuuuccaccuucagcgcgggaaaggacuagccgcgccccucucagcucugagugccccucgacuuccagagcgucccgcagauggcagaguugccguggacgcucagccugcagccaggagcauggauuccgacucuggugaacaaucggagggggaaccaguaacugcugccggacccgauguguuuucaagcaagagucuggcguugcaggcacagaaaaagauucucuccaagauagccucuaaaaccgucgcuaacaugcugaucgacgauacaagcuccgagauuuucgacgagcuguauaaggugaccaaagaacauacucacaauaagaaagaggcccauaagaucaugaaggaucucauuaaaguugcaaucaagauaggcaucuuauaccggaacaaucaguuuucacaagaggaacuggugauugucgagaaauuccgcaagaaacuuaaccagacagcuaugaccaucgugaguuuuuaugaaguagaguacacguucgacagaaauguuuugagcaaccugcuacacgaauguaaggaucucgugcaugagcugguccagaggcaccuuacuccucggacccacggccgcauuaaucauguguuuaaccacuucgccgacguggaauuucugucuacauuguauucccucgauggggacugccgaccaaaucugaaaagaaucugugagggaauaaacaaguuacuggacgagaagguccucuga

SEQ ID NO: 64016 - RNA, 702 nt, Artificial Sequence
  derived and/or modified sequence opt3 from TNF__Homo_sapiens__NP_000585
augagcaccgaguccaugaucagagacguggaacuggccgaggaagcucuccccaagaaaacaggcgggccucagggaucuaggcggugccuuuuccugucauuguuuaguuucuuaauugucgccggugcaacuacgcuguuuugucuacuccacuucggcguuauagggccacaacgcgaggaauuuccgcgagaucugagccuuaucucuccccuggcgcaggcugugcguuccucgucaagaaccccuagcgacaagccaguagcccauguggucgcaaacccccaggccgagggacaguugcaauggcucaauaggcgggcuaacgcacugcuggccaauggcguggagcuccgcgauaaccaguuaguugugccuagugaaggucuguaccuuauuuauucccaggucuuguucaaagggcagggaugcccaucuacacacgugcugcuaacucauaccaucagcagaauugcuguauccuaccaaacaaagguuaaucuccugucagccaucaaaagucccugucagagggagaccccugaaggcgcggaggcaaagccaugguaugagccgauauaccuuggcgggguguuucagcuggaaaagggagaccgguugagcgccgagaucaaccgccccgauuaucucgacuucgcugaaucuggucaggucuacuuuggcauuaucgcccuguga

SEQ ID NO: 64017 - RNA, 1407 nt, Artificial Sequence
  derived and/or modified sequence opt3 from TNFRSF10A__Homo_sapiens__NP_003835
auggcucccccuccagccagagugcaccugggcgcauuccucgccgucaccccgaaccccgggagcgcggcuuccggaacagaggccgcagccgcuacuccuucuaagguuugggguucaagugcaggcaggaucgaaccacgcgggggaggccggggugcccuucccacgagcauggggcagcauggaccuuccgcucgagcccgugcgggcagagcaccaggccccaggccugcccgggaggcuucuccacgccugagagugcacaaaaccuuuaaguucguaguggucgggguguuguuacaaguugugccgucgucagccgcaacaauuaaacugcaugaccagagcauaggaacucagcagugggaacacaguccccuaggugagcucugcccuccaggcucccauaggucugaacaccccggggcuuguaaucggugcaccgagggagucggcuacacaaacgccagcaauaaccuguuugcgugucuuccuugcaccgccuguaaguccgaugaggaggaacgcucaccaugcacuacaacccgaaauacggcaugucaaugcaaacccgguacuuucagaaacgacaauagugcugaaauguguaggaagugcagccggggguguccgcguggaauggugaagguaaaagauugcaccccuuggucugacaucgagugcguucacaaggaguccggcaacggccauaauauuugggugauccuggucgugacauugguggucccccuccugcugguugccgugcucauuguauguugcuguaucgggucaggaugcgguggcgauccaaaauguauggaccgcgugugcuuuuggagauuagggcugcuuaggggaccuggcgcugaagauaacgcccacaaugagauauugagcaacgcagacagucugucuacuuucgucuccgaacagcagauggagagccaggaacccgccgaucuaaccggugugacaguucaaucgccaggggaggcucagugucuccugggccccgcggaggcagaaggaucucagcggcgacgccuucuggugccugccaauggcgcugacccaaccgagacguugaugcucuuuuucgauaaguuugccaacaucgucccguucgacuccugggaucagcugaugagacaauuagaccugacuaaaaaugaaauugacgugguaagggcagggacagccggacccggugaugcucucuaugccaugcuuaugaaguggguuaacaagaccggccggaacgcaucaauccauacucuguuggacgcgcuagagcgcauggaagagagacacgcuagggagaaaauucaggaucugcucguggacagugggaaguuuaucuaccuggaagauggaacaggcagcgccgucucccuugaguga

SEQ ID NO: 64018 - RNA, 1323 nt, Artificial Sequence
  derived and/or modified sequence opt3 from TNFRSF10B__Homo_sapiens__NP_003833
auggagcagagaggccaaaacgcccccgcugcaagcggggccaggaagcggcacggaccugguccacgcgaagcgcgaggcgcucguccggggcccagagugccuaaaacccugguccucguuguggccgcaguacuucuguugguguccgccgagucugcuuuaaucacacagcaggaccuggcaccacagcaaagggccgcuccccagcagaagcggucaaguccuagcgaaggacuaugcccacccggccaccacauuuccgaggauggucgcgacuguauaucuugcaaauacgggcaggauuauucgacucauuggaaugaccuccuguucugucuuagaugcacgaggugugauucaggagaagucgagcugagcccuugcaccacaacucggaacaccgugugucaaugcgaggaaggcacauuucgcgaggaagacaguccagagaugugucgaaagugcagaaccggcuguccgagggggaugguuaaagugggagauugcacucccugguccgacaucgagugcguccacaaggaaucugguacaaagcauagcggcgaggugccugccguagaagagaccguuacguccucaccagggacucccgcgaguccuuguagcuugucuggaauuaucauuggcgugaccgucgcagccguggugcucaucgucgcuguuuucgugugcaaaucccugcuguggaagaaaguacucccauacuuaaaggguauauguucagggggaggcggcgaucccgaacggguggaccguagcagucagcgcccgggggccgaggauaauguccugaacgagaucgugucuauucuucagccuacacagguucccgaacaagagauggaagugcaggagccagcagaaccuacuggagucaauauguugucccccggugagagcgagcaucugcuagaaccagcugaggccgaaagaucgcagaggcggcgacuccuggugcccgcgaacgagggcgacccuaccgaaacacuucgccaaugcuuugaugacuucgccgaccugguaccauuugauucuugggagccguugaugagaaaacucgggcugauggacaaugagaucaagguugcaaaggcugaagccgcuggacacagggauaccuuauauacgaugcugauuaaaugggugaacaagacuggccgggacgccuccguccacacacuccuugaugcacuggagaccuugggugaacgccuagccaaacagaagaucgaggaccaucugcucucaagugggaaauucauguaccuggagggcaaugcugauagcgcgauguccuga

SEQ ID NO: 64019 - RNA, 780 nt, Artificial Sequence
  derived and/or modified sequence opt3 from TNFRSF10C__Homo_sapiens__NP_003832
auggccagaauccccaagacccugaaauucguggucguuauuguggcuguacuccuuccugugcuggcauacagcgccacaacugcgaggcaggaggaagucccacaacagacgguggcuccgcagcagcaacggcacuccuuuaagggcgaggaaugccccgccgggucucaucgcucagagcacaccggagcauguaacccuugcacagaagguguugacuauacuaaugccaguaacaaugagccaagcuguuuccccugcaccguguguaaauccgaucagaagcauaaaucuucgugcacaaugacccgagacacugucugucagugcaaggagggcacauuucguaacgaaaauucaccugagauguguagaaagugcaguagguguccaagcggggaagugcagguauccaacugcaccucuugggaugacauacaaugcguugaggaguucggagcuaaugcaacgguggaaacucccgccgcugaggaaaccaugaacacaagcccuggcacuccagccccggcggcagaggaaaccaugaauacaucccccgguaccccugccccagcugccgaggagacgaugacuacaucacccgggaccccugcaccagcugccgaagagacuaugacaaccagucccggaacgccggcgccugccgcagaagagaccaugacaacuagccccggcaccccagcuucuucccacuacuugucauguacaaucgucggcauuaucguguuaauugugcugcuaaucgucuuuguuuga

SEQ ID NO: 64020 - RNA, 1161 nt, Artificial Sequence
  derived and/or modified sequence opt3 from TNFRSF10D__Homo_sapiens__NP_003831
augggccugugggggcagagcgugcccaccgccuccucugcuagagcaggaagguacccuggugcccggacagcgucaggcacucgcccauggcuccuugacccgaagauccugaaauucgucguuuuuauuguggcuguauuguuacccgugcgagucgauagugccacgauaccucgucaagacgaggugccacagcagaccguugcaccccagcaacagagaaggagccugaaggaagaggaaugcccugccgggucccaccggucugaguauacaggagcuuguaacccaugcacugaaggcguggauuacaccaucgcaucgaauaaccuacccucaugucuccugugcacagucuguaaaagcggucagaccaauaagaguuccugcacuacaacccgcgacacggugugucagugcgagaaagggucuuuccaagauaagaacagcccugagauguguagaacuugcaggaccggauguccacggggcaugguaaagguuuccaauugcacaccgcgcucagacauuaaaugcaagaacgaaagugccgcuagcucuacuggcaaaacccccgccgcggaggaaacagugaccacgauccuugggaugcuggcauccccuuaucauuacuugauuaucauagucgugcucgugaucauucuggccgucguugugguaggauuuucaugucgaaagaaauucaucagcuaucugaaggguauuugcaguggcgggggaggcgguccagagagagugcacaggguccucuuucggcgucgcucuugucccuccagagugccuggggcugaggauaaugccaggaacgaaacuuuaagcaaucgguaccugcagccaacacagguuucggagcaggaaauccaaggacaggagcuugcagaauugaccggcgugacugucgagcugcccgaggaaccgcagcgacuacucgagcaagcugaagccgagggcugccagcgcagaaggcugcuugugccuguaaacgacgcggauucugccgacauauccacacuguuggaugcaucagcuacccucgaagaggggcaugccaaggagacgauucaggaccagcugguuggaagugaaaaauuauucuaugaggaagaugaggcugguagcgccaccuccugucuguga

SEQ ID NO: 64021 - RNA, 900 nt, Artificial Sequence
  derived and/or modified sequence opt3 from TNFRSF11A__Homo_sapiens__NP_001257880
auggcccccagagcuaggcggcgccgaccucuguucgcacuccuucuguugugcgccuuacuggcgcgucuacagguggcucuccaaaucgccccaccguguaccagcgagaaacacuacgaacaucugggcagaugcuguaacaaaugcgagcccgggaaguauauguccucuaaauguacaacuacgucagacagugucugccuuccuuguggaccagaugaauaccuggacagcuggaaugaggaagauaagugcuugcuccacaaaguuugugacaccgguaaggcacugguggccguaguggcuggcaacuccacaacucccaggcggugcgcauguaccgccggguaucauuggucucaggauugcgagugcugucgcagaaauacagagugcgcuccuggacugggcgcccagcacccacuccaguuaaacaaggacaccgucuguaaacccugccuggcggguuacuuuucggaugcauucucaagcacugacaaguguaggccuuggacaaauugcaccuuucuugggaaacggguggaacaucacggaacggagaagagugaugccguuuguuccucuagcuugccagcucgcaaaccgcccaacggcaaugugacuggcaacuccaauucaaccuucauuaguagcgggcaagucaugaacuuuaagggagacauaaucgugguauauguuucucagacaucccaggaaggugccgcagcugccgcggagccuaugggccgaccagugcaggaggaaacucuggccagaagggauucauucgcagggaauggaccccgguuuccugacccaugcggcggucccgaggggcuacgugaaccggagaaggcuagccgcccuguccaagaacagggaggcgccaaggcuuga

SEQ ID NO: 64022 - RNA, 1206 nt, Artificial Sequence
  derived and/or modified sequence opt3 from TNFRSF11B__Homo_sapiens__NP_002537
augaacaaucugcucugcugugcccuuguguuccuggacaucagcauuaaguggaccacacaggagacuuuucccccuaaauacuugcacuaugaugaagagacgucccaucaauuacugugcgacaaguguccaccgggcaccuaccuaaaacagcacugcacagcuaaguggaaaacugucugugcacccugcccugaucauuauuacaccgacucuuggcacacaucagaugaaugucucuauugcaguccaguuuguaaggagcugcaguacgugaagcaggaaugcaacagaacccauaauaggguaugugagugcaaagaggggcgguaucuugaaauagaguucugccugaagcaccgcagcugucccccuggauuuggugugguccaagccggcacuccagaacgaaacacagugugcaaacguugucccgacggguucuuuuccaaugagaccucuucgaaggcgccuugcagaaaacacacgaacuguucaguuuucggauugcuccugacucagaagggcaaugcuacccaugauaacaucugcagcgguaauagugaguccacacagaagugugggauugacgugacucugugcgaagaggccuuuuucagguuugcagucccaaccaaauucacaccgaacuggcucucuguguuaguagauaaucugcccggaaccaagguuaacgccgaaagcguggagcggaucaaacgccagcacuccucacaagaacagacguuucagcuuuugaagcuguggaaacaucagaauaaggaccaagauauugucaaaaagaucauacaggacaucgaucuaugugagaacagugugcagagacacauuggccacgcuaaucucacuuucgagcaacugaggagccuuauggaaucucugccuggcaagaaagugggggcagaggacaucgaaaagacaauuaaagccugcaagccauccgaccagaucuugaaacuccugucauuauggcggauaaagaacggagaucaggacacccugaagggucucaugcaugcucuuaaacacagcaagacuuaccauuuucccaaaacagucacccagagucugaagaaaacgauucgcuucuugcacucuuucaccauguacaagcuauaucaaaagcuguuucucgagaugaucggcaaccagguucaguccgugaaaauuagcugucuguga

SEQ ID NO: 64023 - RNA, 390 nt, Artificial Sequence
  derived and/or modified sequence opt3 from TNFRSF12A__Homo_sapiens__NP_057723
auggccagaggcagccugaggcggcuccuucgccuguugguguuagggcuguggcuagcucuccugcgauccgucgcaggagagcaggcccccgguaccgcgccuugcucucguggcucaaguuggagcgcugaccuugauaaguguauggacugcgccuccuguagagcaaggccacacucugauuucugccuggggugugccgcugcaccgcccgccccuuuucgguugcucuggccaauccugggaggcgcucugucgcucacauucguuuuaggucugcuuucaggguuuuugguguggcgcagaugcaggcggcgcgaaaaauucacuacgcccauugaggaaaccggaggcgagggcuguccugccguagcgcugauacaauga

SEQ ID NO: 64024 - RNA, 882 nt, Artificial Sequence
  derived and/or modified sequence opt3 from TNFRSF13B__Homo_sapiens__NP_036584
augagcggccuggggagauccaggcggggaggucgcucucgaguggaccaggaggaacguuucccccaaggccucuggaccggggucgccaugagaucaugcccugaggaacaguacugggauccacuucugggaacauguaugaguugcaagacuaucuguaaccaccagagccagaggacgugcgcugcauuuugucgguccuugucuugccgcaaagagcaaggcaaguucuaugaccauuuacugagagauuguauuucgugcgccucaauauguggucagcacccgaaacagugcgcguacuuuugugaaaauaagcuaaggagccccguuaaccucccuccagagcugcggcgccagcgaaguggggagguggaaaauaacuccgacaauucuggaagauaucaaggccuugagcauaggggcagcgaggcuucccccgcccugccuggguugaaacucucagcagaucagguagcccugguguacaguacccugggacucugcuuaugcgcuguccuguguugcuuccuuguggcaguugccugcuuuuugaagaagcggggugacccauguagcugucagccccguucucgcccuagacaguccccagcuaaaucaagccaagaucacgccauggaagcgggcaguccggugucuacaucccccgagccugucgaaacuugcagcuucuguuuuccagagugcagggcacccacccaggaaucggccgugacaccugggaccccagaccccacuugugcuggacgguggggcugccauacacgaaccacgguacugcagccguguccucacauccccgauucuggucuagggauuguuugcgugccagcccaagagggaggcccuggcgcauga

SEQ ID NO: 64025 - RNA, 555 nt, Artificial Sequence
  derived and/or modified sequence opt3 from TNFRSF13C__Homo_sapiens__NP_443177
augagaaggggcccccggagccugcgcgggcgagacgccccugcuccaaccccgugcgugcccgcagaguguuucgaucuccuuguccgucacugcguugccuguggacuguugagaacaccuaggccaaagcccgcgggugcuuccucuccugccccacggacugcauuacagccccaagaaucagugggcgccggggcuggagaggcagcccugccucuaccaggccuccuguuuggugcuccggcccuucugggguuggcgcucguacuggcacuggugcucgucggauuagugaguuggcgcagaaggcagcggcgccugcgaggcgccagcuccgcugaagcccccgacggcgauaaagacgcaccugagccacuugauaagguuaucauuuugucucccgggauaucggacgcuacggccccugcguggccacccccgggagaagauccugguaccacacccccaggccauucagugccuguccccgccacugagcuggggagcaccgagcuagugacaaccaaaacugcaggaccagaacagcaguga

SEQ ID NO: 64026 - RNA, 555 nt, Artificial Sequence
  derived and/or modified sequence opt3 from TNFRSF14__Homo_sapiens__NP_001284534
auggagcccccuggcgacugggggccaccgcccuggagaagcaccccuaagacagaugugcugaggcucguccuuuaccugacuuucuugggagccccaugcuaugcucccgcauuaccuuccuguaaagaagacgaguacccaguugguucugaaugcugucccaagugcucaccuggcuaucgggugaaagaggccuguggggaacugacgggaaccguaugcgagccauguccgcccggcacauacaucgcgcaccuaaacggucucaguaagugccugcagugucaaaugugcgauccugcuauggggcuucgcgccagccgaaauuguucccguacugagaacgcagugugcggaugcucuccaggccauuuuuguauuguccaggacggcgaucacugcgccgcuuguagagcauaugccaccucgucacccgggcagagggugcagaaaggagguacagaaagccaagacacccugugccagaauuguccuccaggcacuuucagucccaacgggacauuggaggaaugccagcaucagaccaaguga

SEQ ID NO: 64027 - RNA, 858 nt, Artificial Sequence
  derived and/or modified sequence opt3 from TNFRSF19__Homo_sapiens__NP_001191388
auggagugcgugcccuguggcgacccuccaccgcccuacgaaccucacugcgccagcaaggucaaccugguuaaaaucgcuuccaccgcaucuucaccaagagauacagcccucgcggcugugauuuguagugcccuugcaacuguacuguuggccuuacugauacuaugcgugaucuauuguaagaggcaguucauggagaaaaagcccagcuggucccuccggucucaagacauucaguacaaugggucggaacugucaugcuuugaucgcccucagcuucaugaguaugcucaccgagcauguugccagugucguagagacagcguccaaacgugcggaccagugaggcuguugcccaguauguguugcgaagaggccugcuccccuaacccagcuacccucgguuguggcguucauucugccgcgagccugcaggcacggaaugccgggccggcuggagagauggugcccacauucuuuggcucccugacucagucaaucugcggugaguucagugaugccuggccucucaugcagaacccaaugggaggggacaauauuagcuuuugugauucuuaccccgaauuaaccggcgaagacauccacucccugaacccugagcuugagucaagcacaaguuuggauucuaauuccagccaagaccuggucggcggggcagugccaguacagucgcauucugaaaacuucaccgcugccacugaucuaucccgcuauaauaacacacucguugagucagcgaguacccaggacgcccugacgaugagaagccagcuugaucaagaauccggagcagugauacaccccgcuacucagaccucucugcaggaggccuga

SEQ ID NO: 64028 - RNA, 1368 nt, Artificial Sequence
  derived and/or modified sequence opt3 from TNFRSF1A__Homo_sapiens__NP_001056
augggccugagcaccgugcccgaccuccuucugccuuuggucuuacuggagcuacucguugggaucuacccauccggagugauuggucugguaccgcaccuuggcgauagagaaaagagggacucugugugcccccaggggaaauauauacauccucaaaacaauucaaucuguugcacaaagugucacaaaggaacuuaccuguauaacgauugcccaggccccggucaggacacggauugucgggagugcgaaagugggagcuucaccgccuccgagaaucauuugcgccacugucucucuugcucgaagugucgaaaagaaaugggacaggucgagauuucaagcugcacaguggaccgugauacuguuuguggcugcagaaagaaccaguacaggcauuauuggagugagaaucuguuucaaugcuucaacuguucccugugccucaauggcaccgugcacuuaucuugucaggaaaagcagaacacagucugcaccugucacgcuggguuuuuccugcgggagaaugaaugcgugagcuguuccaacugcaaaaagucacuugaguguacuaaauugugccugccucagaucgagaauguaaagggaacagaagacagugguaccacgguucuacucccacuggugaucuuuuucggccuuugucuguugagccuccuguuuauuggguuaauguaccgcuaucaaagauggaaaucuaagcuguacuccauagucugcggaaagucaacucccgagaaagaaggcgagcucgaagguaccacaacuaagccucuugcaccaaacccgagcuucagucccaccccuggguuuacaccaacccugggauucucucccgugccuuccagcacguuuacuucgucuuccacauacaccccaggcgauugccccaauuucgccgcgccgaggcgggagguggcuccucccuaucagggcgccgacccaaucuuggcaacugcccuagcuucagauccuauucccaacccacugcagaaaugggaggacagugcacauaagccccagagccucgauacagacgacccugccacccuguacgcugucguugaaaaugugccaccgcuucgcuggaaagaguuuguacgaagacugggguuguccgaucacgaaaucgacaggcucgagcugcaaaacggacgguguuuacgugaagcccaguauucuaugcuggcgacguggcgcagaaggacaccccggcgagaggcaacccuagagcuccugggucgcgugcuuagagauauggacuugcugggcugccucgaagauauugaggaagcccugugugggccugcugcccuuccacccgcaccuagccuguugagguga

SEQ ID NO: 64029 - RNA, 1389 nt, Artificial Sequence
  derived and/or modified sequence opt3 from TNFRSF1B__Homo_sapiens__XP_011540365
auggcccccguggcugucugggcagcccuggcgguuggccucgagcuuugggcugccgcacacgcccugccugcucagguggcauucaccccauacgccccggaacccgggagcacaugcagauugagggaguauuacgaccaaacugcucagauguguugcuccaaguguucuccuggacagcaugccaaaguauuuugcacgaagaccucagauacagugugugacaguugcgaagauagcacuuauacccaguuauggaacugggucccagagugucuguccugcgguucucgguguucgucagaccaaguggaaacacaggcgugcacccgcgagcagaaucgaaucuguacuugccgucccggcugguacugcgcacuaagcaaacaggagggguguagacucugcgccccucugaggaagugucggccaggauucggcguugcucgccccgguacagaaaccagugauguggucugcaaaccuugugccccagggacguuuuccaacacuaccucuagcacagacauuugcagaccgcaccaaauauguaaugugguagcaauccccggaaacgcuuccauggaugccguuugcacuucaaccaguccuacaaggagcauggcgccaggcgccgugcaucuuccccagccugucucuacccggucccagcacacgcagccaacucccgagccgucaacagcaccuagcaccaguuuccuguugcccaugggcccaucuccucccgcugaaggguccacuggagacuuugcccucccagugggucugauugugggcgucacagcucuggggcucuuaaucauuggaguugugaauuguguaaucaugacccaagugaagaagaaaccccugugccuucagcgcgaggccaaggucccucauuugccagcagauaaagcccgaggcacgcaggguccggagcaacagcaucugcuaauaaccgcucccagcucgucuuccucaagucucgaaagcuccgcgucugcacuggacagaagggccccuacacggaaccagccacaggcucccgggguggaggccagcggagcaggcgaagcccgugcuucaacuggcaguuccgccgauagcucuccugggggacacgguacccaaguuaaugugacauguaucgucaacgugugcucaaguagcgaccacuccucucagugcucgagccaggcauccucaacuaugggcgauaccgacaguucuccaagcgagucccccaaggacgaacagguaccguucucaaaagaggagugugcguuucgcagccaacuugaaacaccugagacccuguuggggucuacugaagagaagccacucccccugggaguuccugaugcuggcaugaagcccuccuga

SEQ ID NO: 64030 - RNA, 1968 nt, Artificial Sequence
  derived and/or modified sequence opt3 from TNFRSF21__Homo_sapiens__NP_055267
augggcaccagccccuccucuucaacagcccuggcuaguugcagcagaaucgcaaggcgggccacugcgacgaugauugcugggucccuccuucuguugggauucuuaucuaccacaacugcccagccugagcaaaaggcaucgaaccugauagguaccuaccgccacguggaccgagccacaggccagguccuaaccugugauaaaugcccagcugggacuuauguuucagaacauuguacaaauaccagccuccgugugugcaguuccuguccgguaggaacguuuacuagacacgagaacggcaucgaaaagugccaugacuguucucagcccugcccuuggccaaugauugagaaacugcccugugcagcccuuaccgauagggaaugcacauguccuccagguauguuccagagcaaugcuacuugcgcgccccacaccgugugcccugucggguggggagugcggaagaaaggcacagagaccgaggacguucgcuguaagcaaugcgccagaggcacguuuuccgaugugccaucaagugucaugaaguguaaagcauacacugacugccugagccagaacuuggugguaaucaagccggggacaaaagaaaccgauaauguuuguggaacucuccccucuuucuccucaagcacaaguccuucuccagguaccgccauuuuucccaggccugagcauauggaaacgcacgaggugccauccagcaccuauguccccaagggcaugaacucgacagagucuaauuccucagcuagugugcggccgaaagugcugagcuccauccaggaagggacugucccugacaacaccucuagcgcccgcggaaaggaggauguuaauaagacacugcccaaccuccaggugguaaaucaccaacagggcccacaucaccgacauauauuaaaacugcuuccuucaauggaagcaacugguggggagaagaguuccacccccaucaaaggaccaaagagaggccaccccaggcagaacuugcacaaacauuucgacauuaaugaacaucugccuuggaugaucgugcuauuucuccugcuuguccuggugguuauuguggucugcagcauccggaagucuucacguacauugaaaaagggcccacgccaggauccgagugcuauaguggagaaggccgggcucaaaaagagcaugacccccacucaaaacagagagaaauggauuuacuauuguaauggacacgguaucgacauucugaaguuaguagcggcccagguuggcucccaguggaaagauaucuaccaauuccugugcaacgcaucugaaagggagguggcugccuuuucgaacggguauacggcugaccacgaacgggccuacgcagcccuccagcauuggacaauccgaggaccugaggcuagccuugcgcagcugauuuccgcauugcgccagcacagaaggaaugacgucguggaaaagauacggggccuaauggaggauaccacucaacuggagaccgacaagcucgcccugccaaugucacccaguccucuuucuccaagccccaucccguccccuaacgcuaaacuggaaaauucagccuugcucacagucgagccaagcccccaggauaagaacaaagguuucuuuguggacgaaucugagccucuguuacgcugugauuccaccaguagcgggucuuccgcacugucaagaaauggcaguuucauuacuaaggaaaagaaagacacaguucuacgucaggugaggcucgaucccugcgaccugcagccaaucuuugaugacaugcuucacuucuugaacccugaggagcugcggguaauagaagagauuccccaagccgaagauaagcucgaccgacuguucgagaucaucggagucaaaagccaggaggcuucgcagacgcuucuggacuccguguacucucauuugccagaucuccuguga

SEQ ID NO: 64031 - RNA, 903 nt, Artificial Sequence
  derived and/or modified sequence opt3 from TNFRSF6B__Homo_sapiens__NP_003814
augagagcccuggagggccccgggcucagccuucugugcuugguguuagcucugccugcacuacucccagucccggccguuaggggaguggcggaaacccccacauacccuuggcgggacgcugagacuggugaacgccugguaugugcccagugcccacccggcacguucgugcaacgaccuugucguagagauuccccaaccacaugcgggcccuguccuccaaggcacuauacucaguuuuggaacuaccuugagcggugccgcuauuguaauguccugugcggagaaagagaggaggaagcaagggccugucaugcuacccacaaccgggcaugccgcugucgaacaggcuucuuugcccaugcugguuucugcuuggagcacgccucuugcccgcccggggcgggagugaucgcaccuggcaccccaucacagaauacucagugucaacccugcccuccaggcacauuuagugccagcuccucuucgucagaacagugucagccccauagaaacugcaccgcucucgggcuggcccugaauguuccgggaagcaguucccacgacacgcucuguacuucuugcaccgguuucccuuuaagcacaagggugcccggcgcagaggagugugaacgggcugucauugauuuuguggccuuccaggacauauccaucaagcgucugcaacgccuuuugcaggcgcuggaggccccagaaggguggggaccuacucccagagcaggcagggcugcccuacagcucaaacugcggcgacgccuuaccgagcuguugggugcucaggauggggcccuccugguaagauuacugcaagcacucaggguugcccggaugccaggacuugaacgcucagugagagagagguuucugcccguccacuga

SEQ ID NO: 64032 - RNA, 1785 nt, Artificial Sequence
  derived and/or modified sequence opt3 from TNFRSF8__Homo_sapiens__XP_011540743
augagagugcugcucgccgcucuuggccuguuguucuuaggggcacugagggccuuuccccaggaccggccuuucgaggauaccugccacggaaacccaagccauuacuaugacaaggcgguccgccgauguugcuaccguuguccgaugggucuauuucccacacaacagugcccucagagaccaacugauuguaggaaacagugcgaacccgacuauuaccucgaugaggcugaccgguguacggccugcguuaccuguucccgcgaugaccugguggaaaagacaccuugcgcauggaacucuucaagaguaugugagugcaggccaggcauguucugcaguacuagcgccgucaauuccugugcucggugcuuuuuccacucugugugucccgcagggaugaucgugaaauuuccuggaaccgcccaaaagaauacaguuugcgaaccagcuucgccgggcgugucacccgccugugcgagcccugagaacugcaaagagccaaguuccgguaccauuccccaggcaaagccuacuccagucucucccgccacaagcuccgcuucaaccaugccggugcgcgggggaacgcgacuugcccaggaagcagcuaguaagcugacuagagccccugauagccccucuuccguaggcaggccaucaagcgacccuggcuugagucccacccagccaugucccgaggggucuggagauugccggaaacaaugugaaccugacuauuaccucgaugaggcgggucguugcacagccuguguuuccugcagccgcgacgaccugguggagaagacuccaugcgcauggaacucgucuagaaccugugaaugcaggccgggcaugauaugugcuacauccgccaccaauucaugcgcucgguguguccccuauccuaucugcgccgcagagacggugacuaaaccacaggauauggccgaaaaggacacaaccuucgaggcucccccucuggggacucagccagauuguaaucccacaccggaaaacggagaggcgccugcaaguaccagcccaacgcagucccucuuaguggacucucaagccagcaaaacccugcccauuccuacaucagcucccgucgcccuuaguuccacuggcaagccaguuuuggaugcagguccugugcuguuuuggguaauccuagugcucgucgugguuguggggagcucugccuuccugcuuugccaucgacgcgcuuguagaaagaggauucggcagaaacugcacuugugcuaccccguccagaccucacaaccaaagcucgagcugguggacagucgcccgagaaggagcuccacauuacguucuggagccucgguaacugaaccuguugcagaggaacggggccugaugagccagccccucauggagaccugucauuccgugggcgcggcuuaccuugaaucacugccauugcaggaugccagucccgcagggggaccuucuagcccacgagaccuacccgagccuagagucuccacagagcacaccaauaacaaaaucgaaaagauauauaucaugaaagccgauacugugauugucgguacggugaaggcugagcugccggaaggcagggggcucgccggaccagcagagcccgaacuggaggaggaacuugaggcugaccacacaccucauuacccagaacaggagaccgagcccccucugggcucaugcagcgauguuauguugucuguggaagaggaagguaaagaggacccgcuccccacugccgcguccgggaaguga

SEQ ID NO: 64033 - RNA, 306 nt, Artificial Sequence
  derived and/or modified sequence opt3 from TNFSF10__Homo_sapiens__NP_001177871
auggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaccccgcggaugaagcgccugugggccgcgaaguga

SEQ ID NO: 64034 - RNA, 954 nt, Artificial Sequence
  derived and/or modified sequence opt3 from TNFSF11__Homo_sapiens__NP_003692
augagaagggccagccgggacuacaccaaguaucugcgcggcuccgaggaaaugggagggggucccggcgcuccucacgaggggccacuccaugcaccgcccccuccagcgccccaccagccuccagccgcuucucgaucaauguucguggcccuucugggauugggcuuaggucaagucguuugcaguguggcacuguuuuucuacuuucgugcccagauggaucccaacagaaucagcgaagacgggacacauuguauuuauaggauacuacggcuccacgagaaugcugauuuccaggacacuacgcuggaaucccaggauaccaaacuuaucccugacucuugccgcagaauuaagcaagcauuucagggagccguacagaaagagcugcagcauaucgugggcucgcaacacauuagggcugagaaggccauggucgauggcucaugguuggaccucgcgaaacggagcaagcuggaagcacagccauucgcccaccugacaaucaacgcuacugauauaccgagugggucccauaaggugucucucagcuccugguaccacgaccgcggaugggccaaaaucucaaauaugaccuuuaguaacgguaaguuaauuguuaaucaggauggcuucuauuaccuguaugcaaacaucuguuuucgacaucacgagacaagcggggaccuugcuaccgaauacuugcagcugaugguguacgucacuaaaacaucuauuaagauccccuccucacacacccuaaugaaaggaggcagcacgaaguauuggagugguaauucugaguuccauuuuuacuccauaaacguagggggauucuuuaagcucagaagcggcgaggaaauuucgaucgaggugucuaauccuucccugcuugauccagaccaagacgccacuuauuucggcgcguucaaaguuagggauauugacuga

SEQ ID NO: 64035 - RNA, 750 nt, Artificial Sequence
  derived and/or modified sequence opt3 from TNFSF12__Homo_sapiens__NP_003800
auggccgcuagaaggagccagcggcgccgaggccguagaggggagcccggaaccgcacugcucgugccucuugcccuggguuugggcuuagcgcuggcuugccuagggcuccugcuugccgucguuucccugggaucuagggcaucauugagugcccaagaaccagcucaggaggaacucguggcagaggaagaccaggauccgagcgagcugaacccccagacagaggaaucccaagacccugccccauuccugaaucggcucguacgccccagaaggucugcuccuaagggccggaaaacucgcgccagacgagcgaucgcagcccacuacgaggugcauccaaggcccggucaggauggggcucaggccggagucgacggcacggugucgggcugggaagaggcacggauuaacucaagcaguccuuuacguuauaaucgccagauaggggaguuuaucguuaccagagcuggacuguacuaucuuuacugucaagugcacuucgaugaagguaaggccgucuauuugaaacuggaccuacucguggauggcguacuggcgcuuaggugccuggaggaauuuuccgccacagcagcuucuagcuuggggccacagcuccggcugugucagguuuccggauuacuggcccuccgaccgggcucaagucuucgcauuagaacucugcccugggcucauuugaaggccgcaccuuuccuaaccuacuuuggucuguuccaggugcacuga

SEQ ID NO: 64036 - RNA, 993 nt, Artificial Sequence
  derived and/or modified sequence opt3 from TNFSF12-TNFSF13__Homo_sapiens__NP_742086
auggccgcuagaaggucccagcggcgccgaggccguagaggggagcccggaaccgcacugcucgugccucuugcccuggguuugggcuuagcgcuggcuugccuagggcuccugcuugccgucguuucccugggaucuagggcaucauugagugcccaagaaccagcucaggaggaacucguggcagaggaagaccaggauccgagcgagcugaacccccagacagaggaaucccaagacccugccccauuccugaaucggcucguacgccccagaaggucugcuccuaagggccggaaaacucgcgccagacgagcgaucgcagcccacuacgaggugcauccaaggcccggucaggauggggcucaggccggagucgacggcacggugucgggcugggaagaggcacggauuaacucaagcaguccuuuacguuauaaucgccagauaggggaguuuaucguuaccagagcuggacuguacuaucuuuacugucaauccucugaugccuuggaagcgugggagaacggugaaaggagccggaagcgacgcgccgugcugacacagaaacagaagaaacagcacuccguccuacaucucgugccaauuaaugcaacuucaaaggacgauagugacguaaccgagguuauguggcaaccggcucugagaaggggccgggggcuucaggcccagggauauggcgugcgcauccaagaugcuggugucuaccuguuguauagccaggugcuguuccaggacgugacauuuaccauggggcaggucguuucuagagaaggacaaggcaggcaggagacucucuuccguugcauucgguccaugcccucacacccugaucgagccuacaacagcuguuacagugcaggcguguuucauuuacaccagggggacauccugucuguaauaaucccaagagccagggcuaagcucaaucuuagcccccacggaacauuccuggguuuugugaaauuguga

SEQ ID NO: 64037 - RNA, 801 nt, Artificial Sequence
  derived and/or modified sequence opt3 from TNFSF13B__Homo_sapiens__NP_001139117
auggacgauagcaccgagagagaacaguccaggcugacaucuugccucaagaaacgggaggaaaugaagcuaaaagagugugugucaauccugccccgcaaggaaaguccuagcguccgauccucuaaagacggcaaguuguuagccgcuacucugcuacucgcacugcuuucgugcugucugacgguugugucauucuaccaaguagccgcguugcagggggaucucgcuagccugcgugccgagcugcagggacaccaugcagagaagcucccagccggugcuggcgcaccgaaagccggguuagaagaggcucccgccgugaccgcgggacugaagauuuuugaaccuccagcacccggcgaggguaacaguucccaaaauucuagaaacaaaagggccguccaggggccugaggaaacaggaagcuauacuuucgugccauggcuuuuguccuuuaagcggggcucagcucuggaggaaaaagagaauaagauacuuguuaaggaaaccggcuacuucuuuaucuauggacaggugcucuacacagacaaaaccuaugccauggggcaccugauucagcgcaagaaaguccauguguucggugaugagcuuagucugguaacuuuguuuagaugcauccagaacaugcccgagacacucccuaauaacagcuguuacucugcaggcauugcuaagcuggaagagggggacgaauuacaacuggccaucccaagggagaaugcgcagauaucccucgauggagacguuaccuucuuuggcgcccuuaaacuguuguga

SEQ ID NO: 64038 - RNA, 669 nt, Artificial Sequence
  derived and/or modified sequence opt3 from TNFSF13__Homo_sapiens__NP_001185552
augcccgccagcuccccuuuccugcucgcuccaaagggcccgcccgggaacaugggagguccugugagagagccagcacuuucugucgcccugugguugucauggggcgcggcuuuaggggccguugcaugcgccauggcucugcuaacccagcaaacagaacuccagagucugaggcgggaggugagccgccuucagggaacuggcggucccucccagaauggggaaggauacccuuggcaaucucugccagagcagcacucgguauugcaucucgugcccaucaacgcaacgucaaaagacgauagcgacgucaccgaagugauguggcagccugcccugcgacguggcagaggccugcaggcucaaggguauggaguuaggauucaggaugccgguguguaccucuuauauagucagguccuguuucaggacgugacauucacuaugggccaaguaguuucccgggaggggcagggacgccaggagacccuuuuuagauguauaaggucuaugccaagccacccggaucgggcguacaauuccugcuauucagcaggcguguuccauuugcaccaaggugacauccugagugucauuaucccccgcgcccgagcuaagcuaaaccucagcccucaugggacauuucugggauucgugaaacuuuga

SEQ ID NO: 64039 - RNA, 723 nt, Artificial Sequence
  derived and/or modified sequence opt3 from TNFSF14__Homo_sapiens__NP_003798
auggaggaaagcguggucagacccuccguuuucgugguagacggccagaccgauaucccuuuuacaaggcuggggcggucucaccgccgacaaucaugcaguguggcccgugucggacucggucuucuguuguuacugaugggcgcugggcuagcagugcagggaugguuccuccugcagcuucauuggagacugggcgagaugguuacuagguugccagacgguccggccgggagcugggaacagcucauucaagagcggcgcucccacgaagugaaccccgcggcucaucugacgggagccaauucuucgcugaccggcucaggcgggccucucuuaugggagacacagcugggacuugcauuuuugagaggucugagcuaccacgauggcgcccuagucgugacuaaggcuggguauuacuauauauacaguaaaguacagcucggaggcguugguuguccacuggggcuugcauccaccaucacacauggacuguauaagaggacuccccgguacccugaggaauuggagcuccuggugucucagcaaagcccaugcggccgcgccaccuccucaagucgagucuggugggacagcucuuucuuaggcgggguggugcaccuggaagcuggagagaaagucguugugagaguacucgaugagaggcuugugcggcugcgugacgguacacgcuccuauuuuggcgccuucauggucuga

SEQ ID NO: 64040 - RNA, 579 nt, Artificial Sequence
  derived and/or modified sequence opt3 from TNFSF15__Homo_sapiens__NP_001191273
augcagcugaccaagggcagacuccacuucagccauccccuuucccacacaaaacauaucucuccuuuugugacugacgccccacugagggcugauggggacaagccgcgggcacacuugacggucguucgccaaacccccacacagcauuucaaaaaccaguuuccugccuuacacugggagcacgaacugggacuagcguucacuaagaaucgaaugaacuacaccaauaaauuucuccugauuccagagucaggugauuauuucauauacagucaggugacauuucguggcaugaccagcgaaugcuccgagaucagacaagcugggaggcccaacaagccugacucuauuacuguagugaucacaaaggucaccgauucguauccagaacccacgcagcuucugaugggaacuaaaucagugugugagguuggcagcaauugguuccagccuauuuacuugggugccauguuuagucuccaggagggggacaagcugauggugaacgucuccgauaucucucugguggacuauaccaaagaagauaagacauucuuuggagcauuccucuuauga

SEQ ID NO: 64041 - RNA, 600 nt, Artificial Sequence
  derived and/or modified sequence opt3 from TNFSF18__Homo_sapiens__NP_005083
augacccugcaccccagcccuaucacaugcgaguuccucuuuuccacugcccuuauuucuccaaagaugugucugucacauuuggaaaacaugccguuaagucacagcagaacgcagggcgcucaaagguccucuuggaaacuguggcuauucugcucgauagugaugcuccuguuucuuuguucauucagcuggcugaucuuuauuuucuugcagcucgagaccgcaaaggaacccugcauggccaaauuugggccucugccaaguaaguggcagauggcguccucugagcccccuugugucaauaaaguuagcgacuggaagcuggaaauccuccagaacggauuauaccugauuuauggucaaguggcuccaaaugccaacuacaaugauguagcacccuucgaggugcggcuuuauaagaacaaagacaugauccagacauugacuaauaaguccaaaauacagaacgucggcgggaccuacgagcugcaugugggagauacaaucgaccuaauuuuuaauucagaacaccagguucucaagaacaauaccuauuggggcaucauucugcuugccaacccucaauucaucaguuga

SEQ ID NO: 64042 - RNA, 402 nt, Artificial Sequence
  derived and/or modified sequence opt3 from TNFSF4__Homo_sapiens__NP_001284491
auggugagccacagauaccccaggauccaguccauuaagguccaauucaccgaguauaaaaaggaaaaaggcuuuauacugacaucucagaaggaggacgaaaucaugaaaguucagaacaauucagugauuaucaacugcgauggguucuaccucauuagucuuaagggauauuuuagccaggagguaaauaucucccugcauuaccaaaaggacgaagaaccuuuguuccagcugaaaaaggugcggucugucaacucguuaaugguggccucacuaacuuauaaagauaagguuuaccucaaugugacgaccgacaacacaagccuggaugacuuucacgucaaugguggcgagcuuauacugauccaucagaacccaggggaguucuguguguuguga

SEQ ID NO: 64043 - RNA, 705 nt, Artificial Sequence
  derived and/or modified sequence opt3 from TNFSF8__Homo_sapiens__NP_001235
auggaccccggccugcagcaagcccucaacgggauggcuccuccaggagauaccgcaaugcacgugccggccgguagcgucgcgucccaucuuggcacaacuucuagaucauacuucuaucugacgaccgcuacauuggccuuaugccugguuuuuacuguggcaaccaucauggugcuaguaguccagaggacagacaguauucccaauagcccugauaacgugccacucaaagggggaaauuguuccgaggaccugcuuugcauacugaaacgggcccccuucaagaaaucuugggcuuacuugcagguugcaaagcaccucaacaaaaccaagcugucguggaauaaggauggcauccugcauggugugcgcuaucaggacgggaaccucgucauucaauuuccuggauuauacuucaucauuugucagcugcaguuucuugugcagugcccaaauaacucaguagauuugaaacuggaacuacucaucaauaagcacauaaagaagcaagcccugguuacugugugugagagcggcaugcagacaaaacaugucuaucagaaccuuagucaguuccuguuggacuaccuccaagugaauaccacgaucuccgugaacgucgauacuuuucaguauauugacaccucuacauucccccuggaaaauguuuuaagcaucuuucuguacuccaacucagauuga

SEQ ID NO: 64044 - RNA, 765 nt, Artificial Sequence
  derived and/or modified sequence opt3 from TNFSF9__Homo_sapiens__NP_003802
auggaguacgccagcgacgcuucccuggaucccgaagcaccuuggccaccggcccccagagcgagggcuugccgggugcucccuugggcccuugucgcaggccuguuguuacugcuacuccuggccgcugcaugugccguuuuccuugcuugcccaugggccgugucuggggcgcgcgcaucacccggaagugccgcuagcccucgacugcgugaggguccagaauugucccccgacgauccugccggccuccuggaccugagacaggggauguuugcacaacucguagcucagaacguguuacugaucgauggaccacuuucuugguauucggacccgggcuuggccggugucucacugaccgggggacuaagcuacaaggaggauacaaaagaacucgugguugcgaaggccggcguguauuacgucuucuuucagcuggagcuuaggcgggugguagcaggcgaggggaguggauccguuucucuggcuuugcaccuccagccccugcgcagcgccgcuggugccgcagccuuagcucugacuguggaccucccuccagcguccucagaagcaagaaauagugccuucggcuuucaagggaggcuucugcauuugagcgcuggacagcggcuaggcguccaucugcacacggaggcccgcgcacgacacgccuggcagcucacccagggugcuacagugcuggggcuuuucagagugacucccgaaauuccugccggacugccaucucccagguccgaguga

SEQ ID NO: 64045 - RNA, 4059 nt, Artificial Sequence
  derived and/or modified sequence opt3 from TNIK__Homo_sapiens__NP_001155032
auggccagcgacucccccgcucggucucuggaugagaucgaccucucagcacuuagggauccugccggcauuuucgaacugguggaguuggucgggaacggaaccuacggucagguuuauaagggccggcacgugaaaacagggcaauuagcggcuauaaagguaauggacgugacuggagaugaagaggaagagaucaaacaggagauuaauaugcugaagaaauacagucaucaccgcaacaucgccacguauuacggcgcauuuauuaagaagaauccaccggguauggacgaucagcuauggcucgucauggaguucugcggggccggaagcgugaccgaccugaucaaaaacacaaagggcaauacucuuaaagaggaauggauagcuuauaucugucgagagauucugcguggcuugucccaucuccaccagcauaagguuauccacagagauauuaaagggcaaaacgugcugcugaccgagaaugcagaagucaagcucguggacuuuggaguaucugcccaguuagauaggacaguuggucggcgcaacaccuucaucggcacucccuacuggauggcuccugaggugauagccugcgacgaaaauccagaugcgacauaugacuuuaagucggaccuguggucacuugggauuaccgcaaucgagauggccgaaggagcucccccuuugugugauaugcacccaaugagagcccuguuccuaauucccaggaacccugcaccacggcucaaaagcaagaaauggaguaagaaauuucaguccuucaucgagucuugccuggucaagaaucauagccagcgcccggcuacggagcaacuuaugaaacaccccuuuauccgagaccagccuaacgaaagacaggugaggauucagcugaaggaucauauagaccggacuaagaaaaagcguggcgagaaagaugaaaccgaguacgaauacuccgguucagaggaggaagaggaagagaaugacaguggggaaccaagcucuaucuugaaccuccccggagaguccacacugcgcagagauuucuuaaggcugcaacucgccaauaaggagcggucagaagcgcuucgacgccagcagcuggagcaacagcagagagaaaacgaggagcacaaaaggcaguugcuagccgaacggcaaaagcgcauugaggaacagaaggagcagagaaggcgucuggaagaacagcaacggcgagagaaagaacucagaaagcagcaggagagggaacagcgccggcacuaugaggaacaaaugagaagggaggaggaacgccgacgggcagagcaugaacaggaguacauccguagacagcuggaagaggagcagaggcaacuugaaauacugcagcagcaauugcuccacgagcaggcucuguuacuggaauauaaacgcaagcagcuagaggagcagcggcaagccgaaagacuccagaggcagcugaaacaggagcgagacuaccuugugagcuugcaacaucagcgccaggaacagcggccugucgagaagaagccacuguaucacuacaaagaaggcaugagucccucugagaagccggcuugggccaaagagguugaagagagauccaggcucaaccgucaaagcucgccugcaaugccccauaagguggccaaucgcauuucugauccaaaccugccuccccgguccgaaucauuuaguaucagcggcguacagccagcuagaacucccccuaugcuuaggccaguggacccgcagaucccccaccuggucgcggugaaaucccaagggccugcauugaccgccucucagagcguucacgagcagccaacaaagggacucucagguuuccaggaagcucugaaugugaccagucaucgagucgagaugccccggcaaaacuccgauccuacgagcgagaauccacccuuaccgacucgcauugaaaaguuugacagaucuucauggcugaggcaggaggaagacaucccuccaaaagugccccagcggacaaccaguauuagcccugcccuagcacgaaagaacucccccggcaaugggucugcccucggaccaagacugggcucgcagccuauacgcgcuagcaaccccgaucuuaggcguacugagccaaucuuggaauccccgcugcaacggacaucaagugguucuagcuccucaagcucuaccccuuccagucagcccagcucucaagggggcucccagccaggaucacaggccggcaguagcgagagaacgaggguacgcgcaaauucgaaauccgaggggucucccguucucccucacgaaccagcgaaggugaaacccgaggaaagccgagacauuaccagaccuucacggccggcugaucugacagccuuagcaaaggagcugagggagcuucgcaucgaagagacuaaccguccaaugaaaaaggucaccgacuauaguuccucuagcgaagaguccgaaucaagcgaggaggaagaggaagauggagagagugaaacacaugacgguacuguggccgucucugauauccccagauugauuccuaccggcgcuccaggguccaaugagcaguacaacgugggaaugguuggcacacacggucucgagaccagccacgccgacucguucucagggucuauaagucgggaaggcacucugaugaucagggagacguccggagaaaagaaacgcagcggccauucugauagcaauggguucgcaggacacauuaaccuacccgaccuggugcagcagucccauaguccugcugguacaccgaccgagggccucgggcgaguaucaacucacagccaagaaauggauucuggaaccgaguacggcauggguuccucaacaaaggccaguuuuacccccuucgucgacccaagaguguaucagacuagcccuacagaugaggacgaagaggacgaagaguccucugcggccgcucuguuuacgucggagcuuuugcggcaggaacaagcaaaacugaaugaggccaggaagaucagcguugugaacgucaaccccaccaauauucgcccacauucagauacuccugaaaucagaaaauacaagaagagguucaacuccgagauauuaugugcugcccucuggggcgugaaucugcuuguagggacagaaaacggacugauguugcucgaccggaguggccaggggaaaguguauaaucugaucaaccgucgccgauuucagcagauggauguucuagagggacugaauguccucgugaccauuucuggcaagaaaaacaagcugagaguguacuaucuuagcugguugaggaaucggauccugcacaacgaccccgaggucgagaaaaagcaagguuggauuacaguuggggauuuagaaggaugcauccacuacaagguggugaaauaugaacgcauaaaguuccucguaauugcacugaaaaaugcggucgagaucuacgccugggcuccaaagccguaccauaaauuuauggccuucaaguccuuugcagaccuucagcacaagccucugcuaguggaucucacuguugaagagggccagagacugaaagugauuuucgguucacauaccggcuuucacgucaucgacguggauucugggaacagcuaugacauauacauccccagucauauucagggaaauaucacgccacacgcuauuguuaucuugcccaagaccgauggcauggagaugcugguguguuaugaagacgaggggguauacgucaacacauauggaaggauaacuaaagaugugguguuacaauggggcgaaaugccuaccuccgucgccuacauucacagcaaucagaucauggguuggggagagaaggcaaucgaaauucggucuguugagacagggcaucucgacggcguguucaugcacaaacgagcccagagacugaaguuucuuugcgagcgcaacgacaaaguauucuucgcuucagugagguccgguggcaguagccaggucuuuuucaugacucugaacagaaauucgaugaugaacugguga

SEQ ID NO: 64046 - RNA, 1752 nt, Artificial Sequence
  derived and/or modified sequence opt3 from TNIP1__Homo_sapiens__NP_001239315
auggaggccaccagacugaggcagaaggcugaggaacucgugaaagacaacgaacuucugcccccuccaagcccguccuugggcucuuucgaucccuuagcagagcugacagggaaggacucaaaugucacugccaguccuacggcgccagcuugccccagcgauaaaccugccccaguucaaaagcccccuuccucuggaaccucgucagaauuugaggugguaacaccagaggaacagaacagcccggagaguuccucucacgcaaaugccauggcucuagguccccucccucgggaagacggcaaccugaugcuucaucugcagcgcuuggagacuacccucagcgugugugcagaggaaccagaucacgggcagcuguucacacaucugggacgaauggcccucgaguuuaaucguuuagcuuccaaaguccacaagaacgaacaaagaaccucaauccugcagacucuuugcgagcaguugaggaaggaaaaugaggcccugaaagcgaagcuagacaaaggccucgagcagcgggaucaagcagccgaacgccugagagaggaaaaccuugagcugaagaaauugcucaugaguaaugguaacaaggaaggggcuagcggaaggcccggcucuccuaagauggagggcacagggaaaaaggccguggcaggacagcagcaggcuuccguuaccgccgguaaagugccagaggucguggcgcugggcgccgcagaaaagaaaguaaagauguuagagcaacagcggucagaacugcucgagguuaauaaacagugggaccaacauuuccgcagcaugaagcagcaguacgaacagaagauuacggagcuucgacaaaaacuggcugauuugcagaaacaggugacugaccuagaggccgaaagagagcagaaacaaagggauuuugaccggaagcugcuccuggcuaaaaguaagauagaaauggaggagaccgauaaggaacagcuuacagccgaggcaaaagaacugcgucagaaggucaaauauuugcaggaccaacucucuccccugacucgccagagagaguaccaggaaaaggagauccagagguuaaacaaagcccuggaggaagcucuauccauucaaaccccgccuagcucgcccccaacagcguucgggucuccugagggagcaggcgcccuccugcggaagcaggaacuugugacccagaaugaguugcugaagcaacaggugaaaaucuuugaagaggacuuccagcgagagcgcuccgauagagaaaggaugaacgaggaaaaggaggaacucaaaaagcaggucgagaaacugcaagcucagguuacgcuuucaaaugcccagcugaaggcauuuaaggacgaggaaaaagcccgggaggcuuugcgccagcaaaagagaaaagccaaggcaaguggugaaagguaucacguggagccccacccagagcaucucuguggggcguaccccuaugcuuacccuccaaugccggccaugguaccccaccauggauucgaagauuggagccagauucguuauccuccacccccuauggcaauggagcacccacccccgcugccuaacucccgguuauuucaccuaccagaauacacuuggcgacugcccugcggcggcgugagaaacccuaaucagucuagccaggucauggaucccccaacagccaggccuaccgagcccgaaucaccaaagaacgaccgcgaggggccgcaauga

SEQ ID NO: 64047 - RNA, 969 nt, Artificial Sequence
  derived and/or modified sequence opt3 from TNIP2__Homo_sapiens__NP_001154999
augcagcaacugcucagccagccccagcacgagagagaaaaggaggugguccuucugaggcgguccauggccgaaggcgagcgcgcucgagcagccucugacguuuugugccguucauuagcgaacgaaacccaucagcugagaaggacacuaacugcuacggcccacaugugucaacaucucgcaaaaugccuggaugagcggcagcacgcccagcgcaaugugggggagagaaguccugaccagagcgaacauaccgauggacacacauccguacaaucugugaucgagaaacuucaggaagagaacaggcuguugaagcagaaggucacucacguggaggaccucaaugcuaaauggcagcgguacaacgcaucgcgcgaugaauauguucgaggucugcaugcccaacugagaggccuccagauuccacacgagccggaauuaaugaggaaggagauaucacggcugaaucgucagcuugaagagaagaucaacgacugugcugaggugaaacaagaauuggccgcgagccgcaccgcaagagaugccgcucuggagaggguccagaugcuagaacagcagauucucgccuacaaggacgauuucaugagugagcgggcagaccgagaacgcgcucaauccagaauccaggagcuggaggaaaaaguggccucucuucugcaucagguaagcuggaggcaggauucccgggagcccgacgcggggcgcauucacgccggaucaaagacagcaaaauauuuggcugccgaugcucucgaacugaugguuccuggcgguuggagaccagggaccggaagucaacagcccgagccuccagccgaaggcggccaccccggggcagcccagaggggacagggugacuuacaaugcccucauugucugcagugcuuuagcgacgagcagggcgaggaacuccuucgucacguggcugaguguugccaguga

SEQ ID NO: 64048 - RNA, 1110 nt, Artificial Sequence
  derived and/or modified sequence opt3 from TNIP3__Homo_sapiens__NP_001122315
augaacaagaaugagaaacacgacgauaagcuggugauguucaccaaccagagcgaagacuccgagagaugcgaaucuauggagcucgauaaaaagauccaagaccuuauugaaaggaaugccucaccccauccuaaacgguuuacaccagaggcuaugccgacucaccgcaaccuguguaguuugaagacgcccggcaagaccgcaagcauggcccauuucguccaggggacaucccgaaugauagcggcugagucuucgacugaacacaaagagugcgccgaaccuucaacccguaagaauuuaaugaacagccuggagcagaaaaucagaugucuagagaagcagaggaaagaacuccuggagguuaaucaacagugggaucagcaguuucggaguaugaaggaacuuuacgagcgcaagguggcagaacugaaaacaaaguuggacgccgcugagagauuccucuccaccagggagaaagauccacaucaacggcagcgcaaggacgaucgacagagagaagacgauaggcagcgggaccugacucgugaucgccugcaaagagaggaaaaagagaaggaaaggcucaacgaggaguuacacgaacugaaagaggaaaauaaacuuuugaagggaaagaacacacuggcaaauaaggagaaagaacacuaugagugcgagauuaagcggcuaaacaaagcccuccaggacgcucugaauaucaaguguucuuuuagcgaagacugccuucgaaagucccgcguagaguucugucaugaagagaugagaaccgagauggaagugcugaaacagcaaguccagauuuacgaggaagauuuuaagaaagagaggucagaccgggaacgcuugaaccaggagaaggaggaacuccagcaaaucaaugagacgagucagagccagcugaacagauuaaacucucagauaaaagccugccaaauggaaaaggagaagcuggaaaaacagcucaagcagauguauugucccccuugcaauuguggucuuguguuccaucugcaggauccauggguucccacuggcccuggggcggugcaaaaacagagggagcacccagucuacccgcaguga

SEQ ID NO: 64049 - RNA, 1986 nt, Artificial Sequence
  derived and/or modified sequence opt3 from TNK1__Homo_sapiens__XP_011522347
augcugcccgaggccggcagccucuggcuucugaaguuguuaagagacauccagcuggcucaauucuacuggccuauucuagaagaacucaacgugaccaggccagaacacuuugauuucgucaaaccggaggaccuggaugggauaggaaugggucggcccgcacagcgccgacuuuccgaagcccugaagcguuugagaucuggcccuaaaucaaagaauuggguuuauaaaauccucgggggauuugcgccagagcauaaggagcccacacugccuagugacagcccaaggcaucugcccgaaccugagggcggucucaagugcuuaauuccagaaggggcugugugucggggagagcugcuuggcuccggcugcuucgggguagugcaccgcggauuguggacucugccgucugguaaaucgguccccguggccguuaagucacuaagagugggcccugaggggccaaugggaacggaacucggcgauuuucugagggaggucagcgugaugaugaaccuugaacacccccauguacugcgguugcacggucucguucuggggcagccuuuacagauggugauggagcuggcaccacucggaagucuucacgcccgccugaccgcucccgcaccgacaccucccuugcuagucgcccugcucugucuguuccuucgacaacuggcuggcgccauggcguacuugggcgcaagagggcucgugcauagggaccuggccacucggaauuuacugcuagcuuccccacguaccaucaaaguggccgauuuuggacucguccgcccucuggguggcgcaagagggagguauguuaugggaggcccccggccaauucccuacgcuuggugcgccccugaaucucuucgacacggugcguucagcuccgccucagacguguggauguuugggguaacauugugggagauguucaguggcggagaggaaccaugggcaggcgugccgcccuaucugauccuccagcgccuggaggauagagcuaggcuuccucggccaccccuguguagccgcgccuuguacucucucgcucugagaugcugggccccucauccagcagacaggcccuccuuuucacacuuagaagggcugcuacaggaggccggaccgagcgaggcuuguugcguccgugaugugaccgagccuggugcgcuccggauggagacuggcgacccaauaacaguuaucgaagggagucccgauucuaccauuuggaagggacagaacggccgaacguucaaaguggguuccuuuccugcaagcgccgucacucuggcugacgccgggggccuucccgcaaccagaccagugcacaggggaacacccgcccgcggcgaccaacaucccgggucgaucgauggagaccggaagaaggcuaauuugugggaugccccaccggcaagaggucagaggcgcaacaugccucuggagcgaaugaaaggcauuucucggucccucgaaucaguacugaguuuagggccccguccaacuggaggcgguagcuccccuccugagaucagacaggcgagggcuguuccacaggggcccccuggccugccgccacggcccccucuuucuagcucaaguccacaacccucccagccuagccgcgaaagauugccguggcccaagaggaaaccaccucacaaucaucccaugggaaugccaggcgcccgaaaggcagccgcucucucugggggacugcuaucagacccugagcugcagcgcaaaauaauggagguggaacucaguguccacggcgugacccaucaagagugucagacagcccugggugcaaccgggggagaugucgugagcgcuauucggaaccuuaagguugaccaguuguuccaccuguccucuagaucgagggccgauugcuggcguaucuuagaacacuaucagugggaccucagcgcggccucccgcuacgugcuggcucggcccuga

SEQ ID NO: 64050 - RNA, 3261 nt, Artificial Sequence
  derived and/or modified sequence opt3 from TNK2__Homo_sapiens__NP_001010938
augcuggaggccagacccccuaggacccagggcagcgacgcugcaggggccgcggcuggacggggucuccgcgcccuucuguuguccuuaacagcagccgcuggcaucugggggucuaugggagaacgaucagcauaccaacgucuggccggcggugaggaagggccacagagacuaggaggcggcaggaugcagccggaggaagggacuggauggcuccuggagcuucugagugaggugcaguugcaacaguauuuccuccggcugcgcgaugaccugaacgucacgagacucagccacuuugaauacguuaagaaugaggauuuagagaaaauugguaugggcaggcccgggcagcggcgccugugggaggcugugaagcgaagaaaagcccuuugcaagaggaaauccuggaugucuaagguauucucgggaaagcgguuggaggcggaauuuccuccacaucacucacagagcaccuuccguaaaacaagucccgcaccuggcgguccagccggggagggaccccugcaaucccuaacuugucucauaggcgaaaaggaccugcgccuucuggagaaauugggcgaugggucuuuuggaguggucagaaggggugaaugggacgcuccuagcggcaagaccguguccguugccgugaaaugccucaagccagauguccugucacagccggaggcaauggacgauuucauccgggaggugaacgcuaugcauaguuuagaccaccgaaaucugauucgccucuaugggguaguucuuacacccccuaugaagauggugaccgaacuggccccauugggaagccuacuggauagacucaggaaacaucagggccacuuucugcuugguacucugucucgguacgcgguccagguggccgaggggaugggcuauuuggaauccaagcgcuucauccacagagaccucgcagcuaggaaccuguuacuggccacacgugaucuagugaaaauuggagacuuuggccucaugcgggcucugccccaaaaugacgaucauuacgucaugcaggagcaccgaaagguuccuuucgccuggugugcaccagaaucacuuaaaaccagaacguuuagccaugccagugacacuuggauguucggggugaccuugugggagauguuuacauauggacaggagcccuggaucggucugaacggcucucaaauacuccacaagaucgauaaagaaggggagaggcugccgcgcccugaagacugcccccaggauauuuacaauguaauggugcaguguugggcucacaagccagaggaccggccuacuuucgucgcgcuuagagauuuccuguuggaagcacagcccaccgacaugagggcccuccaagauuuugaggagccagacaagcugcauauccagaugaacgaugugauuacaguuaucgaaggacgcgcugagaauuacugguggcgaggccagaacacccggacguuaugcgugggucccuucccucguaaugucgugacuuccguagccgggcugagcgcacaggacauaucgcaaccacuacagaacucuuuuauucacacaggccauggagacuccgauccgagacacuguuggggcuuccccgacaggaucgaugaacucuaucuggggaauccuauggacccacccgaucuuuugucaguugagcugaguaccagccgcccuccacagcaucucggaggugugaaacgggagcccccgccuagaccaccccagccugccuuuuucacucaaaagcccacauacgacccagucuccgaagaucaggacccucugucuagcgauuuuaaaagguuaggccugcgaaagcccgggcuuccacgcggauuguggcucgcuaaaccgucagcccgggugccuggcaccaaggcaaguagagguuccggggcggaggucacgcugauugacuucggcgaagaacccgugguuccagcucuaaggcccugcgccccuagccuggcacagcucgccauggaugcuuguucucugcuugacgaaaccccaccccagucaccuacacgugccuugccgcgcccacugcaccccacuccugugguagauugggacgcacggccauuacccccuccgcccgcuuaugacgaugucgcccaagacgaggaugacuuugagaucugcaguaucaacagcacccucgugggagcgggcguuccagccgggccuucccagggacagacaaauuacgcuuucgugcccgaacaagcaagaccaccucccccacuggaggauaaccuuuuucugccgccucagggcggugggaagcccccaucuucggcccagacugcugaaauuuuccaggccuugcaacaggaguguaugaggcagcuccaggcacccgcgggaagcccugccccaucccccucaccuggcggugacgauaaaccgcaagucccaccccgagugccuauacccccacggccuacccgcccccacguacagcugaguccagcuccuccgggcgaagaggagacaucucaguggcccgggccagccagcccucccagagugccaccuagggaaccccuauccccgcagggaucacggaccccaagcccucugguucccccaggcucuaguccccucccuccgcgacuguccagcucucccgggaagacuaugccaacgacacaauccuuugcaucagacccuaaauaugcuacaccccaggucauccaggccccuggaccaagagcaggccccugcauucuuccuaucgugcgcgaugguaagaaagugaguagcacucauuacuauuugcugccagagaggcccucguacuuagaacguuaccaacgguuccucagagaggcccaguccccggaggaaccuaccccacugcccgucccucuucugcuaccacccccgucuaccccugcucccgcggccccaaccgcaacuguuaggccuaugccccaggcugcccucgacccaaaggccaacuucagcacaaauaacucaaaucccggggcucgcccuccaccgccccgagcaacggccagacugccucagcggggaugcccaggcgauggucccgaggcgggcaggccugcugacaagauacaaaugguggaacaguuguuugggcugggauuacgcccacguggcgagugucacaaagugcucgaaauguucgauuggaaccuggagcaggccgggugccaucuucugggaaguuggggccccgcacaccacaagagauga

SEQ ID NO: 64051 - RNA, 3501 nt, Artificial Sequence
  derived and/or modified sequence opt3 from TNKS2__Homo_sapiens__NP_079511
augagcggcagaaggugcgccgggggaggugcugcaugugccuccgcggcugccgaggcaguggaacccgccgcucgggagcuguucgaagcaugccgcaacggcgacgucgagcgaguuaagcgucucgugaccccugaaaaaguaaauucuagagauacagccgggaggaagucaacuccacuucacuuugcugccggauucggccggaaagacguggucgaguaccuguugcagaacggugcgaaugugcaagcacgcgaugacgggggauuaaucccgcugcauaacgccuguaguuuuggccacgcugagguugugaaucuacuccugagacauggcgccgaucccaacgcaagggacaauuggaacuauacgccucuucacgaagcugccauuaaggggaaaauagaugucugcaucgugcuguugcagcauggagcggagccaaccauucggaauacagacggucgcacugcccucgaucuggcagaccccagcgcuaaggccguacugaccggcgaauacaagaaagaugagcucuuagaguccgcucgaucugggaacgaagagaagaugauggcccugcuuacaccuuugaauguuaacugucacgcaucggacggaagaaaaucaaccccacugcaccuagccgcuggcuauaauagggugaagaucguccagcuccugcuucagcauggugcggaugugcacgcaaaagacaagggggaccuggugcccuugcauaacgccugcagcuacggacacuaugaagucacugagcuccugguuaagcacggcgcuugugugaaugccauggauuuauggcaauucacaccucugcaugaagcagccaguaaaaaccggguagaggugugcucccuccuucugucuuacggcgcugacccaaccuugcuaaacugucacaauaagagcgccauugaucuggcaccgacgccccagcucaaagagcgucuggcguaugaauuuaaggggcauucccuucugcaggcugcccgcgaggcagacgucacuagaaucaaaaagcacuugucacucgaaauggugaacuucaaacauccucagacccacgagacagcccugcacugcgcugccgcaaguccauaccccaagaggaagcaaauaugugaauuacugcuacggaaaggagcuaauaucaacgagaagacuaaagaguuucucaccccucugcauguugccagcgaaaaggcgcacaaugauguggucgaggugguaguuaaacaugaagccaaggugaacgcucuugacaauuugggucagacaucucugcaccgagcagccuacugcggccaccuccagaccugccgccugcuucuguccuaugggugugauccaaacauuaucucauugcagggauucacggcucuccaaaugggcaaugagaacguccagcagcuguuacaagaagguauuagccuggggaauagugaggccgacagacagcuacucgaggcagcgaaggccggcgauguggaaacugucaaaaagcugugcacagugcagucuguuaacuguagggacaucgagggacggcaguccacaccccuucauuuugcugccggcuacaaucgcgugagcguagucgaauauuugcugcaacacggggcagaugugcaugcuaaagacaagggaggucucguuccgcugcacaacgccugcucguacggccauuaugagguggcagaguuacuggucaaacacggggccgugguaaauguggcugaccuuuggaaguucacuccuuugcacgaagcggccgcaaagggaaaauacgagauauguaagcuccugcuacagcauggcgcugaucccaccaaaaagaacagagacgguaacaccccacuggaucucguuaaagacggggauacggacauucaggaucugcuuaggggcgacgccgccuugcuggaugcugcaaagaagggaugcuuagcccgugucaaaaagcucucuuccccugacaaugugaacugucgggauacccagggccgacacucaacaccccugcaucuugcggcuggguauaauaaccuggaaguggccgaguacuugcuccaacacggagcagacgucaaugcccaggauaaagguggccugaucccacuacauaacgcugcaaguuacgggcacguugacguggccgcgcugcucauuaaguauaaugcuugcgugaacgccacugacaaaugggcauuuacuccccugcacgaagccgcucagaagggaagaacacagcuuugugccuugcuguuagcacauggcgcugauccuacucucaaaaaucaagagggucagaccccacuggaccuuguaagcgccgaugacgucuccgcgcugcuaacagccgcaaugccgcccucugcucucccuagcugcuacaagccacaggugcugaacgggguuaggucacccggcgccaccgcugaugcauugaguuccggaccuagcucuccaucaagucugagcgccgccuccucuuuagacaaucucucgggcagcuucuccgagcugucaaguguggucucuagcuccgggacugaaggagcuucaagccuugagaagaaagaagugcccggcguugauuuuucuaucacgcaguucgugcgcaaccuggguuuggagcaccucauggacaucuucgaacgggagcaaauuacacuggauguauuggucgagauggggcauaaggaacugaaagagauaggaaucaaugcguauggccacagacacaaacuuauuaaggguguggaaaggcucaucuccggccagcaggggcugaacccguacuugacccugaauaccaguggaagcggcaccauauuaauugaccucucuccugaugacaaggaguuucaauccguggaagaggagaugcagucaacaguccgcgaacaucgagaugggggacacgcaggcgguaucuucaaccgguauaacauccugaagauucagaaaguuuguaauaagaaacuuugggagcguuacacccauagaaggaaggaagugagugaggagaaccacaaucaugccaacgaacgcaugcuguuucacgggagcccauucguaaaugcuaucauucacaaaggauuugacgagcggcaugccuauauaggcgguauguucggcgcagggaucuacuuugccgaaaacucguccaagucuaaucaguacguguauggaauuggcgggggaacuggcugccccguccacaaggacagaagcugcuacaucugucauaggcaacuacucuucugccgagugacacuggguaaaucauuucuacaguucagugcuaugaagauggcgcacuccccucccgggcaccauucuguuacgggacgcccaagcgugaacggccuggcccuugcagaguaugucaucuaccggggugaacaggcuuauccugaguaccucauuaccuaucagauaaugagacccgagggcaugguggauggguga

SEQ ID NO: 64052 - RNA, 3984 nt, Artificial Sequence
  derived and/or modified sequence opt3 from TNKS__Homo_sapiens__NP_003738
auggccgcuagcagaaggucccagcaccaucaccaucaccaucaacagcagcugcagcccgcaccuggcgccucugcgccaccgcccccuccacccccuccacucucacccgggcuugcuccuggaaccacaccagccaguccgacugcaagcggucuggcccccuucgcuuccccucggcacggcuuggcauuaccagagggggacggaucucgcgaucccccugaccgaccacguucgcccgauccgguggacggcacgucaugcuguagcaccacaaguacuaucugcaccgucgccgcugccccuguugugcccgcgguauccacaucuagcgcagccgguguggcuccaaacccugccggguccggaucaaauaacagucccucuagcuccucaagcccaaccaguucuuccagcucgucucccuccucaccuggcaguagccuggcagaauccccagaggcugccggcgucucuagcacugcgccgcuagggcccggagccgcagguccuggcacaggggugccagcuguuucaggagcccucagagaacugcuugaggcuuguaggaauggcgaugugagucgggucaagcgccugguggacgccgcaaacguaaaugccaaagauauggcugguagaaaguccagccccuugcacuuugcggcaggguucggaaggaaagacguuguggaacaucuccugcaaaugggcgccaacguccacgcucgggaugacggcgggcugauuccucuccauaaugccugcucuuuuggacacgcagagguggugucauuacugcuuugucagggugccgauccaaacgcucgcgacaauuggaacuacacccccuugcacgaggccgcaauaaagggcaaaaucgaugucugcauuguucugcuacagcauggggcggacccgaauauccgaaacacggacggaaagagugcucucgaucuggccgacccuagcgcaaaggccgugcuuacuggcgaauauaaaaaggaugagcuguuggaagcugccagauccgguaaugaggagaaacucauggcacuguuaaccccacugaacguaaauugucacgcuucugacgggaggaagucgacaccccuccaucuugccgcgggcuacaaccgggugcguauuguccagcuguugcuacaacacggagccgaugugcaugcuaaagacaagggcgggcugguuccucuccacaacgcaugcagcuauggacacuacgaagugacugagcugcuucugaagcauggugccugugucaaugcuauggauuuguggcaguucacaccccuccacgaagccgcauccaaaaaccgcguggagguaugcucacuguuacugagucauggcgcggacccaacccuaguuaauugucacgggaagucugccguggauauggcuccuacccccgaacucagagagaggcugacguaugaguuuaaaggacacagccuuuugcaggccgcacgggaagcugaccuggccaaggucaaaaagacucucgcacuggagaucauaaacuucaaacagccacaaucccaugaaacagcccuucacugcgcuguggcgucacugcauccgaagcgaaagcaggucaccgaguugcuccugcgcaaaggcgccaaugugaacgaaaagaauaaagauuuuaugacuccuuuacacguugcagcugagagagcccauaacgacgugauggagguacugcacaagcacggugccaaaaugaaugcucuagacacacucgggcagaccgcacugcauagggccgcgcuugcuggccacuugcaaacgugccggcugcuccugagcuacggaucugaucccuccaucauuaguuuacagggcuucaccgccgcacagauggggaacgaagccguccagcaaauccugagcgagucuacaccaauucgcacuuccgacguggauuauagacuuuuggaagcaucaaaggcaggagaccucgagaccguuaagcagcuguguaguagccagaaugugaacugcagggaucuagaaggucgucauucgacaccccugcacuuugccgcgggcuacaaucgggucuccgugguagaguaccuccugcaucacggggcugacgugcacgccaaagauaagggaggccuuguuccuuugcauaacgcauguucuuauggucacuacgaggucgccgaacuguuagugcgacauggggcuagcgugaaugucgccgaccucuggaaauucacuccacugcacgaggcagcugccaagggcaaauaugaaaucugcaagcugcuguugaagcacggagcggaucccaccaaaaagaacagagacggcaacacaccucucgaucugguuaaagagggggacaccgauauacaggaccuacugaggggagacgccgcacuccuggaugcugccaagaaaggcugucuugcucgcgugcaaaaguugugcacuccggagaauauuaacugucgggacacgcaggguagaaauucaacaccacugcauuuagcagccggguacaacaaucucgaaguggccgaguaucugcuugaacacggagcugauguaaacgcgcaggacaagggcggucugaucccccuacauaaugcagccaguuacggccacgucgauauugcugcccuccugaucaaauauaauaccugcgugaacgcaacugacaagugggccuuuaccccuuugcaugaggcugcgcagaaagggaggacacaacugugugccuuacuccuggcacacggagcugauccaaccaugaagaaccaggaaggccagacuccccuugaccuggccacagcagaugacauccgcgccuugcucauugaugcuaugccuccggaggcccugcccacgugcuucaaaccacaggcgaccguuguguccgcaucucuaauaagcccugccuccacucccucaugucugagcgcugccaguucuaucgacaaucuuacagggccacucgcugagcuggcagucggaggcgccuccaacgcuggugauggggccgcaggaaccgaacgaaaggagggcgaaguggcggguuuggacaugaauauuagccaauuucugaaaucguuaggccucgagcaccuucgggacaucuucgaaacagagcagauaacucuugauguucuggccgacauggggcaugaggaauugaaggagauuggaaucaacgcuuacggccaccgucauaagcucaucaaagggguggaaagacugcuaggaggccagcaagguaccaauccuuaccugacguuccacugcguaaaccaggggaccauucuucucgaucuggcccccgaggacaaggaauaucagucagucgaggaggaaaugcagucuacaaucagggagcaccgcgauggaggcaacgcugguggcauuuuuaaucgguacaacgugauaagaauccaaaaaguggucaauaagaaauugagggaacgauucugccaucgccagaaggagguuagugaggaaaaccacaaucaucacaacgagcggauguuauuucauggguccccauucauuaaugcuaucauccacaagggauuugacgaaagacacgccuauauuggcgggauguucggagcaggcauauacuuugccgagaacagcucuaaaagcaaucaguauguguacgguaucgggggaggcacuggcuguccgacccauaaggauagguccugcuauauuugucaccgucagaugcuguucugccgcguaacacucgggaaaucauuucugcaauucaguacuaugaagauggcucaugcgccucccggacaccacagcgugaucggucggccaucugucaacggccuugccuacgcagaauacgugauuuauagaggggagcaggcuuaccccgaguaucugaucaccuaccagauaaugaaaccugaagccccaucccagacggccacagcagcugagcaaaagaccuga

SEQ ID NO: 64053 - RNA, 954 nt, Artificial Sequence
  derived and/or modified sequence opt3 from TNMD__Homo_sapiens__NP_071427
auggccaagaaucccccugagaacugcgaagacugucacauccugaacgcugaggcauucaaaagcaagaaaauuugcaagucccucaaaauauguggccuuguguuugggauccuggccuugaccuuaauuguccuguucuggggaucuaagcauuuuuggccagaaguuccgaagaaagcguacgauauggagcacacauucuauucaaauggugaaaagaaaaagaucuacauggagauugaccccgugacuagaacggagaucuuuaggaguggcaacgggaccgaugaaacacuagagguacaugacuucaaaaauggauauacuggcauauacuuugugggucuccagaagugcuucaucaagacccaaauuaaagucaucccugaauuuagcgagccagaggaagagauugaugaaaacgaggaaaucacaaccacuuucuuugagcaguccgugauauggguucccgcugagaagccuauugaaaaucgggacuuccugaaaaacucuaagauccuugagauuugugauaaugugacaauguauuggaucaacccaacccugaucucggucucagaauugcaggacuuugaggaagagggggaggaucuccacuuccccgccaaugagaaaaagggaauugaacagaacgaacaaugggugguaccucagguuaaaguggagaagacgcgccaugcacgacaggccagcgaagaggagcugccaauaaaugacuacacugaaaacggcaucgaguucgauccgaugcuggacgaacguggcuauugcuguauuuacugcagaagggggaaucgguacugucgcagagucugcgagccccucuuaggauauuacccuuauccauacuguuaucaggguggcagggugaucugccgggugauaaugcccugcaacuggugggucgcucgcaugcuggggcgaguuuga

SEQ ID NO: 64054 - RNA, 486 nt, Artificial Sequence
  derived and/or modified sequence opt3 from TNNC1__Homo_sapiens__NP_003271
auggacgauaucuacaaggccgcuguggagcagcugaccgaagaacagaaaaacgaguucaaggcagccuuugacauuuucguccucggcgcggaggaugggugcauaagcacaaaagaacuuggaaagguuaugagaaugcugggucaaaaucccacuccugaggaguugcaggaaaugaucgacgagguggaugaagacggcuccgggacgguagauuuugacgaguucuuagugaugauggucagguguaugaaagaugacucuaagggaaagucagaggaggaacugagugaucuauuucggauguucgacaaaaacgcugauggcuauauugaccucgacgaacugaagaucaugcuucaggccaccggugagacaauuacugaagaugacaucgaggagcugaugaaagauggggacaagaauaacgauggacgcauagacuacgaugaauuuuuggaguucaugaaaggcguggaauga

SEQ ID NO: 64055 - RNA, 3900 nt, Artificial Sequence
  derived and/or modified sequence opt3 from TNN__Homo_sapiens__NP_071376
augagccugcaggagauguucagauuucccaugggccuccuucugggguccguguuguuagucgccucugcuccugcaacccuggaaccaccgggaugcucaaacaaggagcaacagguuacagugagucacacuuacaaaaucgacguacccaagagcgcccuagugcaggucgaugcggacccucagccacucuccgaugacggugcuucucugcuugcccugggcgaagcaagggaggaacaaaauauuauauuccggcauaacauccgcuugcagacgccccagaaagauugugagcucgccgggucggugcaggaccugcuggcucgaguuaagaaacucgaggaagagaugguggaaaugaaggagcaaugcucagcacagcguuguugccagggagucaccgauuuaagcagacacuguaguggccaugguacauuuucccuggagacuugcucuugucacugcgaagaggggagggaaggaccugccugugagcggcuugcuugcccaggcgccuguagcggccaugggcgcugcguggacggaagaugcuugugucacgaacccuauguaggugcggauugcggcuacccugcauguccagagaauugcuccgggcacggagaguguguuaggggcgugugccagugucaugaagacuucaugucagaggauugcagugaaaagcgguguccgggugacugcagcgggcacggauuuugugauaccggcgagugcuauugcgaagagggcuucacagggcuggacugugcccaagucgugacaccccagggacuacagcuccugaaaaacacugaggacucucuucugguguccugggaaccuucaagccaagucgaucauuacuugcucaguuauuacccacuggguaaggaguuaucuggcaaacagauucagguucccaaggaacagcacuccuaugagauccuggggcuccuuccuggaacaaaauacauugugacccugcgcaauguaaagaacgaagugagcucgucuccacaacacuugcuagcuacgacugaccuggccguccucggcaccgcaugggugacagaugagacugaaaauucccuggacguugaaugggagaaccccucaaccgaaguggauuacuauaaacuucgauacgguccgaugacagggcaggaggucgcugaggugaccguaccuaaaaguagcgaccccaaguccagauaugauaucacgggccugcauccaggaacugaauacaaaauaacaguugugccuaugaggggcgaguuggaagggaagcccauccuccugaauggacggaccgagauugacucuccaacuaacgucgugacagaucgugucaccgaagacacggccaccgugagcugggaucccguucaggcggugaucgacaaauauguaguccgcuacacaucagccgacggugauacuaaggagauggcagugcacaaagacgagaguuccaccguuuuaacaggccugaagccuggggaagcauauaagguguacgucugggccgagagaggaaaucagggcagcaaaaaggcugauacuaacgcccuaaccgaaauugacucuccagcaaaucucgugacagauaggguaaccgagaacacugccacgaucucaugggacccggugcaagcuacaauagauaaauacguuguccgguauaccagugcggacgaucaggaaacucgagaggugcugguggguaaggagcagagcuccaccguccuuacaggguugcgccccggcguugaauacaccgugcaugugugggcacagaaaggagacagagagucuaagaaggccgauacuaaugcuccuacagacauugauucgccaaagaaccugguaacggacagggucaccgaaaacauggccacugugagcugggaccccguucaagcagccaucgauaaguaugugguccgguacacauccgcuggcggggagacccgcgaagugccuguuggaaaagagcagucaaguacagugcucacuggucugagaccaggcauggaguauaugguacacgucugggcccagaagggggaccaggaaucuaaaaaggcagauaccaaggcgcaaacggacauugauagcccccagaaucuugugaccgacagggugacagagaacauggcuacugucuccugggauccgguucgugccaccaucgaccgguacgugguacgauauacaucagcaaaagauggagaaacuagagaggugccugucggcaaggagcagagcucuaccgugcugacggguuugaggccagggguugaauacacagugcaugucugggcccaaaaaggcgcucaggaguccaagaaagccgacaccaaggcacagacugauaucgacaguccccagaaucucgugacagauuggguuaccgaaaacacugcuaccgugagcugggacccuguccaagccacaauugaccgcuacguagugcacuauacgucugcgaauggagagacccgggaaguucccgugggcaaggagcaguccucaacuguccugacaggguuaagaccaggaauggaguacaccgugcacguaugggcccagaaaggcaaccaggaaaguaagaaagcugauacaaaggcacaaacugagauagacgguccuaaaaaucuggugaccgauugggucacggaaaacauggccacaguuagcugggaccccgugcaggcuaccaucgauaaguauauggugagguacacuucggccgacggggagacccgcgaagucccagugggaaaagagcauuccucuacaguucuaacuggccuccgaccggguauggaguauaugguacacgugugggcacagaagggcgcgcaggaaagcaagaaagccgauaccaaggcucaaacagagcuggacccuccccggaaucuucguccaucagccgucacgcagagugggggaauuuugaccuggacucccccuuccgcacagauccauggcuacauacugacauaucaauuuccagaugggaccgugaaagaaaugcagcucggaagagaggaccagagguucgcucugcagggcuuagaacaaggugccacuuaccccguuucucugguggcauuuaaagggggacgccggagcagaaacgucuccacaacccuuucaacggugggcgccagguucccucacccgagcgauugcagucagguacagcaaaauucuaacgcugcguccgguuuguacacuauuuaucuccacggcgacgccagccgaccacugcaggucuacugugacauggagaccgaugggggaggcuggaucguguuucagcgccggaauacagggcagcuagacuucuuuaagagauggaggucguauguugagggauucggcgaucccaugaaggaguucuggcugggucucgacaagcugcauaaccuuaccacugggaccccugcacguuacgaggugcgcgucgauuugcagaccgcuaaugaaucagccuaugccaucuacgacuuuuuccaaguggcuucuaguaaagagcgguauaagcugacaguuggaaaauacagaggcacugcuggugaugccuuaaccuaccacaacggcuggaaguuuacgacauucgacagggauaacgacauugcgcucuccaauugcgcucugacccaucacgggggauggugguauaaaaacugucaucuugccaauccaaacggccgauacggggagacuaagcacagcgaaggagugaauugggagcccuggaagggccacgaauuuucuaucccuuaugucgagcugaaaauucggccgcaugguuacagccgcgaacccguguuggggagaaagaaaaggacccuccggggacgacugagaacauucuga

SEQ ID NO: 64056 - RNA, 564 nt, Artificial Sequence
  derived and/or modified sequence opt3 from TNNI1__Homo_sapiens__NP_003272
augcccgagguggaaagaaagccuaaaaucaccgccagcaggaagcugcuccuuaaaucccugauguuggcuaaggcaaaagagugcugggaacaggagcacgaggaacgggaggccgaaaagguccgcuacuuagcggagcguauuccaacacugcaaacucgaggccuaucucucucagcucugcaggaccuuuguagagaacugcaugccaagguugaggugguagaugaggaaagguaugacauagaggcaaaaugcuugcacaacacgcgggaaaucaaggaucucaaacugaaggugauggaccugcgcgggaaauucaagagaccgccccucaggcggguccgcgugagugccgaugcuauguuacgagcacugcuuggaagcaagcauaaaguuuccauggacuugagagccaaucugaagucugugaaaaaggaggauaccgaaaaagagaggccugucgaggugggugacuggcggaagaacguagaagcuaugucgggcauggaggggcguaaaaagauguuugaugccgcgaagucaccaacaagccaguga

SEQ ID NO: 64057 - RNA, 549 nt, Artificial Sequence
  derived and/or modified sequence opt3 from TNNI2__Homo_sapiens__NP_001139313
augagccagugcaagaaaagaaacagggccaucaccgcucggcgccaacaccugaaguccgugaugcuccagauugcagccacagagcuugaaaaagaggaaucucgacgugaggcggaaaagcagaauuaccuggcugagcauugucccccuuugcacauaccaggcucaaugagugagguccaggaauuaugcaaacaacugcaugccaagaucgacgcagccgaggaagagaaguaugauauggagguuagagugcagaaaacuagcaaggaacuagaggacaugaaccagaaacucuucgaucugagggggaaguuuaaacggccgccccuucgcagaguaaggauguccgcugacgcaaugcugaaggccuugcucggaucuaagcacaaaguguguauggaucugcgggcuaaucugaagcaggucaaaaaggaagacacggagaaagaacgcgaucuccgagacgugggugauuggagaaagaacauugaggagaaaucgggcauggaagggaggaagaagauguucgagucagaaagcuga

SEQ ID NO: 64058 - RNA, 633 nt, Artificial Sequence
  derived and/or modified sequence opt3 from TNNI3__Homo_sapiens__NP_000354
auggccgacggcagcuccgaugcugcaagagagcccaggccugccccagcgccgauccggcgccgaucuucaaacuaccgugcuuaugccaccgaaccccacgcaaagaaaaagaguaaaauuagcgccuccagaaagcugcagcucaaaacacuucuguugcaaauagcuaagcaggaguuagaaagggaggcagaagaacggcgcggggagaaggguagagcccugucuacuaggugccagccucuagaacucgcuggacugggcuucgccgagcuucaggaccugugucggcaauugcaugcgcgcguggauaaagucgacgaggagcgauacgauaucgaggcaaagguuacgaaaaauauuaccgaaaucgccgaccucacacagaagauuuuugaucugagagggaaauucaagaggccaacucugcggcgugugcgcaucucggcugacgccaugaugcaggcacucuuaggagcuagagccaaggagucacuggaucuuagggcgcacuugaaacagguaaagaaagaagacaccgagaaggaaaaccgggaggugggcgauuggcgcaaaaauauagacgcccugagcgguauggaggggcgaaagaaaaaguuugaaaguuga

SEQ ID NO: 64059 - RNA, 756 nt, Artificial Sequence
  derived and/or modified sequence opt3 from TNNT1__Homo_sapiens__NP_001278703
augagcgacaccgaggaacaggaguacgaagaggaacaacccgaggaggaagccgcugaggaagaggaggaagaggaagagagaccuaagccauccaggccggugguucccccucugaucccacccaaaauuccugaaggcgagcgggucgauuucgacgauauacaccgcaagcgaauggagaaagaccuccuugaacugcagacauugaucgaugugcauuuugagcagcguaagaaagaagaggaagaguuaguagcacugaaggagagaauugaaaggcggcgcucugagagagccgaacagcaaagguuccggacugagaaggaacgcgagcgacaggcgaaacuagcugaggaaaagaugagaaaagaggaagaggaggccaagaaaagggcagaagacgaugccaagaagaaaaaggugcucucaaacaugggcgcucacuuuggagguuaucuggucaaagcagagcagaagcggggcaaacgucagacggggcgcgaaaugaaggugagaauccuuagugagaggaaaaagccacuggacauugauuacaugggagaggaacaauugcgggagaaggcccaggaacucagcgacuggauccaucagcuggaguccgaaaaauucgaucugauggcuaagcucaaacagcaaaaguaugagauaaauguuuuauacaaccgaaucucucacgcccagaaauuucgcaagggcgcggguaaggggagagugggagggagguggaaauga

SEQ ID NO: 64060 - RNA, 867 nt, Artificial Sequence
  derived and/or modified sequence opt3 from TNNT2__Homo_sapiens__NP_001001430
augagcgacaucgaggaaguggucgaggaauacgaggaagaggagcaggaagaggccgcuguugaagaacaagaggaagcagccgaggaagaugcggaggcugaagccgagaccgaggaaacaagagcagaggaagacgaggaagaggaggaagccaaggaggcugaagauggccccauggaggaauccaaaccuaagccaaggucuuucaugccgaaccuggugcccccuaaaauuccagacggggagcggguagauuuugacgauauacaccgcaagcgaauggagaaagaccucaaugaacuucaggcacugaucgaggcccauuucgaaaaccguaagaaggaggaggaagaguuggugucauuaaaagauagaauugaaaggcggcgcgcugagagagccgaacagcagaggauccggaaugagcgcgagaaggaacgacaaaacagacuggcggaggaaagggcacggcgugaggaagaggagaaucgcagaaaagccgaagacgaggcuaggaagaaaaaggcccuaaguaacaugaugcacuuuggagguuauauucagaagcaggcacagacugaacggaaaagcggcaagcgacaaacggagcgcgagaaaaagaaaaagauccucgcugagagaaggaaaguccuggccauagaucaucuuaaugaggaccagcugcgggaaaaggcgaaggaguuguggcaguccaucuacaaccucgaagccgagaaauucgaucugcaggagaaguuuaaacaacagaaguaugaaauuaaugugcugcgcaacagaaucaaugacaaccagaaaguuucuaagaccagggggaaggcaaaagugacaggacguuggaaguga

SEQ ID NO: 64061 - RNA, 753 nt, Artificial Sequence
  derived and/or modified sequence opt3 from TNNT3__Homo_sapiens__NP_001036245
augagcgacgaggaaguggagcaggucgaggaacaauacgaagaggaggaagaggcccaggaagaggaggaaguucaggaggaagagaagcccagaccuaaacugaccgcuccaaagaucccggaaggcgagaaaguggauuucgacgauauucagaagaaaaggcaaaacaaggaccucauggagcuucaggcacugauagauucccacuuugaagcccggaagaaagaggaagaggaauugguagcguuaaaggagcgcaucgagaaacgacgugcugaaagagccgagcagcagaggauucgggcagaaaaggagcgcgaaagacaaaauaggcuggccgaggagaaagcucggcgcgaagaggaagacgcaaagagacgagccgaggaugaccuaaagaaaaagaaagcucucucuucaaugggggccaacuauaguagcuaccuggcgaaggcagaucagaaaaggggaaagaaacagacagcccgggagaugaagaagaaaauccuugcugaacgucgcaagccccugaauauugaccauuugggugaggauaaacucagagacaaggccaaagaacugugggagacucugcaccagcucgaaaucgauaaguucgaguuuggcgagaaguuaaaaaggcaaaaguaugacauaaugaacgugcgggcacgaguccagaugcuggcuaaauucuccaagaaagccgggacgccugcgaagggaaaggugggcggucgcuggaaauga

SEQ ID NO: 64062 - RNA, 168 nt, Artificial Sequence
  derived and/or modified sequence opt3 from TNP1__Homo_sapiens__NP_003275
augagcaccuccagaaagcugaaaucucacggcaugaggcggucaaagagucgcagcccccauaaaggggugaagcgaggagguuccaaacguaaguacagaaagggcaaccucaaaucuaggaagcgcggggacgaugccaaucggaacuauagaucgcaccuuuga

SEQ ID NO: 64063 - RNA, 417 nt, Artificial Sequence
  derived and/or modified sequence opt3 from TNP2__Homo_sapiens__NP_005416
auggacacccagacacacagccugcccaucacucauacgcagcuccacuccaacucucagccucagucaagaaccugcacaaggcauugucagacuuucagucaaagcugccggcagucccaccgcggcucucgaucgcagucaagcagucaguccccagccucucaucguaauccgaccggggcucacagcuccucaggacaccaaagucagagccccaacacaucuccuccacccaagagacauaaaaagaccaugaacucccaccauucaccuaugaggccaacuauucuucacugucggugccccaaaaaucgcaagaaucuggaggguaaauugaagaagaaaaagauggcaaaaagaauacaacagguguacaagacaaaaaccaggagcaguggcuggaagucuaacuga

SEQ ID NO: 64064 - RNA, 2697 nt, Artificial Sequence
  derived and/or modified sequence opt3 from TNPO1__Homo_sapiens__NP_002261
auggugugggacagacagaccaagauggaguacgaauggaaacccgaugagcaaggccugcagcagauccuccagcuucugaaggaaagccaauccccugacacaacuauucagaggacgguccagcagaaauuggagcaauuaaaccaguauccagauuucaauaacuaccugauauuuguucuaaccaagcucaaaucugaagacgagccgacacggucacugagugggcuuauccugaagaauaacgugaaggcccacuuccagaauuuucccaacggaguaacugauuucauuaaaagcgagugcuugaauaacaucggugacuccucuccucucauucgcgcuaccgugggcauccugauaacaaccaucgcaucgaagggggaacugcagaauuggccagaucucuuacccaaacuguguucacuuuuggacagcgaggauuauaacacuugcgaaggagccuuuggcgcgcugcaaaagauuugugaggacagugcugagauccuagauuccgacguccucgaucgaccucugaauauuaugaucccaaaauuccuucaguuuuucaagcauucuagccccaagauacguucccacgccguggcaugcguuaaccaguuuauuaucucaagaacacaagcccugauguugcauauugacaguuucaucgaaaaucucuuugcucuggcaggggacgaggaaccugaggugaggaaaaacgucugucgggccuuagugaugcugcucgaaguacgcauggauagacuucugccacacaugcauaauaucguugaguacauguugcagaggacccaggaccaggaugagaacguggcucuagaagccugcgaguucuggcugacgcucgcggaacaaccgauuuguaaggacguccuggugcggcaccuucccaaacugauaccuguguuggucaacgggaugaaguauagcgauaucgacauuauccuccugaaaggagauguugaggaagacgagacuauaccagauucugagcaggacauucgcccccgauuucacagauccaggaccguggcacagcagcaugaugaagacggcaucgaggaagaggacgaugacgaugacgaaaucgaugacgaugacacaauuucagauuggaauuuacggaagugcagcgccgcugcccuggacguacuagcaaacguguaccgugaugagcuccugccucacauccuuccauugcugaaagagcuccuguuccaucacgaaugggucgugaaggagaguggcauucuuguucugggggcuauagccgaaggauguaugcaagguaugauccccuauuugccggagcucauuccucaccugauccagugcuuaucugacaagaaagcgcuggugcgcuccaucacuuguuggacccuaagcagauacgcccauugggucgugucgcagcccccagauacauaccucaagccucugaugaccgagcuuuugaaaaggauucuggacucuaauaagcggguacaggaagcagcuugcuccgccuucgcuacgcucgaggaagaggccugcacugaacugguucccuauuuagcauacauacuggacacacuuguguuugccuucucaaaauaucaacacaagaacuugcucauccuguacgaugcuauuggcacccuagcggacagugucgggcaucaccugaauaagccagaguauauccagaugcucaugcccccucugauucagaaauggaacaugcuuaaggaugaggacaaagauuuguuuccacuguuagaaugucucagcuccguggcaacugcccugcagucuggauuccuuccguacugcgagcccgucuaucaacgaugugugaaucugguucagaagacauuggcucaggccaugcucaacaaugcacaaccugaccaguacgaagccccagauaaagacuuuaugaucguggcucuggaucuacugagcggccucgccgagggucuggguggaaacauagaacagcuuguagcacgcucaaauaucuugacccugauguaccagugcaugcaagacaagaugcccgaggucagacagaguuccuucgcguuacucggcgaucugacgaaggcuuguuuucagcaugugaaaccuugcauugccgacuucaugccaauccuuggcaccaaccugaaucccgaguuuauuagcguuuguaacaaugcaacaugggccaucggggaaauaucuauucagaugggaaucgagaugcaaccguauauuccuauggugcuacaccagcucgucgaaaucauaaacaggccaaacacucccaagacccuguuggagaauacagcuaucacuauuggucggcugggcuacgugugcccucaggaaguagcccccauguuacagcaauucauccgcccaugguguaccucacucagaaacauuagggauaaugaggagaaagacagugcauuucgugggaucugcacaaugauaagcgugaacccuuccggaguuauucaggacuucaucuuuuucugugaugcugucgccucuuggaucaaucccaaggacgaucugcgggacauguucugcaaaauucuucacggcuuuaagaaccaggugggugaugaaaauuggcgaagauucucggaccaauuuccacugccguugaaggagaggcucgcggccuucuaugggguguga

SEQ ID NO: 64065 - RNA, 2664 nt, Artificial Sequence
  derived and/or modified sequence opt3 from TNPO2__Homo_sapiens__NP_001129667
auggacuggcagcccgaugagcaaggccugcaacaggugcuccagcuucugaaggacagccaguccccuaacaccgccacacagagaaucguccaggauaaauugaagcaguuaaaucaauucccagacuuuaacaauuaccugauuuucguucuaacuaggcucaaaucugaagaugagccgacgcggucacugagugggcuuauacugaagaacaaugugaaagcucacuaucagagcuuucccccuccaguagcagacuucaucaagcaggaaugcuugaacaauauuggagaugccuccucucucauccgcgcgaccauugguauccugauaacaacuaucgcuucgaagggcgagcugcagauguggcccgaacucuuaccucaacuguguaaccuuuugaacucagaggacuacaauaccugcgagggggccuuuggagcacugcagaaaauuugugaagauagcagugagcuacucgacuccgaugcccugaaucgaccacuuaacaucaugauucccaaguuccugcaguuuuucaaacauugcucuccuaagauccguagccacgcuauagcaugugugaaucaauuuauuauggacagagcccaggcuuugauggauaacaucgacacauucauugaacaucucuuugcccuggcggucgacgaugacccagaggugaggaaaaauguuugccgggcauuagugaugcugcucgagguccgcaucgauagacuuaucccgcacaugcauuccauuauacaguauaugcugcagaggacccaagaccacgaugaaaacguggccuuggaggcuugugaguucuggcuaacucuggccgagcagcccaucugcaaggaaguacucgcaucacaccugguucagcuuauuccuauccuggugaacggcaugaaguacagugagauagacauuaucuugcucaaaggugaugucgaggaagacgaggcugugccagauagcgaacaggacaucaagccccgguuucauaaaucucgcacagugacccugccucacgaggccgaacgaccagauggguccgaggacgcggaggacgaugacgaugacgaugccuuaucagacuggaaucugagaaaguguagcgcagcugcccuagauguccucgcuaacguuuucagggaagaacugcuuccccauuugcugccgcuccugaaaggacuucuguuccacccugaaugggugguaaaggagaguggcauuuuggugcucggcgccaucgcagaagggugcaugcaaggaaugguccccuaucugccagaguuaauuccucaccugauacagugucuaucugacaaaaaggcccucgugcgguccaucgcuugcuggacgcugagccguuacgcgcauuggguugugucgcagcccccagauaugcaccuuaagcccuugaugacugagcugcucaaacgcauucuggacgguaauaagagaguccaggaagcagccugcucugcuuuugccaccuuagaggaagaggcauguacagagcuggugccuuaucuuuccuacaucuuggauacucucguauucgccuuuggcaaauaccaacauaagaaccugcuaauccuguaugacgcuauugggacccucgccgauucaguuggacaccaucugaaucagccagaauacauacagaaacuuaugccgcccuugauccagaaguggaacgagcugaaggacgaagacaaagauuuauucccucuccuggagugccuuaguagcguggcaacagcgcugcaauccggcuuuuugccauauugugaacccgucuaccagaggugcgugacccucguccagaagacgcuggcucaagccaugauguauacucagcacccugagcaguacgaggcaccagacaaagauuucaugauuguggcccuagaccugcucucuggucuggcugaagggcuuggaggccacguugagcaguugguggcccggagcaauaucaugacacuguuauuucaauguaugcaggauucaaugcccgaaguacgacagaguuccuucgcacuccugggcgaccuuaccaaggcuugcuuuauucaugucaaaccguguaucgccgaguucaugccuauacuggggacuaaccuaaauccagaauuuaucagcgugugcaacaaugcgacaugggccauuggagagaucuguaugcagaugggugcugagaugcaacccuauguucagauggugcucaacaaucuggucgaaauuaucaaccgcccuaauacccccaagacguugcuggagaacaccgcaauaacaauuggcagauuaggguacgugugcccacaggaaguagccccuaugcuccagcaauucaucaggcccugguguacuucucugcggaacauucgcgauaaugaggaaaaggacucagcuuuuagaggaaucugcaugaugauaggcgugaacccaggugggguuguccaggauuucaucuucuuuugcgacgccguggcaaguugggugagcccgaaagaugaccuuagggauauguucuacaagauucugcacggcuuuaaagaccaggucggagaggacaauuggcaacaguucuccgagcaguuuccucccuugcucaaggaacgucuggcggccuucuauggcguuuga

SEQ ID NO: 64066 - RNA, 2580 nt, Artificial Sequence
  derived and/or modified sequence opt3 from TNPO3__Homo_sapiens__NP_001177957
auggagggcgccaagcccacccugcagcucguguaccaagcuguccaggcacuuuaucacgacccugauccaagcgggaaggaaagagccuccuucuggcugggagaguugcagaggucuguucaugcgugggaaaucucagaccaguuacugcaaauucggcaggauguggagaguugcuacuuugcugcccagacaaugaagaugaaaauacagacuagcuucuaugaacuaccgacggacucccacgcaucucuccgcgauucgcugcuuacccauauccaaaaccugaaggacuugucacccguaauugugacacagcucgcccuggcuaucgcagaucuggcccuccagaugccuagcuggaaagguuguguccagacuuuaguggagaaguacaguaaugacguuaccucccugccauuucuuuuggagauucugacagugcuacccgaagagguccacucucgaagccuccguaucggcgcuaacagaaggaccgaaauaaucgaggaucuggccuucuauuccucaacugugguaagucuucugaugacaugcguugagaaggcggggaccgacgagaaaauguugaugaagguguuucggugucucggaagcugguucaaucugggcgucuuagauucuaacuuuauggcaaauaacaaacugcucgcccuucuguucgagguguugcaacaggacaagacguccucaaaucuacaugaagcugccagcgauugcguguguagugcacuguacgcuauugagaacgucgaaacuaaucucccucuggccaugcagcuuuuucaagguguucugaccuuggagacagcguaucacauggccguggcacgcgaggaccucgacaaaguacugaacuacugcagaaucuucacugaauuaugugagaccuuucuggaaaagauugugugcacaccagggcagggacuaggcgaucucaggacccuggagcuuuugcugaucugugcuggccacccccaguacgaagucguggagauaucuuucaauuuuugguaucggcucggggagcaucuguacaagacgaacgacgaaguuauucacggaaucuucaaagccuauauucagcgccuucugcaugcuuuggcccgacacugccaacucgagccugaucacgaaggugugccagaggaaacugacgauuucggcgaguuuagaaugagggucuccgaccuggugaaggauuuaaucuuccugaucgggagcauggaguguuuugcacagcuauacucgacacucaaagaaggaaauccgcccugggagguaaccgaagccguucuguucauuauggcugcgauagcaaagucuguggacccugagaacaauccaacucuugucgagguguuggaaggcgucgugcggcugcccgagacaguucauaccgccgugcguuauacguccaucgaacucguaggugagaugucagaagucguggaucgcaacccucaguuucuggggaccgcuuuaguucuggccagacuuccauuggacaaaauuacagagugccucagugagcugugcagcgugcaggucauggcacuaaagaaacugcucucccaagaacccucuaacggaaucagcucagauccgacuguguuccuggacaggcuugccguaauauuucggcacaccaauccuauuguggagaacggccagacacaucccugucagaagguuauccaggaaaucuggccagucuugagugagacucugaauaagcaccgagcugacaaccgcauuguggaaagaugcuguaggugcuuacgguucgccgugcgcugugucggcaaaggguccgcagcgcuccugcaaccucuuguuacccagauggugaauguguaccauguacaccagcacagcugcuuucuguauuugggaucuauccucgucgaugaguacgguauggaggaaggcuguagacaggggcugcuagacaugcugcaagcucucugcauucccacauuccagcugcuugagcagcaaaacggauugcagaaucauccagauaccguggacgaucuguuuagguuagccacucguuucauacagcggucacccguuacgcuccugcgaagucagguggucaucccuauucuucaaugggcaaucgccagcacaacccuggaccacagagaugcuaacuguuccgugaugagguuucuacgcgaccucauccauacuggcguugccaaugaucacgaagaggacuucgaacugcggaaggaguugauuggucaggugaugaaccagcuggggcagcaauuaguaucucagcuccugcauaccugcuguuucugccuuccaccguacacacugcccgaugucgcagagguguugugggaaauaaugcaaguggacagaccuaccuuuuguagguggcucgaaaauucgcugaaaggccuaccaaaggaaacuacagucggagcuguuacggugacccacaaacagcugacugauuuccacaagcagguaacaagcgccgaggagugcaaacaggugugcugggcgcuucgcgacuuuacccgacucuuccgguga

SEQ ID NO: 64067 - RNA, 8907 nt, Artificial Sequence
  derived and/or modified sequence opt3 from TNRC18__Homo_sapiens__NP_001073964
auggacggcagagauuucgggccccagagguccgugcacggaccuccaccgccccugcucuccggucuugccauggacucucaucgggucggcgcugccaccgccgggcgccugccugcgucaggauugccaggccccuuaccuccagguaaguacauggcugggcugaacuugcacccccauccuggagaagccuuucucggcaguuucguugccagcggcauggggccauccgccucuucgcacggaucaccggugccccugccuagcgaucuuaguuuucgauccccaacacccucuaaucugccuaugguacaauugugggcugcccaugcccacgaagguuucagccaccucccauccggccuguaucccucauaccugcaucucaaccacuuagagccgccuaguagcgggucuccccugcuuucccaguugggacagccaucaaucuuugacacucagaaaggccaagguccugggggagauggcuucuaucugcccacggcuggcgccccagggagccuacauagucacgcgcccucugcccguaccccuggagguggccacuccagcggggccccagcuaagggaucgucuucccgggacggcccggccaaagaaagggcugguagagggggcgagcccccuccacucuuuggaaagaaagauccccgcgcuagaggcgaagaggccucagggccuaggggaguggucgaccugacacaggaggcgcgggccgaaggucgccaggaucgaggcccacccagacuugcagagaggcugaguccguucuuggcugaaagcaagacuaagaaugccgcucuccagccuuccgugcugaccaugugcaacgggggagccggcgacguugguuuaccagcacugguggccgaggcugggcggggcggagcgaaagaggcagcccgucaagaugaaggcgcucgccuccuuagaaggacagagacccuguugcccgggccucggcccugcccaucuccucuacccccaccgccugcaccaccaaagggacccccugcaccacccgccgcuacuccugccggugucuacacaguguuucgagaacagggccgcgagcauagaguaguugcaccgaccuucgugccaagcgucgaagcguuugacgagaggcccgggccuauucagauagcuucacaggcccgggaugcacgcgccagagagagggaagcuggacguccaggcgugcugcaagcacccccugguaguccgcggccccucgaccgaccagaggggcugagagagaaaaauuccgugaucaggagccuuaagcgcccucccccagcagacgcuccuacgguccgggccacuagagcgucucccgauccaagggccuauguuccggcuaaagagcuguugaagccugaagcagacccccgcccaugcgagcgagcaccccggggcccugcuggaccagccgcacagcaggcggccaaacucuucggccuggagcccgggcguccuccgccaaccggacccgaacacaaauggaagccuuuugaguuaggcaacuucgcugccacacaaauggcagugcuggcugcccagcaucaccauucaagagcagaagaggaagccgcuguaguggcggccaguagcuccaaaaaggcauaccuagaucccggugcuguccucccaaggucugccgccacuugugggcgcccuguggcugacaugcacucggcagcccacggaagcggcgaggcguccgcuaugcagucacugauuaaauauagugguucuuucgcccgggaugcaguugccgugagacccggcgggugcggaaagaaaagcccauuuggcgggcuuggaaccaugaagccugagccggcucccacauccgcaggcgccucaagggcgcaggcucgauugccacauagcggugggccugccgcaggaggcggucgccaacugaagcgggaccccgaaagaccagagucugccaaggcuuucggcagggaaggguccggagcccagggcgaggcagagguccgucacccucccguggggaucgcuguagccguugcgcgccagaaggauaguggaggcagcggucggcucgggccgggacugguggaccaggaaagaucucuuucccugucaaaugucaaaggccaugguagggccgaugaggacuguguggaugaccgagcacggcaccgcgaagagagauugcucggcgcuaggcuggaccgggaucaagaaaaguuacugcgagagaguaaagagcuagccgaccucgcuagacugcacccaaccagcugcgcaccuaacgggcuuaaucccaacuugauggucacgggaggcccagcccuggccgggucgggacgcugguccgcugaucccgcggcacaucucgccacucacccuuggcugccgaggucuggcaaugcuagcaugugguuagccggucaucccuacgggcugggaccaccuucacuucaccagggcauggcacccgccuuuccuccaggccuagggggaagucuccccuccgcuuaccaguucgugcgugacccucagucuggucaacugguugugauuccaagcgaucaucuaccccacuuugcggaacugauggagcgggccacaguaccgccucucuggccagcacuguaucccccuggcagauccccacuucaccaugcucagcaguugcagcuguucucacaacagcacuuuuuaaggcagcaagaguuccucuaccugcagcagcaggccgcacaagcccuugagcugcagcgcagcgcucaguugguccaggaacgacucaaggcccaagagcauagagcggagauggaagagaaggggaguaaacggggacuggaagcagccggcaaggcuggucuagccaccgcugggcccggacugcucccgaggaaaccucccggccuggcagccggcccagcugggacuuauggaaaggccgugucuccucccccaagcccccgcgcaagcccuguugcggcccuuaaagcuaaggugauccagaaguuggaggacgucucgaaaccaccggccuacgcauaucccgcuacaccuucaucucacccaaccagucccccuccagccucucccccuccgacgccagguauaacccguaaggaagaggcacccgagaacgugguagagaagaaagaucuggaguuagaaaaagaggccccuagccccuuucaggcucucuucucugacaucccaccuagauaccccuuucaggcgcugccaccgcauuauggccggccuuaccccuuccuucugcaaccaacagccgcagcugaugccgacgggcuagcccccgaugugccucucccagcagacggacccgagaggcuggcuuugagcccugaagauaagccgauucgccuguccccaucaaagaucacugagcccuuacgagaaggcccugaggaagaaccacucgccgagagagaaguuaaagcggaggucgaagacauggacgagggucccaccgaacugccuccccuugagaguccacugccguugccugcugccgaggcaauggccacacccagcccagcugggggauguggcggcgggcuccuggaagcacaggcccuaucugcgacuggacaguccugcgcugagccuucagaaugucccgauuuuguggaggguccagaaccucggguggacagucccggcaggaccgagccgugcacagccgcacuggaucuugggguccaacucaccccagagacucugguugaagccaaggaggaaccuguggaggugcccguagcugucccagugguugaggccgugcccgaagagggauuggcacaggucgcuccuagcgaaucccagccgacgcuggagaugucugacugugaugugccagccggcgaaggucagugccccucguuagagccucaagaggcgguucccgugcucgggagcacaugcuuccuggaagaggccucauccgaccaguuccuuccaagucuggaagauccuuuggcaggaaugaaugcucucgccgcagcugccgagcugccccaggcccgcccacuaccuucuccgggcgcggcuggcgcacaggcccuggaaaaacuugaggcugccgagagccucguacuggaacaauccuuuuugcacgggauuaccuuacugucagagaucgcagaacucgagcuggaaagaaggucucaggagaugggaggugccgagcgggcucuugucgcgcgucccagccuggaaaguuugcuagccgcaggcucccacaugcugcgcgaggugcucgacgggccaguggucgauccucugaagaaccuucgauuacccagagaacugaaaccaaauaagaaauacagcuggaugaggaagaaggaggagcggauguaugcuaugaaaucuucacucgaagacauggaugccuuggagcuggacuuccgcaugagacucgcagaaguucagaggcaguacaaggagaaacaacgggaacuggugaaacuucagcgaagacgcgauuccgaggacaggcgggaggaaccucaucguagucuggccagaaggggacccggccgcccgcggaaacgaacucacgcuccaagcgccuugucgccucccagaaagagggguaagucugggcauuccagcggaaaacuaucaaguaagucucugcucaccuccgacgauuaugaguuaggcgcgggcauacgcaaacggcacaaggggagcgaagaggaacacgacgcacugauuggaauggguaaagccagaggccguaaccagacaugggaugagcaugaggcuucaagugacuuuaucagccagcuuaagauuaagaaaaagaaaauggccuccgaucaagaacagcuggcaucuaagcucgacaaggcuuugagccugaccaagcaggauaagcucaaauccccauucaaguuuucagacucugccgggggaaaaaguaagacuucgggcgguugugggagguaccugacacccuaugauagccuucuaggcaaaaaccggaaggcucuggccaaaggauugggcuuaucccugaagucuucacgcgaggggaagcacaaacgagcagcgaagacgagaaaaauggaaguaggauucaaggccaggggucaaccuaaaagcgcucauucccccuuugccagugaggugucuagcuacucauauaauaccgacuccgaagaggaugaggaguuccucaaggacgaguggccagcacagggcccuaguagcucuaagcugacuccgucccuucugugcucaauggucgcuaaaaacagcaaggccgcagggggacccaaacucacaaagcggggcuuggccgcgccacgcacccugaaaccuaagcccgcuacaucgagaaagcagccauuuugucuacugcucagggaagccgaggcacgaucuaguuucuccgacagcucagaggaauccuuugaucaggacgagucuagcgaagaggaagaugaggaggaagaacuugaagaggaagacgaggccaguggugggggcuaccggcugggagcucgugagagagccuuauccccuggcuuggaagagagcgggcugggacuccuggcacgcuucgcugccucugcgcuucccucaccgacuguggguccuagucuguccguugugcaacucgaagcuaaacagaaggccaggaaaaaggaggaacggcagagcuugcugggcaccgaguuugaguacacggauucugaaucggaggucaaagugagaaagcgcucaccagcaggguuacuaaggcccaagaaaggacugggcgaaccugguccaagccucgccgcucccaccccuggggcacgaggcccagaccccuccaguccggauaaggccaaacuugcgguugagaagggacggaaagccagaaagcugaggggcccuaaggagcccggguucgaagcuggaccagaggcaucugacgaugacuuguggacacgccgucggagcgaaagaaucuuccugcacgaugccuccgcugccgcacccgcuccugugucaacugccccagcgaccaaaacaaguaggugcgccaagggcgguccccucucuccucgcaaagacgcagggcgagcuaaggaucggaaagacccaagaaagaaaaagaagggaaaagaggccggcccgggugcaggccugcccccuccaagggcccccgcacuuccuagcgaagcccgcgcgccacaugcuuccucacucacugcagccaagagaagcaaagcuaaggccaaagggaaggaggucaagaaagagaaucggggaaagggcggggcaguaucuaaacugauggaauccauggccgcugaggaagacuuugagcccaaccaggauaguagcuucucggaagacgagcacuugccgaggggaggcgcgguggagcguccucugaccccagcaccccgauccuguaucauugauaaggacgaauuaaaagauggucuacgcguucugauaccuauggacgauaagcuccuuuaugcagggcacgugcaaacgguccauucucccgacaucuacagagugguaguggagggagaacggggcaauaggccacacauuuauugccuggagcaguugcugcaggaagccaucauagauguccgcccggcuucaacaagauuucucccucaggguacccggauugcagccuacuggagccaacaguauaggugucuguaccccggcacuguugugcgagggcuuuuagaccuggaggaugacggagaucucaucacaguggaguucgacgacggcgauaccgggcguaucccauugagucauauuagacugcuacccccugacuauaagauccagugcgcugaaccaucccccgcccugcucgucccuucugcgaaacgccggagcaggaagacuucaaaagauaccggagagggcaaggacggugggacagcaggauccgaagaaccaggcgccaaagcuagaggccgcgggcggaagccgagugccaaggcaaaaggagauagggcugccacgcuugaggaagguaaccccaccgacgaggugccuagcacuccacuggcguuggaacccucuucaacaccuggcuccaagaaaagcccacccgagccuguugauaagcgagccaaagcuccgaaggcaagacccgccccaccucaacccucuccagcuccucccgcauuuaccaguuguccagccccggaaccuuucgcugagcugcccgccccagcaacaucgcucgcccccgcgccucugauuacuaugccagcuacccggcccaaaccuaagaaggccagggcagccgaggaauccggggcuaaaggaccgcgccgucccggcgaggaagccgaguuacuuguaaagcuggaccacgaaggugugacgagcccaaaaucaaagaaagcaaaggaggcucuccuacugagagaggauccuggggccggaggcuggcaggaacccaagucuuugcugagccucggcuccuaucccccugcggcagggaguucagagcccaaagccccauggccgaaggcuacagacggagaucuugcccaggaaccuggucccggccugaccuuugaggacucugggaauccaaaaagcccugacaaggcucaggcagaacaagauggagccgaggaguccgaaaguagcuccucuucaagcucgggcuccaguucuagcucauccucuaguagcuccucagguagcgagacugaaggggaggaggaaggagacaaaaacggcgauggcgggugcggaaccgguggccgaaauuguucugcggccaguuccagggcugcaagccccgccucaucuuccucgagcaguucuuccagcucaaguuccuccucuucaagcuccucuaguucgagcuccucaucuagcaguuccucaucuagcuccaguagcagcucauccagcaguucuuccucgagcucauccucuaguagcucauccagcucuaguuccagcucaucuucgagcacaacugacgaggauuccaguuguucuucagacgaugaagcugccccagcaccuaccgccgggcccagcgcucaggcggccuugccgacaaaggcaacgaagcaggcuggaaaagcccggccauccgcacacagucccggcaagaaaaccccugccccacagccccaagcuccuccgccccagccaacucagccucugcagcccaaggcgcaagccggugcaaaaucucgcccaaagaagagagaggggguccaucucccuacaaccaaagaauuagcuaagaggcagcggcugcccagcguggagaaccgcccaaaaauagccgccuuccuuccugcuagacagcuguggaagugguuuggaaaacccacucagcgaaggggcaugaagggcaaagcacggaagcuauucuacaaggccaucguucgugggaaagagaugauucgcaucggagacugcgcuguguuucucuccgcggguagaccgaaucugccuuacaucggcaggauucaaucaaugugggaaagcugggggaacaauauggucgugcggguaaagugguucuaccacccagaggaaacaucucccggaaaacaguuccaucagggccaacacugggaucagaaguccaguagaucauugccugccgcacugcgcgucagcucgcagcgaaaagacuuuauggagagggcccucuaucaguccucucauguggaugaaaacgacguucaaaccgugagucacaagugucuugucgugggucuggagcaguacgagcagauguuaaagacgaaaaaguaucaggauagcgaagggcuguacuauuuggcuggaacuuacgagccaaccacaggcaugauauucucaaccgacggcguucccgugcucugcuga

SEQ ID NO: 64068 - RNA, 5889 nt, Artificial Sequence
  derived and/or modified sequence opt3 from TNRC6A__Homo_sapiens__NP_055309
augcgggaacuggaagccaaggcuaccaaagacguggagaggaaucucucccgggaucuuguccaggaagaggaacaacugauggaggagaagaaaaagaaaaaggacgauaagaaaaagaaagaagcagcccagaagaaagcgacugagcagaagaucaagguucccgaacagauuaaaccuuccgugucucaaccacagccggcuaauucaaacaauggcacaaguacggccaccagcacaaacaauaacgcaaagcgcgccacugcuaauaaccagcagccccaacagcagcagcaacagcagcaaccucagcagcagcaaccacagcagcagccccaaccucagccacagcagcaacagccccagcagcaaccucaggcauugccacgauacccgcgugagguacccccuagguucaggcaccaggagcacaaacaauuacugaagcgggggcagcacuuuccagugaucgccgcuaaucuaggguccgccgucaaagugcucaacucucagucggaaucaagcgcgcugaccaaucagcaaccccagaacaauggugagguucagaacaguaagaaucaguccgacaucaaccauucuacaagcggcucccacuaugaaaacucacaacgcgggccugugaguagcaccucugauuccucaacuaauugcaaaaacgcagucgugagcgaccuuagugagaaggaagccuggccaucugcucccggguccgauccggagcuggccagcgaguguauggacgcagauucggcuucuuccucagaaagugagagaaauauuacaaucauggccagcggcaacaccgguggggaaaaggacggauugagaaauuccacgggccucggcucucagaacaaauucguaguugggagcucaaguaauaacgugggacaugguuccagcacuggcccuuggggguuuucucacggagcgauuaucucaaccugccaggucaguguggaugcccccgagagcaaguccgaaucuucgaauaaccggaugaaugcauggggcacagugagcuccucaaguaacggugggcugaauccaucuacucugaacagcgcuuccaaucacggagccuggccuguccucgagaacaacggcuuagcucugaaaggccccguugggucaggaagcucugguauaaauauccaguguuccaccauuggccaaaugccaaacaaucagaguaucaacagcaaggugucugggggauccacacauggcaccugggguucacuucaggagacgugcgaaagugagguaagcgggacucaaaaagugucguucuccggccagccccagaauauuacaaccgaaaugacuggaccuaacaauacaaccaacuuuaugacgucuagcuugccaaauucaggcaguguccagaacaaugagcugccguccucuaacaccggggccuggcgcgugagcacaaugaaucacccccaaaugcaggcaccuuccggaaugaacgguacuucacuaagccaucucaguaauggcgaaucuaaguccgggggaagcuacggcaccacauggggugccuaugggucgaacuacucaggcgacaaguguucuggaccaaacggccaggcuaauggggauacuguuaacgcgacccugaugcagcccggagugaaugguccuaugggcacaaacuuccaagucaauaccaacaaagggggaggcgugugggagaguggugcagccaauucccagagcacuucuugggggagcggcaacggagcuaauuccggcgggucacgaagaggauggggcacgccagcccagaacacagguaccaaucuucccaguguagaguggaacaagcugccgagcaaucagcacucuaacgacuccgcaaaugggaacggaaaaacuuuuaccaacggcuggaagucaacagaagaggaagaccaagguagugccaccagccagacuaaugagcaguccucuguuugggcuaaaacaggcgggacgguggagucggauggaagcaccgaaucaacuggcagguuggaggaaaaggggacaggagagucccagagucgggaccgucgcaagaucgaucaacacacccuccugcagucuauagucaacagaacagacuuagauccuagggugcugagcaauuccggcuggggucagacuccaauuaaacaaaacaccgccugggacacggaaaccucacccagaggggaacgaaagacagauaauggaacugaggcauggggcucuagcgcgacccagacauucaacaguggugcuugcaucgacaaaacuuccccuaauggcaacgauaccagcucugucucaggguggggagaccccaagccagcccuccgcuggggcgauuccaaagggaguaauugucagggaggcugggaagacgacagcgcagccacggguauggugaagucgaaccagugggggaauugcaaggaggaaaaagcugccuggaacgauucucaaaagaauaaacagggauggggcgacggucagaaguccagccagggcuggucaguuagugcaucugauaacuggggagaaacauccagaaauaaccauuggggcgaagcuaauaaaaagagcucaaguggagggagcgacuccgauaggucugugagcggguggaacgagcuuggcaaaaccuccucauuuacuugggguaacaauauuaacccuaauaacucuagugggugggacgagucgagcaagcccacaccaucccaaggauggggcgauccgccuaagucuaaucagucacugggcuggggagacagcuccaaacccguaaguucuccagauuggaacaagcagcaggacaucgucggaagcugggguauacccccugccaccggcaaaccacccgggacuggaugguugggcgguccuauuccggcgccagccaaggaagaggaacccaccgggugggaggaaccuucaccagaguccauacggcgcaaaauggagaucgaugacggaacaagugcuuggggcgaucccagcaaguauaauuacaagaacgugaauauguggaacaaaaauguuccuaacggcaauucuagauccgaccaacaggcacaggugcaccaacuacugacgccggccucagcuauuagcaacaaggaagccucgucugggaguggauggggugagcccuggggcgaaccauccaccccugcaacuacagucgacaaugggaccagcgcguggggaaaacccaucgauucaggcccauccuggggugagccuauagccgcugccucuagcacaaguacuuggggguccagcucugugggaccccaggcacucucaaagaguggcccaaaauccaugcaggacggcugguguggggaugacaugccgcugccuggaaacaggcccaccgguugggaggaagaggaagauguagagauuggcauguggaacagcaauucuucgcaggaacuuaacucaagccugaauuggccacccuauacgaagaagauguccaguaaaggguugucuggaaagaaacgucggcgagagagaggcaugaugaagggugggaacaaacaagaggaggcuuggaucaauccuuucgugaagcaguuuagcaacaucuccuucucaagggacaguccagaggaaaauguucagucuaacaagauggaucucagcggaggcaugcugcaggacaaacgcauggagauugauaagcauuccuuaaauaucggcgacuacaaccggacagucgggaaaggacccgguucaagaccucaaauuagcaaggaaucuuccauggagaggaauccguacuuugauaaagacggcauaguggccgaugagagucagaacaugcaguucaugagcucgcaguccaugaagcugccacccucuaauucagcacuaccuaaccaagcccucgggagcaucgcuggacugggcaugcagaaucuuaacagugugcgccagaacgguaaucccuccauguucggggucggaaacaccgcggcccagccacgaggcaugcaacagccucccgcacagccauugucuagcucacaaccuaaucugcgggcucagguuccgcccccacuccuguccccucaggugcccgugagucuucugaaauaugccccaaacaauggcggguugaacccucucuuuggaccccagcaaguagccaugcugaaucaguuaagccagcugaaccagcuaucucaaauuucacagcuccagcgucugcuugcucagcaacagagagcacagucccaaaggagcgucccgucugguaaucgcccacagcaggaccagcaaggccggccuuugagugugcagcagcagaugaugcaacagucgagacagcuggaccccaaccuccugguuaagcagcaaacuccacccucccagcagcaaccuuuacaccagccggccaugaagucauuccuggauaaugugaugccccauaccacaccagaacuucagaaagggccuagccccaucaacgcguuuucuaauuucccuaucggauugaacagcaaucucaacgucaacauggacaugaacuccauuaaggagccacagaguaggcugcgaaaauggacuaccguggauucaauaucuguuaacacaagccuagaccaaaauuccaguaagcacggcgcuaucagcuccgguuuucgccuggaagagucucccuucgugccuuacgauuuuaugaacucaagcacgucgccagccagucccccggggagcauuggcgacggauggccucgggcaaaaucuccaaauggcagcucauccguaaacuggcccccugaguucagaccaggggagcccuggaagggauauccgaauaucgauccugagaccgaccccuacgucacuccagguucugugauuaacaaucucaguaucaacacagugagggaagucgaucaucugcgugaccgcaauagcggcuccucaagcucucuuaacaccacuuugccuaguacauccgccuggagcucaauacgggcuucuaauuauaacguuccccuguccucgaccgcacagagcacgagugccagaaauucugauuccaaguuaacuuggagcccagggucagugaccaacacaagucucgcgcaugagcuguggaaaguaccccuuccuccaaagaacaucaccgcuccguccaggcccccuccaggacugacuggccagaaacccccuuugagcacaugggacaauucuccacuccgaauuggugggggcuggggaaacucagacgcccgguacacccccggcagcuccuggggagaaucuaguucgggacgcaucacaaauuggcuggugcuaaagaaccugacuccucagauugaugguagcacccucagaacgcugugcaugcaacacggcccgcuuaucacauuucauuugaaucugccacacgggaacgcauuagucagguauuccucaaaagaggaggugguuaaggcccagaagucucuccacaugugugugcugggaaauaccacuauacuugcugaguucgccagcgaggaagagauuagucgguuuuucgcacagucccagucacugacccccucuccuggcuggcaaagccuagguuccagucagagccgacucgggucucuggacugcucacauuccuuuagcaguagaacagauuugaaccacuggaauggcgcuggacugucuggcacuaacugcggggacuuacauggaaccucccucuggggcacgccccacuacucgacaagccugugggguccaccuucauccucugauccccgcgggaucaguagcccaucaccgauuaaugccuuccuuuccgucgaccaucugggaggcgguggcgaaagcauguga

SEQ ID NO: 64069 - RNA, 3090 nt, Artificial Sequence
  derived and/or modified sequence opt3 from TNRC6B__Homo_sapiens__NP_001020014
augcagaccaacgagggcgaagugagcgaggaauccucuucaaaggucgagcaagaagacuucguuauggaggggcacggaaaaacacccccuccaggugaggaaaguaagcaggagaaagaacaggagagagaggaacagcugauggaggauaagaaaaggaagaaggaagacaaaaagaaaaaggaggccacucaaaaagugacggaacagaagaccaagguaccggaggugacaaaacccagccucucccagccuacugcugcaucuccaaucggcucgucacccagcccuccagucaaugggggaaacaaugccaagcggguggcgguucccaacggccagccuccaagugcugcccgcuacaugccgcgagaggugcccccucguuuuagaugccaacaggaucauaaaguccuucugaagaggggucagccacccccuccauccuguauguuguuagggggaggcgcagggcccccgccuugcaccgcccccggggcuaauccaaacaaugcacaggugacaggagcccugcuacaaucugaaagcgguaccgcuccuguaugguccaaaucaacucccccagcccccgacaacggcacaagugcguggggcgagccuaaugaaagcucuccaggauggggcgagauggaugacaccggugcauccacgacuggguggggaaacaccccggccaaugcucccaacgccaugaagccuaauucaaaaagcaugcaggauggcuggggcgaaagugacgggccaguuacaggagcacggcaccccucuugggaggaggaagaggaugguggcguguggaacacuaccgggucccagggaagcgcuucgucucauaauuccgccucauggggccaaggugggaagaagcagaugaaauguagucucaagggcggaaacaacgacagcuggaugaauccucuggcgaaacaguucuccaacaugggccuucugucucagacagaagauaauccaagcucaaagauggacuugagugucgggucccucagcgauaaaaaguuugacguggacaagcgcgccaugaaccugggagauuucaaugacauuaugagaaaagauaggucugguuuucggcccccgaacucaaaggacaugggcaccacggauagugggccuuauuucgagaaaggaggcagccacggucuguuuggcaauuccacugcacaaucucgcgggcuccauacaccagugcagcccuuaaacucgagcccuucccugcgagcucagguucccccacaguucauaucaccucaagucagugccucuaugcuuaagcaguuucccaauagcggauuguccccaggccuguucaacguggggccgcagcuaucaccucagcaaaucgcuaugcucagccagcugccccagauuccacaguuucaacuugccugccagcuguugcuccagcaacagcagcagcaacagcuguuacagaaucagagaaaaaucucucaagcaguaaggcagcagcaggaacaacagcuggcccggaugguguccgcucuccagcaacagcagcagcaacagcagcgucagcccggaaugaagcacaguccuagccacccagucggucccaagccucaucuugacaacauggugccgaaugcgcugaacguuggcuugccagaucuacaaaccaaagggcccauuccuggauacggcucugguuucuccucagggggcauggacuauggaauggugggcgggaaggaggcaggaacugagagucgcuuuaaacaguggacaagcaugauggaaggccugccaucggucgccacccaggaggcuaauaugcacaagaacggugccaucguggcacccgggaaaacgagaggaggcuccccuuacaaccaguucgauauaaucccgggugacacccucggcgggcauacaggacccgccggcgauucuuggcugccagcuaagagcccucccacuaauaagauugggucaaaaaguuccaacgccucuuggccaccugaguuccaacccggaguaccauggaagggcauccagaauauugacccggaaagcgacccuuauguuacccccgguuccgugcuugggggaacagcaacuucaccaaucgucgauaccgaccaccagcuguugagggauaacacaaccggcagcaauaguucucucaacacuucccugcccagcccuggugcguggccauacucggcuucagacaauucuuuuacgaacgugcacaguacauccgccaaauuccccgauuauaagagcaccuggucuccugacccgauaggccauaauccaacucacuuaagcaacaaaauguggaagaaucauauuuccucacggaacaccacaccccugccucgacccccaccugggcuaaccaaucccaaaccaaguagcccuuggucuuccacugcaccgcgcucagucagaggauggggcacacaggauaguaggcucgccagcgcuuccacguggucugacgggggaucggugcggcccagcuacuggcugguucuucacaacuugaccccacaaaucgauggcucaacucugcgcacaauuuguaugcagcaugguccucuccugaccuuucaccuuaaucugacacaggggacugccuugaucagauacuccaccaagcaagaggcagcuaaggcccagacggcgcuccacaugugcgugcugggaaacaccacaaucuuagccgaguucgcuacugacgaugaaguaaguagguuucuggcacaggcccagcccccaaccccugcugccacacccucugcaccggcggccggcuggcaaagccuagaaacuggucagaaccaguccgacccagucggcccugcucucaaucuguucgggggaucaaccggccuugggcaguggucuagcagugccggaggcuccagcggugcagauuuggcuggggccucucuguggggacccccaaacuauucauccagucucuggggcgugcccacgguugaggacccucaucguaugggcagcccggcaccccuguuaccaggggaccugcuuggagguggcucggauucuauuuga

SEQ ID NO: 64070 - RNA, 4077 nt, Artificial Sequence
  derived and/or modified sequence opt3 from TNR__Homo_sapiens__XP_011508249
augggcgccgacggggagaccgugguccugaagaacaugcucaucggaauuaaucuuauacuguuggguagcaugaucaaacccuccgaaugccaguuagagguuacaacugaaagagugcaaaggcagucuguagaggaagagggcgggauugcuaacuacaauacgucaaguaaggagcagccuguggucuucaaccacguguauaauaucaacguuccacuggauaaucuauguagcuccggacucgaagcaucugccgagcaggaagugucggcggaggacgagacccuggcugaauacaugggccaaacaucagaucaugagagccaggucacuuuuacccaccggauuaacuucccgaaaaaggccugccccugugcaaguuccgcccaggugcuucaggaacuguugucucgcaucgagaugcucgaacgagagguaagcguucugcgugaccaaugcaaugcuaacuguugccaggaguccgcagccacaggucagcuggauuauauaccucauuguucagggcacggaaauuuuaguuucgaaagcugcggcuguaucugcaacgagggcugguuugggaaaaauuguucugaaccauacugcccccucggaugcuccucaagaggugugugugucgacggccagugcauuugugauagcgaguauaguggggacgauugcucugaauuaagguguccuaccgacugcuccagccggggacuguguguggauggcgagugcgugugugaggaaccauacacuggugaggacugccgcgaacuuagaugucccggggauugcucgggaaaggggaggugcgcuaacggcacauguuugugcgaggaaggcuaugucggagaggacuguggucaacggcagugccugaaugccuguucuggccgcgggcagugcgaggaaggacuauguguuugcgaggaaggcuaccaagguccugacuguuccgcgguggcaccaccggaggaucuccgaguagccgggaucucagacagaaguauugagcuggaaugggauggccccauggcugugaccgaguacgucaucagcuaucagccuacggcccuuggaggccugcaguugcagcaaagggugccaggggacugguccggaguuacuauaaccgaacucgagcccggucugacauacaacauuucuguguaugcagucaucagcaacauuuuaucacugccuaucacugcuaagguggccacccaucucaguacaccacagggccuucaguucaaaaccaucacggaaacuacaguagagguucagugggagcccuuuuccuucagcuuugaugggugggaaauuucuuucauaccgaagaauaacgagggaggcgugaucgcgcaagucccuucagacgugaccaguuuuaaucagacuggucugaaacccggggaagaguacauugucaacgugguugccuugaaggaacaggcacggagcccaccuacauccgcuucugugucgaccguaaucgauggccccacgcagauucuaguccgugacgugagcgauaccguugccuucguggaguggauaccaccccgcgcuaaagucgacuuuauccugcucaaguauggacuggugggcggggagggagguagaacaacuuucaggcuucaaccuccacugucccaguacucaguacaggccuugcggccgggcagucgauaugaagugucuguuagcgcaguccgcgggaccaaugaguccgauucagccacaacucaguucaccacagaaaucgacgcucccaagaaccucagagugggaagcaggaccgcgacuucucuggacuuagagugggauaauuccgaagcagaggugcaagaguacaaagucguuuacaguacgcuggccggcgaacaguaucacgaggugcuagugccucgggguauugggccaacaacccgcgcuacucucaccgaccugguacccggcacagaauacggagucggcaucagcgccgugaugaacucucagcaauccguuccugcaaccaugaaugccagaacugagcuugauucaccaagggacuugauggugacagcuaguagcgagacgucgauuucccugauauggaccaaggccucugggcccaucgaucacuaucguauuacuuuuacaccgagcucaggaaucgcaagugaagucaccgugccuaaagaccggacauccuacacucucaccgaucuggagccaggcgcggaauauaucauuucuguuacggcugagcgagguagacagcagagccuugaauccaccguggacgccuucacaggguuuaggcccauaucacaucugcacuucagccauguaacuuccucuuccgucaacaucaccuggagcgauccuucgcccccagcagaccgcuugauucucaauuacucaccucgggaugaggaggaagagaugauggaagugucucuggacgccacaaagagacacgcuguguuaaugggacugcagcccgccacugaguauaucgucaaccuaguugcagugcacggcaccguaacgagugaaccaauuguggguuccaucacaaccggcauagauccgccuaaagacaucacuauuagcaaugucacaaaggacucugugaugguuagcuggagucccccaguggcuucauuugauuacuacagggucaguuaucgccccacccaaguggggcgacucgacagcucuguugugccuaacacugucaccgaguucacaaucacgcggcugaauccagccaccgaguacgaaauuucccuuaacucaguacguggaagagaggaaagugagaggaucugcacuuuggugcauacagcgauggauaaccccguugaccugauagccaccaauauuacaccuacugaagcucuccugcaguggaaagcaccggugggcgaggucgagaacuaugugaucguauuaacccacuuugccguggcuggggaaacgauucuggucgauggaguuagcgaggaguuccgccuuguggacuugcucccauccacacauuacaccgccacuauguaugcaaccaauggcccccugacaucugguacuaucucgaccaacuuuagcacacuacuggauccuccagcgaaucucacggccucagaagugacccggcaguccgcucugauaaguuggcagcccccuagagccgagaucgaaaacuacguccuuacuuauaagucuacagacgggagcaggaaggaguugauuguggaugcagaagacaccuggauccgacuggagggauuacucgaaaauacugauuacacaguucugcuucaagcugcccaggacaccacgugguccucaauuacuucuaccgcauucacaaccggcggucgcguauuuccgcacccccaggauugugcccagcaucugaugaacggcgacacuuugagcgggguguacccaaucuuccucaauggagagcugagucaaaaacuacaggucuauugcgacaugacaaccgauggcgggggauggauaguguuucagcggagacaaaacggccagacagacuucuucaggaagugggcugauuaccguguugguuuugggaauguggaggacgaguucuggcugggacucgauaacauucaccgcaucacuucccagggccgguaugaacugagagucgacaugagggauggucaggaagcggccuuugcaagcuacgaccgauucucuguggaggauucacggaaucuuuauaaauugcgcaucggcuccuacaacgggaccgcuggagacagucugagcuaucaccaaggcagaccuuuuucgacggaagauagggacaaugacguagccgucacaaacugcgccaugucuuacaagggggcuuggugguacaaaaacugucaucggaccaauuuaaacggaaaguauggcgagucccgacacagccaggguauuaauugguaccauuggaaggggcacgaguucucaauccccuuuguggaaaugaaaaugagaccauauaaccaccgccucauggcaggaaggaagcgucagagucugcaguucuga

SEQ ID NO: 64071 - RNA, 5208 nt, Artificial Sequence
  derived and/or modified sequence opt3 from TNS1__Homo_sapiens__NP_072174
augagcguguccagaaccauggaggacucuugcgaacuggaucucgucuacguuacagagaggaucauugccgugucauuccccaguacugcuaacgaagagaauuuucggagcaaccuucgcgaaguagcacagaugcugaaguccaaacacggcgggaauuauuuguuauucaaccugucugagcgacguccugacauaacgaagcuacaugccaaagugcucgaguuuggauggccagaucugcacaccccggcgcuugaaaagaucuguucgauuugcaaagcuauggacacauggcugaaugccgauccccauaacgucgugguuuugcacaauaaggguaacagaggcaggaucgggguggucauugcagccuacaugcauuauucaaauaucagcgcuagugcagaccaagcccucgaucgguucgcuaugaagcgcuuuuacgaggacaaaauagugccuaucggacagccaucccagagaagguauguacacuacuucucuggccugcugagcgguuccauuaagaugaacaauaaaccccucuuuuuacaccauguuaucaugcacgggauuccuaacuucgaaucaaagggaggcugucggccauuucugcgcaucuaucaggccaugcaacccguguacacuaguggcauauacaauauuccuggggauagccagaccucugucugcaucacaauugagccaggacuuuugcugaaaggugacauccuacucaaguguuaucauaagaaauuccgauccccggcgagagaugugaucuuuagggugcaguuccacaccugcgcaauucacgaccugggcgucguuuuugggaaggaggaucuugacgacgccuucaaagaugaccgguuccccgaauacggaaagguggaguuuguauucucauauggcccugaaaaaauacaggguauggagcaucuggaaaacgggccaagcgugagugucgauuacaauacuucugaccccuugauccguugggauuccuaugacaacuuuagcggacaccgcgaugacggcauggaggaggugguuggccauacacaagggccucucgauggaucgcuguacgcuaaggugaaaaagaaggacucuuuacacgguuccaccggcgccgucaacgcaacgagaccaacucugucagcuacccccaaucauguggaacacacacucaguguaagcuccgauucugggaacagcacugccucaaccaaaacagacaagaccgacgagccgguuccuggagcgaguuccgccacggcagcucuuagcccccaggaaaaaagggagcuggaucgguugcuaucuggcuucggucuggaacgagagaagcagggggccauguaucacacucagcaucuccgcucaagaccagcuggcggaagugccgugccuagcuccggcaggcacgucgugcccgcacaaguccaugugaaugggggagcccuggcuucugagcgggaaacagacauucuugaugacgagcugccaaaccaggauggucacucggcgggcagcauggggaccuuguccucacucgacggaguuacuaauacaagugaaggcgguuaccccgaggcacugucuccuuuaaccaacgggcuggauaaaagcuacccaauggaaccgauggugaauggcggaggcuaucccuacgaguccgccucacgcgcugggccugcccacgcaggacauacggccccaaugagacccagcuauucugcucaggagggucuagccggcuaccaaagggaagggccucacccagcauggccccagccgguaaccacaucccauuaugcgcacgacccuaguggaauguuucguagccagucuuucuccgaggcugaaccacagcuccccccugcccccguccggggcgguucaagucgagaggcagugcaaagagggcugaacagcuggcagcagcagcaacagcagcagcaacagccaaggccucccccacgccagcaggagcgggcccaucuugaaucguugguugcuuccagaccgucuccucaaccccuggccgagacuccaauccccagccucccugaauuuccaagggcagcuucacagcaggagauagaacaaaguauugagacccugaauaugcuuaugcuggauuuggagcccgccuccgcggccgcuccucuccacaagucucagagcgugccgggcgcauggccaggagccuccccccugucaagccagccuuuaaguggcucuucccgccagagccacccacugacacaaucgcgaucaggguacauccccucuggacauagucuaggcacuccugaaccggcuccccgggccucccucgagagcgucccaccuggucguucuuauagccccuacgacuaccagccaugucuggcagggccuaaccaggauuuccacuccaagucacccgcgaguagcucucuuccagccuuuuugccgaccacacauuccccucccggaccacagcaacccccugcuucacugccaggccucaccgcccagccccuguuaaguccuaaagaagcaacuagcgacccguccagaacgccagaggaagagccccugaaucuugaggguuugguggcucacaggguagccggcgugcaggcacgcgaaaagcagccugccgagcccccagcuccucuccggagaagggcggccucugaugggcaauaugaaaaccagucgcccgaggcaacaagcccacgaucaccuggaguucgcuccccgguccagugcgugagucccgaacuggcucuaaccaucgcccugaauccaggcgggcggccuaaagagccccaucuccacucuuacaaggaggccuucgaagagauggaaggaacuagcccauccucaccucccccgucuggcgugagaagcccaccuggucuggcuaaaaccccccuuagugcauuggggcugaagccacacaaccccgccgacauuuuacuccauccuacaggagucaccaggcgucgcauccaaccggaggaggacgaaggcaagguuguggugcggcuguccgaggaacccagaagcuauguagagucugucgcgaggacugcuguggccgguccacgagcacaggauucagaaccuaaauccuuuagugcccccgcuacacaggcauacggccacgagauuccucuucggaaugggacgcugggaggcagcuucguuucgccaucucccuuguccaccagcucaccuauacucagugccgacucuacuuccguggggagcuuuccaucaggagagaguagcgaucagggcccccgcacaccgacccaaccucugcuagaauccgguuucagaucugggagccugggacagccaucccccucagcgcagaggaacuaucagucuaguucgccucucccaacagucggcagcuccuacucuucacccgacuauagccugcaacauuucuccaguucuccggagagccaggcucgggcccaguuuucaguggcagguguucacacugugccuggcuccccccaggcccgacacagaaccguagggacgaacaccccaccuagucccggauucggcuggcgcgcuaucaauccaagcauggccgcacccucuuccccuucacuuagccaucaccaaaugauggggccaccgggaacaggcuuucaugguucgacugucucuaguccccaguccagcgcugccaccacaccugggucaccauccuuguguaggcaccccgcgggaguguaccaggugucuggccugcauaacaaggucgccacuaccccuggcagcccaaguuuagggcgucaccccggagcacaccaggguaaucucgcuuccggccugcauagcaacgccauugcuucuccugggucaccgagucuuggacggcaccugggcgguuccgggagcguugugccaggaucucccugccuagauagacauguagcauacggcggcuauucgacgccugaagacaggcgccccacacucucacgacaaagcuccgccaguggguaccaggccccaucuaccccuagcuuccccguguccccagcuuauuacccgggacugucaaguccugcgacuucucccagcccagauuccgcagccuuuagacaggguucacccacaccugcuuugccagagaaacggaggaugagcgucggcgaccgcgccgggucucugcccaauuaugcaaccaucaacggaaagguguccaguccuguugccagcggcaugucguccccgucuggugggucaacugugagcuucagucacaccuuaccagauuuuuccaaauacucuaugcccgacaauagcccugaaacacgugcuaaggucaaguucgugcaagauacgucaaaauauugguacaagccagagaucuccagagagcaggcgauugcccuccugaaagaccaggaacccggagcauuuauaauccgggauagucacagcuucaggggcgcuuacggccuugccaugaagguuucuucaccucccccaaccauuaugcagcaaaacaaaaagggggacaugacucaugagcuggugcgccacuuuuugaucgaaacaggaccgcgaggugucaaacucaagggcuguccuaaugagcccaacuucgggucccugagcgcacuaguauaucagcauucuauuaucccacuggcccuuccuugcaagcucgugauacccaauagagacccaaccgaugaaaguaaagacucguccggaccugcuaacagcacagccgaucuguugaagcagggcgcggcaugcaauguucuguuugugaacucagucgacauggagucuuuaacugguccccaggccaucagcaaagcuaccuccgagacgcucgccgcugauccgacaccagcagccaccauugugcacuucaagguaagugcucaagggaucacucugaccgacaaucagcggaaacuuuucuuuaggcgccauuacccucugaacacagugacuuucugugauuuggacccccaggaaagaaaguggaugaagaccgagggaggcgccccagcaaaacucuuuggcuucgucgcgaggaagcaggggucaacaacggauaacgccugccaccuguuugcugaacuagaccccaaucaaccugccucugcaauuguuaacuucgugagcaaagugaugcugaaugcuggacagaagcgguga

SEQ ID NO: 64072 - RNA, 4260 nt, Artificial Sequence
  derived and/or modified sequence opt3 from TNS2__Homo_sapiens__NP_056134
auggacggcgggggagugugcgucgguagaggcgaucugcucagcagcccccaggcccuugggcaacuguugaggaaggagucucggccucgccgagcuaugaaaccacguaaggcagaaccgcacucauucagagagaaaguuuuuaggaagaaacccccugugugugccguaugcaaggugaccaucgacggaacaggcgucaguugucgggugugcaagguugcgacucaucgcaaaugugaagcuaaggugacgagcgccugccaggcauuaccacccgucgagcugagaaggaacaccgccccugugcggcgcauugaacaccuagguuccacaaaaucucucaaucauucgaagcagcgaucaacucugccaagauccuucagucuugauccccugauggagaggcggugggacuuggaucucaccuacguaacagagcguauacuggcugcagccuuuccugcucgcccagacgaacagagacacagggggcaucugcgggagcucgcccacguuuuacaauccaaacaccgagauaaguaucugcuuuucaacuugucugaaaagcgccaugaccugaccagacuaaauccgaaagugcaggauuuuggauggcccgagcuccacgcgccuccacuggacaaacuuuguagcaucugcaaagcaauggagacuuggcuguccgccgauccccagcaugucgugguguuguacuguaagggcaacaaaggcaagcucggggucauuguuucagcuuauaugcacuacaguaaaaucagcgccggagcagaccaggcucuggccacauuaaccaugaggaaguucugcgaagauaagguggcgacggagcugcaaccuucucagcggcgcuauauuuccuacuuuucaggucuccuuagcggcaguaucagaaugaacucuuccccacuguucuugcacuauguacuaauacccaugcugccggccuuugaaccugggacuggauuccagcccuuucucaaaaucuaccagagcaugcaacugguguacaccucgggcgucuaucauauugcagguccagggccucagcagcuuuguaucucucuggagcccgcuuugcuccugaagggagacgugaugguuacaugcuaccacaaaggcggcagggggacugaccguaccuuaguguuccggguccaauuucauacaugcaccauucacggaccacagcugacguuccccaaggaucagcuagacgaagccuggacugaugagcgauucccuuuucaggcuuccguggaguucguauuuucaaguagcccagaaaagaucaaggguuccacaccgagaaaugaccccucuguuagcguggauuauaauaccacugagccugccgucaggugggacucauacgaaaacuucaaucaacaucacgaggauaguguggacggcucccucacacacacccgcgggccacuggauggaagccccuaugcacagguccagcggccuccaagacagacgcccccggccccuucuccagaacccccucccccaccuaugcuuucagugaguagcgacuccggccauucuucgaccuugacaacugagcccgcugcggagagcccagguaggccgccucccaccgcagccgaacgccaagagcuggaucgacuccuugggggcuguggaguugcuuccggcgggcggggagccggucgugaaacagcaauacuggacgacgaggaacagccaacugugggcgggggaccccaccugggcguauacccuggucauagaccaggguugucaaggcacugcaguugucgccagggcuaucgggagcccugcggagucccuaacggcggguacuacagaccggagggaacccucgaaaggcgacgccuggccuaugguggcuacgaggggucuccacagggauaugcugaagccagcauggagaagcggagauuauguaggucccugucagagggccuauaccccuauccuccagaaauggguaaacccgcaacaggggauuuuggcuaccgugcgccuggauaucgcgaggugguuauucucgaagacccgggccugcccgcucuuuacccaugcccugccugugaggaaaaguuggcacugcccaccgccgcucucuacgggcugcgguuagagagagaggccggagaaggcugggcaagcgaggcugguaaaccacugcuucacccugugaggcccgggcauccauugccgcuccugcuaccugccugcggacaccaucacgcgcccaugccagauuauucuugucugaagcccccuaaagccggcgaagagggucaugaaggcugcuccuacacuauguguccagaggggcgauauggacaccccggcuacccugcucucgucacguauaguuacgggggagcagugccgagcuauugcccagccuacggccggguaccccacucuugcgguuccccuggggagggacgcggcuaccccucaccaggugcucauaguccuagagccggcagcaucucgcccggguccccaccuuauccgcaaucuaggaagcugagcuacgaaauucccacagaggaaggaggcgaccgguauccacuuccugggcacuuggcaucagcgggaccccuggccagugcugaguccuuagaaccagugucuuggcgagagggcccuagcggucauuccacccuccccagaucaccgcgcgaugccccauguagcgcaaguucugagcuguccgggccuagcacuccccuucacaccucgucaccaguucagggaaaggaaucuacaaggcgucaggacacccggagucccacuuccgcuccuacacagagacugagcccgggcgaggccuugcccccagucucucaagcagguacgggcaaagccccugaacuccccagcggguccggaccugagccacuggcucccucaccugugaguccaaccuuucccccgagcucuccuuccgauuggccacaggagaggucacccggcgggcauagugacggagcgagcccucgcuccccagugcccacuacacuaccgggccugcgacacgccccuuggcagggucccagagggccaccugauucucccgacggaucgccacucacccccgucccuagccaaaugccauggcugguugcaucaccggaacccccucaguccaguccaacacccgcuuucccucuugccgccucuuacgauacuaauggcuugagccagccaccccugccugagaagcggcacuuaccgggcccagggcagcaacccggaccuuggggucccgaacaggcuuccucaccagcaaggggcaucucucaucacgugaccuucgccccucuccugagcgacaacgugccccagacgccagagccgccuacccaggaaagucaauccaauguaaaauuuguccaggauacaagcaaguucugguauaaaccccaucuuucucgcgaccaggcgaucgcucugcuaaaggacaaggauccaggggccuuucucauucgugacucacacuccuuccagggagcauacggccuggccuugaaaguggcuacucccccuccaagugcacaacccuggaagggugauccuguugagcagcuggugagacacuuuuuaauagagaccgggccgaaaggagucaagaucaaaggcugcccaagcgaacccuauuucggcucgcucucugcccuggugucccagcauagcauuucaccuaucagucuuccauguugccugcggauacccucuaaggacccuuuggaggaaacacccgaggcgccaguuccgacuaacauguccaccgcugccgaucuccugaggcaaggggcagccuguagcgugcuauaccugacgucaguagaaacagagagucuuaccggaccucaggcugucgcccgcgcaagcuccgcugcccucucuugcagcccccgaccaacuccugcgguggugcacuucaaagucuccgcccaggguauuacacugaccgacaaucagagaaaguuguuuuuccggaggcauuaccccguuaacucaaucacuuuuucuaguaccgauccacaagaccgcagauggacaaacccugauggcacgaccucgaagaucuucggguuuguggcuaaaaagcccggaagcccgugggagaauguaugucaccuguucgcagaauuagacccagaucagccugccggcgcuauugugacuuuuaucacaaaaguccuccugggucagaggaaguga

SEQ ID NO: 64073 - RNA, 4686 nt, Artificial Sequence
  derived and/or modified sequence opt3 from TNS3__Homo_sapiens__XP_011513778
augugcagcagacagagguccggcuucggguguaucaccaacugguggaagaugggaacacggcaccccgcccauccugcucaaccagaggaacugacuucuucacuccacgcauuuaaaaauaaggccuucaaaaagaguaaagugugcggugucuguaagcagauuauagacggccaggggaucagcugccgcgcguguaaguacuccugccauaaaaagugugaggcuaaaguugugauuccgugcggaguacaggugcgacuugaacaagcccccggaucuucgacgcugucaagcaguuugugucgugauaagccuuuaagaccagucauccugucccccaccauggaggaaggucacgggcuagaccucacauauauuacugagaggaucauagcagugucuuuuccugccggaugcagcgaggaauccuaccugcauaaccuucaggagguuacccggaugcugaaaucaaagcacggcgauaauuauuuggugcucaaccugagugaaaagcgcuacgaccugacaaaacucaauccaaagaucauggaugucggcuggcccgaguuacacgcuccuccacuggacaaaauguguaccauuugcaaggcacaggagagcuggcuuaacucuaauuugcagcaugugguaguuauccacugcagagggggaaaagguaggauuggcguggucaucuccucauauaugcauuucacuaacgugagcgccagugcugaucaagcccuggaccgguuugcgaugaagaaauucuacgaugacaaggugucugcacuaaugcagccgucccagaagcgcuauguccaguuucucagcgggcugcuuucgggaucuguuaaaaugaaugccagcccccuguucuugcacuuugugauacuccacggcacaccuaacuucgauaccggugggguaugucgaccauuucugaaguuauaccaagcuaugcagcccguguacacgucaggaauuuauaaugucggcccugaaaacccaaguagaaucugcauugugaucgagcccgcccagcugcucaaaggcgacguuauggugaaguguuaccauaaaaaguauaggagcgcaacucgggaugucaucuuccgucuucaauuucacaccggggcugugcagggauacggucugguauucggcaaggaagacuuggacaaugccuccaaagaugaccgcuucccggauuaugggaagguugagcuaguguuuucugcgacaccugagaaaauucagggaagcgaacaucuguacaacgaccacggcgucauaguggauuauaauacuaccgacccccucaucagaugggauucauacgagaaccugagugccgacggugaaguccuucauacacaggggccaguggauggcucccuguacgcaaagguuaggaaaaaguccucuucagacccuggcauucccggcgggccacaagcuauccccgccaccaacaguccugaucacagcgaccacacguuguccgugucuucggacagcggacauuccacugcuucagcccggacagauaagaccgaggaacgacucgcaccagguacucgcagaggccugagugcccaggagaaagcugaauuagaccagcugcuaucuggguucggacucgaggauccgggcagcucccugaaggagaugacagacgcgaggucaaaauauagcgguacccggcacguaguccccgcacaggugcauguuaauggggaugccgcucuuaaggaccgcgaaacggauauauuggacgaugagaugccucaccacgaccugcauucuguggauucccucggcacccugaguagcucugaaggaccacaauccgcccaccuuggccccuuuacaugccauaaaucaagucagaacagccuguugucggacggguucggauccaaugucggugaggauccucagggcacucucgugccagaccugggguuaggaauggacggccccuacgaaagagagaggaccuuugguucucgugagccgaagcagccucaaccacugcuacggaagcccagcguaucagcacagaugcaggccuaugggcagaguuccuacucuacacaaacuugggugcgacagcagcaaaugguugucgcucaccaguauagcuucgccccugauggcgaagcaagacucguguccaggugucccgcggacaacccaggacuggugcaggcucagccucgcgucccccuuaccccaacacggggcaccucaagcagaguugccgugcaacgcggggugggaaguggcccgcauccucccgauacucagcagccaucucccuccaaagcauuuaagccuagguucccaggugaccagguagucaauggggccggacccgaguugagcacgggcccuucgccggguucaccaacacuggauauugaccaaucuaucgaacagcucaaccgacugaucuuagagcuggaucccaccuuugagccuauuccaacucacaugaaugcucuuggcagucaggccaacggguccgugagccccgacucuguuggaggcggguugcgggcaagcucccgucucccugauaccggagaaggcccgucaagagcuacagguaggcaggggaguagcgccgagcaaccccugggaggccgccuacggaaacugucucucggucaguacgacaaugaugcgggcgggcagcugccauucuccaagugcgccuggggaaaagcuggcguggacuaugcaccuaaccuucccccauuuccuucacccgccgaugucaaggaaaccaugacuccaggguacccgcaagacuuggacaucauugauggaagaauacugaguagcaaagaguccauguguucuacgccugcuuuccccgugucgccagaaacacccuacguuaagaccgccuuaaggcacccuccauuuucacccccugagccgccacucagcucccccgcaagucagcauaagggcggucgagagccucgcucuugccccgaaacucugacacacgcgguggggaugagcgaguccccaaucggaccuaaaucaaccaugcuucgggccgacgcuucuagcacacccaguuuccagcaggccuucgcauccagcuguacuauuucuucaaauggcccaggucaaagaagggaauccaguagcucggcugagcgucaguggguagaaucuuccccuaagccgauggucagccuguugggcucagggcgccccaccggaaguccacucucugccgaguuuuccggcacgcggaaagauagcccugugcugucaugcuuucccccaagugagcuacaggcaccuuuccauagccacgaacugucccucgccgagcccccggacucucuggcuccaccuagcucccaggcguuccuuggguuuggaaccgcccccgugggcucagguuugccacccgaagaggaucugggggcauuacucgcuaacucucauggagccaguccuacaccgucgaucccccugacugccaccggcgcugcagacaauggcuuccuuagccacaacuuucugacagucgccccagggcacuccucucaucacucaccuggacuacaaggucagggcguuacucuccccgggcagccuccacugcccgaaaagaaaagagcgagcgagggagauagguccuugggcagugugucuccuagcucauccgguuucaguagcccacauucuggguccaccaucucaauucccuuuccgaauguacugccugacuucagcaaggcuucggaggccgcaucuccauuacccgauaguccuggagacaagcucgugauagucaaauuugugcaggauacguccaaguucugguauaaagccgacaucagccgagaacaagcuauugcaaugcugaaggacaaagagccaggcucauuuaucguucgggauucccacucuuuccgcggcgccuacgggcuugcgaugaagguggcuacacccccgccuagcguccugcaguugaacaagaaagccggagaccucgcaaacgaacuggugagacacuuccuaauugaguguacccccaaggguguuaggcugaaaggcugcaguaaugagccauauuuugggucccuuacugcccucgugugccagcauagcaucacaccucuggcuuugcccuguaagcuguuaauaccagaacgggauccccucgaggaaaucgccgagucuucaccucagaccgcagcuaacagugccgcggaacugcuuaaacaaggagccgcaugcaaugucugguaccugaacuccguagagauggagagcuugacuggccaccaggcuauucagaaggcccucucuaucacccuggugcaagaaccaccgcccguuucgacagugguccauuucaaggugucagcucaggguauuacgcuaaccgacaaucagcgaaaacuguuuuucagacgccacuauccuguaaacagcgugaucuuuugugcacuugauccacaggacaggaaguggauaaaagaugggcccuccaguaaggucuucggauuuguugcccguaaacaaggcucugccacugacaaugugugccaucucuucgcugagcacgauccugaacagccagcgagcgcaauugugaacuuugucuccaaggugaugaucggcucacccaaaaagguuuga

SEQ ID NO: 64074 - RNA, 2148 nt, Artificial Sequence
  derived and/or modified sequence opt3 from TNS4__Homo_sapiens__NP_116254
augagccaggugauguccucuccccugcucgccggcgggcacgcugucucacuugcaccuugcgacgagccaagaaggacccugcauccggcccccaguccuagcuugccaccccaauguuccuacuauacaacugaaggauggggugcgcaggcuuuaauggccccuguuccaugcauggggcccccuggccggcugcagcaggcaccacaaguggaggccaaggcuacguguuuccuaccgucucccggagaaaaagcacucggcaccccugaggaucuggacucguacaucgauuuuucacuugaaagccugaaccagaugauuuuggagcucgacccaacauuccagcugcugcccccugguacugggggaagucaggccgagcucgcucaauccaccaugucuaugcgcaagaaagaagagagcgaagccuuagauauaaaguauaucgagguaacauccgcgcgaucacguugccacgacggcccacagcauuguaguagccccucugugaccccgccuuuuggcucccugagaucagggggacuuuugcugagcagggaugucccccgggagacucgcaguucuuccgaaagccuaauuuucucggguaaucagggcagagggcaccagaggccacucccucccucugagggacuguccccacggcccccuaacucaccaaguaucagcauuccgugcaugggcuccaaagcaucuagcccccauggucuugggucaccucugguggccaguccacgcuuggaaaagcgacucggaggccuggcuccccaaagaggcuccaggaucagcguuuuaucugccucaccugugagugacgucagcuacauguuuggguccucucagucgcugcuccacagcuccaauucaagucaccagucuagcucccggucacuugagagcccagcaaacucuuccaguagccugcauucuuugggauccgugucacuauguacacgucccagugauuuccaagcuccgcgcaauccuacccugacgaugggucagccaagaacuccccacagcccuccccucgccaaggaacaugcgucguccugcccaccuucuauaaccaacagcaugguagacauccccauuguucugaucaauggcuguccagagccggggucaaguccuccccagaggacaccaggacaccagaacuccgugcaacccggcgccgcaucuccuagcaauccaugccccgcuacucgguccaacucacagacccuuagcgaugccccuuuuacaaccuguccggaggguccagcucgagacaugcagcccacgaugaaauucgucauggauacaaguaaguauugguuuaaaccuaauauuacucgcgaacaggccaucgagcuguugagaaaggaagaaccaggggcauucgugauaagggacucuuccagcuaccggggcucguuuggacucgcccugaaagugcaagaaguccccgcuucagcgcagucucgcccuggcgaggacaguaacgauuuaauuagacacuuccugaucgaguccagcgcaaaggggguucaucuaaagggagccgacgaggagccguauuuugguucucucagcgcuuucgugugccagcacuccauuauggcccuggcacuucccugcaaauugaccaucccacagagggaacugggcggggccgauggagcuucagacaguacugauagcccugccucuugucaaaagaaauccgcaggcugccauacacucuaccugucaaguguaagcguggagacccuuacgggugcgcuggcuguccagaaggccaucuccaccacauucgaacgugacauuuugcccacuccaaccgugguucacuuuaaagugacagagcaggggauaacucucaccgauguccagcggaagguguucuuucgaagacauuacccucugacaaccuuaagguucuguggcauggaccccgagcaacgcaaauggcagaaguauugcaagccaucuuggaucuuuggauucguagcaaaaucgcagacugaaccgcaagagaauguuugucaccuguuugccgaauacgauauggugcagccugcuagccaggucauuggccuagugacggcccuccugcaggacgcagagcggauguga

SEQ ID NO: 64075 - RNA, 12729 nt, Artificial Sequence
  derived and/or modified sequence opt3 from TNXB__Homo_sapiens__NP_061978
augaugcccgcccaguacgcucugaccagcucccucgugcuucuggucuuguuaucuacagcaagagccggcccuuucucaaguaggagcaacguuacucugccagcgccgcggcccccuccacaacccgggggacacacggugggugcuggcguaggguccccuucuucgcagcuauaugagcauaccguggaaggaggcgagaagcaggucguguuuacacaccgcaucaaucucccacccucaacugguugcggguguccuccaggaaccgaaccgcccguucuggccagcgaggugcaggcacuucgaguccgucuggaaauuuuggaggagcucgugaaaggccugaaggaacaaugcacaggcggguguugcccugccagugcucaggcaggaaccggucagacugacguaagaacacuguguucccuccauggcguuuucgauuuaucuaggugcaccuguagcugcgagccaggguggggaggccccacguguuccgacccuacugaugccgaaauaccacccucaaguccgccuagcgcuucugguuccugccccgacgauuguaacgaccaggggcggugcgugcgcggaagaugcgucuguuuuccaggcuacaccggcccuucaugcggguggcccagcuguccaggagauugccaagguaggggccggugugugcagggggugugcgucugucgcgccggauucaguggccccgacugcucucagcgauccuguccuagagguugcagccagagggggcggugugagggcggacguugcguuugcgauccaggcuauacaggggacgauuguggaaugcgcucgugcccgagagguuguucucaaaggggccggugcgagaaugggcgaugugugugcaaccccggauacacuggcgaagacugugguguacgcuccugcccuagaggguguucacagaggggccggugcaaagauggacgcugugugugcgacccaggcuauaccggggaggacugcggaacaagaaguugucccugggauugcggugaaggcgggaggugugucgacggacguugcguguguuggccuggcuacaccggugaggauugcagcacgcggacuuguccacgagacugcagagggaggggccgcugugaagauggagagugcaucugugacacaggcuauuccggggaugacugcggaguucggucuugccccggcgauuguaaucagagagguaggugcgaggacgggcgcugugugugcuggccgggauacaccggcacugauugugguagccgagcgugcccucgggacugucguggcagagggaggugcgaaaacggagucugugugugcaaugcaggcuacucaggggaggacuguggaguacgcaguugcccaggcgauugccgggguagagggaggugugaauccggacgaugcauguguuggcccggcuauacaggucgcgacugcggcacccgggccuguccuggggauugcagaggaaggggccguuguguugacgggcgcugcguguguaaccccggauuuacgggcgaggauugcgguagccggagauguccaggggacugcaggggacacggccugugcgaagauggugucugugugugcgacgcuggcuacucuggggaggauuguucaacccgaaguugcccuggaggcugucgggggcgcggacaaugccuugacggcagaugugucugcgaggaugguuauagcggggaagacuguggagugaggcagugccccaaugauuguucccagcauggcguuugccaggacggcguguguauuugcugggagggguacguaucugaagacugcucgauccggacauguccaagcaacugccacggacgagguagaugugaggaaggccgcugcuugugugauccgggguauacuggaccuaccugcgccacaaggaugugucccgcagacugccguggccgggguagauguguccaaggggugugccugugucacguuggauacggcggcgaggauugcgggcaggaggaaccacccgcuuccgccugcccuggagguuguggcccaagggagcuaugccgcgcggggcagugugugugcgucgaaggauuccgaggccccgacugugccauucagacuugcccuggugauuguagagggcggggagagugccaugacggcucaugugugugcaaggauggcuaugcaggggaggacuguggagaagagguaccgaccaucgaagguaugaggaugcaccuccuggaggaaacaaccgugcgcacugaguggacgccagcucccggcccuguugaugccuacgagauacaauuuaucccaacaaccgaaggggcuagucccccuuucacugcccgugucccgucuagcgcauccgccuacgaccagagaggacuugcucccggccaggaguaucaggugaccgugcgggcgcugagggguacaucauggggguugccagcaagcaaaaccauuacuacaaugaucgauggaccucaagaccuccgcgucguugccgugacgcccaccacucuggaauuaggcuggcugcgaccacaggcugagguggauagauuuguagucucuuacguguccgccggcaaucagcggguuaggcucgaagugccucccgaggcagacgggacacuucugaccgacuugaugccaggagucgaguaugugguuacagugacugccgaacgcgguagagcuguaaguuacccggccagcgucagggcaaacaccggcucuuccccucuagggcugcucggaacgaccgaugagcccccacccucaggcccuaguacaacucagggugcgcaagcuccacugcuucagcagcggccccaagaacugggggaguugcgugugcucggacgcgacgaaaccggccgacugagaguggucuggacagcccagccugauacuuucgcauauuuucaguuaaggaugcggguuccggagggcccaggggcccaugaggaagugcugcccggagacguacgccaggcucuagugccucccccaccucccgguaccccauacgagcucagccugcacggcgucccuccggggggaaagcccucggauccaauuaucuaucaaggcauaauggacaaggaugaagagaaaccugguaaguccucugggcccccaagacuuggcgaguugacggugacagacaggaccagcgauucacugcuccugcgguggacuguuccugaaggagaguucgacaguuuugugauucaguacaaagaucgagacggccagccccaggucgugccgguugaagggccacaaagauccgccgugaucacaucucuugacccuggacgcaaguacaaauucguccuguaugguuucguaggcaagaagaggcacgggcccuugguggcagaggcuaaaauucucccacagagcgaucccuccccuggaaccccgccccaucugggcaauuuauggguuacugacccaaccccugauucacugcaccuaagcuggacagugcccgaaggucaguuugacacguucaugguccaguaccgggaucgugacgggagaccucaagugguaccaguggagggccccgagaggaguuuugucguuucuucccucgauccugaccauaaguaucgcuucacccuguuuggaaucgccaacaaaaagcgguacggcccacuuacugcggaugggacaaccgcccccgaacgaaaagaggaaccgccuagaccagaguucuuggaacagccccugcucggagagcugacagugacuggugugaccccugacagcuuaaggcugucguggacggucgcucagggcccauuugauucauucauggugcaauauaaggacgcacaggggcagccccaggccguuccgguagcuggagaugagaaugaagugacagucccuggccuugaccccgaccgcaaauacaagaugaacuuguauggucuccgggggagacaacgugugggcccagagucuguuguggccaagaccgcaccucaggaagaugucgacgagacucccaguccaaccgaacugggaacagaggcgcccgaguccccugaagagccacuacugggcgaacucacugugaccgggagcucuccggauagccugucccuuuuuuggacaguaccccagggaucauucgacaguuuuacgguccaguacaaagauagggacggccggccucgcgccgugcgaguuggugggaaggagagcgaggugaccgucggaggcuuggaaccaggucacaaauacaagaugcaucuguauggcuuacacgaggggcaaagagugggacccguuucugcugugggcgucacugccccucagcaggaagagacaccacccgcaaccgaauccccucucgagccgaggcugggggagcuuacugugacagauguaaccccaaacucagugggacugaguuggacgguucccgaaggccaguucgacagcuuuaucguccaauacaaagauaaggacggucagccucagguggugcccgucgcugccgaucagcgggagguaacuguguauaauuuggaaccagagcgcaaguacaaaaugaacauguaugggcuccacgacggacaaagaaugggcccucuguccguugugauugucaccgcaccccuaccaccggccccugcuacagaagcgucuaagcccccacuggagcccaggcucggugagcugaccgugacugauauaacaccugacucgguuggccuuagcuggaccgugccagaaggggaguucgacucauucgucgugcaguacaaagaucgagacggacagccccaaguagugccuguugccgcagaucagcgggaagucacaaucccggacuuggagccaucccguaaguauaaauuucuguuauucggcauucaggaugggaagagacgcagucccgugucuguggaagcuaagacugucgccaggggagacgccagcccuggcgcuccaccccggcucggugagcuguggguuaccgauccuacgcccgacucccuuagacugucauggacagugccagaggggcaguuugauucuuucguagugcaauuuaaagacaaggauggaccgcaggucgugccuguugaaggccaugagcgcagcgugaccgucacuccccuagacgcaggcaggaaauaccgauuccuccuguacggguugcugggaaagaaacggcacgguccauuaaccgccgacggcacaacugaagcgagaagugcuauggaugacaccgggacgaagaggccucccaagccacgccucggagaggagcugcagguaacaaccgugacucagaauuccguuggccuuagcuggacagugccugaaggucaauuugauucuuucgucgugcaguauaaagaccgugaugggcagccccaggucgugccgguugagggaucacugcgggaaguguccguaccaggcuuggacccugcccauagauacaagcuccugcuauauggccugcaccacgggaaaagggugggacccaucagugcagucgccauaaccgcuggucgcgaggaaacugagacagagaccacggcaccaacucccccugccccggaaccacaucuuggcgagcucaccguugaagaggcgacaagccacacccugcauuugucguggauggugacagaaggggaguuugauucuuucgagauucaauacacugaccgagauggacagcugcagaugguccggaucggcggugacagaaacgauaucaccuuauccgggcucgaaagcgaccacagguaucuggugacgcuuuacggauuuucagauggcaagcauguaggccccgugcacguugaggcucugacagugccugaagaggaaaaacccagugagccaccuacugccacccccgagccaccuauuaagccgcgcuugggggaacucacagucaccgacgcaacucccgacucucugucccuaagcuggaccgugccagagggacaauucgaucacuuucugguccaguauagaaauggugacggccagccuaaagccgugcggguucccgggcaugaagagggaguaacaaucucaggccuugagccagaucacaaguacaagaugaaccucuacgguuuccaugggggacagaggaugggcccugugagugucgugggcguuacggcugccgaagaggaaacucccagcccgaccgagccauccauggaagcaccugagcccgcugaggaaccacuguugggggaguuaacagugaccggaucuagccccgacucccugucacucucuuggacugucccucaaggucguuucgauaguuuuacagugcaguauaaagaccgagauggccgcccccagguagugagaguugggggagaagagucggaagucaccgugggcggucuggagccagggcggaaguacaaaaugcaccuuuauggacugcaugagggcaggcgcgugggcccugucagcgccguuggggugacggcgccggaagaggaaucccccgacgccccauuggcaaagcuaagacugggacagaugacuguacgggauauuacaucugacucacucagccuguccuggaccgugccugagggucaauucgaucacuuucuuguccaguucaaaaauggcgacgggcagcccaaggcugugaggguuccaggacacgaagacggcgugaccauaagugguuuagagccugaucauaaguacaaaaugaaccuguauggguuucacggaggccagcgagucggccccgugucugccguagggcucacugcuccgggaaaggacgaggaaauggcaccugccagcacagagccacccaccccugaaccacccaucaaaccucguuuggaggagcugacaguuacugaugccacgccagacucacucucccugaguuggaccgugcccgaaggucaauucgaucauuuucuuguccaguacaagaauggcgacgggcagccgaaagcuacaagagugccuggacacgaggaucgcgugacuauuagcggccuggaacccgacaacaaguauaagaugaauuuguacgguuuccacgggggccagcgggucggaccaguuucugcgaucggcgugaccgcagccgaggaagagacacccuccccuaccgagccaucaauggaagcucccgagccuccagaagagccgcuacugggggaacucacuguaacgggaagcucgcccgauucuuuaagucuguccuggaccgugccucaagguagguuugacagcuucacaguccaguacaaagauagagacggccgcccacaggugguucggguggggggagaggagucagaagucacugugggcggucuugagcccgggaggaaguauaaaaugcaucuguacggccuccacgaaggacgaagaguaggcccuguuuccaccgugggggucacagccccacaagaggauguggacgaaacccccucuccgacugagccuggaacagaggcaccaggucccccugaagagcccuugcugggcgaacucacgguuaccgggagcaguccagacucccugagccuuucuuggacugugccgcagggacgguuugauucauucacaguccaguauaaggacagggauggccgcccucaggccgugcguguagguggccaagagaguaaagugaccgucagagggcuagagcccggacgaaaguacaagaugcaucuguauggcuugcacgaagggaggcgguuaggaccaguuuccgcugugggcgucaccgaggacgaagcggagacaacucaggccgugcccacgaugaccccugaaccacccaucaaaccucgccugggugagcucacaaugacugaugcaaccccagacagccugucucuuucguggacaguaccggaggggcaguucgaucauuuucuggugcaguacagaaacggagacggccaacccaaggcuguuagggugccuggucacgaagauggcgucaccauuucagggcucgagccagaccacaaauauaagaugaauuuguacggauuccauggcgggcagcgggugggacccauaagcguuaucggcgucacugccgcagaagaggaaacgccuuccccaacagagcugaguaccgaggcccccgaaccuccggaggaaccccuacugggugagcucacugugaccgggucuagcccagauucccuuucacugaguuggacaauuccucagggacacuuugacucuuucacugugcaguacaaagaucgcgacggcagaccccaaguaaugcgagucaggggugaagagagcgaggugaccguuggcggguuagaaccaggacggaaguauaaaaugcauuuguacggccugcacgaggggcgucgcgugggaccugucuccacagugggcguuacggaagacgaggcugagaccacucaggccgugcccacaaccacuccagaaccgccuaacaagcccagacucggugagcugacaguaaccgaugcgacgccagacucacuuagccugucuuggaugguccccgaagggcaguuugaucacuuccucgugcaauauaggaauggagacggccagccuaaggugguucgggucccaggccaugaggauggggugaccaucuccggauuggaacccgaccacaaauacaagaugaaccuguaugguuuucauggcgggcagagaguaggaccuauuagugugaucggcgucacagcagccgaggaggaaacuccggcucccaccgagccaagcacagaagccccugagcccccagaagagccuuuacuaggugagcugacugugaccgggucgucccccgauucucucucacuuagcuggacaauaccacagggacgcuucgacaguuuuaccguucaauacaaagaucgagacggcaggccgcaggugguccgggugagaggcgaagaguccgaaguuacuguggggggacuggagccugguugcaaguauaaaaugcacuuguacggccugcaugaagggcagcguguaggacccgucucugcugugggcguuacggcaccaaaggaugaggccgagacaacccaggcugugccuacuaugacccccgaaccaccuaucaagccccgccucggugagcugacagucacggacgccaccccggacagccuuucacucuccuggauggugccagaagggcaauucgaucacuuucugguacaguacaggaacggagacggccagcccaaagcagugcgggucccuggccacgaggaugggguuacuauuaguggauuggagccagaccauaaguauaaaaugaaucuguacgguuuccacggcgggcagagagugggacccgugagcgcgaucggcgucacagaagaggaaaccccuucuccgacugagcccucaacagaagccccagaggcuccugaggaacccuuacuaggugagcugaccgugacaggguccagcccagauucucucagucuuucguggacuguuccucaaggacgauuugacuccuucaccguacaguauaaggauagggacggccagccccaagugguccgcgugcggggcgaagagagcgaaguuacgguggggggacuggagccagguagaaaauacaagaugcauuuguauggccugcacgaggggcagagggucggaccugugucaaccguaggcauuacagccccccucccgacuccucugccaguggaaccccgccuuggugaguuagcagucgcugccguuaccucugauagcguggggcuguccuggacagucgcacagggaccuuucgacaguuuucucgugcaguaccgugaugcccaaggccagccacaggcuguucccgugucaggcgacuugcgggcgguagccgugucugggcuggauccggcaagaaaguauaaauuccuacuguuuggacuccagaacgguaagcgacacggcccuguccccguggaagcuaggacugccccagacaccaaacccagcccucgccuuggggagcugacgguuacagacgccaccccagauuccgucggauugaguuggacugugcccgaaggcgaguucgacagcuuugugguacaauacaaggauaaagacggucggcugcaggucgugccuguugcagcuaaucagagagaggugacaguccaggggcucgaaccauccaggaaguaccgcuuccuguuauauggccuuucuggaagaaagcggcugggcccgaucucagccgauagcaccacugcgccccucgagaaagaacuaccuccacaucugggggaguugaccguggcugaggaaacaucguccagucugcgacucucuuggacgguugcccaaggacccuuugacagcuucgugguccaguacagggauaccgacggucagccucgugcagugccaguagccgcugaucagagaacugugacaguugaggaccuugaacccggcaagaaauauaaguuucuguuguacgggcugcucggaggcaaacgguuagguccggucucagcacuggggaugaccgccccugaggaagauacuccagcgcccgagcuugcuccugaggcccccgaaccaccugaggaaccccgccugggcgugcuaacagugaccgacacgacaccagauuccaugaggcucucuuggagugucgcacaaggaccguucgacagcuuuguugugcaguaugaggacaccaacggccagccccaagcccuguugguagauggggaccaguccaagauacugauuucaggacucgaaccuagcacuccauaccgauuccuucuguaugguuuacacgagggcaagagacuggggcccuugucugcugagggaaccacaggccucgccccugcaggucagacuagugaagagucccggccacgccugagccagcuaucagugaccgaugucacaacgucuucccuuaggcugaauugggaagcucccccuggggccuuugacucguuccuccugagauucggcgugccgagcccaaguacuuuggagccccauccucggccacugcuccaacgugaacuuaugguucccggaacccgccacucugcggugcugagggauuuacgauccggcacacuguacagcuugacccucuacgggcugagaggaccucauaaagccgacucaauccaggguacugcacggacacuaagucccguccuugaguccccaagggaucugcaguuuagcgagauucgcgaaaccucugcuaagguaaacuggaugccgccucccucaagagccgacagcuucaaaguguccuaucagcucgcagauggcggggagccacaaucuguucagguggacggacaggcucggacgcagaagcugcaaggcuugaucccuggugccagguacgaagucacuguggugaguguccgcggcuuugaggagucggaacccuuaaccggguuccugacaaccguuccagauggaccgacucagcuccgagcccuuaaucugacagagggcuuugcggugcuacacuggaaaccuccccagaacccaguagacaccuaugacgugcaagucacagcucccggggcaccuccacugcaggccgaaacucccggaagcgcuguugauuacccucuccacgacuuggugcugcauaccaauuauacggccacagugagaggccuucgugguccgaaccugaccuccccagcaucaauaacuuucaccacagggcucgaggccccccgggauuuagaagcuaaggaggucacuccuaggacggcgcuguugaccuggacagagcccccaguacgcccugccggauaccugcucucuuuucacacccccggcggucagaaucaggaaauccuucugccaggcgggauuacuagccaucaacuacugggacucuucccuaguacauccuauaacgcaagauugcaggcuauguggggccagucacugcuuccgcccgugucuaccagcuuuacuacagggggacugcggaucccauucccuagggacugcggcgaggaaaugcagaauggugccggggcaucccgaaccaguacgauuuuuuuaaacggaaauagagagcgcccccucaacguuuucugugauauggaaacugacggcgguggcuggcugguguuucaacggaggauggaugggcagaccgacuucuggcgugauugggaggacuacgcccacggauucggcaacaucagcggggaguuuugguugggaaaugaagcucugcauucucucacacaggccggcgauuacucaaugagagucgaccuucgcgcgggugaugaggcaguguucgcccaguaugacuccuuucacguugacagcgcugccgaauacuauaggcugcaccuagagggguaccauggaaccgcaggcgauaguaugucuuaucacuccggcucgguguucagcgcucgggaccgagauccaaacucacugcucauauccugcgccgucucuuacagaggggcuuggugguaucgcaauugucauuacgccaacuugaauggacuguacgguaguacuguagaccaccaaggcgugagcugguaucacuggaaaggguuugaauucucagucccuuuuacagagaugaaguuaaggccccggaacuucagauccccggcaggaggcgguuga

SEQ ID NO: 64076 - RNA, 1038 nt, Artificial Sequence
  derived and/or modified sequence opt3 from TOB1__Homo_sapiens__NP_001230806
augcagcuggagauccaaguggcccucaacuucauuauaagcuaccuuuauaauaagcugcccagaaggcgggucaacaucuuuggcgaagaguuggaacgcuuacugaaaaagaaauacgaggggcacugguauccugaaaagccauacaaaggauccgguuuccgaugcauucauaucggcgagaagguugacccggugauugagcaggcuucuaaggaaucagggcuagauaucgacgauguacguggaaaucucccccaggaccugaguguguggauagauccuuuugaggucagcuaucagaucggcgaaaaagguccagugaagguucuuuacguggacgauaacaaugagaacgggugugagcuggacaaagaaauuaaaaauuccuucaaccccgaggcacaagucuuuaugccuaucucugauccagccucgucagugagcaguucccccucuccuccauucggacacagcgcggcuguauccccgaccuuuaugcccagaucaacacagccuuugacuuucacgaccgccacauuugcagccacuaaguucggcaguaccaagaugaagaauagcggcaggucuaacaaaguugcucggacauccccaauuaaucucgggcugaacgugaaugaccugcucaagcagaaagcaaucucaagcaguaugcauucuuuauauggacugggucuuggcucccagcaacagccccagcagcaacagcagccugcccaaccacccccgccucccccaccuccccagcagcagcaacagcagaagaccagcgcuuugucgccaaacgccaaagaauuuauauuccccaauaugcaggggcaaggaucuuccacuaacggcauguuuccuggugauucaccacugaaccuaaguccgcuccaguacagcaaugcguucgacgucuucgcagccuacgggggacugaacgagaaguccuuuguggauggccuuaauuucucucugaacaauaugcaguauagcaaccagcaauuucagcccgugauggcuaauuga

SEQ ID NO: 64077 - RNA, 1035 nt, Artificial Sequence
  derived and/or modified sequence opt3 from TOB2__Homo_sapiens__NP_057356
augcagcuggagaucaagguggcccucaacuucauuauaagcuaccuuuauaauaaacugcccagaaggcgggcugacuuguuuggcgaagaguuagaacgccugcuaaagaaaaaguacgaggggcacugguauccugaaaaaccacucaagggauccgguuuccgaugcguccauaucggcgagaugguugauccggugguagagcuggcagccaagcguucugggcuugcgguggaagacgucagagcuaacgugcccgaggaacugucaguuuggauugauccuuuugaggugaguuaccaaaucggagagaaaggcgccgucaagguguuguaucucgacgauagcgaagguuguggggcaccagagcuggacaaagaaauuaaguccucuuucaaucccgaugcccagguauuuguuccuaucggaucgcaggacucaagccugaguaacuccccaucucccagcuucggccaguccccuucaccaaccuuuauaccgaggagugcucaacccaucacauucacuacggccagcuuugcagcuaccaaauucggcucuacaaagaugaagaaagggggaggugccgcguccggcgggggaguggcaucaagcggcgccggugggcagcagccuccacagcaaccccggauggcucgcaguccuacuaauucucucuuaaagcacaaaucccugagccuuucgaugcauucuuugaacuuuauuaccgccaauccagcaccccagucccagcugucaccgaacgcuaaggaguucgucuacaauggaggcggcaguccuagccuauuuuucgaugccgcggacgggcagggauccgguacacccggcccauucgggggaucuggcgccgguaccugcaacagcucaaguuuugauauggcacaaguguucgggggcggagcuaauucccucuuucuggagaaaacuccuuucguggaaggccuuagcuauaaccugaauacaaugcaguaccccucucagcaauuucagccagucguuuuggccaacuga

SEQ ID NO: 64078 - RNA, 825 nt, Artificial Sequence
  derived and/or modified sequence opt3 from TOLLIP__Homo_sapiens__NP_061882
auggccaccacagugagcacucagagaggccccgucuacaucggggagcugccucaagacuuccucaggauuacgccaacccagcagcagcggcaaguucagcuugaugcucaggcagcccagcaacugcaguauggaggugcggugggcacaguagggcgcuugaacauaacugugguccaggcuaaguuagccaaaaauuacggaaugacccgaauggacccguauugccgucugagacuaggcuacgcaguguaugaaacacccaccgcccacaacggugcuaagaauccuagguggaacaaaguuauccauuguacugugccacccggggucgauuccuuuuaccucgagauuuucgacgaacgggcauuuucuauggaugaccgcaucgccuggacacacauuaccaucccugagucacugagacagggaaagguggaagauaaaugguauagucuuagcggcaggcaaggcgacgauaaggaggggaugauaaaucugguaauguccuacgcuuugcucccagccgcgaugguuaugcccccucagccagugguccugaugccgacgguguaccagcaaggaguggguuauguccccaucacuggcaugccugcaguuugcucuccagggauggugcccguagcccugccuccagcugccgugaacgcacagccccgguguucggaggaagaccucaaggcuauucaggauauguucccgaauauggaccaggaggucauccgcucaguguuagaagcccaacgaggaaacaaagaugcggccauuaauagccugcuucagaugggcgaggagccuuga

SEQ ID NO: 64079 - RNA, 1383 nt, Artificial Sequence
  derived and/or modified sequence opt3 from TOM1__Homo_sapiens__NP_001129201
auggagaucugcgacauuauaaacgaaaccgaggaaggccccaaggaugcccugagagcugugaaaaagaggaucgucgggaauaaaaacuuccacgagguuaugcucgcacuuacagugcuggaaacuuguguaaagaauugcggacaucgguuucacguguuggucgccagccaggacuucguggaguccguuuuagugcgcacgauucugccuaaaaacaauccaccgaccaucguccaugauaaggugcuaaaccucauucaaucuugggcggacgcuuuucgaucaagucccgaucugacagguguaguuacuaucuacgaggaccuucguagaaagggccuggaguucccuaugaccgauuuggacaugcucagcccaauacacacaccccagaggaccguguuuaauuccgagacucagucugggcaggauucggucggaacagacucaagccaacaggaagauaguggccagcaugccgcaccucugccagcucccccuauccuguccggugacaccccaauugccccgacgcccgagcagaucgggaaacuccggucugaguuagaaauggugagcggaaacgugcgcgucauguccgagaugcugacugaacuuguuccuacccaagcagagccagccgauuuggaacugcuacaggagcucaauagaacauguagggcuaugcagcagcgggugcuggagcuuauuccccaaaucgccaacgaacagcugacugaggaauugcucauaguaaaugacaaccugaauaacguguucuuacgccacgagcgauuugaaagauucaggaccggccagacaaccaaggcgccuucagaggcagagccagccgcugaccugauugauaugggccccgacccggccgcaacggggaaucucaguagccaacuugcuggaaugaaccuggguucuuccucaguccgggccggcuugcagagccuagaagcgagugggcgucuggaggaugaauuugacauguucgcccucacucgcggaucuucccuggcagaucagagaaaagaggugaaguaugaagcuccucaggccacagacggccuugcuggugcccuggaugcaaggcaacagagcaccggggccauccccguuacucaggcuugcuugauggaggacauugagcaguggcucucgacagaugugggaaacgacgcggaagaaccaaaaggcgucaccucugaaggcaaguuugauaaguuccuggaggagcgggcaaaagccgcugaccgauuaccuaaucuguccucacccagugccgaagggccacccggaccuccaagcgguccggcaccccgcaagaaaacgcaagagaaggacgaugacaugcuauuugcccucuga

SEQ ID NO: 64080 - RNA, 1431 nt, Artificial Sequence
  derived and/or modified sequence opt3 from TOM1L1__Homo_sapiens__NP_005477
auggccuucggcaagagccacagagaccccuacgcuaccuccguggggcaucugaucgagaaagcaacauuugccggaguccagacugaagauuggggucaauucaugcacauuugcgacauaaucaacacgacccaggauggcccuaaggacgcgguuaaagcucucaagaaaaggauuucuaagaauuauaaccauaaggagauccagcuuacacugucauugauugauaugugugugcagaauugcgggccaaguuuucagagcuuaaucgugaaaaaggaguucguaaaagaaaaccuggucaagcuacucaauccgcgguacaaccugccccuugacauacaaaaucgcauccugaacuuuauuaaaacuuggucccagggauucccuggcgguguggauguuucugaagugaaggaggucuauuuggaccucgugaagaaagggguacaguuuccacccucggaggccgaagcagagaccgcccgacaagaaacagcucagaucucaagcaauccuccaaccaguguucccacugccccugcacuguccucugugauugcuccaaagaacagcacagucacccuggugccggagcagaucggaaaacuccacuccgaguuagauauggugaagaugaauguccguguuaugucagccauacugauggaaaacacgcccggcagugagaaucaugaagacauugagcuuuugcagaaacuguacaagacuggcagagaaaugcaagagaggaucauggaucuacucgugguaguggagaacgaagacgucaccguggagcugauucagguuaaugaagaucuuaacaacgcgauccugggguaugagcgguucacacgcaaucagcaaagaaucuuggaacagaacaaaaaucagaaggaggcaacuaacaccacaagcgagccuucugccccaucccaggaccuccuggacuuaucacccagcccuaggaugccacgggcuacccugggagaacucaauacgaugaacaaucaacuuaguggucugaacuuuucuuugcccuccagcgaugugacuaauaaccuaaagccgucgcugcacccucagaugaaucuccuggcccuugagaacacagaaauucccccauucgcacagcgcaccucucagaaucugacuuccucacacgcuuacgacaacuuuuuggagcauaguaauagcgucuuccuccaaccugugucccugcagacaauagccgcggcccccucuaaccagagcuuaccaccccugccuucaaaccacccagcaaugaccaaaagugaucuacagccgcccaauuauuacgaaguaauggaguuugacccucucgcuccagccguuacgaccgaggcuaucuacgaagagauugaugcccaucaacacaagggcgcacagaacgacggggauuga

SEQ ID NO: 64081 - RNA, 438 nt, Artificial Sequence
  derived and/or modified sequence opt3 from TOMM20__Homo_sapiens__NP_055580
auggugggcagaaacagcgccaucgcugcaggggucugcggagcccuguucauugguuacuguauauauuuugacaggaagcggcgcuccgaucccaauuucaaaaaccgacuccgugagagaaggaagaaacagaaguuggcgaaagaacgggcuggccugucuaaguugccugacuuaaaggaugccgaggcaguucaaaaauuuuuccuggaagagauccagcuaggggaggaacuccuggcccagggagaguacgaaaagggcguggaccaccuuaccaaugcuauugcaguaugcggucagccacaacagcugcuucaggugcuccagcaaacacugccgcccccugucuuucagaugcugcucacuaaauuaccaacgaucucacagcgcauugugagugcccagagccuggcugaggaugacguugaauga

SEQ ID NO: 64082 - RNA, 930 nt, Artificial Sequence
  derived and/or modified sequence opt3 from TOMM34__Homo_sapiens__NP_006800
auggcccccaaguucccugacagcguggaggaacugagagcugcaggcaacgaguccuuuaggaaugggcaguacgccgaagcgucugcucucuauggacgggcccuucgcguccugcaagcacaggguucaagugauccagaggaagagagcguuuuguacuccaaccgagccgcuugccacuuaaaagacggcaauugucgugauugcaucaaggacuguaccucugcacuggcccuagugccguucucgauuaaaccccuccugagaagggcuucagccuaugaggcgcuugaaaaguacccuauggcauauguagauuacaaaacagugcugcagauagacgauaacgucacuagcgccguggaggggaucaaucggaugacgcgcgcuuugauggacagucucggaccagaauggagacugaagcugcccuccauuccucucguuccagugucugcccagaagagguggaacagcuuacccuccgagaaucauaaagagauggcaaagucaaaaaguaaggaaaccacagcuacuaaaaaccgggucccuagcgccggcgauguggagaaggcgcgcguacugaaggaagaggguaaugaacuuguuaaaaaggggaaccacaaaaaggccaucgagaaauauucugaguccuugcugugcucaaaucuagaaagcgcaaccuacaguaaccgagcucucuguuaccuggugcuuaagcaauauacagaggccgucaaagacugcaccgaagcucugaaguuggauggaaagaaugugaaagccuuuuacagaagggcacaggcccauaaggcucucaaagacuauaagucuuccuucgcggauauuagcaaccuguuacagaucgagccacggaauggcccggcacagaaacugcgucaagaagugaagcagaaccuccacuga

SEQ ID NO: 64083 - RNA, 1086 nt, Artificial Sequence
  derived and/or modified sequence opt3 from TOMM40__Homo_sapiens__NP_001122389
augggcaacgugcuggccgcuagcucucccccugcagggccaccgcccccuccagcccccgcgcucgucggacuuccuccacccccuccauccccgcccgguuucacccugccuccauugggcgggucauuaggagcuggcacaaguacuagcagauccucugagaggacgcccggugccgcaaccgccucggcuucaggggcagccgaagacggagcuugcggcugucugccuaauccaggcacauuugaggaaugccaccggaaguguaaagagcuauuccccauccagauggaagggguuaagcucacugugaacaaaggacugagcaaucauuuucaaguaaaccacaccguggcccuuaguacaauuggugaguccaauuaccauuucggcgucaccuauguggggacuaagcagcugucuccgacagaggcguuuccuguuuuggugggagauauggacaacagcggcucccucaaugcacaggucauacaccagcugggucccgggcugcgcucaaaaauggccauccaaacccagcagaguaaguucgugaacuggcagguagauggagaauaccgaggcagcgacuuuacggcugccguuacucucggcaauccagauguguuagucgggucugguauucugguggcacauuaucuucaauccaucaccccuugcuuggcucugggaggcgagcuaguguaccaccguagacccggggaagagggaacagucaugucacucgccggcaaguauacucugaacaauuggcuugcgaccguuacacugggucaggccgggaugcacgcaaccuacuaucauaaagcuagcgaccagcuccaggugggcguagaguucgaagccaguacgaggaugcaagauacuucuguguccuuuggauaccaguuggaccugccaaaggcuaacuuacuguucaaaggcagcgucgauucgaauuggauugugggggccacacucgagaagaaacuucccccucugccauugacccuagcacugggagccuuucucaaccaccggaagaauaaguuccagugugguuuuggccugacuaucggguga

SEQ ID NO: 64084 - RNA, 1827 nt, Artificial Sequence
  derived and/or modified sequence opt3 from TOMM70A__Homo_sapiens__NP_055635
auggccgcuagcaagcccguggaggcagccgucguugcggcugccgugccuuccucuggcucagggguaggagguggcgggaccgcaggaccaggcacaggugggcugccgagauggcagcucgcccuugcugugggagcaccccuguuguuaggcgccggcgcuaucuaccuguggaguaggcaacagcggcgccgagaagcccgugggagaggagacgcgagcggucuaaaaaggaacuccgagcggaagacuccugaaggccgcgcaucuccagcccccgggucgggacacccugagggcccaggugcucaucucgauaugaauagccuggacagagcccaggcagcuaaaaacaaggggaauaaauauuucaaggccggaaaguacgaacaggcgauucaaugcuauacggaggccauaagccuuugucccaccgagaaaaacgucgaucugaguacauuuuaccagaauagggcagcugccuucgaacaguugcagaaguggaaagagguggcucaagacugcacuaaggccguugaacucaacccuaaauaugugaaggcacuguuucggcgcgccaaggcucacgagaaacuggauaauaagaaagagugucucgaagacgucaccgcggugugcaucuuagagggcuuccagaaccagcaguccaugcugcuugcagauaagguauugaaacugcuaggcaaggaaaaagccaaggagaaguacaaaaaucgagaaccacucaugccgucuccccaauuuauuaagagcuauuucuccucauuuacagacgauaucauuagucagccuaugcugaaaggggagaagucagacgaggauaaagacaaggaaggagaggcucuugaaguuaaggagaacucugguuaccugaaagccaagcaguacauggaagaggagaauuaugauaaaaucauauccgaauguucaaaggagaucgacgcagaaggcaaauacauggccgaggcuuugcuccugagagccaccuucuauuuacugauugggaacgcaaaugcggcuaagccagaccucgauaaggugaucagccuuaaagaagccaacgucaagcugagggcaaaugccuugauuaaacggggaaguauguacaugcaacagcagcagccccuacugucuacucaagacuuuaacauggcugccgauaucgacccucagaacgcagauguguaucaucaccguggccagcucaagauacugcuugaccagguggaggaggcugucgccgauuucgacgaaugcauucgccugagaccagaguccgcguuggcccaagcucagaaauguuuugcacucuacaggcaggccuauacagguaauaacagcucgcagauccaagcugccaugaagggguucgaagagguuauuaagaaauuuccccggugcgcagagggcuacgcgcuguacgcccaggcuuuaaccgaucagcagcaauucggaaaggccgacgaaauguaugauaaauguaucgaccuggagccggacaaugcaacgacuuacgugcauaagggccuacuccagcugcaguggaaacaagaucuugaccgaggguuggaacugaucucuaaggcuauugagauagauaacaaaugcgacuucgccuaugaaaccaugggaacaaucgagguacagcgcgguaauauggagaaggcaauugauauguuuaacaaggccaucaaucucgcuaaauccgaaauggagauggcgcaccuguacucacuuugugacgccgcacacgcucagacugaaguggccaagaaauauggccugaagccucccaccuuguga

SEQ ID NO: 64085 - RNA, 4137 nt, Artificial Sequence
  derived and/or modified sequence opt3 from TONSL__Homo_sapiens__NP_038460
augagccuggagagagaacucaggcagcuuuccaaggccaaagcuaaggcacaacgggccggccagcgccgagaggaagcggcucugugccaccaguugggggaguuacuggccggacauggucguuacgcagaagcccuagagcagcacuggcaagagcuccagcugagagaaagggcugacgauccccuuggcugugcaguggcccaucggaaaaucggggagcgccuggcugaaauggaggacuauccugccgcguugcagcaccagcaucaauaccucgagcuggcacacucucugagaaaccacaccgaacuccagagggccugggcuacaauuggacggacucauuuagauauauaugaccacugccagucacgcgaugcccugcuucaggcacaagcugccuucgagaagaguuuggcgaucgucgacgaagaacuggaaggcacgcuagcccagggugagcucaaugagaugcgaaccagacuguaccuuaaccugggguugacauuugaaagccuccagcaaacugcacuguguaaugauuauuucaggaaauccaucuuuuuagcugagcagaaccaucuguacgaagaccucuuccgggcccguuauaaucuuggaaccauucacuggcgcgcuggccagcacucucaggccaugagaugccuggagggcgcaagggaaugugcccauacaaugcggaagcgauuuauggagucggagugcuguguugugauugcucaaguauugcaggaucuaggggacuuccuggcggcaaagcgcgcccucaaaaaggcuuacagacugggaucacagaaaccagugcagagggccgcaaucugccaaaaccuucagcacguccuggccgugguucgguugcagcagcaacucgaagaggcugaaggucgcgauccgcagggcgccauggugauaugugagcagcugggggacuuauuuagcaaggcaggagauuuccccagagcggcugaagccuaccagaaacaacugagguuugcagagcuacucgaccguccuggcgccgagcgggcuaucauucaugucagucuggccaccacucuuggugacaugaaggaucaccauggggcagugcgacacuaugaagaggaauugagacugagguccggaaauguacucgaggaggcuaagacauggcugaacaucgcccuuucucgcgaagaggcgggcgacgccuacgaacuguuggcuccaugcuuccagaaagcacucagcugugcccagcaagcucagcggccccagcugcagagacaaguuuuacagcaucugcacaccgugcagcuaaggcuccagccucaagaggccccagaaacggagacucgccugcgagagcuuuccgucgcagaagaugaggacgaagaggaagaggcggaggaagccgcugccaccgcagagucagaggcuuuggaggccggcgaaguggagcugagugagggggaagaugacacagauggacucacuccccagcuggaggaagacgaggaguuacagggucaccugggccggcguaaggggagcaaauggaauagaaggaacgauaugggagaaacccuuuugcaucgcgcaugcauugagggccagcuccggagagugcaagaccuggucaggcagggucacccucuaaauccacgagauuauugcggguggacaccgcugcacgaagccuguaacuacggccaucucgagaucguucgcuuucugcuugaccacggagcugcgguggacgaucccggcgggcagggaugcgaagguauaaccccuuugcaugacgcccugaauuguggccacuucgagguagcagaguuacuccuggaaagaggggcuucugugacgcuucggacuaggaagggacuguccccauuggagacacuccaacagugggucaaacuguaucgucgcgaucuagaccuggaaacccggcagaaggccagagccauggagaugcuccugcaggcugcagccucaggccaagauccccauagcagucaggcguuucacacuccuucuucccuuuuguucgacccagaaacaucucccccgcugucgccuugccccgagccaccuucuaacuccaccagguuacccgaggcuucacaggcccacgugcgaguuaguccaggucaggcagcccccgcuauggcacggccucgcagaagcaggcaugggccagccuccucuagcucaaguuccgaaggcgaggauagcgcgggaccggcucggcccucucaaaaacgaccuagauguucagccacggcacagcgcguggccgcuuggaccccaggccccgccaguaauagggaagcagcuacagccagcacuucccgugcggccuaccaggcagcuauuagaggggucggaucugcccagucgcggcucgguccuggcccacccagggggcacagcaaggcucuggcaccgcaagccgcccuuaucccugaggaagagugccuggcuggagacuggcuagagcucgauaugccacugacccgcucccgaagaccccggccuaggggcacaggugacaaccgccgucccucaaguacuucugggagcgauuccgaagagucaagaccacgggcgagggcaaaacaggugcgcuugaccuguaugcagagcugcucugccccuguaaacgcuggccccuccagucuggccagcgaaccaccgggaucuccuuccacaccccgaguuucagagccaaguggcgacagcucggcagccgggcagcccuuaggaccugcuccacccccuccgauuagagugcggguccaagugcaggaucaucucuuccugaucccagucccccacuccucugacacccauagcguggcguggcuugccgagcaggcagcucaaagguauuaccagacuuguggccuguugccucgccucacgcugagaaaggaaggugcccuacuggcaccacaggaccuuauccccgauguucuccagucaaaugacgaggugcuggccgaaguaacaaguugggauuugccuccgcugaccgacagguaccggcgugcuugccaauccuuagggcagggagagcaccagcagguccuccaagccguggaacugcagggccuuggucugucuuuuagcgcguguuccuuggcacucgaucaggcccagcugacuccccuacugcgcgcucuuaagcuccacaccgcccugcgagaguugagauuagcuggcaacaggcugggggacaaaugcguugcagagcucguggccgcucugggaacaaugccaucacuugcccuguuggaucuaagcaguaaucaucugggcccugaagggcuccggcaacuggcaaugggacuucccggccaggcgaccuuacagucucuggaggaacucgacuuguccaugaacccacugggugaugggugcggacaaagccucgccucgcugcuucacgcuuguccucuguugucaacucuacgccugcaggccugcggcuucggucccagcuuuuuccucagucaucagacagcauuaggcuccgcuuuucaggacgccgagcaccugaagacgcuuagccugucuuauaaugcacucggggccccagcuuuggcgagaacccugcaaagccucccggccggaacucugcuucaccuagaacuguccucagucgcagcuggcaaaggggauagugacuugauggagccuguguucagguacuuagccaaggagggaugugcccuggcacaucucacacugagcgcuaaccaccuuggcgauaaggccguacgggaccugugccgaugucucucuuugugccccucccugauuucacuagaccugagugcgaauccagaaauaagcugugcuucccucgaggaacuucugucuaccuuacagaaaagaccccaggguuugucguuucuggggcucagcggaugcgccgugcagggcccucugggucuuggccugugggauaagaucgcagcccaacuccgcgaguugcagcuguguucaaggcgguuaugcgcugaagaccgugaugcacuaagacagcugcagccauccaggcccgggccuggagaguguacacucgaccauggcaguaaacuuuucuuucgccggcuguga

SEQ ID NO: 64086 - RNA, 2298 nt, Artificial Sequence
  derived and/or modified sequence opt3 from TOP1__Homo_sapiens__NP_003277
augagcggggaccaucugcacaacgauucccagaucgaggccgacuucagacucaaugauucucacaagcauaaagacaagcacaaagauagggaacaucggcacaaggagcacaaaaaggaaaaggaccgcgagaaaucaaagcauaguaacagcgaacacaaagauuccgagaagaaacauaaggagaaggaaaagaccaagcacaaagacgggucuucggagaagcacaaagauaagcauaaagaccgagauaaggaaaagcguaaagaggagaaggugagagcuucaggagacgcaaaaauuaagaaagaaaaggagaaugguuuuagcagucccccucaaauaaaggaugaaccagaggacgacggcuacuucgucccgcccaaagaagauaucaagccucuuaaaaggccacgggacgaggaugacgccgauuauaagcccaaaaagauuaagacagaggacacuaaaaaggaaaagaagcgcaaacuggaggaagaggaagaugggaaguugaagaaaccuaagaacaaagacaaggauaaaaagguuccagagcccgacaauaaaaagaagaaaccuaagaaagaggaagaacagaaguggaaauggugggaagaggaaagauacccagagggaaucaaguggaaguuuuuagagcacaaaggcccgguguucgcgcccccuuaugaaccacugcccgagaacguaaaguuuuacuaugaugguaaagugaugaagcuauccccuaaagcugaagaggucgccacguucuuugcaaagaugcucgaccaugaguacaccacaaaggaaauuuucaggaaaaacuuuuucaaggacuggcggaaagagaugacuaaugaagagaagaauaucauaaccaaccugucuaaaugcgauuuuacacagaugagccaguauuucaaggcccaaaccgaagcucgcaagcagauguccaaagaggagaaacuuaaaaucaaggaagagaaugaaaaacuguugaaggaguacggguuuuguauuauggacaaccacaaagaacgaaucgcaaauuucaagauugagccacccggacucuucagaggcaggggcaaccauccgaagauggggaugcugaaacggcguaucaugccugaggauauaauuaucaauugcucaaaggacgccaaagugcccaguccaccucccggacacaaguggaaagaaguucgccacgauaacaaggugacuuggcuggucagcuggacagagaacauucaggguucuaucaaguacaucaugcucaauccauccucaagaauuaaaggcgaaaaggacuggcagaaauaugagaccgcuaggcgguuaaagaaauguguggauaagauacgaaaccaauaccgcgaagacuggaaaagcaaagagaugaagguaagacagagggccguugcgcuguauuuuaucgauaaacuugcauugcgggccgggaaugagaaggaagagggagaaacggcugacacugugggcugcuguagucugcgcgucgagcauauuaaccuacaccccgagcucgauggucaggaauacgugguggaguucgacuuucuggggaaagauucuaucagauauuacaauaaggucccuguugaaaagaggguguucaaaaaccuucagcuguuuauggagaauaagcaaccagaagacgacuuguucgaucgucucaacaccggaauacugaauaaacauuuacaggaccugauggagggccucacagccaagguauuucggacuuauaacgcauccauuacccuucagcaacagcugaaagaguugacagcuccggaugaaaauauccccgccaagauccuaagcuacaaccgagcgaauagagccguggcaauucugugcaaccaccagagggcuccuccaaagaccuucgagaaaucgaugaugaaucuccagacgaagaucgacgccaaaaaggaacaacuggcugaugcccgccgggaccuuaaaucugcaaaggccgaugcuaaagucaugaaggacgcgaagacuaaaaaggugguugaguccaaaaagaaagcagugcagagacuggaggagcaguugaugaagcucgagguccaggccacagauagggaagagaacaagcaaauugcucugggcaccucaaaauuaaacuaccuggacccccgcauaacuguggccugguguaagaaauggggcguaccuaucgaaaagauuuauaauaaaacacagcgagagaaguuugcaugggccaucgauauggcugacgaagauuacgaguucuga

SEQ ID NO: 64087 - RNA, 4596 nt, Artificial Sequence
  derived and/or modified sequence opt3 from TOP2A__Homo_sapiens__NP_001058
auggaggugagcccccugcagccugucaacgaaaauaugcaaguuaacaagaucaaaaagaaugaggacgccaaaaagagacucuccguggaaaggauuuaccagaaaaagacccagcuugagcacauacuguugcggccagauacauauaucggcucuguagaauuagugacucagcaaaugugggucuacgacgaggauguggggauuaacuaucgcgagguuacguucgugccgggacuguacaagaucuuugacgaaauucuagucaaugcugcagauaacaaacagcgagaccccaagaugucaugcauccgugugaccauagauccugagaauaaccucaucaguauuuggaauaacgguaaaggcaucccaguaguugaacauaagguggagaaaauguauguccccgcccugauuuucgggcagcuucugacaagcuccaauuacgacgaugacgagaagaaggugacuggaggcagaaacgguuauggggcgaaauuguguaauaucuuuucuaccaaguucacaguggaaaccgcuucgagggaguacaaaaagauguuuaaacagacuuggauggauaacaugggacgggccggcgaaauggagcucaagccuuucaauggcgaagacuacacaugcauaaccuuucaaccagaucugucaaaauucaagaugcagagccuggacaaggacauugucgcacucaugguucgcagagccuaugauaucgcugggaguacgaaagacgugaagguauuuuuaaacggaaacaaacugcccgugaaggguuucagguccuacgucgauauguaucuuaaagacaaguuggaugagacuggcaauucucugaaggugauucacgagcagguuaaccaucggugggaagugugucuaaccaugagcgagaaaggguuucagcaaaucuccuucgucaauucaaucgcaacaaguaagggaggccgccacguggacuacguagccgaucagauuguuacuaaacucguggacgucgugaagaaaaagaacaaggguggggucgcugugaaagcccaucagguuaagaaucacauguggauauuugugaacgcgcugaucgaaaauccuaccuucgauagccaaacaaaagagaacaugacccuucagccaaagucuuucggauccacgugccagcugucagaaaaauuuauuaaggcagccaucggcuguggcauaguagagagcauuuugaauugggucaaguucaaagcucaggugcaacucaacaagaaaugcagugccguuaagcacaaucgaaucaaagggaucccgaagcuggacgaugcaaacgacgcuggagguagaaauucuacugaguguacauuaauucugaccgaaggcgacuccgccaaaacucucgcggugagcgggcuuggagucgugggcagggauaaguaugguguauuuccccugcgggggaagaucuugaacgugcgugaggccucgcauaaacagauuauggaaaaugcagagauaaacaacaucauuaagaucguuggccuacaguacaaaaagaauuaugaagacgaggauucucugaaaacacuccgcuacggaaagaucaugauuaugaccgaccaggaucaagacggcucccacauaaaggggcugcuuaucaacuucauucaucacaauuggccuucacuguugagacacagguuucucgaggaguucaucacgccaauugucaaagugaguaagaacaaacaggaaauggcuuuuuacagccugcccgaguucgaagaguggaaguccucuaccccuaaucauaaaaaguggaaggugaaauauuacaagggauuagguacaagcacuucaaaagaagccaaggaguauuuugcugauaugaaacggcaccgaauccaguucaaguacaguggcccagaagacgaugccgcaauaucccuggccuuuagcaagaaacagaucgacgaucgcaaggaguggcuaaccaacuucauggaagacagaaggcaacggaaacuccuggggcuucccgaggauuauuuguacggacagacaacuaccuaucugacauacaaugacuuuauuaacaaggagcucauccuguucucuaauucagacaacgaacgcaguauuccgagcauggucgauggccuuaaaccuggucagagaaagguucuguuuaccugcuucaaaaggaaugacaagcgugaggugaagguggcucaguuggcgggguccguagcagaaaugucuucguaccaucacggcgagaugagccucaugaugacuaucauaaaccuggcccaaaauuucgucggauccaacaauuuaaaccugcuacagcccauuggccaguuugggacgcggcuccauggagguaaagauucagcuaguccacgauauaucuucacaaugcugucuagccuugccagauugcuguuuccucccaaggacgaucacacccucaaauuccuguacgacgauaaccaaaggguggaaccagagugguauauucccaucauaccuaugguuuuaaucaauggcgcagaggggauuggaacuggcugguccuguaagaucccaaacuuugacgugcgcgaaauugucaauaacauccggagacugauggauggugaggaaccgcuucccauguugccuucauacaaaaauuucaaggggaccauagaggaacucgccccaaaccaguaugugauuagcggcgagguugcuauccuaaauucuacaaccaucgagauuuccgaacugcccgugaggacuuggacacagacguacaaggagcagguacuggaaccuaugcucaacggaaccgagaaaacuccaccccugaucacagacuaucgcgaguaccacaccgauacaacugucaaguuuguggugaaaaugaccgaagagaaacuugccgaagcagagcgagucggcuugcauaaaguuuucaagcugcaaacgaguuuaaccugcaauagcauggugcucuuugaccacguagggugucugaagaaauacgauacagugcuugacauucugcgggacuucuuugaauugcgucucaaguauuacggacugagaaaagaguggcuacugggcaugcucggugcggagucugcuaagcugaacaaucaggccagguucauacuugaaaagaucgaugggaagauuaucauugagaacaagccgaaaaaggaauugaucaaaguccugauacagcgcggauaugacuccgauccugugaaggcauggaaagaggcccagcaaaagguuccagacgaagaggagaaugaagagucagauaacgaaaaggagacugaaaagagugacagcgugaccgauucgggccccacauucaauuacuuacucgacaugccucugugguaucuuacuaaggagaaaaaggaugagcugugccggcuaagaaacgaaaaagagcaggaacucgacacccugaagaggaaaucccccucugauuuguggaaggaggaccuggcuacguuuaucgaggaauuagaggccgucgaagcaaaggagaaacaggacgaacaggugggucucccaggcaaagggggaaaagcuaagggcaaaaagacacaaauggccgagguucugccuagcccccgagggcagcgcgugauuccacggaucaccauugagaugaaggcggaagccgagaaaaagaacaaaaagaaaaucaagaaugaaaacacugagggaucaccgcaggaagauggcgucgagcuugagggucugaagcaaagauuggagaaaaagcagaaaagggaaccugggacaaagaccaaaaagcagacuacccucgcuuucaagcccauuaaaaagggcaaaaagcguaauccauggagugacuccgaaucugaucgcagcuccgacgagucaaacuuugauguacccccucgggaaacagagccaagaagggcagccacgaaaaccaaguucacuauggaccuggauagcgacgaggauuuuagugacuucgaugagaaaacagacgaugaagacuuugugcccucugacgcuuccccuccgaagaccaagacaagcccaaaacuaucgaauaaggaacugaaaccccagaagucaguugugucugaucuugaggccgacgaugucaaaggaagugugccucucuccagcucuccacccgcaacucauuucccugacgagaccgaaauaacgaacccgguacccaagaagaaugugacagucaaaaagaccgcggccaaaagccaauccucaaccaguacuacaggugcuaagaaacgagccgcaccaaagggcacuaagcgggauccugcucugaacagcgggguuucucagaaacccgacccagccaagaccaaaaaucgcagaaagaggaaaccuuccacaucagaugacagugauagcaacuuugagaagaucguguccaaggcagugacgucuaaaaagucgaaaggagaaagcgacgauuuccacauggacuuugauucagccgucgcuccccgggcgaaguccgugcgagccaaaaagccaaucaaauacuuggaggaaagugacgaggacgaucuguucuga

SEQ ID NO: 64088 - RNA, 4866 nt, Artificial Sequence
  derived and/or modified sequence opt3 from TOP2B__Homo_sapiens__NP_001059
auggccaagagcggcgggugcggagcuggugcaggcguagggggaggcaacggugcccugaccugggucaauaacgcggcuaaaaaggaggaauccgagacagccaauaaaaacgacucuucaaagaaacucaguguugaaagaguguaccagaagaagacucaacuugagcacauccuguugaggcccgauacguauauugggagcguagaaccuuuaacccaguucauguggguguacgacgaggaugucggaaugaauugucgggaggugacauuuguuccaggccuguauaaaauauucgacgaaauccuagugaacgcagccgauaauaagcagcgcgacaaaaacaugacuugcauuaaggucuccaucgauccggagucuaauauuaucucgauauggaacaauggcaaagggauccccgugguagaacauaagguugagaagguguacgucccugcucucauuuuuggacagcugcuuaccucaagcaacuaugacgaugacgagaaaaaggugacagguggccgaaauggguacggagcaaaacuguguaacaucuucaguaccaaguuuacuguggaaacagccugcaaagaguauaagcacuccuucaaacaaaccuggaugaauaacaugaugaagacgucugaagcuaagauuaaacauuuugauggcgaggacuacacuuguaucaccuuccagccagauuugagcaaguuuaaaauggaaaagcucgacaaagacauagucgcccugaugacacguagagcguacgaucuggcagguuccugcaggggaguuaaggugauguucaacgggaagaaacuccccguaaauggcuuucggucauauguggacuuauacgucaaggauaaacuggacgagacuggcguggcccuuaagguuauucacgaguuggcuaacgaacgcugggaugugugucugacccuaagugagaaaggguuccagcagaucagcuuugucaauucuauugccacaaccaagggagguagacauguggacuauguaguugaucaaguggucggcaagcucaucgaaguggucaaaaagaaaaacaaggcagggguguccguuaaaccuuuccaggugaagaaucacaucuggguauucauuaacugccugauagagaauccaacguuugacucacagacuaaggaaaacaugacacuucagcccaaauccuucggaaguaagugucaacugucugagaaauuuuucaaggcugccuccaauugcggcaucgucgagagcauuuugaacugggugaaauuuaaggcgcagacccagcucaauaaaaaguguucgucuguuaaguacuccaaaaucaaggguauaccuaaacuggaugacgccaacgaugcagggggcaagcacucauuagaaugcacucugauucucacagagggagacagugcuaaaagccuugccguguccggccugggggucaucggaagggaccgguaugguguguucccauugcgcggcaagauccuaaauguacgagaggcuucucauaagcaaauuauggaaaacgccgaaaucaauaacauuauaaaaaucguggggcugcaguacaagaaaagcuaugaugacgcagagucacucaagacccugagauacggaaaaauuaugaucaugacggaucaggaccaggauggcagucacaucaagggucuucugauuaacuuuauacaucacaauuggccguccuugcucaagcacggguuccuggaggaauuuaucacccccauuguuaaagccagcaagaacaaacaagaguuaucuuucuacucaaucccugaauuugacgaguggaagaaacauauugagaaucagaaggcuuggaagaucaaauauuacaagggccugggaacaaguacugcgaaagaagcaaaggaguauuucgccgauauggaaaggcaccggauacuauuucguuacgcuggcccagaggacgaugccgcaaucacccucgccuucagcaaaaagaaaauugacgaucgcaaggaauggcugacaaacuucauggaggacagaaggcagcggcgacuucauggguugcccgagcaguuucuguauggaacugcuaccaagcaccucacauacaaugauuucaucaacaaagaacugauucuuuuuagcaauucugacaacgagcgcucgaucccuagccuggucgacgguuucaagccaggccaaagaaaaguguuguuuaccugcuucaagaggaaugauaaacgggaagugaaggucgcccagcucgcaggguccguugcggagaugucagcuuaucaucacggagaacaggcccugaugaugacuauagugaacuuagcacagaauuuugugggcaguaacaauauuaaccugcuacaacccaucggucaguucgggacgcgccuccacggcggaaaggacgccgcuucuccgagauacauuuuuacaaugcugagcacccuugccagguugcuguucccugcaguagaugacaaucuccugaaauuuuuauacgaugacaaccagcgugucgagcccgagugguauaucccaauaaucccuauggugcugauuaacggcgcugaagggaucggaacuggcugggccuguaaacuucccaauuacgaugcgcgggagauuguuaacaaugugcgaagaauguuggacggucucgauccacaucccaugcugccuaacuauaaaaauuucaaggggaccauccaggaacuaggacaaaaccaguacgccgucuccggcgagauauuugugguugacaggaauacaguggaaauuaccgagcugccaguacgcacuuggacacaggucuauaaagagcaagugcucgaaccgaugcugaacgguacggauaagacccccgcucuuaucucagacuacaaggaguaucacacugauacaaccgugaaauucgucguuaagaugacagaagagaaauuggcacaggccgaggcugccggccugcauaagguguucaaauuacagacuacccucacgugcaauagcaugguacuguuugaccacauggggugucuuaagaaguacgaaaccgugcaggacauccugaaagaguucuuugauuugcggcucucuuacuauggacugagaaaggaauggcuagucggcaugcugggggcagaguccacaaaacucaacaaucaagcgagguucauucuggaaaagauccagggaaaaauuacuauagagaaccgcaguaagaaggaccuuauccagauguuggugcagcgaggcuacgagagcgauccuguuaaagccuggaaggaagcucaagagaaagccgcagaagaggacgaaacccagaaucagcacgaugacucuuccucagauagugguacaccaagcgggcccgacuuuaacuauauucugaauaugucguuauggucccucacuaaggagaaaguggaggaacugaucaagcagcgggaugcuaaaggacgugaggucaacgaccuuaagagaaagucuccuagcgaucuguggaaagaagaccuagccgcauucguggaggaacucgacaagguugagucacaagagagggaagaugugcuggccggcaugagugguaaagcuauuaagggcaaagucgggaagccaaaggugaaaaaguugcagcuggaggaaaccaugcccuccccguacggacgccggaucauaccugagaucacggcgaugaaagccgacgcaucuaagaaauuacucaagaagaaaaagggcgaucuggacacagcugccgugaaaguugaguuugaugaagaguucagcggggccccaguggaaggagcuggcgaggaagcacuuacccccuccgucccuauuaacaagggucccaaaccaaagagagagaagaaagagccugggacuagggugcgaaagacacccaccucaagcggaaaaccaagugccaagaaaguaaagaaacgcaauccguggucugacgaugaauccaagagcgagucggaccuggaagagacugaaccuguggucaucccccgggauucauugcucagaagggcggcugccgagcguccaaaguauaccuuugacuucucugaggaagaggaugacgaugcagacgacgaugacgaugacaacaaugaucuggaggaacuaaaaguuaaggccagucccauuacaaacgacggcgaagaugaguuugugccuuccgacggucuggauaaagacgaguacacguucagcccaggcaagucuaaagcuacccccgaaaagagccuucaugauaagaaaucccaggacuucgggaaucucuuuucauucccuaguuauagccaaaagucugaggaugacuccgcaaaauuugacucaaacgaagaggauagugccagcguguucuccccgucuuuuggacugaagcagacugacaaagucccaucgaagacaguggcggcuaagaaaggcaagcccagcucagauaccguuccuaaaccaaagcgcgcccccaaacagaagaagguaguggaggcagucaauuccgacagugauucugaguucgggaucccuaaaaagacaacuaccccgaaaggaaagggccggggugccaaaaagagaaaagcuagcggguccgaaaacgaaggagacuacaaucccggcaggaagacgucaaagacaaccucuaaaaagccaaagaagacuagcuuugaucaggacagugauguggacauauucccuuccgauuuucccaccgagccaccuagcuugccccgaacaggccgggcccgcaaagaaguuaaguacuucgcagagucugacgaggaagaggacgauguggacuuugcuauguucaacuga

SEQ ID NO: 64089 - RNA, 3006 nt, Artificial Sequence
  derived and/or modified sequence opt3 from TOP3A__Homo_sapiens__NP_004609
augaucuuccccguggccagauacgcucugagguggcuccggcgcccugaggaccgagcauuuagccgugccgcgauggaaauggcucuuagaggcgucaggaagguucugugcguggccgagaaaaacgaugcagccaaggggauugcugacuuguuauccaauggacggaugcgcagaagggaaggucugucuaaauucaacaagauauaugaguuugauuaccaccuauauggccagaauguaaccauggugaugacaucagucagugggcaucuccuggcacacgacuuccaaaugcaguuucggaaauggcagagcuguaacccacuugugcuguucgaagccgagaucgagaaguacugcccggaaaauuuuguugauauuaagaaaacuuuggagcgcgaaacgcgacagugucaagcucucgugaucuggaccgacugcgauagagagggagagaacauuggcuucgaaaucauacaugucuguaaggccgugaaacccaaucugcagguacugagggcgcgguuuuccgagaucacaccucacgcaguucguacugccugcgaaaaccucaccgagccagaccagcgcgugucugaugcugucgacgugagacaggaauuagaucugaggauuggugccgcauucacacgguuucaaacccuucgauugcagcgcaucuuccccgaggugcuggcugagcagcuaauuucguaugggucaugucaguuuccuacucucggauucgucguugaaagauucaaggccauccaagcguuugugccagagauauuccauaggauuaaaguaacacacgaccacaaggauggcaucguggaauuuaauuggaagcggcaucgccuguucaaccacaccgccugccuuguccuguaccaguuguguguggaggaccccauggcaacgguuguggaagucagaagcaaaccuaagaguaaauggaggccacaggcucucgacacuguggagcuggagaaguuagccucccguaaacugcggauuaaugcuaaggaaaccaugcgaaucgccgagaaacucuauacacaaggcuacaucucuuacccgagaacugaaaccaacauuuuucccagggaucuuaaucugacaguauugguugagcagcagaccccugacccacgcuggggcgcauucgcccagagcauacuagaacggggaggucccacgccuagaaacggcaauaaguccgaucaagcucauccacccauccacccgacuaaguauacaaacaaccugcagggggacgagcagaggcucuacgaguuuauugugcgccacuuccuggcgugcuguucacaggaugcacaaggacaggaaaccacugucgagaucgacauagcccaggaacgauuuguggcucauggccuuaugauucuggcccggaauuauuuggaugucuacccuuaugaccacuggagugauaaaauccuccccguguacgagcaggguagccauuuccaaccaucuacaguugagaugguggacggggaaaccuccccucccaagcuguuaacggaggcagaucugaucgcccuaauggaaaaacacggaauuggcaccgacgcuacacaugccgagcacaucgaaacuauuaaggcacguauguauguaggccucaccccagacaaaagauuucugcccgggcaccuuggaauggguuuggucgagggcuacgauucaaugggguacgagaugagcaagccugaccugagggcggaacucgaggcugaucugaagcucauaugcgacggaaagaaggauaaauucgugguucugcgccaacaggugcagaaguauaaacaggucuuuaucgaagccguggcaaaggccaagaaauuggacgaggcucucgcccaguacuucggcaacgguacagaacuggcacagcaagaggauauuuauccagcuaugccggagcccauccggaagugcccucaguguaauaaagacaugguauuaaagacuaaaaagaacgggggcuucuaccugaguugcaugggauuuccagaauguagaucugccguguggcuacccgauuccguucucgaggcgagcagggacucgucugucugcccugugugucagccacaucccguguaucgacugaaacuuaaauucaagcgcggcuccuugccgccuaccaugccacuggaauuugucugcuguaucgggggaugcgaugacacacuccgggagauucuggauuuaagauucucaggugggcccccuagggccagucagcccagcgggcgucugcaagcuaaucagucccuuaaccgcauggacaauucucagcacccacagccugcagacagccggcaaaccggaucaaguaaagccuuggcucagacucuucccccaccgacggccgcaggcgaauccaacagcguuacauguaauugcggucaggaggcggugcugcuaaccgugagaaaggaggggccuaacaggggccgacaguuuuucaaauguaauggaggcucuugcaacuuuuuccugugggccgauucacccaauccaggggcuggaggucccccugcccucgcauaccggccacugggcgcuagucuugggugucccccuggaccgggcauacauuuggguggguuuggcaacccaggagacggcagcggguccggaacuucuugccugugcucgcaacccagcguaacccgcacaguccagaaggauggcccuaauaaagguagacaguuccacaccugugccaagccaagggaacaacagugcggguuuuuccaguggguggacgagaacacugcacccggaacauccggcgccccuucauggacgggugaucggggccgaaccuuagaaagugaggcuagaucuaagcgcccgagggcgagcuccucagacauggggagcacugccaaaaagccccguaaauguucucucugccaccagccaggacauacacggccuuuuuguccccaaaacagauga

SEQ ID NO: 64090 - RNA, 2589 nt, Artificial Sequence
  derived and/or modified sequence opt3 from TOP3B__Homo_sapiens__NP_001269042
augaagaccgugcugauggucgccgagaaacccagccucgcucaguccaucgcaaagauucuuucuagaggcucacugaguagccacaaaggguugaacggagccugcuccguucaugaauacacagguacuuucgcgggccaaccugugagguuuaagaugacgucuguaugugggcacgugaugaccuuagacuuccugggaaaauauaauaagugggauaaggucgacccagcugagcuauuuucgcaggccccgacagagaaaaaggaagcaaaccccaaacucaauauggugaaguuccugcagguugaaggccgggguugcgauuacauagugcuuuggcuggacugugauaaagagggggagaacaucugcuuugaagucuuggacgccgugcucccuguaaugaauaaggcucauggaggcgagaagacuguuuuccgcgcacgauuuucaagcauuaccgauacagacaucuguaacgccauggcuugccugggcgaaccagaucacaaugaggcccugaguguggacgcgcgucaggagcucgauuuaagaauugggugugcauucaccagguuucaaacuaaauauuuccagggaaaguacggugaccuggauuccucucuuaucagcuuuggccccugccagacaccuaccuugggguucugugucgaacggcaugacaaaauacaguccuuuaagccagagacguauugggugcugcaagccaaagugaacacugacaaggaucgcucacuacuccuggacugggauagagucaggguuuucgaccgggaaaucgcucagauguuccuuaauaugaccaaacuggagaaggaagcccagguggaggcaacaagucgcaaggagaaagcuaagcagcgacccuuggcccucaacacuguagaaaugcugagaguggcgucuagcuccuuaggaaugggcccucaacacgccaugcagaccgcagagaggcuguacacacaggguuauauuucauacccacggaccgaaacgacucacuacccggagaauuuugaucucaaagggagccuucgucaacaggcuaaccaucccuauugggccgacacagucaagcgccuguuggcugaaggaaucaauagaccuaggaaaggccacgaugccggcgaccauccacccauuaccccuaugaagagugcaacugaggccgagcuagggggagaugcuuggcggcuguacgaauauaucacacgacacuucauagcgaccgugucucacgacugcaaguaccuccaguccacgauuagcuuucgcaucgguccagagcuguucaccuguucgggcaaaacaguucuuucucccggguuuacugaagugaugccguggcaguccgucccucuggaggaaucauugccaaccugccaaagaggagaugcauuccccgugggcgagguaaagaugcucgagaaacagacaaacccucccgacuaucugacugaagccgaguuaauuacccugauggaaaagcaugguaucgggacagacgcuaguaucccaguucacauuaauaacauaugccagaggaacuacgugaccgucgagagcggccggcgccuaaaacccacuaaucucggaaucgugcugguccauggcuauuacaagauugaugccgagcuuguguugccuacgaucagauccgcaguugaaaagcagcugaaccucauagcccaagggaaagcugacuacaggcagguucugggacacacacuugauguauuuaagcguaaauuccauuauuuugucgacucuauugccgguauggaugagcugauggaagugagcuucucaccauuggcagcgaccggcaagccgcucagucggugugggaaaugccaccgauuuaugaaguacauccaggcuaagcccuccagacugcacuguagccauugcgacgagacuuauaccuuaccucagaauggaacaaucaaacuguacaaggaacuaagguguccacucgaugacuucgagcugguucuuuggucuucaggcagucgcgguaaaagcuaucccuugugcccuuacuguuauaaccacccacccuuucgggauaugaagaaagggaugggcugcaaugaguguacccauccguccugccaacacucucugucgaugcucggaauuggccaguguguggaaugcgagagcgggguccugguguuagacccuacuuccggaccaaaguggaaaguagccugcaacaaguguaaugugguugcacacugcuucgaaaacgcccauagagucagggugucagcugauacauguagugugugcgaggccgcacugcuugacgucgauuucaauaaggcuaaaucucccuugccuggugacgaaacgcagcacaugggcuguguguuuugcgaccccguguuccaggagcucguggagcugaagcaugccgcgagcugucacccaaugcaucgcgggggaccuggccgacggcaaggucgugggagaggcagggcccgccggcccccaggaaaaccgaacccuagaaggcccaaggauaaaauguccgcucuagcagccuacuuuguauga

SEQ ID NO: 64091 - RNA, 4569 nt, Artificial Sequence
  derived and/or modified sequence opt3 from TOPBP1__Homo_sapiens__NP_008958
augagcagaaacgacaaggagcccuucuuugugaaauuccugaaguccucugauaauucaaaaugcuuuuucaaggcccucgaaaguaucaaagaguuucagagcgaagaguaccuucaaauuauaaccgaagaggaggcucugaagaucaaggaaaacgacagguccuuguauauuugugauccuuucucuggcgucguuuuugaccacuugaaaaagcuggggugccggaucgugggaccacagguagugauuuucuguaugcaucaccagcgcugcgucccgcgagcagagcaucccguguacaauaugguuaugucggaugugacaaucucauguacuagccuagaaaaagagaagcgugaggaaguccacaaauaugugcagaugauggguggcagaguauacagggaccucaacguuagugugacgcaucugauagccggggaggucggauccaagaaguaucuuguggcggcuaaucugaaaaagccuaucuugcucccaucuuggauuaaaacccugugggaaaagagccaagagaaaaagaucacacgguacacugauauuaacauggaagacuuuaaaugccccaucuuccugggcuguauaauuugcgugaccggucucuguggguuagaucgcaaggagguccagcagcugacaguuaagcacggaggccaguauaugggccaacuuaaaaugaaugagugcacccacuugaucgugcaggaaccuaaggggcagaaauacgagugugccaagagauggaacguacauugcgugacuacacagugguuuuucgacuccauugaaaaaggauuuugccaagaugagucaaucuacaagaccgaaccaaggcccgaggcaaagacgaugccuaauaguagcacuccaaccucucagaucaacacaauugacucccggacucugucagaugucagcaauauaaguaacaucaaugccucuuguguguccgagagcauuugcaacucgcuaaauucuaaacucgaaccgacccuggagaaccuugaaaaccuggacguuuccgcuuuccaggcacccgaggacuugcucgaugguugucgcaucuaucugugcggcuucucagggcgaaaguuagacaaacugagaaggcucauaaauaguggaggcggugugcgguuuaaccaacuuaaugaagaugucacacacgugauuguaggggacuacgaugacgagcugaagcaguucuggaacaaaagcgcccaucguccucacguugugggagcuaagugguugcuagaguguuuuuccaagggcuauaugcugucugaagaaccauacauccacgccaauuaucagcccgucgaaaucccugugagccauaaaccagagucaaaggcggcacuccugaaaaagaaaaacaguuccuucagcaagaaggauuuugcccccucugagaaacacgaacaggcugacgaggaucuucugucacaauacgaaaauggcaguagcaccgucguggaggccaagacguccgaagcacgcccguucaacgacucuacucaugcugagccuuugaaugauucgacacacauuagccuccaggaggaaaaccaguccucaguuagucauugcgugcccgacguaucuaccaucacugaggaagggcuguuuagccagaaauccuucuuaguccugggauuuucaaaugagaacgaaagcaauauugccaacauaaucaaggagaaugcggguaaaauuaugucucuacucuccagaacaguggccgacuaugcaguugugccacugcuuggcugugaggucgaagcuaccgugggggagguagugacgaacaccugguugguuacaugcaucgauuaccaaacucuguucgacccuaagaguaacccccucuuuaccccaguccccgugaugacaggaaugacuccucuggaagauugugugaucagcuucucucagugcgccggcgcugagaaagaaucccuuaccuuucuggccaauuugcucggugcaucaguccaggaguacuucguuaggaagaguaacgccaagaaagggauguucgcuagcacacaccugauuuuaaaggagcggggcggaucgaaauaugaagcggcaaagaaauggaaucugccagccgugaccauagcuuggcuacucgagacugcccgaacgggcaagcgcgcagacgaaucccacuuucugaucgagaacucuacaaaggaggaaagaagccuugagaccgaaauuacuaaugggaucaacuuaaauucagauaccgccgagcauccgggaacaaggcugcagacccaccggaaaacugugguaacaccccucgacaugaaccgcuuccaaaguaaggcuuuuagagccgucgugucccagcaugcaaggcagguugcggcuucuccugccgugggucagccacugcaaaaagaacccagcuuacaccuggauacgccuuccaaguuccuuucaaaagacaaguuguuuaagcccagcuucgaugucaaagacgcacucgccgcucuggagaccccaggccguccgagucagcagaagcggaaaccuucuacuccacuauccgaggugauuguuaagaaucugcaacucgcccuggcaaacagcucgcgaaaugcuguggcccuuucagcgucuccccaguugaaagaagcccagagugagaaggaagaggcuccuaagccccugcacaaaguagucguguguguguccaagaaauuaagcaagaaacagucugaacucaacgggaucgcagccagccugggagcugauuacagaugguccuuugacgagacagucacccauuucauauaucaaggcaggccaaaugauacaaaccgcgaguacaagucaguuaaagaacggggugugcacaucguaagugagcauuggcuucuggacugcgcccaggaaugcaagcacuugccugagagccucuauccccauacuuacaauccaaagaugucucuggacauuuccgcagugcaggaugggagacuauguaacucaaggcugcucagugcggucagcuccaccaaagacgaugaaccggacccucugauccuugaggagaacgauguggacaauauggccacgaacaauaaggaaucugcucccucgaacggcagcggcaaaaaugauucaaagggaguuuugacccagacacuggagaugcgcgaaaacuuucaaaaacaguuacaggagauuauguccgccaccaguaucgugaagccacaggggcaacgaaccucucucagccgguccggaugcaauucagcaucuagcacacccgacaguacucguuccgcuagaagcgguaggucucgcguccuggaggcccuucggcagucaagacagaccgugccugauguuaacacggaaccaucccaaaaugagcagauaauuugggacgaucccacagcaagggaggagcgagcccgccuggcuaguaaccuacaguggccuagcuguccgacccaguauucggaacuccaaguggacauccagaaucuggaggauucuccauuccagaagcccuugcacgacuccgagauugcgaaacaggccgucugcgacccuggcaacauccggguaacugaagcaccaaagcaccccauaagcgaggaacuggagacaccuaucaaagauucacauuuaauuccgacuccccaagcuccaaguaucgccuuuccucucgccaaucccccaguggcuccucaccccagagaaaagauuaucacuauagaggagacccaugaggaacugaaaaagcaguacauuuuccagcuuucuucccugaacccacaggaaaggaucgacuacugucacuugaucgagaagcucgggggacugguuauugaaaaacaaugcuuugauccgacauguacgcauaucguggucggccacccucuacguaaugagaaguaucuggcaagcguggccgcggguaaauggguacuucaccgcucauaccucgaggcuugccggaccgccgggcauuucgugcaggaagaggacuaugaauggggcaguagcuccauucuggaugucuugacuggaauaaacguucagcagagaaggcuggcauuagccgcuaugcgauggcggaagaaaauccaacagcgccaggagucuggcauuguggagggggcauucagcggauggaaggugauccuccacgucgaccaauccagagaagccggcuuuaagaggcugcuucagucagguggggcgaaagugcugcccggacauucuguuccauuguucaaggaggcuacacaccucuuuagugaucugaacaaacuaaagcccgacgauucgggcguaaauauugccgaagcagccgcucagaacguguacugucugcggaccgaguauaucgccgacuaccuuaugcaggaaagcccuccacacgucgagaauuauugccuccccgaggcaauauccuucauccaaaacaauaaagaacuggguacaggcuugucucagaagcgaaaggcuccuacugagaaaaacaagauuaaaagaccgcgcgugcauuga

SEQ ID NO: 64092 - RNA, 2943 nt, Artificial Sequence
  derived and/or modified sequence opt3 from TOPORS__Homo_sapiens__NP_001182551
augaucauggccagcgcugcaaaggaguucaaaauggacaacuuuucccccaaggccggcaccucuaaacugcagcaaacagugccugcggaugcuucaccagacaguaagugcccgauuugucucgauagauucgacaaugucagcuaccuugauaggugccugcacaaauuuuguuuccggugcguucaggaaugguccaagaacaaggccgagugucccuugugcaaacagccuuuugacucuauauuccauucggugcgcgcagaagaugacuuuaaggaguauguauuacgaccaucauacaaugggagcuucgugacucccgaucguagauuuagguaucggacgacccugacacgcgaaagaaacgccagugucuacuccccuucuggaccagugaauaggcggacuaccacacccccugacagcgguguucuauucgagggccucgggaucuccacccgcccacgagauguggagauuccgcaguuuaugagacaaaucgcugucaggcggcccacuacagcagacgaacguucacugcgcaaaauucaggagcaggauaucauaaacuucagaaggacccuuuaucgggccggagcucgagugcgcaauaucgaagacggcgguagauacagggacauuagugccgaguuuuuccggcgcaacccugcgugucugcacagauugguaccauggcucaagagggagcugacgguucuguucggggcacauggaagccucgugaauaucguccagcacauuaucaugucuaacgugacucguuaugauuuagaaucccaagccuuugugucagaccugcggcccuuccuuuugaaucgaaccgagcauuuuauacacgaguucauuagcuuugcuagaaguccuuucaacauggccgcauuugaucagcacgcuaauuacgacugcccagcccccucuuacgaagaaggcucccauagcgauucgucugucaucacaauuuccccggacgaggcggagacucaggaacuggauaucaacguugccaccgugucacaggcaccuugggacgaugagacacccggcccaaguuauagcuccucugaacaaguacacgugaccaugagcucacuacucaauacgagugacuccagcgaugaggaacuggucacugggggagcuacaucucagauccagggugugcaaaccaacgacgaccuuaacaaugauucagacgauaguagcgacaacuguguuauugugggcuucgucaaaccucuggccgagaggacucccgaguugguggaacucuccucugauucggaggaccuggggagcuacgaaaagauggagacaguaaagacccaggaacaggagcaguccuauucaaguggagauucugacguuagccgcugcuccucaccacauagcguguuaggcaaagaugagcaaauaaauaagggucacugugacucuuccacgcggaucaaaaguaagaaagaagagaagagaagcaccucucuguccucacccaggaaccucaauaguagcguccgcggggaucgaguguacucgccuuauaaccaccggcaucguaaaagaggaaggucccgcucuagcgacucacggagucaguccagaucuggccacgaucagaagaaucauaggaagcaccauggcaaaaagcgaaugaaaagcaagcgcucccggucaagagaaagcaguaggccacgugggcgccgggacaaaaagagaucuaggacacgagacuccagcuggucgcggcgcucacagacucuuucucugaguuccgagagcaccucuagaagcaggucccggucaagugaucacggaaagcgaagaagccgcucuaggaaccgugaccgguacuauuugagaaauaacuacgguuccagguacaaaugggaguauacauacuauucacgcaauaaggaucgagacggcuacgaaaguagcuauagacggaggacucuaucccgcgcucacuacucucgucaaucgagcucaccggaguuuagaguccaguccuucagugaacggaccaacgccaggaaaaagaauaaccauucugagcgcaaauauuacuacuaugaacgacacagaagccggucccugucaucuaauaggagccgcacagcaaguaccgggacugauagagugaggaacgagaagcccggaggcaagcggaaauacaagacgcgucaucucgaggguacaaacgaaguugcccagccuucccgcgaguuugcuagcaaagcgaaggacucucacuaucagaaaucauccaguaagcuggaugggaauuacaagaacgaaagcgacaccuucucggauucucgauccagcgacagagagacuaaacacaagaggcggaaacgcaagaccagaucacuuaguguggaaauuguauaugagggcaaagcaacagauaccacuaagcaucacaaaaagaagaaaaagaaacauaagaaaaagcacaagaaacaucacggagacaaugccucuagguccccagucgugaucacaauagauagcgacucagacaaggauagugagguuaaagaagacacggagugcgauaacagcggcccccaagacccucugcagaaugaauuuuuggcuccaucccucgagcccuucgaaaccaaggauguggucacuauugaggccgaguucggggugcuggacaaagaaugcgauaucgcaacauuaucuaacaaucugaacaaugccaacaagaccguagacaauaucccgccucuagcugccagcguggagcagacacucgauguucgggaagaguccacuuuugucucagaccuggagaaccagccaucuaauauugugagucuucaaaccgaacccucgcgacaguugccuagccccagaacgucccugaugucugugugucucggacgcgauugcgacaugucauga

SEQ ID NO: 64093 - RNA, 999 nt, Artificial Sequence
  derived and/or modified sequence opt3 from TOR1A__Homo_sapiens__NP_000104
augaagcugggcagagccgugcucgggcuucuguuguuagcucccagcgucguucaggcaguggagccuaucucccugggacuagcccucgcggguguacugaccggcuacauuuauccaaggcuuuacugccuguucgcugaauguugcgggcaaaaacggucuuugucacgcgaggcccuccagaaggaccuggaugacaaccuguuuggacagcaccucgccaaaaagauaaucuuaaaugcaguguucggcuuuauuaacaauccgaaacccaagaagccucugacacuuaguuugcaugguuggacugggacgggcaaaaacuucgucagcaagaucauugcugaaaauaucuaugagggaggccugaacuccgauuacgugcaccuauuuguugcaacccuccauuucccacacgccucuaauauaacacuguauaaagaccagcuucaacuguggauccgagggaacgugucggcuugugcccguucaauuuuuaucuucgaugaaauggacaagaugcaugcgggauugauugaugcaaucaaacccuuucucgacuacuaugaucuggucgacggugugagcuaccagaaggccauguucauauuuuuaaguaaugcuggcgccgagagaauuacugauguagcacuggacuucuggagguccgggaagcagcgggaggauaucaaacucaaggacauugaacacgcucuuucuguuagcguguuuaacaauaaaaacuccggauucuggcacucaagucugaucgaccgcaauuugaucgauuacuucgucccuuuucuaccacuggaguauaagcaucucaaaaugugcauuagaguggaaaugcagagcaggggcuacgagauagacgaggauaucgugucucgggucgccgaagagaugaccuucuuucccaaggaggaacgcguuuucuccgacaaagguuguaagacaguguuuaccaagcuggauuauuacuaugacgauuga

SEQ ID NO: 64094 - RNA, 1752 nt, Artificial Sequence
  derived and/or modified sequence opt3 from TOR1AIP1__Homo_sapiens__NP_056417
auggccggcgacgggagaagggcugaggcagugcgggaaggauggggugucuacguuaccccucgcgcccccauccgagagggccgugggagacuggcgccacagaacggaggcagcuccgaugcuccggccuauaggacacccccuucucggcaaggucgcagagaagugagguucucagacgagccacccgaaguauacggggauuuugagccucucguggcaaaggagcggaguccagucggaaaacgcacucgacuugaagaguucagaagcgacuccgccaaggaagaggugagggagucugcuuauuaccugcggucgcgucagcgcagacagcccaggccucaggaaacggaggaaaugaaaacccggcgaacaacucgcuugcaacagcagcacucagagcagccaccguuacaacccagcccuguuaugaccagaaggggccugcgggauagucauuccucugaagaggacgaggcaagcucccagacagaucuaucacagaccauuaguaagaaaacugugcgcagcauacaggaagccccagucucugaggaccucgugaucagacugaggcgucccccucuucgguauccacgauacgaagcuacauccguacaacagaagguuaauuuuucagaggaaggcgagaccgaggaagaugaccaggauagcagucacucuuccgugacgacugucaaggccagaagcagggacucggaugagucuggggacaaaaccacacgcuccucaagucaauauauugaaucauucuggcaguccucucagagccagaacuuuacugcgcaugacaagcaacccucagugcugaguuccggauaccagaaaaccccgcaggagugggcaccucagacagcccggaucagaaccaggaugcaaaaugauagcauuuugaagucugaacucgguaaccagucacccaguacgagcucccgccaggugacuggccagccacaaaaugcuucuuucgucaaacgaaaccggugguggcugcugccucucaucgccgcauuagcuucggggagcuuuugguucuuuuccacacccgagguugagaccacugccgugcaggaauuucagaaucagaugaaccaacugaagaauaaguaccagggacaggacgagaaacuuuggaagcguucacaaacauuuuuggaaaaacaccugaacaguucucauccaagaagccagcccgcgauacuacuccugaccgccgcaagggaugcugaggaggcccuucgcugccuguccgaacagaucgcugacgccuauagcagcuuccggucuguaagagcaauuaggaucgauggcacggacaaggccacccaggauuccgacacagugaaauuggaggucgaucaagaacucaguaaugguuuuaagaacgggcagaaugcugcggugguucaccgauucgagagcuucccugcaggaucuacucugauuuucuacaaauauugugaccacgaaaacgccgcuuucaaggauguggccuuaguccugaccgugcuccuugaggaggaaacacugggcacuuccuugggccuaaaggagguagaagagaaaguucgcgacuuucugaaggugaaauucaccaauucaaacacaccaaacaguuacaaucauauggacccggauaagcucaacgggcuguggagccggaucucgcaccuuguccugcccgugcagccugaaaaugcauugaaaagaggaauaugccucuga

SEQ ID NO: 64095 - RNA, 396 nt, Artificial Sequence
  derived and/or modified sequence opt3 from TOR1AIP2__Homo_sapiens__NP_071742
auguucagcgacaacucccacugccccgauuguggccagcaaugguuuccuucucuggagcucgggcauuggcuuuaccagaccgaacugguggagaaugaaugcuaucaggucuucuuggacagaaucaacagggccgauuacuguccagagugcuauccggacaaucccgcuaaccggucauuaguucugccuuggaguuuuccacuagaaugggcaccccagaaucucacacgcuggacuuucgagaaggccugucacccuuuucugcuuggaccaccccuggugcgaaaacguauucaugauagcagaguagcggguuucaacccugcuuugcaacucauacugacgaggaccgacaagacacugaauaaaaagcucggccagaacaaauga

SEQ ID NO: 64096 - RNA, 1011 nt, Artificial Sequence
  derived and/or modified sequence opt3 from TOR1B__Homo_sapiens__NP_055321
augcugagagccggcuggcucaggggagcugcagcccuugcgcuguuguuagcugcccggguggucgcagccuucgagcccaucaccguugggcuggcuauuggugcagccagcgcuauaacaggcuaccuauccuauaacgacaucuacugccgcuuugccgaauguugccgagaggaacguccucucaaugcgucugcacugaaacuugaucuggaggaaaaguuguucgggcagcaccucgccacugaggugauuuuuaaggcucugacgggauucagaaacaauaaaaacccaaagaaaccgcugacccucucauuacauggcugggccgguacagggaagaauuuuguaagucaaaucguggcagagaaccugcaccccaagggacuuaaaagcaauuucguccauuuguuuguguccacucugcacuucccucaugaacagaagauuaaacuauaucaggaccagcuccaaaaguggaucaggggcaacguuucugcuugugccaauucgguguuuauauucgaugagauggacaaacugcacccaggcaucauugaugcgaucaagcccuuucuugacuacuaugaacaggucgauggggugucauaccggaaggccauuuucaucuuucugagcaacgcaggaggugacuugauaaccaaaacagcucucgauuucuggcgcgccggcagaaagagggaggacauucagcugaaagauuuagagccuguacugaguguugggguguucaauaacaagcacuccggacucuggcauucuggccuuaucgacaaaaaucugauugauuauuuuaucccauucuugccccuagaauaccggcacgucaagaugugcgugcgcgcugagaugcgagccagagguagcgcaaucgacgaagacauugugaccagggucgccgaggaaaugacauuuuucccucgggaugagaaaauauacuccgacaagggguguaagacuguucagucacgucuggauuuucauuga

SEQ ID NO: 64097 - RNA, 966 nt, Artificial Sequence
  derived and/or modified sequence opt3 from TOR2A__Homo_sapiens__NP_001078816
auggcugcugcaaccagaggcugcaggcccugggggagccugcucggacuucuggguuugguguccgccgcggcugccgcaugggacuuagccucucugcgguguacacuaggcgcuuucugcgagugugauuuucgcccugaccucccagggcuggaaugcgaucuugcacagcaccuggccggacaacauuuggcuaaggcccucgucguuaaagcgcugaaggcauucgugcgagacccggcccccacuaaaccucugguacucucauuacacggcuggacggguaccgggaagaguuacgugagcucccugcuugcucauuauuuguuucagggaggccugcguucuccaagaguccaccauuucucgcccgugcuacacuuuccucacccaucacauaucgagagguacaaaaaggaucucaagagcuggguucagggcaaccugacagccugugggcggagucuuuuccuguuugacgaaauggauaaaaugcccccuggauugauggaggugcuccgcccauuccuggguuccucuugggucguguauggcacuaauuacagaaaggcaauuuuuauauucaucagcaacaccgggggagaacagauuaaucaaguagcuuuagaggccuggaggucccggcgcgaccgagaggaaauccugcuccaggagcuugaaccgguuauuucaagagcggugcuggauaacccccaccauggcuuuaguaauagcgguaucauggaggagagguugcuagacgccgucgugccuuuccugccacuccagcggcaccacgugcgucauugcguccugaacgaacuugcacagcugggguuggagccccgcgaugaaguugugcaagcuguacucgacucuacaaccuuuuucccugaggaugaacagcuguucuccucaaauggauguaaaacuguggccagcagaauagccuuuuucuuauga

SEQ ID NO: 64098 - RNA, 1395 nt, Artificial Sequence
  derived and/or modified sequence opt3 from TOX2__Homo_sapiens__NP_001092266
augagcgacggcaaccccgagcugcucuccaccucucagacauacaaugggcaaucagaaaacaaugaggauuaugaaaucccuccaauuacuccgcccaaccuuccugagccaagucuguugcacuuaggagaccaugaagccagcuaccacucccugugccauggucuaacgcccaauggccuccugccugcuuauucuuaccaggcaauggaucuuccagccauaauggugucgaacaugcuggcgcaggacucacacuugcucagcgggcagcugcccaccauccaagagaugguccauagugagguugcugccuaugauuccggaagaccuggcccacugcucgguaggccggcaauguuagccucucacaugagcgcucugucccagucacagcuuauuagucagauggggauccggagcucuauugcacacuccucacccagcccuccaggaaguaaaucugccacacccuccccuagcucgucuacucaagaagaggaauccgaggugcauuucaaaaucucaggcgagaagcgcccaagugcugaccccggcaaaaaggccaaaaauccgaagaagaaaaagaaaaaggauccuaacgaaccccagaaaccaguaagcgcguacgcauuguuuuuccgagacacccaggccgcuauaaaggggcagaauccuuccgccacauuuggagaugugucuaagaucgucgcaagcaugugggacucacugggugaggaacaaaaacaggcuuauaagcguaaaaccgaggccgcgaagaaagaauaccuaaaggcccucgcagcuuacagagccagucugguguccaaaagcucucccgaucagggcgagacuaagucaacacaagcuaacccacccgccaagaugcuuccuccaaaacagccgauguaugcaaugcccgggcuggccaguuucuugaccccuagcgaccuccaggcuuuuagguccggagcgucuccagcaucgcuggcccggacguuaggcagcaagucccugcuccccggucuuucagcuaguccuccacccccgccuucuuucccacugagccccacuuugcaccagcaacuaucccugccuccccaugcccagggggcacuccugucaccaccuguuagcaugucucccgccccacagccgccugugcuucccaccccaauggcucugcagguccaauuggccaugucccccaguccuccaggaccccaggauuuuccucacauuagcgaguucccgucuuccucaggcaguuguagcccaggccccucgaauccuacauccucuggggacugggacagcucauacccaaguggagaaugcgguaucuccacuuguucucuccugccccgcgauaagagcuuauaucugaccuga

SEQ ID NO: 64099 - RNA, 1731 nt, Artificial Sequence
  derived and/or modified sequence opt3 from TOX3__Homo_sapiens__NP_001073899
auggacgugagauucuaccccgccgcugcaggcgauccugccagccuggacuuugcgcagugccucggguauuacggauauuccaaguucgguaacaauaacaauuacaugaacauggcugaggccaauaacgcauuuuucgccgcuucugaacaaaccuuucacacaccaucacuuggcgaugaggaguucgaaaucccgcccauuacuccuccacccgaaagugacccugcacuggggaugccagaugucuuguuacccuuucaggcccugagcgacccucuaccaucccagggaucugaguucacgccgcaguuucccccucaaucgcucgaucugccaucaauaaccaucagcaggaaucuuguugagcaggacggcgugcugcauaguuccgguuugcacauggaucagucucauacacagguaagccaauaucggcaggaccccucccucauuaugcgcucaaucgugcacaugacugaugcugcccgaaguggggucaugccuccagcgcagcugaccacaauuaaccagagccaacugucugcacagcucggauuaaaucugggcggcgccuccaugccccauaccucaccgagcccucccgcuaguaaaucugccacuccauccccuagcucgucuaucaacgaagaggacgcagaugaagcuaaucgugccauaggggagaagagagcggcccccgacuccgguaaaaagccaaaaacacccaagaagaaaaagaaaaaggacccuaacgagccacagaaaccggugucagcauacgcucuuuucuuuagggauacccaagccgcuaucaagggacagaaucccaacgccacguucggcgaaguuaguaagauuguggcaagcaugugggacuccuugggggaggaacagaaacaggucuauaagcggaaaacugaggccgcuaagaaagaauaccugaaggcgcuagcagccuaccgcgcuucucucgugagcaaagccgcagccgagucagcugaggcccaaaccaucagaaguguacagcagacacuggcauccacuaaucuuaccagcucucuguugcucaacacaccucugucacagcacggaaccguuagugcgagcccacaaacguuacagcagucccugcccaggucuauugcuccuaagccacucacuaugcggcuucccaugaaccagaucgugacaucggucaccauagccgcaaauaugccgagcaacauuggcgccccucugaucuccucaauggguacuacaaugguggggagugcuccaucuacccaagugagccccuccguccagacgcagcagcaccaaaugcaguugcagcaacagcagcagcaacagcagcagcaaaugcagcagaugcagcaacagcagcuacaacagcaucagaugcaccagcaaauucagcagcagaugcaacagcagcauuuucagcaccacaugcaacagcaucugcagcagcaacagcagcaccuccaacagcagaucaaucagcaacagcugcagcagcaacuucagcagcgccugcaguugcaacagcuccagcauaugcaacaccagucacagccuagcccccgacagcauucuccaguugccucccaaaucaccaguccuauucccgcaauaggaagcccacagccggcuucucagcagcaccaaucccagauccagucacagacacaaacucaggugcugagucagguaagcauuuucuga

SEQ ID NO: 64100 - RNA, 1797 nt, Artificial Sequence
  derived and/or modified sequence opt3 from TOX4__Homo_sapiens__NP_001290452
auggagaccuuccacacacccagccugggcgacgaagaguuugaaaucccuccaauuucccucgauucugacccgucacuugccgugagugaugucguugggcauuucgacgaucuggcugaccccagcuccucucaggauggaucguuuucagcacaauacggugugcagacuuuggacaugccuguaggcaugacgcacggguuaauggagcagggaggcggucugcuaagcgggggacucaccauggaucuggaccauaguauaggcacacaguauuccgccaacccacccgugacuaucgaugucccuaugaccgacaugacaucuggccuuauggggcacagccaacugaccacuauugaucaguccgaauugucaagucagcucggacugagccuggguggcgggacaauccucccacccgcgcagucuccugaggacagauuauccaccacgccaucaccgacuagcagucugcaugaggacggaguggaagauuucaggcggcaacuucccucucagaagaccguuguggucgaggcuggcaaaaagcagaaagccccuaagaaacgcaagaagaaagacccaaaugaaccccagaagccuguguccgcauacgccuuguuuuuccgagauacacaagcugcaauuaaaggucagaacccaaaugccacuuuuggggagguaagcaagaucguugcuucgaugugggacucucugggagaggaacagaaacaaguguauaagcguaagaccgaggccgcgaaaaaggaauaccuaaaagcacucgccgcuuauaaggauaaccaggagugccaggccacagucgaaaccguggagcuggaccccgcaccgccuucccagacgcccucaccaccucccauggcuacuguggauccagccagucccgcgccugccagcauagagccaccggcacuuucccccucuaucgucguuaauagcacacugucaaguuacguggcuaaccaagccuccagcggcgcuggcgggcagccuaauauuaccaaauugaucauuacuaagcagaugcucccaucuucaaucacaaugagucagggagguaugguaaccgugauacccgccacggucgugaccagcagaggccugcaauuagggcagacauccacugcaaccauucagccuucucagcaagcccagaucguuacaaggucggugcugcaggcugcggcagccgcugccgcagccgcuagcaugcagcucccacccccgcggcuucaaccuccaccccugcagcagaugccucaacccccaacucagcagcaggucaccauuuugcaacagccucccccacuacaggccaugcagcaaccgccuccccagaaagugcgcaucaaccugcagcagcaaccacccccucuccagaucaaguccguaccacugcccacacuuaagaugcagaccacucugguuccuccgacgguggaaucaaguccagagagacccaugaauaacucuccugaagcacacacagucgaggcgccaagccccgaaaccauuugugagaugauaacugacguggucccugagguggaauccccgucacaaauggauguugaguuggugagcggaucucccguagcucucuccccacagccuaggugcguccggaguggcugugaaaaucccccaaucgugagcaaagacugggauaacgaguauugcucuaaugaauguguugugaagcacugccgcgacgucuuccuggccuggguggcaucccgaaacucaaauaccguaguguuuguuaaauga

SEQ ID NO: 64101 - RNA, 1581 nt, Artificial Sequence
  derived and/or modified sequence opt3 from TOX__Homo_sapiens__NP_055544
auggacgugagauucuaucccccuccagcccagccggcugcagcccccgaugcgccuugccugggcccaagccccugucucgacccuuacuacugcaacaaguuugauggggagaauauguauauguccaugaccgaaccaucucaagacuacguccccgcuucacagaguuauccuggaccaagccuugaguccgaagauuucaacaucccgcccauuacaccuccaucucugcccgaccacucguugguucauuuaaaugagguggaaucagguuaccacagccugugucauccuaugaaccacaauggccuacucccauuucauccccagaacauggaucugccggagauaacuguaaguaauaugcuugggcaggacggaacgcuguuguccaacucuaucagcgugaugccugauauuaggaaucccgagggcacccaauauuccucacacccacagauggccgcaaugcggccucgcggucagcccgccgacauccgacagcaaccagggaugaugccccacggacagcucacaacuauuaaccagagucagcugagcgcucaacugggccucaauaugggcgggucuaacgucccucauaauuccccaucaccgcccggaagcaaaagugcaaccccuucuccauccagcucggugcacgaagaugagggugacgauacaucuaagaucaacggcggggaaaaacgucccgccuccgacaugggaaagaaaccuaagaccccaaagaaaaagaaaaagaaagaccccaaugagccgcagaagccuguuucagcuuacgccuuauucuuuagagauacucaggcggcaauaaagggccaaaacccaaacgccacauucggugaggugaguaaaaucgucgcuagcaugugggacgggcugggagaggaacagaaacagguguacaagaagaaaaccgaagccgcaaagaaagaguaucuuaagcaguuggcugccuacagggcgucccugguaucuaagagcuauucagaacccguugaugugaaaacgagucaaccuccccagcuaauuaauuccaagccaagcgucuuucauggcccuucucaggcccacucagcacucuaccugaguagccacuaucaucagcaacccggcaugaacccacaccuuacugcuaugcauccgucccugccucggaauaucgcccccaaaccaaacaaucagaugcccgugaccgugucuauugcuaacauggccgucucgccuccacccccuuugcagaucagcccgccacuccaccagcaucugaauaugcaacagcaccagcccuuaacaaugcagcaaccucuggggaaccagcucccaaugcagguucaauccgcacuucacucacccacuaugcagcagggauucacccugcagccugacuaccaaacaauaauuaauccgaccaguacggccgcucaggugguaacucaggcgauggaguaugugcgcucugguugcagaaaucccccaccucagcccgucgauuggaacaacgacuacuguagcuccggcgggaugcaaagggauaaggcauuguaccuaacauga

SEQ ID NO: 64102 - RNA, 363 nt, Artificial Sequence
  derived and/or modified sequence opt3 from TP53AIP1__Homo_sapiens__NP_001182123
augggcagcuccucugaggccucauucagaagugcucaggcaagcugcuccggggccaggcggcaaggacugggucgcggcgaccagaaccucucugugaugcccccuaaugggcgagcgcagacccacacaccaggaugggucucggauccgcuuguucugggcgcucaggugcauggugggugucguggaaucgaagccuugucaguaagcaguggcuccuggucuagcgcaacuguguggauuuuaacgggccuguccagacccuuucuaccuggggccaccguccucagggaccggccacugggaucagcuuucgagcuuaguuacgaucaaaagaaagcaccccugcgcuugcaguga

SEQ ID NO: 64103 - RNA, 5928 nt, Artificial Sequence
  derived and/or modified sequence opt3 from TP53BP1__Homo_sapiens__NP_001135451
augcccggcgagcagauggacccuaccgggagccaacuggauuccgacuucucucaacaggauacaccaugccucauaauugaagacucacagccggagagucaagugcuugaagaugacagcggaucccacuuuucuaugcugucgagacauuugcccaacuuacagacucacaaggagaauccuguccuggauguugugucaaacccagaacagacggccggugaggagaggggcgacgggaauagcggauucaacgaacaucuaaaagagaauaagguagcugaucccguggacaguuccaaccucgauaccuguggcucuauaagccaggucaucgaacaacugccucagccaaaucggacauccucagugcuugguaugaguguugagagcgcacccgccguggaggaagagaaaggggaggaacuggaacagaaggagaaagagaaggaagaggacacuucuggaaacaccacacacuccuugggcgcggaagauaccgcuucaagccagcucggcuuugggguccuggagcugagucaaucucaggacguggaagagaauacuguaccuuacgagguugacaaggaacagcuccaauccgugacaaccaacagcggauauacgcgcuuaucggaugucgacgccaauacugcaauuaaacaugaggaacagucuaacgaggauaucccaauugccgaacaguccucaaaggacaucccggugaccgcucagcccaguaaagaugugcacgucguuaaggagcaaaauccuccacccgcacgaagcgaggacaugccuuucuccccaaaagccucuguggcugccauggaagcgaaggagcagcugagcgcacaggaacuuauggagucagguuugcagauacaaaagagucccgagccggaaguacuguccacacaggaggaucuauuugaccagagcaacaaaacugugucuucagauggcugcaguaccccuagccgugaagaagggggcuguucccucgccucuacacccgcuaccacgcugcaccuucugcaguugucgggccaaagaagccucguccaggacucccugucaacuaauaguucugauuuaguggccccaagcccugacgcauucagguccacacccuuuaucguuccaucaagccccaccgaacaggagggucggcaggacaagccuauggauacuucugugcuguccgaggaagggggagagccauuccagaagaagcuccagaguggcgaaccggucgagcuugaaaacccaccucuguugccagagagcacagugucuccccaggcuuccaccccuauuucacaaaguacgccaguauuucccccgggcagccuaccuaucccaucgcagccccaguucucccaugacauuuuuaucccuucucccagccuggaggaacagucaaacgaugggaaaaaggacggagauaugcacaguuccucucucaccguugagugcagcaaaacauccgaaauagagcccaaaaauucaccugaagaccugggucuuagccugacuggcgauaguuguaaguugaugcucucuaccuccgaguacagccaaucgcccaaaauggagucacugucuagucaucgcauugacgaagauggggagaacacacagaucgaagacacugagccaauguccccgguguuaaauagcaaguucgucccugccgagaacgauucuauucugaugaaucccgcgcaggacggagaagugcagcuaagccaaaacgaugacaaaaccaagggcgacgauacagacaccagagaugacaucuccauccucgccacugguugcaaagggagggaggaaacggucgcagaggauguguguauugaccugacaugcgauucaggcagucaggcuguuccaagccccgccacccggucugaagcucuuuccucaguguuggaccaggaggaggccauggaaauaaaggagcaccacccugaagagggaaguagcggcuccgaaguagaggagaucccagaaacucccugugagucucagggggaagaacugaaggaagagaauauggagucggucccucuccaucugagccuuaccgaaacacaaucacagggacugugcuugcagaaagagaugccgaagaaagaauguuccgaggcaauggagguggaaaccaguguuauuucuaucgauagcccacaaaagcucgccauacuggaccaggaguuagaacacaaagagcaggaggcuugggaggaggcgacuuccgaagauucaucuguggucauuguggacguaaaggagcccagcccucgcguggauguuaguugcgaaccacuggagggugucgaaaagugcuccgacagccagucuugggaggacaucgcacccgagaucgaaccuugugccgagaaccgacuagauacaaaagaagagaagucaguggaauaugagggcgaccucaaauccgggacggcugagaccgaaccgguggagcaagauaguagccagcccucgcugccacuugucagagccgacgauccuuugaggcuggaccaggaacuccagcaaccccagacucaggagaagacaucuaauucccugaccgaggauagcaaaauggcaaacgccaagcaguuaucaagugacgcugaagcccaaaagcugggaaaaccaucugcacaugcgucccagagcuuuugcgagucaaguagcgaaacaccuuuccacuucacucuucccaaggagggcgauauuaucccaccguugaccggugcuacgccuccccucauugggcaucugaaacuagaaccaaagcggcacuccacccccauaggcaucucuaauuacccugagagcacaauugccacuuccgacguuaugucagagucuaugguggaaacccacgauccaauccugggaaguggcaaaggggacucgggagcagcccccgacguggaugacaagcucugucugcguaugaaacuuguaagcccugagacagaggcuuccgaggaaucuuugcaguuuaaccuggagaagccggccacuggugagcgcaagaauggcucaaccgcagucgcugaaagcguggccuccccacagaaaacgaugaguguuuuaucuugcaucugugaggcgagacaagaaaacgaggccaggagcgaagaucccccuacaacccccauucgggggaaucuccugcauuucccaucaucccagggagaggaggaaaaggagaaacuugaaggcgaccacacuauacgacagagucaacagccuaugaagcccaucagcccagugaaagauccugucucuccggcuucccagaagauggugauucagggucccucaagcccacaaggggaggcaaugguuacagacgugcuggaggaucagaaggaaggccgcucgaccaacaaagagaacccuucuaaggccuugaucgaaagacccagucagaauaacauuggaauccagacuauggagugcucccucaggguaccagaaaccgucagcgcugccacacaaacgaucaaaaaugugugugagcagggcaccucaacuguggaccagaacuuugggaagcaggaugcaacaguccaaaccgagcggggauccggcgaaaaaccuguuucugcgcccggugacgauacagagagccugcauagucagggggaagaggaguucgacaugccgcagccaccucacggacacgugcuacaucgccacaugagaacuaucagggaaguacguacccuggugacgcgggucauuacagauguguauuacguugacggcaccgagguggaacgaaaggucacugaggaaaccgaggaacccaucguggagugccaagagugugaaacagagguuuccccaagccagacugguggaucuucaggggaccucggagauauuaguuccuuuagcucuaaggccucgucacugcauagaaccagcuccggcacaagucuuucugcuaugcacagcuccgggucaaguggaaaaggcgccggucccuugagggggaagacgucuggaaccgaaccugcagacuucgcucugccgagcucccgcggcggucccggcaaauuaucaccacggaagggggugagccagacuggaacaccugucugcgaggaggauggcgacgccgggcucggaaucagacagggcgguaaagcacccguaaccccuagggggcgcggacgacggggccguccacccucuagaacuacagguaccagggaaacggccgugccuggcccacuggggauagaggauauuucccccaaucuuaguccggacgauaagagcuuuucgcgcguugugccucgggucccagacuccacuagaaggaccgaugugggagcuggcgcgcugcgacgcucugacucacccgaaaucccuuuccaagccgcagcugggccaagcgauggacuagacgccaguucccccggcaacucuuuuguaggucuccggguggucgccaaguggagcucaaauggguauuucuacuccggaaaaauuacaagagauguuggcgcuggcaaguacaaacuguuguuugacgacggguaugagugugaugugcugggaaaggacaucuuacucugcgauccgauaccucuggacaccgaagugacugcacuuagugaggaugaguacuucagcgccggugucgugaaaggccauaggaaggaaucuggggagcuguauuacucaaucgaaaaagagggacagcguaagugguauaagcgcauggcgguuauuuugucccucgaacagggcaaccggcugagagagcaguacggucuagggcccuaugaggcuguaacaccacugaccaaagccgcagacaucagccuugauaaucucguggaaggaaagaggaaacgacggucuaacgucaguucgccugccacacccacugcuuccagcucaucuagcaccacgccaacacgcaagauuaccgagucccccagagcaaguaugggcgugcugucaggcaaaaggaaguugaucacuucugaagaggaacggagcccugccaagcgagggagaaaauccgcgaccguuaagccagugggagcuggugaguuugucaguccgugcgagagcggcgacaauacaggggaacccuccgcccuggaggaacaacgcggaccuuuaccacucaacaaaacucuguuccuuggcuacgcauuccuguugaccauggccacgacaucugauaagcucgcuucaaggagcaaacugcccgacgguccuaccgggucguccgaggaggaagaggaauuucuagagauaccacccuucaauaagcaguacacugaaagucagcugcgugccggagcaggcuauauucuugaggauuuuaacgaggcucaguguaauacagccuaccaaugccuccugaucgcggaccagcacugucggaccagaaaguauuucuugugcuuagccucuggcaucccuugugugagccacguauggguccaugacucaugccacgcaaaccagcugcagaacuacaggaauuaucuccugccggcuggguacucccuugaggaacaacgcauucuggauuggcagccacgagaaaaccccuuucagaauuugaaagugcuacugguuucugaccaacagcagaacuuccucgagcuguggagugaaauccuuaugacuggaggugccgcuagcgugaagcagcaucacuccucagcacauaauaaagauauugccuuaggcgucuuugacgugguugugacagauccuagcugucccgccucuguccugaagugcgcugaggcgcuccaauugccagugguaagucaggagugggugauacagugucugaucguuggggaaagaauuggauucaaacagcacccuaaguauaagcacgacuacgucucccauuga

SEQ ID NO: 64104 - RNA, 3405 nt, Artificial Sequence
  derived and/or modified sequence opt3 from TP53BP2__Homo_sapiens__NP_001026855
augagauucggcagcaagaugaugcccauguuucugaccguguaccucuccaacaaugagcagcacuucacagaagucccuguuacuccagagacgaucugcagggacgugguagaucuuuguaaagaaccgggggagucugacugccaucuggccgaagugugguguggaucagagcggcccgucgcugauaacgagcgcauguuugacguguugcaacgauucgguagucagcguaaugaaguuagauuuuucuuaaggcacgagcggccuccaggccgcgauauugugagcgggcccagaucccaggacccuucucugaagaggaacggagucaaagugccaggcgaauaucggcgcaaggagaaugguguaaacucgccccgaauggaucuaacccucgcagagcugcaggaaauggccucaagacaacagcagcagauagaggcgcaacagcagcuucuggcuacaaaagaacagagguugaaguuucucaagcaacaggaccagcggcaacagcagcagguugccgagcaagaaaaacugaagcgucugaaagagaucgcagagaaucaggaagccaagcucaaaaaggugcgcgcuuuaaaggggcaugucgagcagaaaagacugagcaacggaaaacuuguggaagagauugaacagaugaauaacuuguuccaacagaagcagagggagcuggugcuagcagucaguaagguugaggaacucacucggcagcuggagaugcuuaaaaauggccgaaucgauucccaccaugacaaccaaucugccguggcugaacuggaucgcuuguacaaggagcuccagcugagaaauaaauuaaaccaggaacagaaugccaagcugcaacagcagagggagugccucaacaagcggaacagcgagguagcggugauggacaaacgcgucaaugaacuuagagauaggcuguggaagaaaaaggcagccuugcaacagaaagagaaccuaccuguguccucagacggcaaucugccacagcaggcugccagugcaccgagccguguugcugccguggggcccuauauucaaucuuccaccaugccucggaugccaucacgacccgaacuccuggucaagccugcgcuuccagacggaagccuggugauccaggccagugagggucccaugaagauacagacauugccgaacaugagaucuggcgcagcuucccagaccaaagggagcaagauccacccuguaggacccgauuggucgccaucuaaugccgaccucuuuccuucccaaggcucagcuaguguuccccagagcacugguaacgcccuggaucagguggacgauggggaggucccauuaagggaaaaagagaagaaagugcgccccuucuccauguuugacgcagucgaucagucuaaugccccucccagcuucggaacacugcggaagaaccaaucaagugaagacauucuaagagaugcucagguggcgaauaagaacguugcaaaagugccgcccccuguaccaaccaagcccaaacagaucaaucucccuuacuuuggccaaacgaaccagccacccuccgacauuaagccggauggcagcucucagcagcugucaacugucgugccuaguauggggaccaaaccaaagcccgccggacaacagccuaggguucuuuugagccccuccaucccaucugugggucaggaccagacacugucgccuggcagcaagcaagaguccccaccagcugccgcaguccgcccguucacuccucagcccucaaaagacacccuccugccacccuuccgaaagccucagacaguggccgcuaguucuauauauagcauguacacccagcaacaggccccagggaaaaauuuucagcaggcaguacaauccgcgcuuacgaagacucacacacggggaccccauuucucaagcguguauggcaaaccuguuauugcugccgcacagaaccagcaacagcacccggaaaauaucuacucuaacucccaggguaagccagggagucccgagccugagaccgaaccagucagcucugugcaggagaaccaugaaaaugagcguauucccagaccucuguccccgacuaaauugcuccccuuucugucaaacccauacaggaaucaaagugaugccgacuuagaagcucugcgcaagaagcuaagcaacgccccucggccccucaaaaagagaucguccaucacagagccagagggcccuaauggacccaacauccagaaacugcuuuaucagaggaccacgauugcagcuauggaaaccauaucugugccaagcuacccgucaaagagugccuccgucacagcgucuagcgaguccccuguugaaauccagaaucccuauuugcacguggagccagaaaaagaggugguaucacugguccccgagagccucaguccugaagaugugggcaacgccucuacugaaaauuccgacaugccagcucccagcccugggcuggauuacgagccggagggaguuccagacaacucgcccaauuuacaaaacaauccugaggaacccaacccagaggcaccucacgugcuggaugucuaucuugaagaguaucccccauacccuccgcccccauacccuucaggugaacccgagggcccaggggaggacucugugaguaugcgaccucccgaaauuaccggacagguuuccuugccgccaggcaagcgcacaaaucuccggaagacugguagcgagagaaucgcccaugggaugagggugaaauucaacccucuggcucuacugcucgauucuagccuggaaggcgaguuugaccuuguacagcguauaauuuacgaagucgaugaccccuccuugccaaacgaugagggaaucaccgcccugcacaaugcagugugugcgggccauacagagaucgugaaguucuuaguccaguuugggguuaacgugaaugccgcugacucagacggauggacuccccuccacugcgccgcaaguuguaacaauguacaagugugcaaauuccuggucgaaagcggugcugccguguuugcaaugaccuauucugauaugcagacggccgcugacaagugugaggaaauggaggaaggcuacacacagugcucccaauuccuuuaugggguucaggagaaaaugggaauuaugaacaagggcgugaucuacgcgcugugggauuaugagccucagaaugacgaugaauugccgaugaaggagggugacuguaugaccauuauacaucgcgaagaugaggacgagaucgaaugguggugggcccggcucaacgauaaagagggguacguccccagaaaucugcuaggccuguauccaaggauuaagccucgacagcggucacucgcauga

SEQ ID NO: 64105 - RNA, 1182 nt, Artificial Sequence
  derived and/or modified sequence opt3 from TP53__Homo_sapiens__NP_000537
auggaggaaccccagagcgacccuuccguggagccaccgcugucucaagaaaccuucucagaucucuggaaacuucugcccgagaacaaugucuugaguccuuuaccaagccaggccauggacgaucugaugcuaucccccgacgauaucgaacagugguuuacagaggacccuggcccagaugaggcucccagaaugccugaagcagccccaccgguugcgcccgcuccugccgcaccaacucccgccgcuccugcaccagcccccucuuggccgcucucgucaagcgugccuagucagaagacguaccaaggguccuauggauucaggcuggguuuucuucacucuggcaccgcuaagagcguaacaugcacuuacucccccgcccugaacaaaauguucugucaguuggcgaagaccugcccagugcagcucugggucgacucaacaccucccccagggacccgggugcgcgcaauggccauuuauaaacagagucaacauaugacugagguugugcgacguuguccccaccaugaaagaugcagcgauucugacggacuggcuccuccacagcaccugauaagggucgagggcaaucuccggguggaguacuuagaugaccgcaacacauuuagacauuccguaguugugccguaugaacccccugaggucgguucagauuguaccacgauccacuacaauuauaugugcaacagcaguuguaugggagggaugaauaggcggccaauucugacuaucauuacccuugaagacucuuccggcaacuugcugggccgcaauagcuucgaggugcgagugugcgccugucccgggagagacaggcggacagaagaggagaaccuacguaagaagggagaaccucaccaugagcucccacccgguucgacuaaacgcgcacugccgaauaacaccucuuccucaccucagccaaagaaaaagccccuugauggcgaauacuuuacacugcagaucagagggagggagcgguucgaaauguuucgagaguugaaugaggcucucgaacugaaagacgcccaagcgggaaaggagccuggcgguagucgcgcccacagcucccauuuaaagucuaaaaaggggcagagcaccucaagacacaaaaagcugauguucaaaacggaaggacccgauagugacuga

SEQ ID NO: 64106 - RNA, 570 nt, Artificial Sequence
  derived and/or modified sequence opt3 from TP53I11__Homo_sapiens__NP_001245253
auggccgcuaagcagcccccuccacugaugaaaaagcacagccaaaccgaccucguguccagacuuaaaacaaggaagauccugggcgucgggggagaggaugacgauggugaaguucaucggucuaaaauuucacagguguugggcaacgagauaaaguucacuauccgcgaaccguuagggcugcgaguauggcaguuugugagugcaguccuauucagcggaauugccaucauggcgcucgcuuuucccgaccagcuguacgaugccguguucgacggcgcacaaguuacguccaagaccccuauucgucuuuaugguggggcccuguugucuaucucgcucauaauguggaaugcucuguacacagcagagaaagugaucauuagauggacucugcucaccgaagccugcuauuuuggaguccaguucuuagugguaacagcuacccuggccgagacuggccuuaugucauugggcauccugcuacuccugguuagcaggcuucuguuuguggucauuaguaucuacuauuacuaucagguggggcggcgcccaaagaaagcguga

SEQ ID NO: 64107 - RNA, 1182 nt, Artificial Sequence
  derived and/or modified sequence opt3 from TP53I13__Homo_sapiens__NP_612358
auggcucccccuccaccgagcccccagcugcuccuucuggccgcauuggccagauuacugggcccuuccgaggugauggcggggccagcugaagaggccggagcacacugccccgaaucucuauggccucucccaccccaagucucaccuaggguuaccuacacacgggugaguccaggucaggccgaggacguaacuuuccuguaucauccgugugcucaccccuggcuuaagcugcaguuggcacuccuggccuacgcuugcauggccaacccuagccugacgccagauuuuucccucacccaggaccgccccuuagugcugacagcguggggccuugcauuggaaauggccugggucgagccugcuugggccgcacauuggcugaugcgacguagaaggcggaaacaacgcaagaaaaaggcuuggaucuauugugagucucuaucggggccagcccccucagaaccgacuccuggaagaggcaggcucugccggcgcgguugugugcaggcgcuggcccuugcauucgcucugcgaagcuggagacccccagggaccgagguuacaagucagggaccuaggcagcccuccucuagcggcgccaaacggcgucgcuugagagcugcccucggcccacaacccaccagguccgcacugcgguuuccuucagccaguccagggagcuuaaaggcuaagcagucuauggcggguauuccgggacgagaauccaaugcacccucagugccuacugucagccugcucccaggcgcccccgggggaaacgcuaguucucgcacagaggcccaggugccuaauggccaggguuccccagggggaugcguauguagcucgcaagcaucucccgccccgagagcugccgcaccuccaagggcggcucggggccccaccccucgcacggaggaagccgcaugggccgcuauggcccuuacuuuccuguugguucuacugacccucgcaacacugugcacuagacuucacaggaacuuucgucggggcgaguccauauacugggggcccaccgcugauucacaggacacaguggccgcgguccugaaacgaagauugcuccagccaaguaggcgcgugaagcggagcagaaggcgcccucuguuacccccaaccccggauuccggaccugaaggugagucuagcgaauga

SEQ ID NO: 64108 - RNA, 747 nt, Artificial Sequence
  derived and/or modified sequence opt3 from TP53I3__Homo_sapiens__NP_001193731
augcuggccgugcacuucgacaagcccggcgggccugagaaccucuacgucaaagaaguugcuaagccaagcccgggagagggugaagugcuucugaaaguagcagccuccgcguugaauagagcugauuuaaugcagaggcaaggccaguaugaucccccuccaggggccucuaacauccugggacuagaggcaucaggccauguggccgaacucggucccgggugccagggacacuggaagauuggcgacaccgcuauggcacugcuuccuggcgggggacaggcccaauacgucacagugccagagggucuguugaugcccauaccugagggccucacucugacgcaggcugccgcgaucccagaagcauggcugaccgccuuucagcucuuacaucugguugggaaugugcaggcuggagacuauguccuuauucacgccggcuugagugguguggggacagcagcuauccaacugacucggauggccggagcgauuccgcuaguaaccgccggcagccagaaaaagcuccagauggcagagaagcugggcgcugccgcuggguucaacuacaaaaaggaagauuuuuccgaggccacacuuaaauucaccaagguucaggcaaaugccggagaguguuuucauggugcuaacucugcgucgcuguugcacggcgggcccccuacuucagcagccggaagcggccaaaaucucccaagugaccgcaaccccggugggccuuga

SEQ ID NO: 64109 - RNA, 495 nt, Artificial Sequence
  derived and/or modified sequence opt3 from TP53INP1__Homo_sapiens__NP_001129205
auguuccagagacugaacaagauguuugugggcgaggucagcuccucuucaaaucaagaacccgaguucaacgaaaaagaggacgaugaauggauccucguugacuuuauugauaccugcacaggguucagugccgaggaggaagaggaagaggaggacauaagcgaagaguccccuacugaacacccaucuguguuuucgugucuuccggcuucacuggagugcuuggcagauacgagcgacaguuguuucuuacaguuugaauccugccccauggaggagucuugguucaucaccccuccacccuguuuuacagccggaggucugacuaccauuaagguagaaacaagcccuauggagaaucuacucaucgaacauccauccaugucaguguacgcgguccacaacaguugccccggccugagcgaggcuaccagggggacugaugaacuucauucuccuuccucaccacgggcccgcaaaagcugucuguga

SEQ ID NO: 64110 - RNA, 663 nt, Artificial Sequence
  derived and/or modified sequence opt3 from TP53INP2__Homo_sapiens__NP_067025
auguuccagagacugagcucccucuuuuucucuacccccucaccuccagaggacccggauugccccagggccuuugugagugaagaggacgaagucgauggcuggcuuaucauugaccugccugauagcuacgcugcaccacccuccccuggggccgcgccagcucccgccggacggccuccaccggcacccucuuugauggacgagucgugguucguuacaccuccagccuguuuuacugcugaaggucccggcuuagggccugcacgccugcaaucaagcccacuagaggaucuccugauagagcaccccaguauguccguguauguaacgggaucuaccaucgugcuugaaccgggcagcccuucaccccugccagacgccgcuuugccugauggugaccucuccgagggggaacugacacccgcccgacgugagccaagagcggcaaggcaugccgcuccccugccugcccgggcagcucucuuagagaaggccggacagguccgcagacugcagagggcgcggcagcgcgccgaacgacacgcacuuagugcuaaagccgugcaaagacagaacagggcucgggagagccguccacgcagaucuaagaaucaguccucauucauuuaccagccgugccaaaggcaguuuaacuauuga

SEQ ID NO: 64111 - RNA, 762 nt, Artificial Sequence
  derived and/or modified sequence opt3 from TP53RK__Homo_sapiens__NP_291028
auggccgcugcaagagccaccacacccgcggacggcgaggaaccugcuccagaggccgaagcacuggccgcugcaagggagcggagcucccgcuuccucucugggcuugaacuggugaagcagggagccgaggcucgagucuuucgugguagauuccaaggcagggccgcgguuaucaaacaccgguuuccgaagggguaccgccaucccgcauuggaggccagauuaggaaggcggcgcacugugcaggaagcucgagcccugcuaagaugcaggcgggcaggcauuucagcuccuguaguguucuuugucgauuaugccaguaacugucucuacauggaggaaauagaggguagcgugacgguucgugacuauauccaguccaccauggagacagagaaaacuccacaggggcugucuaaucuugcgaagaccauuggacaagugcuggcccgcaugcacgaugaagacuugauccauggcgaucucacaaccucgaacaugcugcugaaacccccucucgaacaguuaaauauuguccugaucgacuucggccuuucauuuauaagcgcauugccagaggauaaggggguggaccuguacguacuagaaaaggcuuuccucaguacucaccccaacacagagaccguuuuugaggccuuccugaaauccuauucuacgagcuccaagaaagcuagaccugugcuuaagaaacuggaugaagucagguugcggggacgaaagcgcucaaugguggguuga

SEQ ID NO: 64112 - RNA, 375 nt, Artificial Sequence
  derived and/or modified sequence opt3 from TP53TG3C__Homo_sapiens__NP_001192188
augagagccagccccugcaucucccagccugcugcaucuuggcacccaaggccgucagcccugcggcccaccgcgggcagugggccugacacacgcacuccaggaacgguggaggaugguagcgcucccuguccugccuuccgauccccagcagucucucccugcggcgaggaaccuuguugcuuucaaauuucgccagccgaagagacccucgaacuugggcgucugguuucaccgggaaacugugacacauugagccccagagcugcaggcuucuacgccugccaugugaggaguuuaauaccuugucgguccacuaagggucgcuggccacugaccgcuucugccgcggggcuaagcuccuuuucaggauga

SEQ ID NO: 64113 - RNA, 1668 nt, Artificial Sequence
  derived and/or modified sequence opt3 from TP63__Homo_sapiens__NP_001108450
augaacuucgagaccagcagaugcgccacacugcaguacugucccgacccuuauauccaaagguuuguggaaacuccagcucacuucuccuggaaggagucuuacuaucggucaacgaugagucagagcacccagacaaaugaauuucucuccccggaggucuuccagcauauuugggauuuucuugaacaacccauaugcucuguucagccuaucgaccugaacuucguggaugagccaucggaggacggcgcaacuaauaaaauugaaaucucaauggauuguauucgcaugcaggacagcgauuugagugaccccauguggccucaguacaccaacuuagggcugcuaaauuccauggaucaacagauccagaacggaucuagcuccacaucaccauauaauaccgaccacgcccagaacaguguaacugcgcccagcccuuacgcucaaccaucuuccacauuugaugcccucucaccgagccccgcaauaccuaguaauaccgacuauccagguccccauucuuucgauguguccuuucagcagagcucgacggccaagucugcuacuuggaccuacuccacagagcugaaaaagcuguacugccaaaucgcaaaaacuuguccuauucagaucaaggucaugaccccacccccgcagggcgccgugauucgagcuaugccuguuuauaagaaagccgaacacgugacagaggucgugaagcguugccccaaccaugagcuuucaagagaguucaaugaagggcagaucgcgccaccuagucacuugauaaggguagaaggaaacagccacgcacaauacguugaggaccccauuaccggccggcaguccgugcucgucccauaugaacccccucagguggguacggaguuuacuacagugcuguacaauuucauguguaacucuagcugcgucgggggaaugaaucgcagaccaauccugauuaucguuacccucgagacuagggacggccagguguuaggccggcgcuguuuugaagcccgaaucugcgcuuguccggggagagauaggaaagccgacgaggauucaauucggaagcaacagguaagugacuccaccaaaaacggagaugguacaaagcgucccuuccgccagaacacgcauggcauacagaugaccagcaucaagaaaagaaggucuccugacgaugaacugcuuuauuugccagugcgggggcgagagacauacgaaaugcugcuaaagauuaaagagucacucgagcugaugcaauaucuuccccagcacacuaucgaaaccuaccgccagcagcaacagcagcaacaucagcaccuguugcagaagcagacaaguauacaaagcccuuccucuuacggaaauucgagcccaccccucaacaaaaugaacuccaugaauaagcugccgucagucagucaguuaauuaauccucagcagagaaacgcacugacuccaaccacaauccccgacggcaugggugcuaauaucccuaugauggggacccacaugcccauggccggagauaugaacggccucucuccaacucaagcgcuuccucccccacugagcaugccguccacgucacauugcacaccucccccacccuauccuaccgacugcagcauugugaggaucuggcagguuuga

SEQ ID NO: 64114 - RNA, 1911 nt, Artificial Sequence
  derived and/or modified sequence opt3 from TP73__Homo_sapiens__XP_011540366
auggcccagagcaccgcuacaucccccgacggcgggacuacguucgagcaccuguggucuucacucgaaccugauaguaccuacuuugaccuuccacaaagcuccagaggaaacaaugagguggucgguggcacagauucuucgauggacguuuuccaucuggaagggaugacuaccucagugauggcacaguuuaacuuguuaagcaguacaauggaucagauguccucuagggccgcgagcgcuuccccguauacccccgagcacgccgcaucaguaccuacucauaguccauacgcccagcccagcucuacauucgacaccauguccccugcuccagugauccccucaaauacggauuauccuggaccacaccauuuugaagucacuuuccaacagagcaguaccgcaaagucugccacauggacuuacuccccgcugcugaaaaagcucuauugccagauugcuaaaaccugucccauacagaucaaggugagcacaccuccacccccuggcaccgccauucgggcgaugccaguuuacaaaaaggcagagcacgugacggacgucgugaagcgcugccccaaccacgagcugggucgagauuuuaaugaagggcaaucggccccggcuucucaucuuauccguguagagggaaacaaucugucccaguauguugacgauccugugacuggcagacagucagucguggugcccuacgaaccaccucaggucggcacagaguucaccacuauuuuguacaacuuuauguguaauaguagcugcguugggggaaugaacaggcggcccauccucauaaucauuacacuggagaugcgcgacggucaagugcugggcagaagguccuucgaagggcggaucugugccugcccaggacgcgaucgaaaagcagacgaggaccacuauagagaacagcaggcucucaaugagucuagcgccaagaacggcgcggccucaaaaagggcauuuaagcaaagucccccugcuguaccagccuuaggugcuggggugaaaaagcggcgucauggagaugaagacaccuacuaucugcagguccgcggcagagagaauuucgagauucuuaugaaguugaaagaaucccuggagcuaauggaacucgugccgcagccccugguugauagcuacaggcagcaacagcagcuucugcagcggccuucucacuugcaaccacccucauauggcccugugcucaguccaaugaacaagguccacgggggaaugaauaaacugcccagcgugaaccaguuaguaggucagccgccuccacauuccucugccgcaacgcccaaccugggcccuguugggcccggaaugcucaauaaccacggccaugccgugccagcuaauggugagaugucgagcucccacucagcgcagaguauggucucugggagccauuguaccccucccccaccguaccacgcagacccuucccuugugucauuucugacaggcuugggaugccccaacuguaucgaauauuucacuagccaaggccuacagucuauauaccaccuacagaaucucaccauugaggaucugggggcccuuaagaucccagagcaguaccgaaugacaauuuggcgcggacugcaagacuugaaacagggucaugauuauuccacugcucagcaacuccugagaaguagcaacgccgcaaccaucucuaucggcggguccggagaauuacagaggcagcgggucauggaggccgugcacuuccgcguuagacauacaauuaccauacccaauaggggcgguccugggggcggaccagacgaaugggcugauuuuggcuucgaccugcccgauugcaaggcccguaaacagccuaucaaggaggaauuuacugaggcagagauucacuga

SEQ ID NO: 64115 - RNA, 1263 nt, Artificial Sequence
  derived and/or modified sequence opt3 from TPBG__Homo_sapiens__XP_011534399
augcccggcgggugcagcagaggaccugccgcuggugacggcaggcugcggcucgcacgccuugcccugguguuguuagggugggucuccucuucaaguccaaccagcuccgcgucuucguucucaagcagugcuccguuucuggccuccgcaguuucugcccagcccccucuaccagaucaaugucccgcucucugcgaguguagcgaagcagcccgaacagugaagugcguaaaccguaaucugacugaggugccuacggaccuuccagcuuacgucagaaaccuguucuugaccggaaaucagcucgccgugcugcccgcgggcgcauuugccaggcggccuccacuggcugaacucgccgcauuaaaccuguccgguucacgccuugaugagguuagagcuggggccuucgaacacuugccgagucugaggcagcuagaccucagccauaauccccuggcggaucuuucuccuuuugccuucuccggaucaaacgcaagcgugagugcuccaucuccccuggucgaguugauccucaaucacauugugccuccagaggacgaacggcagaaccgcuccuuugagggcaugguaguugccgcucuguuagccggccgagcacugcaagggcucagaaggcuugaacuggccagcaaucauuucuuguaucuaccccgggaugugcuggcucagcucccgucgcugcgucaccuugaccugucuaacaauuccuuggucucacucacauacgugaguuuucgcaaccugacucauuuagagagccugcaccuagaggauaaugcgcucaaagugcugcacaacggaacccuugcagaauugcagggucugccucauauaagagucuuccucgacaauaaccccuggguuugugauugccacauggccgacauggugacauggcugaaggagaccgaaguagugcagggcaaagauaggcuuacuugugcuuauccagagaagaugcggaaccgaguccuguuggaacucaauuccgccgaccuggacugcgauccuaucuuacccccaucucugcaaacaagcuacguguuucuagggauuguucucgcacugaucggagccauuuuccuuuuggugcuguaucucaaccgcaaaggcaucaagaaguggaugcauaauauaagagacgcuuguagggaucacauggaggguuaccacuaucgguacgagaucaacgccgacccccgccugaccaauuuaucaaguaacuccgaugucuga

SEQ ID NO: 64116 - RNA, 2667 nt, Artificial Sequence
  derived and/or modified sequence opt3 from TPCN1__Homo_sapiens__NP_001137291
auggagagcugcuacaucgcccaggcuggccuggaacuccuuggguccucuucaagucccacccugacaagccaauccgcagagauuacugaagacgccucuaacggaggugugucggagcagcacccuuggccaucaggcuucgaaagagaguugaagccggagacgauaagcagucccggguaucauaucuuaagggcgaccggagaagagaauauggcugucucccuggaugacgauguuccucuaauucucacacuggacgaaggcgguucugccccacuugcacccagcaacgggcugggacaggaggaguugccuuccaaaaauggcggcucauacgccauccacgauagucaggcuccaagccucucuuccgggggagaaucaagccccaguucuccugcacauaacugggagaugaauuaucaagaagccgcuauuuaccugcaggagggugaaaacaaugacaaguuuuucacucacccaaaagaugccaaggcgcuggcagccuaucucuuugcucauaaccacuuauucuaccugauggagcuugccaccgcauugcugcuacuccugcuuucccugugugaggcuccggccgugcccgcguugcggcucggcaucuauguacacgccacacuggaauuauuugcacugaugguggucguguucgagcucugcaugaaacuucgcuggcugggguugcauaccuuuauacgacacaagcguacuaugguuaagacaagcgugcuagucgugcaguucguagaagcuaucguugugcuggucagacagaugucgcaugugagggugacccgggcccuccgcuguauuuuucuggucgacugcagauacuguggaggcguuaggcggaaucuucgccaaaucuuccagucucugccuccauuuauggauauuuugcuccuguuacuguucuuuaugaucauauucgcuauucuagguuucuaccucuuuucccccaacccuucagacccauauuucaguacgcuggagaauagcaucgugucccuuuuuguauugcugacuaccgccaacuuccccgaugugaugaugccgucuuacagccgaaauccuuggucaugcgucuuuuucauuguguaucucaguaucgaacuguacuuuaucaugaaccuucuguuggcaguuguguucgacacauuuaaugauauugagaaaagaaaguucaaaucccuccuguuacacaagaggacugccauacagcacgcuuaucggcugcuaaucagccagcgucgccccgcggggauuucuuacagacaauuugagggacucaugagguucuauaaaccacggaugucagcacgagaacgcuaccugaccuuuaaggcccuuaaccagaacaauacaccuuugcugagucucaaggacuucuacgacaucuaugaggucgcugcccugaaauggaaggcaaagaagaacagagaacauugguucgaugaguuacccaggaccgcccugcuuauauuuaaaggcauuaauaucuuggugaaaagcaaggcuuuccaguacuuuauguaucucguaguugccgugaacggcgucuggauccugguggaaacguucaugcuaaaagggggaaacuuuuucuccaagcacgucccauggucuuaccugguguuucucacuauuuaugguguugagcuguuccuuaaaguggcaggcuuggggcccguagaguaccugucgagcggauggaauuuauuugacuucuccgucacaguguuugcguuccucggccugcuugcucuggccuugaauauggaaccuuuuuauuucaucguugugcuccggccacugcaacuacugcgccucuucaagcugaaagagagauacaggaacguccuugauaccauguuugaauugcugccgcguauggcaucauuaggucucacucugcuuauuuucuacuauaguuuugccauaguggggauggaguucuuuuguggcaucguauuccccaauugcuguaacacaucuaccguggcugacgccuaccgguggcgaaaucauacgguuggaaacagaaccgucguggaggaaggcuauuacuaucugaauaacuuugauaauauucuaaacagcuucgugacacucuuugagcugacugucguuaacaauugguacaucaucauggaaggggugaccucccagacaucacacuggagcagguuguauuucaugacuuuuuacauugugaccaugguagucaugacaauaaucguggcauucauucuggaggcuuucguuuuucgcaugaacuacucucggaagaaucaggacuccgaaguggauggagguaucaccuuagagaaagagauuaguaaggaagaacucgucgccgugcuggaacuuuauagagaggcgaggggcgccagcucugacguuacucgccuguuggaaacgcucucccagauggagcgauaccaacagcauucaaugguguuccuggggcggcguaguagaacaaagagcgaucuaucgcugaaaauguaucaggaggaaauccaggagugguacgaggagcacgcuagggaacaagagcagcagcgccagcuuuccucuagcgcagccccugcugcccaacagccacccggaucacggcagagaagucagaccguaacuuga

SEQ ID NO: 64117 - RNA, 2259 nt, Artificial Sequence
  derived and/or modified sequence opt3 from TPCN2__Homo_sapiens__NP_620714
auggccgagccccaggcugaaagcgagccucugcucggcggggcaagaggagguggcggggacuggccagccggacuuaccacauacagguccauccaagugggcccgggugcggcugcccggugggaucugugcauugaccaggcagucguuuucauagaagaugccauccaguaucgcucuauuaaccaccgaguggacgcuucaaguaugugguuguaccguagauauuacagcaauguaugucagaggacuuuauccuuuacgaucuuccugauucuauuucucgcauucaucgagacccccucuucgcugacaucaacugccgaugugcgguaucgcgcugccccuugggaaccacccugcgggcuuaccgagagcgucgaggugcuguguuugcucguuuuugcggcagaccugagugugaagggauaccuguucggcugggcccauuuucagaaaaaccucugguuacugggcuaucuugucguguugguaguuucccugguggauuggacagucucucuaagccucgugugccacgaaccucugagaauaaggcggcuucugcgcccauucuuuuugcuccaaaauuccucaaugaugaagaaaacccugaaguguauccgauggaguuuacccgagauggcuagcguggggcugcuccuugccauucaucugugcuuguucacuauguuuggaaugcuacuguucgcugguggcaaacaggacgaugggcaggacagagaaaggcucacauacuuucaaaaccugccugagucucuuaccucccuguugguccuccugacgacugcaaauaacccagauguuaugaucccggccuacucaaagaaucgggcguaugccauuuucuucaucguguuuaccguaauaggaagccuguuccugaugaaccuacucacagcaauuaucuacagucaguuucguggcuaucugaugaagucucuucagacuuccuuguuccgcagaaggcuggguacccgggcugccuuugaggugcucagcucgauggucggggaaggaggcgcuuucccccaggccgugggcguuaaaccucaaaaucugcuucaggugcugcagaagguccaauuggacucuucccacaaacaggcaaugauggagaaggugcgaucauacgggaguguacuccugagcgccgaagaguuucagaaauuauucaacgaacuggaucgcuccguugugaaggagcauccacccagaccugaguaucagucuccauuucuacaaagcgcucaguuccucuuuggacacuacuauuucgacuaccuggguaaucuuauugcguuggcaaaccuggucucaaucuguguguuucucguccuggacgccgauguguuacccgcugaaagggacgauuucauccugggcauucuuaauugcguuuucauaguguacuauuugcucgagaugcugcuaaagguauuugcccuggggcuccggggauaccugaguuauccguccaacgucuucgacggccuuuugacagugguucuguuagugcucgaaaucagcacccuggcagucuaccgccuuccucaccccgguuggagaccagagaugguggggcuguugucucucugggauaugacgaggaugcugaauaugcuaauuguauuucguuuccugcggaucauaccuucaaugaaacucauggccgugguugcuaguacuguccugggccuugugcagaacaugcgagccuuuggaggcauuuugguggucguuuauuacguguucgcaaucaucgggauuaaccuguuuagaggagugaucguagcguuacccgguaauagcucccucgcuccagccaacggcucugcacccugugggucguucgaacagcuggaguauugggccaauaacuuugacgauuucgcugccgcacuugucacacuguggaaucuaauggugguuaacaauuggcaaguguuucucgacgcuuacaggcgcuacagcggaccuugguccaagauuuauuucguccuguggugguuggugucaaguguuauaugggugaaccuguuuuuagcccucauccuggagaauuuccuucauaaaugggauccacggucucacuuacagccguuggcgggcacccccgaagccacuuaccagaugacaguagagcuccuguucagagacauucuagaggaaccuggugaagaugagcugaccgagaggcuuagccagcauccacaccucuggcugugccgcuga

SEQ ID NO: 64118 - RNA, 675 nt, Artificial Sequence
  derived and/or modified sequence opt3 from TPD52__Homo_sapiens__NP_001020423
auggacugcagagagauggaucuguacgaagacuaucagagccccuucgauuuugacgccggcgugaacaaguccuaccucuaucuuucuccuucagggaauaguagcccaccgggaucccccacccugcaaaaauucgguuuguuaaggacagauccugucccagaggaaggcgaggacguugcugcaacuaucucugccacggaaacccugucggaggaggaacaggaggaacuacggcgcgagcucgcgaagguggaggaagagauucagacacugucacagguacuugcugccaaagaaaagcaccuggcagagauaaaacgaaaguuggggaucaacagccuccaagaacugaagcagaauauugccaaaggauggcaggaugugacugcuaccagugcauacaagaaaacauccgagacccugucucaggccggccaaaaggcuagcgccgcguuuuccucagucgguagugugaucacuaaaaagcucgaggacguuaagaacagccccacauucaaaucuuuugaagagaagguggaaaauuuaaaauccaaggucgggggaaccaaaccugcaggcggcgauuucggggaggugcugaacucagccgcuaaugccagcgcaacgacuaccgaaccacuucccgagaagacacaggagaguuuguga

SEQ ID NO: 64119 - RNA, 435 nt, Artificial Sequence
  derived and/or modified sequence opt3 from TPD52L1__Homo_sapiens__NP_001003396
auggaggcccaggcucaaggccugcucgaaaccgagccccuucaggggacagacgaagaugcaguggccagcgcggacuucuccucuaugcugucagaggaagagaaggaggaauugaaagcugaguuaguccagcuggaagaugagaucacuacgcuaagacagguucucagugccaaggagaggcaccugguggaaauuaaacaaaaacuuggaaugaaccugaugaaugaguugaaacagaacuuuagcaaguccuggcaugacaugcagaccacaacugcauacaagaaaacccacgaaacacucucucaugccggucagaaggcuaccgcagccuucucgaauguaggcacugcuauaucaaagaaguuuggggauaugagcuauaguauccggcacuccauuucuaugccugccaugcgccgaaaauga

SEQ ID NO: 64120 - RNA, 492 nt, Artificial Sequence
  derived and/or modified sequence opt3 from TPD52L2__Homo_sapiens__NP_001230821
auggacagcgccggccaggggguggcugcaagaacccccgccgucgagggacugacagaagcggaggaagaggaacucagggcugagcuuacuaagguugaggaagagaucgugacgcugcggcaaguauuggccgcaaaagaacgccacugcggugaguuaaagcgacgucugggccuauccacccucggggagcugaaacagaaccuuucuagaucauggcaugaugugcaggucaguagcgccuacaagaaaacacaggaaacucugucccaagcuggacagaagaccucugcagccuugucgacagugggcucagcuauuagcaggaagcucggugacaugcggaauagugccaccuucaaauccuuugaggaucgcguugggacuauaaagucuaaaguggucggagacagagaaaacggcagcgauaaucugccuuccucagcgggcaguggggacaagccacugagcgauccggcacccuucuga

SEQ ID NO: 64121 - RNA, 774 nt, Artificial Sequence
  derived and/or modified sequence opt3 from TPGS2__Homo_sapiens__NP_001258879
auggaggaagaggccagcucccccggccuggggugcucuaagccucaccucgaaaaacuuacccugggaaucacaagaauuuuggagucaaguccaggugugacugaagucacgauaaucgagaagccgcccgcugagaggcauaugauuagcuccugggaacagaaaaacaauuguguuaugccugaggacgugaagaacuucuacuuaaugaccaauggcuuucacaugacauggucuguaaaacuggaugcaucggacgaucaaccagaaaagccccauuucgacucacggagcgugaucuuugagcuagauaguugcaacggguccggaaaggucugucucguguauaaaucuggcaagccugcccuggcggaggacacugaaauuugguuccuugaucgcgcucuguacuggcacuuuuugaccgacacauucaccgccuauuaccgacuccugaucacucaucugggucucccacaguggcaguaugcauuuacaagcuacgggauaucaccccaggccaaacaaugguucuccauguauaagccuaucaccuacaauacgaacuuacugacugaggaaaccgauaguuuuguuaauaaacuugacccaagcaagguguucaagucuaaaaacaagauugucaucccgaaaaagaaaggacccgugcagccugcuggcggccagaaggggccauccggacccucagguccuagcacaaguucuacuuccaaaagcucgucuggcuccgggaauccaacccguaaguga

SEQ ID NO: 64122 - RNA, 1335 nt, Artificial Sequence
  derived and/or modified sequence opt3 from TPH1__Homo_sapiens__NP_004170
augaucgaggacaacaaggaaaauaaagaucacagccuggagagaggcagggccucccucauuuucucucuuaagaacgaagucgggggacugauaaaggcuuugaaaaucuuucaggagaaacaugugaauuuacugcacauugaaucacggaagaguaagcgccgaaacagcgaguucgagaucuuuguugacugcgauauuaaucgugaacaacuaaacgacaucuuccaucuccugaaaucccacaccaaugugcuuucuguaaaccugcccgauaauuuuacauugaaggaggacgguauggaaacugugccuugguucccgaaaaagauaucggaucucgaccauugugcaaacagaguccugauguacggcucagagcuggaugccgaccacccaggguuuaaagauaauguguauaggaagcggcgcaaguacuucgcggaccucgcuaugaacuauaaacacggagaucccaucccuaagguugaguuuacggaagaggaaauuaaaaccuggggcacaguguuccaggaguuaaauaagcuguacccaacucaugccugcagagaauaucuuaaaaacuugccccugcuaagcaaguacugugguuauagggaggacaauaucccucagcucgaggacgucaguaacuuucugaaagaacggaccggguucuccauucgcccaguggcaggauaccuuucuccccgagauuuucugagcggcuuggccuucagaguauuccacugcacacaguacguuaggcauuccucagacccuuuuuauaccccagagccggauacuugucacgaacuccugggccacgugcccuuacuggcugagccuaguuucgcacaauuuagccaggaaaucgggcucgccucucuuggagcuuccgaggaggccguccagaagcuggcgacaugcuacuucuuuaccguggaguucgguuuguguaagcaggacggccaacuacggguguuuggggcaggacugcucucaagcauaagugaacugaaacaugcccuuucuggccacgcuaaggucaaaccauucgaucccaagauuacgugcaaacaggaaugucugaucacuaccuuucaggacguuuauuucguguccgagagcuuugaagaugccaaggagaagaugcgugaguucacaaaaacuauuaagcgcccuuuugguguaaaauacaacccauauaccagaucgauccagaucuugaaggacacaaaaucuauuaccuccgcaaugaaugaacuccaacaugaucuggacguggucucagaugcuuuagccaaggugaguaggaagcccagcauauga

SEQ ID NO: 64123 - RNA, 1473 nt, Artificial Sequence
  derived and/or modified sequence opt3 from TPH2__Homo_sapiens__NP_775489
augcagcccgccaugaugauguucagcuccaaguacugggcuagaaggggcuuuucucuggacucagcagugccugaggaacaccaacuccuugggaguagcacccugaacaaaccaaauuccggaaagaacgaugacaaagguaauaaggggucuucgaaacgggaggccgcgacagaaucagggaagacugcugucguuuucagcuugaagaacgaggugggaggcuuaguaaaagcccugcgccuauuucaggaaaagcgagugaauaugguccauaucgagagucguaaauccagaaggcggucuagcgagguggaaauuuucguugauugcgagugugguaagacggaauuuaacgagcucauacagcugcuuaaauuccagaccacaaucgugacucugaauccgcccgagaacauuuggaccgaagaggaagaguuggaagacgucccuugguuuccacgcaagaucuccgagcucgauaagugcucacacagagugcugauguaugggagugagcuggacgcagaucaucccggauucaaagacaauguauacaggcaacggcgcaaguauuuuguugauguggccaugggcuacaaauauggccagccuauuccacgagucgaauacacagaggaagagaccaagacuuggggcgugguguucagagaacucagcaaauuauaucccacacacgcuuguagggaguaccugaagaacuuuccucuuuugaccaaauacugcggauaucgggaggacaaugucccacagcuggaagauguuucuauguuccuaaaggagcguuccgguuuuacggugcgcccgguagcaggcuaccucucacccagagacuuccuggccgggcuugcuuauaggguguuccauuguacucaguacauccggcacggaagcgauccucuguauaccccagaacccgacacaugccacgaguugcucggccaugucccucuguuagccgacccaaaguuugcgcaauucagucaggaaauaggucuggcaucucucggggccuccgaugaggacgugcagaaacuugcuacuuguuacuuuuucaccaucgaguuuggacugugcaagcaggaaggccaauugcgagccuauggcgcagggcuacugagcucgauuggagagcucaaacacgcucugucugauaaggccuguguuaaagcguucgaccccaagacaaccugccuucaggaaugucugaucacgacuuuucaggaggccuacuucguguccgagucauuugaagaggcaaaggagaaaaugcgcgauuucgcuaagaguauuacaagaccguuuagcgucuacuucaacccuuauacccaauccaucgaaauauugaaagacacuaggucuauugaaaaugugguacaggaucuccggagcgaccugaacacaguuugcgaugccuuaaauaagaugaaccaguaccuggguaucuga

SEQ ID NO: 64124 - RNA, 750 nt, Artificial Sequence
  derived and/or modified sequence opt3 from TPI1__Homo_sapiens__NP_000356
auggcccccagcagaaaguucuuugugggcgggaacuggaaaaugaauggaaggaagcagucccugggugagcucaucggcacccuuaacgcugcaaaagucccugccgacacagaaguugugugcgcgccaccgacugcuuacauugauuucgcccggcaaaagcuggaccccaaaauagcaguagccgcucagaauuguuauaaggugacgaacggggcauuuaccggagagaucucuccuggcaugauuaaggauugcggugccacaugggucguguuggggcacucagaacgccgacauguuuucggagagagugacgaauuaaucggccagaaaguggcucacgcccuggcggagggccuaggggucauugcauguaucggagagaagcucgaugaacgugaggccgguauaacugaaaaagugguauuugagcagaccaagguuaucgcugacaaugugaaagauuggagcaaggucgugcuggccuacgagccagugugggcaauuggcacagggaagaccgcuacuccccaacaggcccaggaaguccaugagaaacuuagaggauggcugaaguccaacguuucugacgcgguggcccagucgacaaggaucauuuauggcgguucaguaaccggggcaacgugcaaagaauuggcuagccaaccugauguggacggauuccucgucggcggcgccagucugaagccagaguuuguggauaucauaaaugcuaaacaguga

SEQ ID NO: 64125 - RNA, 585 nt, Artificial Sequence
  derived and/or modified sequence opt3 from TPK1__Homo_sapiens__NP_001035947
auggagcacgccuucacaccccuggaaccucuccuuagcaccggcaaccugaaguacugcuuggugaucuuaaaucagccacuggacaacuauuuuagacaucuauggaauaaagcucuccugagggcaugugccgaugggggagcgaaccggcuuuacgacauuacugagggugaacgcgaguccuuccugccggaauuuauaaauggcgauuucgacucuauccgacccgagguccgugaguauuacgcuacgaaggggugcgaauugauuucaaccccugaucaagaccacacagauuuuacuaaaugucucaagaugcugcagaaaaagaucgaggaaaaggaccugaaaggaaagcauagacuccacguugauaccggcauggagggugacuggugcggguuaauuccagugggacagcccuguaugcagguaacaaccacuggccugaaauggaaccuuacaaaugauguguuggccuucggcacccuggucaguacgagcaacacuuaugacggguccggagugguuaccguggagacagaucauccucuacucuggacuauggcaaucaagucuuga

SEQ ID NO: 64126 - RNA, 855 nt, Artificial Sequence
  derived and/or modified sequence opt3 from TPM1__Homo_sapiens__NP_000357
auggacgccaucaagaaaaagaugcagaugcugaaacucgauaaggagaacgcucuugacagagcagaacaagccgaggcggauaaaaaggcugccgaagacaggagcaagcagcuggaggaugaauugguguccuuacagaaaaagcugaaaggcaccgaggacgagcuagauaaguacucugaagcacucaaagacgcccaggagaagcuggaacuugcugagaagaaagcaacagaugccgaggcugacgucgccucacugaaucggcgcauucaauugguugaagaggaacucgaucgagcgcaggagcgucuggcaacugcccugcagaagcucgaagaggcugagaaagccgcagacgaaagugagagagggaugaaggugauagaaagcagggcucagaaagaugaggaaaagauggagauccaagagauucaguuaaaagaagccaagcacaucgcggaggacgccgaccggaaguaugaagagguagcacgcaaacuggugauuaucgaauccgaucuugagagagcugaggaaagggccgaguugucugaaggacagguccggcagcuggaggagcaacuacgcauaauggaccagacgcucaaggcucugauggccgcagaagauaaauacucgcagaaggaggaccgauaugaagaggaaaucaaagugcuuucagauaagcugaaggaggccgagaccagagcugaguucgcggaaaggagcguuacaaaauuggaaaagaguauugacgaucucgaggacgaacuguacgcacaaaaauuaaaguauaaagccaucuccgaggagcuggaucaugcucucaacgacaugacuucuauguga

SEQ ID NO: 64127 - RNA, 855 nt, Artificial Sequence
  derived and/or modified sequence opt3 from TPM2__Homo_sapiens__NP_001288155
auggacgccaucaagaaaaagaugcagaugcugaaacucgauaaggagaacgcuauugacagagcagaacaagccgaggcggauaaaaagcaggcugaagacaggugcaagcagcuugaggaagaacagcaagcccugcagaaaaaguugaaaggcaccgaggaugaaguggagaaguacagcgaauccgucaaagaggcacaggagaaguuagaacaggccgagaagaaagcuacagacgcagaagccgauguugcuucucugaaucggcgcauacagcuaguggaggaagaacucgaccgagcccaagagcgucuggcgacugcacuucagaagcuggaagaggccgaaaaagcugccgaugagucagaaagagggaugaagguaaucgagaacagggcaaugaaagacgaggaaaagauggaguugcaggaaaugcaacucaaagaggcuaagcacauugccgaagauagugaccggaaguaugaggagguggcgcgcaaacuggucauccuggaaggagagcucgaaagaagcgaggagagggccgaaguggcagaguccaaguguggugauuuagaagaggaacugaaaauuguuacgaauaaccuuaagucuuuggaggcucaggccgacaaauacucgaccaaggaggacaaguaugaagaggaaaucaaacugcuagaggaaaagcucaaagaggcugagacacgggccgaguucgcagagcgcucaguggccaagcuggagaaaacuauagaugaccuugaggaaacccuggcuagcgcgaaggaggagaaugucgaaauccaucagacauuggaucaaacccuccuggaguuaaacaaucuguga

SEQ ID NO: 64128 - RNA, 747 nt, Artificial Sequence
  derived and/or modified sequence opt3 from TPM3__Homo_sapiens__NP_001036816
auggccggcaucaccacaauugaggcugugaagagaaaaauacagguccugcaacagcaggcagacgaugccgaagagagggcggaacggcuccagcgcgagguugaaggggagcgacgugcuagagagcaagccgaagcagagguggccagccuuaacaggcggauccagcugguagaagaggaguuggaccgcgcucaggaaagauuagcaacugcccugcagaagcuagaggaagcugagaaagccgcggaugaauccgagaggggaaugaaggugauugagaaucgggcacucaaagacgaagagaagauggaacugcaagagauccagcuuaaggaagccaaacacauugcugaggaggccgaucgcaaguacgaagaggucgcacgaaaacuggugaucauagaaggugacuuggagagaacggaagagagggcugagcucgccgaaucuaagugcucagagcuggaagaggagcugaaaaacguuaccaauaaccucaagaguuuagaagcgcaggccgagaaguauagccagaaagaagauaaguacgaggaagagaucaaaauucugacagacaaacuuaaggaggcagaaacucgggcugaguucgccgaacguuccguggcuaaguuggagaaaaccaucgaugaccuggaagauaagcuaaaguguacaaaagaggagcaucucugcacccaacgcaugcuggaccagacucuucuggauuugaaugaaauguga

SEQ ID NO: 64129 - RNA, 855 nt, Artificial Sequence
  derived and/or modified sequence opt3 from TPM4__Homo_sapiens__NP_001138632
auggaggccaucaagaaaaagaugcagaugcugaaacucgacaaggaaaacgcuauugauagagcagagcaagccgaagcggacaaaaaggcugccgaggauaagugcaaacagguggaagaggagcuuacccaucugcagaagaaauugaagggcacagaagacgaguuagauaaauacagcgaagaccugaaggaugcacaggagaagcuagagcucacugagaaaaaggccuccgacgcugaaggggaugucgcagcccugaauaggcggauacaacuuguugaagaggaacuggaccgcgcucaggagcgauuggccacggcgcuccagaaacuggaggaagcagagaaggccgcugaugaaucugagcguggaaugaaagugaucgaaaacagagccaugaaggacgaggagaaaauggaaauucaggagaugcaacugaaggaagcaaagcacaucgcugaggaagccgauaggaaauaugaggagguagcgcggaagcucgugauuuuagaaggugagcuggaacgcgccgaggagagagcagaagucucagagcuuaaauguggcgacuuggaagaggaacugaagaaugugaccaacaaucuaaaaagucucgaggcugccagcgagaaguacuccgaaaaggaggacaaauaugaagaggaaaucaagcugcuuucugauaaacugaaggaggcugagacaagggccgaguucgcagaacggacuguugccaaauuggaaaagaccauagacgaucucgaggaaaagcuggcucaggcgaaagaggagaacgugggguuacaccagacacuggaccagacccucaaugaacuuaacugcaucuga

SEQ ID NO: 64130 - RNA, 738 nt, Artificial Sequence
  derived and/or modified sequence opt3 from TPMT__Homo_sapiens__NP_000358
auggacggcaccagaacaagccuggauaucgaggaauacuccgacacugaggugcagaagaaccaaguccucacgcuugaagaguggcaggauaaauggguuaaugggaagaccgccuuccaccaggaacagggacaucaacuguugaaaaagcacuuagacacauuucugaaagguaagucuggccuaaggguguucuuuccccucugcgggaaggcuguagagaugaaaugguucgcagaucggggacauucaguggucggcguggagauuagugaacuggguauacaggaguuuuucacugaacagaaccuuagcuauuccgaggagccuaucaccgaaauuccagggacaaagguuuuuaaaucuucgucaggaaauaucagccuguacuguugcaguauuuucgacuugccgcgcaccaacaucggcaaguuugauaugauaugggaccgaggcgcccucguggcgaucaaucccggggaucguaaauguuaugcugacacuauguucucccugcugggaaagaaguuucaguaccucuuaugcguccugucuuaugauccuacaaaacacccaggucccccuuucuacgugccacaugccgagauugaaagacuuuuuggcaagaucuguaacauuaggugcuuggagaaaguagacgcauucgaggaacggcacaagagcugggggaucgauugucuguucgagaaacuauaucuccugaccgaaaaguga

SEQ ID NO: 64131 - RNA, 2802 nt, Artificial Sequence
  derived and/or modified sequence opt3 from TPO__Homo_sapiens__NP_001193673
augagagcccuggcugugcucagcgucacccuuguuauggcaugcacagaggccuucuuucccuucaucuccaggggcaaggaacuguugugggggaaaccugaggaaucucgggugucaaguguauuagaggaaagcaagcgccugguggacacugcgauguacgcuacgaugcagcgaaaccugaaaaagcgugguauucucuccccagcccaacugcuuucuuuuucgaaacugccggagcccaccucaggagucauagcaagagccgcugagaucauggaaacaagcauucaggcaaugaagaggaaggugaauuugaaaacucagcagagucaacacccuaccgaugcccucuccgaggaccugcugucuaucauugcuaacaugagcggcugucucccauauauguuacccccuaagugcccaaauacaugucuggccaacaaauaccggcccaucaccggggcgugcaauaaccgcgaucauccuagauggggagcauccaauacugcccuugcuaggugguugccaccgguuuaugaagacggcuucucacagccccgggguuggaacccuggguuucuguacaauggauucccacuacccccugugcgcgaggucacacgacacgugauacagguaaguaacgagguugugaccgaugacgauagauauagcgaccuccugauggccuggggccaguacaucgaucaugacauugcauuuacgccacaaucuacuuccaaggcugccuucggcgggggagcggauugucagaugaccugcgaaaaucagaaccccuguuuuccgauccagcuuccugaggaagccaggcccgcagcugguacagccugccugccauucuaucggucaagcgcugccuguggcacuggggaccaaggagcauuguuuggcaaucucaguaccgccaacccucgucagcagaugaauggucugacaucuuucuuagaugcuuccaccgucuacgggagcucgcccgcgcuggagcgccaacucagaaacuggacgucugcagaaggacuucugagggugcacgcccgguugcgagacuccggccgcgcuuaccuaccauuugugcccccuagagccccagcagccugcgcuccggagcccggcauuccuggggagacuaggggaccauguuuccuggccggugacggccgggcaucagaaguccccagucucacagcgcugcauacccuuuggcugcgcgagcacaacagauuggcugccgcacucaaagcccugaaugcucacuggagcgccgaugcaguuuaucaggaagcuaggaaggugguaggggccuuacaucagaucauaacucugcgugacuacauuccucggauccuaggaccagaggcguuccagcaauaugugggccccuacgaagguuaugauuccacagccaacccgaccgucucuaauguguuuagcacggcugcauuccgauuugggcacgccaccauucauccucucguuagaaggcuggacgcuucauuccaggagcacccagaucuucccggcuuguggcugcaccaggccuuuuucaguccuuggacacuccugcgcggaggcgggcuugacccccugauccggggauugcucgcaagaccagcgaagcuacaggugcaagaucaguuaaugaacgaggaacugacugagaggcuauuuguccucuccaauagcucuacccuggaccuugccucaaucaacuugcagcgcggucgagaucauggccugccuggguacaaugaauggcgggaguucugcggacucccccgucuggaaacaccagcugacuuaaguacugccauugcaagcagauccguggcugauaaaauacuggaccuuuauaagcacccggacaacaucgauguaugguugggcggucucgccgagaauuuucugccuagggcacgcaccgggccccuauucgccugccugauuggcaaacagaugaaggcucuccgggacggagauugguuuuggugggagaacucucauguuuucacagacgcgcaaagaagggaacuggagaaacacucgcuuagccgagugaucugugauaauaccggcuugacucgcgucccaauggacgccuuucagguggggaaguuccccgaagauuucgaguccugcgacucaauaacgggaaugaaccuggaggcauggcgggaaacauuuccucaggaugacaaaugugguuucccagagagugucgaaaauggcgauuuugugcauugcgaggaaucugggagaaggguuuuaguguacagcugucgucacggauacgagcuccagggccgcgagcaacugaccugcacucaggaagguugggacuuccagcccccucuuuguaaggauguaaacgagugcgcugacggggcccacccgccaugucaugccuccgcucggugcagaaauaccaagggcggauuucaaugucugugcgcagaccccuaugaauugggcgaugacgggaggacaugcgucgauucaggacgacucccucgggugaccuggauuagcaugucucuggccgcgcuacugaucggcgguuucgcugggcucacuuccacaguuaucugucgcuggacgagaaccggaacuaaaaguacacugccaauuagcgagaccggcgguggcacacccgaacuuaggugcgggaagcaccaggccgugggaacuucuccucagcgggcagccgcucaggacuccgagcaagagucagcaggcauggaagggcgagauacccauagauugccgcgcgcccuguga

SEQ ID NO: 64132 - RNA, 1692 nt, Artificial Sequence
  derived and/or modified sequence opt3 from TPP1__Homo_sapiens__NP_000382
augggccugcaggccugccuccuugggcuguucgcuuugaucuuaagcggaaaguguuccuacucucccgagccugaccaaagaaggacccugccaccggguugggugucacuaggccgggcagaucccgaagaggaacucagucugacauuugcccuucgccagcagaacgucgagcgacugagcgaauugguucaggcgguguccgacccuucuucgccacaauaugggaaauaccucacucuggagaauguagcugaucuggugcgucccucaccucucacguuacacaccguccagaaguggcugcuugccgcaggagcccagaaaugccauagcgugauuacacaggacuucuugacuuguuggcugaguauaagacaagcugagcuacuccugccaggcgcagaauuucaccauuauguuggugggcccaccgagacacacguggucagguccccucauccauaccagcuuccgcaggcccuggcuccccacguggauuucguaggaggcuugcaccgguuuccuccaaccucuagccuccgccagagacccgaaccucaaguuacuggcacaguggggcugcauuuaggagucaccccauccgugaucaggaagcgguauaaccugacgucacaggacguggguaguggcacuagcaauaacucucaggccugcgcgcaauuccucgagcaguacuuucacgauuccgaccuugcacaguucaugcgccuguuugggggaaauuucgcccaucaggcuucagucgcccgaguugugggccaacaggguagagggagggcaggaauugaggcuagcuuggauguacaguaucuaaugagugccggcgcgaacaucucuaccuggguguacuccagccccggccggcacgaagggcaggagccguuucugcaauggcucaugcugcuuucgaaugaaucugcccugccucacguccauacaguguccuacggagacgaugaggacucauugaguagcgcauauauucagcguguuaacacugaacucaugaaagcugccgcucgcggucugaccuuacuguucgccuccggcgauucuggggcaggauguuggagcgugucaggcagacaccaguuuaggcccacauucccagccaguuccccuuacgucaccacggugggugggacuagcuuccaggagcccuuucuaaucacaaaugagauaguagacuauaucucuggcggaggcuucucaaacguuuuuccacggcccaguuaccaagaagaggcugugaccaaguuccucagcuccucuccucaucugccaccgucgagcuauuuuaaugcguccgggcgagcauaccccgacgucgccgcucuuucagauggauauuggguggucaguaaccgcgugccuauuccauggguuucugguacuagcgccuccacacccguguucggcgggaucuugucacugauuaaugaacacagaauccucagcggaaggccuccacugggcuuucuuaacccccggcuguaccagcagcauggugcaggguuguucgacguaacccgcggcugccacgagucuugucucgaugaagaggucgagggacagggcuuuugcuccgggccgggaugggacccugugacggguuggggcaccccaaauuuccccgcccuguuaaagacacugcuaaacccuuga

SEQ ID NO: 64133 - RNA, 3750 nt, Artificial Sequence
  derived and/or modified sequence opt3 from TPP2__Homo_sapiens__NP_003282
auggccaccgcugcaacagaggaacccuucccuuuucacggccugcucccaaagaaagagacuggggccgcgagcuuccuuugcagauacccggaauaugacggaaggggugugcugaucgcugucuuggauacgggcguugaccccggggccccuggaaugcaagugaccacagauggcaagccaaaaauuguagacauaaucgauacuaccgguuccggggacgugaacacagcaaccgaggucgaacccaaggauggagagauugugggcuuaucuggccggguucugaaaaucccugccucauggacuaauccaagugggaaguaccauauuggaaucaagaacgguuaugacuuuuaccccaaagcucuaaaggagcgcauacaaaaagaacgaaaggagaaaaucugggauccugugcaccgugucgcacucgccgaggcuuguagaaagcaggaagaguucgacguggccaauaacggcagcucccaggcgaauaagcugauuaaagaggaacuucagucucaaguagaacuguugaacucguuugagaagaaauauucagauccagggccgguuuacgacugccucguguggcaugauggagaagucuggagggcauguaucgacagcaaugaggacggcgaucugaguaaguccacagugcugcggaacuauaaagaggcccaggaauacgguucuuucgggaccgcugagaugcucaauuacagcgugaacauuuaugacgauggaaauuuacuguccaucgucacgucaggcggcgcccacgggacucauguugcaaguauagcugccggacacuuucccgaggaaccugaacgcaacgguguggcgccaggcgcccagauucuuagcaucaagauuggggacaccagauugucuacaauggagacuggaaccggccugaucagggcaaugaucgagguaauuaaucacaaaugcgaucuagugaacuacuccuauggugaagcuacacauuggcccaauucagggcggauaugugaggucaucaacgaagccguguggaagcacaacauuaucuacguuagcagugcuggcaauaacggaccuugccucucuaccgugggcuguccagggggaacgacuuccagcgucauaggugugggcgccuauguaucgcccgacaugaugguugcagaguacucucugcgcgaaaaacuuccggccaaucaguauacaugguccucacgagggccuagugcugauggagcgcugggcgugagcauuuccgcacccgguggggccaucgcuucugucccaaacuggaccuugagaggcacucaacucaugaauggaacaagcaugucaaguccuaacgccugcggcgggaucgcacugauuuuauccggacugaaagccaauaacaucgacuacaccgugcauagcgucaggcgggcucucgagaauacggccgugaaggcagauaacauugagguuuucgcgcagggucacggcauaauccagguggacaaggcuuacgauuaucuuguacagaauaccucuuuugccaacaagcugggguucacagucacugugggaaauaaccguggcauuuacuugcgcgaccccguucaaguggcagccccaucagaccacggugucgggaucgaacccguguuuccugagaauaccgaaaacagugagaaaaucagccuacagcugcaucucgcucugacauccaacucuucguggguacaguguccaagccaccuugagcugaugaaucaaugcagacauauuaacauaaggguggauccgcggggcuugcgagaaggacuccacuauacugagguuuguggcuacgacaucgccucccccaaugcagggccucuguuccgcgucccaauuaccgcugugaucgccgcgaaggugaacgaaucaagucauuaugauuuagccuuuacagacguccacuucaagcccggacagauuagaaggcacuucaucgagguuccugaaggcgcuaccugggcagaggugacugugugcucuugcagcuccgagguaucagccaaauuuguccugcaugcugugcagcuaguuaagcagcgggccuaccgcagccacgaguucuauaaauuuuguucucucccagaaaaggguacgcugacagaagcauuccccgugcuugggggaaaagcgauagaguuuugcaucgccagauggugggcuuccuugagugaugucaauauugacuacaccaucagcuuccauggcauuguguguacugccccgcaacugaacauccacgcaucugaagguauaaauagguuugauguucaguccucacucaaguacgaggaccuggcuccuugcauuacccuuaagaacugggugcagacacugcguccaguaagugccaaaaccaagcccuugggcagccgggauguccucccuaauaaccgacagcuguaugagaugguguuaacuuacaauuuccaccaacccaaaucgggggaagugacaccauccuguccucugcuaugcgagcuccuguaugaaucugaguuugacagccagcuuuggaucauuuucgaucagaacaagagacagaugggaucaggcgacgcauacccccaucaauauaguuugaaacuggaaaagggggauuacacgaucaggcuccagauacgccacgagcagaucuccgaccuggagcgguuaaaggaccugccauuuauugucucucauagacuuagcaauaccuugucccucgauauccacgaaaaccauucauucgcccugcuaggcaaaaagaaaagcaguaaucugacucucccgccuaaguauaaccagcccuuuuucguuacaucucugccagacgauaaaauucccaagggagcugguccuggguguuaccuugcgggauccuugacccugagcaaaacagaguuaggcaagaaggccgacgugaucccaguacacuacuaucucauacccccuccgacuaaaaccaagaacgguucgaaagauaaggaaaaagacucagagaaggagaaggaucugaaagaagaguucacggaagcacuuagggaccugaagauucaauggaugaccaaauuggauucuagugacaucuacaaugagcucaaggaaacauauccaaacuaccugccccuauauguggcucgccugcaccagcucgaugccgagaaagagcgaaugaagcggcugaaugaaaucgucgacgccgcuaacgcagugauuucccauaucgaucagacugcccuugcgguuuacauugcuaugaagaccgacccucguccagacgccgcaacaaucaaaaaugauauggacaagcagaaaagcacuuugguggaugcccugugcagaaagggcugugcuuuagcagaccaccuccugcauacccaggcccaggauggggcgauaucuacggacgcugagggaaaagaagaggaaggcgagagcccccuugauucccuggccgagacauuuugggaaaccacuaaguggacagaccuauucgauaacaagguccucaccuuugcauauaaacacgcccuggugaauaagauguacgggaggggauugaaauucgcuacuaagcugguugaggaaaaaccuaccaaggagaacuggaaaaauugcauucaguuaaugaagcuccugggcuggacacauugugccucauuuacggaaaacuggcuuccgaucauguaucccccagacuacugcguguucuga

SEQ ID NO: 64134 - RNA, 513 nt, Artificial Sequence
  derived and/or modified sequence opt3 from TPPP2__Homo_sapiens__XP_005267381
auggccagcgaggcugaaaagaccuuccacagauuugcagccuucggcgaguccucuucaagugggacagaaaugaacaauaaaaacuuuagcaagcugugcaaagacuguggaaucauggaugguaagacugugacguccaccgacgucgauauuguuuucucuaaagugaaggcgaagaaugcuaggacaauaacuuuucagcaauucaaagaggccguaaaggaacucggccagaaacgguuuaaggggaaaucgcccgacgaggugcuugagaacaucuacggacugauggaaggcaaggauccugcaaccacaggugccaccaaggcuacuacagucggggcaguggaccgcuugaccgauacgucaaaauauacuggaacccauaaggagcgauucgacgaaagcggcaaaggcaaggggauugccggacgugaggagaugacagauaauacugguuacguuaguggcuauaaaggguccggaaccuacgacaagaaaacaaaguga

SEQ ID NO: 64135 - RNA, 531 nt, Artificial Sequence
  derived and/or modified sequence opt3 from TPPP3__Homo_sapiens__NP_057224
auggccgcuagcaccgacauggcaggccuggaggaauccuucagaaaguuugccauccacggggaucccaaagcgucuggacaggagaugaacgguaagaauugggcuaaacucugcaaggacuguaaaguggccgauggcaagucagucacagggacugacguugauauuguguucaguaagguaaaaggaaagagcgcaagggugauaaacuacgaagaguuuaaaaaggcccuugaggaacuggcuacgaaacgguucaagggcaaguccaaagaggaagcauuugacgccaucugccaauuggucgcugguaaggagccugccaauguggggguuaccaaagcgaagacaggaggcgcaguggaucgcuuaacugacaccucucgauauacaggcucgcauaaagaacguuucgaugagucagggaagggaaaagguauugccggcagacaggacauccuggaugacagcggguacgucagugcuuauaagaacgccggaaccuacgaugcaaaggugaaaaaguga

SEQ ID NO: 64136 - RNA, 660 nt, Artificial Sequence
  derived and/or modified sequence opt3 from TPPP__Homo_sapiens__NP_008961
auggccgacaaggcuaaacccgcaaaggccgcgaacagaaccccuccaaaaagcccgggcgaucccuccaaggacagggcugccaaacggcugucucucgagucagaaggggcaggagagggugccgcugcaaguccugaacuuagcgcccuggaggaggcuuuccgccgauuugccgugcacggcgaugcgcgugcaacagggagagaaaugcauggaaagaauugguccaaguugugcaaagacugucaggucaucgauggcaggaacguuacugugacggacguagauauuguguucucuaagauaaaagguaagucgugccggaccaucacauuugagcaauuccaggaagccuuagaggaacuggcuaaaaagcgcuuuaaggacaaaucaagcgaggaggccgucagagaagugcacaggcuaauugaggggaaggcaccaaucauuaguggaguuacuaaagcuaucuccucucccaccgugagccggcucacagauaccacuaaguucacaggcucccauaaagaacgcuuugacccuucaggcaaggggaaaggaaaggccggucgagucgaucugguggacgagaguggcuacguaagcggguauaagcacgcgggaaccuacgaucagaaaguucagggcgguaaguga

SEQ ID NO: 64137 - RNA, 828 nt, Artificial Sequence
  derived and/or modified sequence opt3 from TPRG1__Homo_sapiens__NP_940887
augagcaccaucggcuccuucgagggguuucaggccgugucucugaagcaagaaggagacgaucagcccucagagacagaccaccucaguauggaagaggaagauccuaugccaagacagauuagcaggcaguccucugucacugagucgacgcuuuacccgaaccccuaucaucaaccuuacauaucacggaaguauuucgcuacccgcccaggugcaaucgagacagccauggaagaccugaagggccacguugcggagacuagcggggaaaccauucagggauuuugguuguuaacaaaaaucgaucauuggaauaacgagaaggagcguauucugcuagugaccgacaaaacucuccugaucugcaaguacgauuucauaaugcuuaguuguguacagcugcagcgaauccccuuguccgcuguguauagaauuugccucggcaaguuuacauucccugguaugucucuggacaaaaggcaaggggaaggacugcggaucuacuggggcagcccagaggaacagucccucuuaucacgcuggaaucccuggaguaccgaggucccuuaugccacguuuacugaacacccaaugaaguacaccagcgagaaauuccuggagauuuguaaacuuucuggcuuuauguccaaguuggugccggcaauccagaacgcccauaaaaauucaacagggagcggaagagguaagaagcugaugguucuaacugaacccauacucauugagaccuacacaggccugaugaguuucaucgggaacaggaauaaacuuggauauucucuggcucggggcuccauugguuuuuga

SEQ ID NO: 64138 - RNA, 7092 nt, Artificial Sequence
  derived and/or modified sequence opt3 from TPR__Homo_sapiens__NP_003283
auggccgcugugcugcagcaaguccucgagagaaccgaacuuaacaagcugcccaaaagcguucagaauaaguuggagaaauucuuagcagaccagcaguccgaaaucgauggccugaaggggaggcacgagaaauuuaagguggaaucugagcaacaguacuucgagauugaaaagcggcuaucacauagucaggagcgccucguaaacgaaacacgagagugccagagccugcgucuugagcuggaaaaauugaauaaccaacucaaggcccugacugagaaaaauaaggaacuggagauagcgcaggacagaaacaucgcuauucagucccaguuuacgaggaccaaagaagagcucgaggccgaaaagcgggauuuaauccgcacaaaugagagacugucucaagaacuugaguauuugacugaagacgugaagaggcugaacgagaaacuaaaggagucgaauaccacaaaaggagaacuccagcugaagcuugaugagcugcaggcaucagacgucagcgugaaauaccgggaaaagcgcuuggagcaagaaaaagagcuccugcacagucagaacaccugguuaaauacugagcugaagacaaagaccgaugaacuccuugcccugggucgagagaaaggcaacgaaauuuuggagcuaaaguguaaucuggagaacaaaaaggaagagguuuccagacucgaagagcagaugaaugggcugaaaacgucuaacgaacaucuucagaagcacguggaggaccuguugacuaagcucaaagaggcuaaggaacaacaggcaagcauggaggaaaaauuccauaacgagcugaaugcccacaucaaguuauccaaccuguauaaaucagcugccgaugacagugaagcgaagagcaaugagcuaaccagggcagucgaggaacuccacaagcugcuuaaagaggccggagaagcuaacaaggccauacaggaucauuugcuggagguggaacagucuaaagaccaaauggagaaggagaugcucgaaaaaaucggccggcuggagaaggaacuugagaaugcaaacgaucuguuguccgcuacaaagcguaaaggugccauucucucagaggaagagcuggcggccaugagcccuacugcagcugccguagcuaagaucguuaaaccagggaugaaguuaaccgaacuguacaaugccuauguggagacacaggaccagcuacuccuggaaaaacuugagaacaagcgcauuaauaaauacuuggacgagaucgucaaggaaguggaggcaaaggccccgauacugaaaagacagagggaagaguaugaacgggcucaaaaggcgguggcaagucucucugucaaacuggagcaggccaugaaggagauucagcgauuacaggaagauaccgacaaagcuaacaagcaauccagcguucuggagcgcgauaauagaaggauggaaauccaggugaaggaccuuucgcagcaaauucggguauugcucauggagcuggaagaggcccgcggaaaccacgugaucagagaugaggaagucucuuccgcagacaucucaaguagcuccgaggugauuucucagcaucuaguuagcuacaggaauauagaagagcugcagcagcaaaaccagcgucuccugguggcccuucgggaguugggcgaaacgcgagagagagaagagcaggaaacuacaucaaguaaaaucaccgagcugcaguuaaagcucgaguccgcucugacugaacuugagcaacugaggaaaagccgccagcaccagaugcaguuggucgauucuauugugcggcaaagagacauguacaggauccuccugucacagacaaccggcguagccauaccccuacacgcaaguagccuggaugacguuucccucgcgucuacgccuaagcgcccaucgaccagccagacaguguccacucccgcuccugucccagugauugaaucaaccgaggccaucgaagcaaaagccgcucugaagcaacuucaggagaucuuugagaauuauaagaaagaaaaggccgagaacgaaaaaauucagaacgagcaguuggaaaagcugcaagagcaggucacagauuuacgaagucagaauacuaaaaucucuacccagcucgacuucgcaagcaagcgguacgagaugcugcaagacaacguggaaggguaucguagagagauuacaucccuucaugaaaggaaucagaagcugaccgcuacuacgcagaaacaggagcaaauaaucaacacaaugacccaggaucuacgcggagccaaugagaagcucgcgguugccgaagugcgggcugagaaccugaaaaaggaaaaagagauguugaagcugucagaaguaagauuaagccagcagagggagucucuccuggcagagcaacgaggucagaaucuucuguugacuaaccuccagaccauucaaggcauccuggaacgcuccgagacagaaaccaaacagcggcuaaguagccagaucgagaagcuggaacacgagauuucucaucuuaagaaaaagcucgagaaugaagucgagcagagacacacucugacaaggaacuuggacgugcaacuguuagauacgaaacgucagcucgacaccgaaacuaaucugcaucuuaacacaaaggagcuguugaaaaaugcccagaaggaaauagcuacccucaagcagcaccuguccaacauggagguucaaguggccucacagaguagccagcgcacagggaaaggacagcccucgaauaaggaggaugucgacgaucuagugucccaacugcggcagacugaagagcagguaaacgaccuuaaagaaagacucaagaccucuacgagcaacguggagcaauaccaggcaaugguuaccucacuggaggaaaguuugaauaaagagaagcaggucacagaagaggugaggaagaacaucgaagugcgauuaaaagaguccgcggaguuucagacucaacuggaaaagaaacucauggaggucgaaaaggagaaacaggaacugcaggaugacaagcggcgcgccauugagucuauggagcagcaacuuagcgaacugaagaaaaccuuguccucaguucagaaugaggugcaggaagcucuacagagagccagcacagcacugaguaacgagcaacaggcuaggcgggauugccaggaacaggccaagaucgcaguggaggcccaaaauaaauaugagcgagaacucaugcugcacgcugcggacguagaggcccuucaggcagcuaaggaacaggucucuaaaauggccuccgugagacaacauuuagaggagacuacccagaaggccgaaagccagcugcucgaguguaaggcuucgugggaagagcgcgaaaggauguugaaagaugagguuucaaagugcgugugucguugcgaggaccuggaaaaacagaaccggcuccugcacgaccaaauugagaagcuuucugauaaagucguggcaaguguuaaggaaggcgugcaggguccucugaauguauccuugagcgaggaagggaaaucucaggagcagauccuagagauacugagauucaucaggcgcgaaaaggagauugccgaaacgcgauuugaggucgcgcaaguggaaagccucagauaccggcagaggguggaguuacuggagcgcgaacuucaggagcugcaggacucccucaacgcugaacgugagaagguccaaguuacagccaaaaccauggcacagcaugaggaauugaugaagaaaacugagacaaugaaugugguaauggaaaccaacaagaugcugagagaggaaaaagagcggcucgagcaggaucugcaacagaugcaggccaaggugaggaagcuugaacuagacauccugccauugcaggaggcuaaugcagaauuaucagagaaaaguggaaugcugcaagccgaaaagaaacuccuggaggaggaugucaagcgcuggaaagcgcgaaaccagcaccuugugagccagcagaaggacccggauacugaagaguauagaaagcugcucucugaaaaagagguucacaccaagcggauucaacaguugacagaagagaucggcaggcugaaagcugagauagcccgcuccaaugcaucacuaacgaacaaucagaaccugauucagagucucaaggaagaccuuaacaaagugagaaccgagaaggaaacuauccaaaaggaucuggacgccaaaauuaucgauauacaggagaaggucaaaacaaucacccaggugaagaaaauuggcaggcgguacaagacacaauacgaggaauuaaaagcucagcaggacaagguuauggagacuagcgcccaguccucuggggaucaucaagaacagcacgugucgguccaggagaugcaggaauugaaggagacccugaaucaagcagagacgaaaagcaagucacucgaaucccagguagagaaccugcagaaaacacuuagugaaaaggagaccgaagcucguaaucugcaggagcaaacugugcagcuccagucugaguugagccgccugcgacaggacuuacaagacagaaccacacaggaagagcagcuaaggcaacagaucacugaaaaagaggaaaagacccggaaggccauuguugcggccaaauccaagaucgcacaucuggcuggagugaaagaucagcucacaaaggagaacgaggaacuuaaacagcgcaauggugcccuggaccaacagaaggaugaguuggacgucagaauaacggcucugaagucacaguaugaaggcaggauuucucggcucgagcgagagcugagagaacaccaggagcgccaucuugaacaaagggaugagccccaggaaccuagcaacaaagugccagagcagcagcggcaaaucacccucaagacuacacccgcaaguggggagcguggaaucgccuccaccagcgacccuccaacugccaauauuaaacccacaccgguagugucuaccccuucaaaggucacggcugcggcaauggccggcaacaaauccacucccagagcuaguaucaggccaaugguuaccccugccacagugaccaaucccacuacaaccccaacagcaacugugaugcccaccacgcaggucgaaagccaggaggccaugcaaucggaagguccuguggagcacguuccaguauucgggucuacauccggcagcgugcgcucaaccaguccgaacguccagcccucuauuucccagccuauacugacugugcagcaacagacccaggcuacagcguuuguucagccaacucaacagagccacccccagaucgaaccugccaaucaggaguugucaaguaacauuguggaggucgugcaaagcuccccaguagaacggcccucuaccagcacggcagucuucggaacaguguccgcuaccccgucaucuagucugccuaagcgaacuagagaggaagaggaagauucgacaaucgaggccagcgaccagguuuccgaugacaccguggagaugccauuacccaagaaacuaaagucugucacuccugugggcacagaagaggaaguuauggcagaggagucaaccgauggggaaguggagacgcaggucuacaaucaggacagccaagacuccauuggagaaggugugacucagggcgauuauacccccauggaggacagugaagagacaucucagagccugcaaaucgaucucgggccacuucagucagaccagcagaccacaacuuccagucaagauggacagggcaaaggugacgauguaauagugaucgacagcgaugacgaggaagaggaugacgaugaaaacgacggggagcaugaagacuacgaggaggaugaagaggacgaugacgaugacgaagaugacaccggcaugggagaugagggcgaagacucuaaugaggggacgggauccgccgaugguaacgacggcuaugaggcugaugacgccgaagggggagacggcacagauccugguacugagaccgaagagucaauggggggcggagagggcaaucacagggcggcagacagccagaacucgggggaaggaaacacaggcgccgcugagucuaguuuuucccaggaaguuagccgcgagcaacagcccucauccgccucugaacggcaggcuccaagagcaccgcagagcccucguaggcccccacauccccugccuccacgguugaccauucacgcccccccucaagagcuggguccgccaguccagcgcauccagaugacucgaagacaaaguguggggaggggacuccagcugacccccggcauugguggcaugcagcagcauuucuucgaugacgaggaucggacagugccuuccacgccaacucuugucguaccccaccgcaccgacggguuugcugaagccauccacagcccucaaguggcaggaguuccgagauucagguuuggccccccagaggauaugccucagacaucuucaagucauuccgacuuagggcagcuggcgagccagggaggccucgguauguacgaaacccccuuguuccuggcccacgaggaagagucugggggacgaucggugccaacuacaccucuacaagucgcugcccccgugaccguuuuuacggagucaacuacaagcgaugcauccgaacaugcuagucagucugugccaauggucaccaccagcacuggcacacuguccaccacaaaugagacugccacgggugacgauggcgacgaaguguucguagaggcagaaucagaggggauaaguucugaggccggacucgaaauugacagccagcaggaggaagagccggugcaagcuuccgaugagucagaccuuccuagcaccucucaggaucccccauccaguagcucgguugacacauccucuucacagcccaagccuuuucggcgugucagacugcaaacuaccuugcgccagggcgugagggggcggcaguucaacagacagcgcggagugagccacgcgaugggcgguagggggggaaucaaucgaggcaacaucaauuga

SEQ ID NO: 64139 - RNA, 2136 nt, Artificial Sequence
  derived and/or modified sequence opt3 from TPRN__Homo_sapiens__NP_001121700
auggccgcucugggcagacccgggagcggaccuagggcagccgugccagcguggaagcgggagauccucgaacgcaaacgagcuaaacuugccgcacuggguggcggggccggaccgggcgcugcagagcccgaacagcgugucuuggccgaguccuuagguccucugagagaaaacccauucaugcuacucgaggcugagaggcggcgcgggggaggcgccgcgggcgcaagacugcuugaaagguaccggcgcguucccggggugcgagcccugagagcugacucuguauugauuauagagaccgugccuggauuuccacccgccccuccagcaccgggugcugcccaaaucagggcggccgaaguccucguguauggcgcacccccugggcggguuucacgucugcuggagcgcuucgauccacccgcugccccuagaaggcggggaaguccagagcgagcuagacccccgccucccccaccucccccagcacccccucgcccaccgcccgccgccccuagcccacccgcugcgccuggcccaaggggugggggagcaucccccggcgcccggcgcucugacuuucuccagaagacaggcagcaauucauucacugugcacccgagaggguuacauaggggagcuggugcccgucugcuuagcaacggccacagugcaccugaaccacgggccgggcccgcuaaucgauuggccggauccccucccggcucuggucaguggaagccaaaagucgagagcggggauccuucccugcaucccccaccgucaccuggcacgcccagugcaaccccagcgucgcccccugcuucugccacaccaucccagagacaaugcgugucagcagccacuagcaccaacgacaguuuugaaauuaggcccgcuccuaagccgguaauggagacaaucccacuaggagaucuccaggcccgcgcacuggcuucucuucgggccaauuccagaaacagcuucaugguuauucccaagucgaaagcgucuggcgccccuccacccgaagggaggcaguccguggagcugccuaagggagacuuggguccggcuucacccagucaggagcucggcagccaaccagucccugggggagauggcgcacccgcccuggguaaauccccauuagaaguggaggcucagugggccguggaagagggggcauguccucgcaccgcgacugcccuggcugaccgagccauccgguggcagcgucccucuagcccaccgccuuuucuccccgcagcuucagaagaggccgagccagcagaaggccuuagaguccccggacuggccaagaauaguagggaguacguucgcccuggcuugccagugacauucauagaugaaguagacuccgaggaagcuccccaggcggccaaacuaccuuaucugccgcacccagcacggccccuccauccugcuagacccgggugcguggccgagcugcaaccaaggggaagcaacaccuuuacggucgugccuaagcgaaagcccgguacucuucaggaucagcacuucucucaagccaaucgcgagccacggccuagagaagcugaggaagaggaggcaucaugucuguugggcccgacccucaaaaagagguaccccacaguucacgaaaucgaggugauugggggauaucuggccuuacagaaaaguugccugacuaaggcgggcagcucccguaaaaagaugaaaaucucuuuuaacgacaagucgcuacagaccacauucgaauacccaagcgaguccucacucgaacaggaggaggaagucgaucaacaggaggaagaggaagaggaggaagaggaagaggaagaggaggaagaggguagugggucugaagagaagccuuuugcucuguuccuuccccgcgccaccuucgugagcuccguacggccagagucaagcagauugccugaaggaucuuccggccugaguagcuauacgcccaaacauucuguugcauuuuccaaguggcaggagcaggcccucgaacaagcuccgagggaggcagaaccaccucccguggaggccaugcugacuccagcgucacagaaugaccuuagugacuuccgaagcgagcccgcucuguacuuuuga

SEQ ID NO: 64140 - RNA, 828 nt, Artificial Sequence
  derived and/or modified sequence opt3 from TPSAB1__Homo_sapiens__NP_003285
augcugaaccuccuucuguuggccuuacccgugcuggcuagcagagcauacgccgcgccugcuccaggccaggcccuacaaagggucgggaucguuggaggucaggaggcaccgcgguccaaguggcccuggcaagugucucuccgcguacacggcccuuauuggaugcauuucugcgggggaucacugauucacccacagugggugcuuaccgccgcucauugugucggccccgacgugaaagaucuggcagccuugcgaguucagcuccgugaacagcaccuguacuaucaggaccagcugcucccugugaguagaauaaucguccauccacaauuuuacacagcucagauuggugccgauaucgcguuacuggagcuugaggaacccgugaauguaagcucccacguucacacugugacguugccuccagcaucugaaaccuucccgcccgggaugccuugcugggucacaggauggggcgacguggauaacgacgagaggcugccacccccuuuuccacuaaaacaggugaagguccccauuauggagaaucauaucugugaugccaaguaucaccucggcgcuuacacuggggacgauguucggauagugcgcgacgauaugcugugcgccggaaacaccagaagggacucgugucagggugauucaggcgggccgcuuguaugcaaagugaauggaacauggcugcaagcaggcgucgugagcuggggugaagggugugcucagccuaaccggcccggaaucuauacccgcguuacuuacuacuuggacuggauucaucacuaugugccaaagaagccuuga

SEQ ID NO: 64141 - RNA, 828 nt, Artificial Sequence
  derived and/or modified sequence opt3 from TPSB2__Homo_sapiens__NP_077078
augcugaaccuccuucuguuggccuuacccgugcuggcuagcagagcauacgccgcgccugcuccaggccaggcccuacaaagggucgggaucguuggaggucaggaggcaccgcgguccaaguggcccuggcaagugucucuccgcguacgagaccguuauuggaugcacuucugcggcgggucacugauucauccucagugggugcuuaccgccgcucacugugucggaccagaugugaaagaccuggcagccuugagaguucagcucagggaacagcaucuguacuaucaggaucagcugcuccccgugagucggauaaucguccacccucaauuuuacacagcucagauuggcgccgacaucgcguuacuggagcuugaggaaccagugaauguaagcucccauguucacacugugacguugcccccugcaucugaaaccuucccaccggguaugcccugcugggucacaggguggggagauguggacaacgaugagcgccugccuccacccuuuccucuaaaacaggugaaggucccaauuauggagaaucacaucugugacgccaaguaucaucucggcgcuuacacuggcgaugacguuagaauagugagggaugacaugcugugcgccgggaacacccggcgcgauucgugucagggagacucagguggcccccuuguaugcaaagugaaugggacauggcugcaagcaggagucgugagcuggggcgaagguugugcucagccgaaccgaccugggaucuauaccagaguuacuuacuacuuggacuggauucaccauuaugugcccaagaagccauga

SEQ ID NO: 64142 - RNA, 729 nt, Artificial Sequence
  derived and/or modified sequence opt3 from TPSD1__Homo_sapiens__NP_036349
augcugcuccuugcuccccagaugcugagcuuguuacugcuagcccucccugugcuggcauccccagccuacgucgcgccggcucccggccaagcccuucagcagaccgggaucguuggaggucaggaggcaccuagaucuaaguggccauggcaagugucacugaggguacggggccccuauuggaugcacuucugcgggggaaguuugauucauccucagugggugcucacagccgcucacugugucgaaccagacauaaaagaucuggcagcccugcgcgugcagcuccgagagcagcauuuauacuaucaagaccagcugcuucccguuagccguaucauugugcacccucaguuuuacaucauucagacuggcgcugauaucgccuugcuggaacuagaggaaccagucaacauauccucucauauccacacggugacccucccgcccgcgucggagacauucccuccagguaugcccugcuggguaacuggguggggagacguugauaauaacgugcaucugccuccacccuauccgcuuaaggaggucgaagugccuguggucgagaaucaccuguguaacgcagaauaccacaccggcuugcauacaggccacucauuucaaauuguuagagacgauaugcucugcgccgggagcgagaaucacgacaguugucagggagauuccgguggcccccuggugugcaaaguaaacgggaccuga

SEQ ID NO: 64143 - RNA, 966 nt, Artificial Sequence
  derived and/or modified sequence opt3 from TPSG1__Homo_sapiens__NP_036599
auggcccugggcgcuugcgggcuccuucuguuguuagcagugcccggagucagccugagaacccuacagccugguuguggcaggccacaaguuuccgacgccgggggacggaucgugggcggucacgcggcuccggccggggcauggcccuggcaggccucucuccgccugcgacguguacaugugugcggaggcucacuucugaguccucagugggucuugacagcugcacacuguuucagcggcucccucaacucuucggauuaccaggugcaucugggggagcuggaaauuacucucucaccacacuuuagcacgguuagacaaauaaucuuacauaguucccccucuggacagccugguaccagcggcgacauugcccugguggagcuuuccgucccagugacauugucaaguaggauccugcccguaugccuaccugaagcuagcgaugacuucuguccagggauucggugcuggguuacuggauggggcuauacccgcgagggugaaccgcugcccccuccauacucucucagagaggugaaggucuccgugguggauacagagaccuguaggcgggacuaucccgggccuggaggcucaauccuucagccagauaugcugugcgcccgcggccccggggacgcgugucaggaugacagcggagguccguuggucugccaaguuaauggcgcaugggugcaggccgggauaguaaguuggggagaaggcuguggucgaccuaacagacccgggguguacacuagggucccagcuuaugugaauuggauccggcgucacauuacagccucuggcggauccgagagcggcuacccucgccucccccuguuagcaggguuuuuccugccaggacucuuucuucuguugguuucgugcgugcuacuggcuaaaugccuccugcaccccucugccgaugguaccccuuucccagcgccggacuga

SEQ ID NO: 64144 - RNA, 417 nt, Artificial Sequence
  derived and/or modified sequence opt3 from TPT1__Homo_sapiens__NP_001273202
auggugagcagaaccgagggcaacaucgacgauucccugauugggggaaaugccucugcugaaggucccgagggcgaagggacagagucaacugucauaacgggaguugacaucgugaugaaccaccaucuccaggaaaccaguuucacaaaggaggcauacaaaaaguauauuaaagauuacaugaaaagcaucaagggcaaacuugaggaacaaaggccugagcggguaaagccauuuaugacuggugccgcggaacagauuaagcacauccuggcuaauuucaagaacuaucaguuuuucauaggggagaauaugaacccggacggaaugguggccuuguuagauuaccgcgaggacggcgucacccccuauaugaucuuuuucaaagauggccuggaaauggagaagugcuga

SEQ ID NO: 64145 - RNA, 1236 nt, Artificial Sequence
  derived and/or modified sequence opt3 from TPTE2__Homo_sapiens__NP_001135440
augaacgagagcccccagaccaaugaguucaagggcacaacugaagaagccccugcuaaagaguccccacacacgucugaauuuaagggggcagcccuggugucaccgaucaguaaaagcaugcucgagagacuuuccaaguucgaggucgaagacgcggagaacguugcuucuuacgaauggacccaucuggugagguuguuacggcugauuauacuaauccgcauuuuucaccuccugcaucaaaaacgacagcuugagaagcugaugcguagauugguaucggagaauaagaggcgguacacacgcgauggauucgaccucgaucugacuuacgugaccgaaagaaucauugccaugucauuucccagcagugguaggcaguccuucuaucggaacccuaucgaggaagucgugcgcuuucuggacaaaaagcaccgaaaucauuacagaguuuauaaccucugcucugagagggcauacgauccaaaacacuuccacaaucgggugagccguauaaugaucgacgaucauaacguccccacauuacacgaaauggugguauuuaccaaggagguuaaugaguggauggcccaggaccuggaaaacauuguggcuauccauuguaaaggcgggaagggacgcacuggcacaauggucugcgcacuuuugauugccuccgagaucuuccugaccgcugaagagucacuauauuacuuuggugaaagaaggacgaauaagacucacaguaacaaauuccaagggguggagaccccuagccagaaucgguacgugggauauuuugcccaggucaagcaccucuacaacuggaaucugccaccccgacgcauacuuuucauuaaaagauucaucauuuauucuaucaggggcgauguuugugaccugaaggugcagguagugauggagaaaaaggucguguuuuccucaacuagcuugggcaacugcaguauccuccaugauauugaaacagacaaaauacugaucaacguuuacgaugggccuccauuauaugacgacgugaagguccaauucuuuucuuccaaucugccgaaguacuaugauaacugucccuucuuuuucugguuuaauaccagcuucauucagaacaaucggcucugccuuccucgcaacgagcuggacaauccacacaaacagaaggcguggaaaaucuaucccccugaauuugcaguggagauauuguucggagaaaaguga

SEQ ID NO: 64146 - RNA, 1602 nt, Artificial Sequence
  derived and/or modified sequence opt3 from TPTE__Homo_sapiens__NP_954868
augaacgagagccccgacccuaccgaucuggccggcgugaucauugaacucgggccaaaugacuccccgcagacaucugaguucaagggagcuacugaagaggcacccgccaaagaaucaguccuugcgagacugaguaaguuugagguugaggaugcugaaaacguggccagcuacgacuccaaaauaaagaaaaucguacacucuauugugucgucauucgcauuugguuuguucggcgucuuuuuagugcugcuagauguuacgcucauccuggccgaccuuauuuucaccgauagcaagcuguauaucccuuuggaguacaggaguauaucccucgcuaucgcacuguuuuuccugauggacgugcucuuacgggucuuuguggaacgccgacaacaguauuucucugaucuguuuaauauucuugacacagccaucauuguaaucuugcugcuaguugauguggucuacauauucuuugacauuaagcuccugcguaacaucccaagauggacucaucuucugagguugcuccggcugauuaucuuacugcgcaucuuccaccucuuccaucagaaaagacagcuugagaagcugauuaggcggcgcgugagcgagaauaaacgaagauauaccagggauggguuugacuuggaccuaacauacgugaccgaacggauaaucgcuauguccuuccccucaaguggacgucagagcuuuuaucgcaacccuauuaaggaggucguuagauuccuggauaaaaagcacaggaaucauuaccggguguacaaccucugcucugaacgagccuaugacccaaagcacuuucacaaucgcguagugagaaucaugauagaugaccauaacguccccacucugcaccaaauggugguuuucacaaaagaggugaaugaauggauggcgcaggaucuugagaacauugucgcaauccauuguaagggcgguaccgacaggacggggacuauggugugcgccuuucugaucgcuuccgagauuuguucaaccgccaaagagagcuuguacuauuucggagaacggcgcacagauaagacucacagugaaaaauuucagggcguagagaccccuucucaaaagagauacguugcauauuucgcucaggugaaacaccucuacaauuggaaccugccaccgaggcguaucuuauuuauuaagcauuucauaaucuauuccauuccccgguacguccgagaccugaagauccagaucgaaauggagaaaaagguggucuuuagcacaauuucgcuaggcaaaugcucugugcucgauaauauaaccacggacaagauccugauugauguuuucgacgggcuuccuuuguacgacgaugugaaaguacaguucuuuuauuccaaccugccaacuuacuaugacaacuguucauucuacuuuuggcuccacacaaguuucaucgagaauaacagacuguaucuucccaagaaugaacuggauaacuugcauaagcaaaaagccaggcgcauuuacccuagcgacuuugcggucgagauccucuucggagaaaagaugaccuccucugaugugguugccgguagcgacuga

SEQ ID NO: 64147 - RNA, 2244 nt, Artificial Sequence
  derived and/or modified sequence opt3 from TPX2__Homo_sapiens__XP_011527001
augagccaggugaaguccucuuacucauaugacgcccccagugauuucaucaacuuuagcucccuggacgaugagggcgacacccaaaauauugauucuugguucgaagagaaagcuaaccucgaaaauaaacuucuggggaagaacggaacagguggcuuguuucaggggaagacuccuuuaagaaaagcaaaucugcagcaggccauagucacgccacuaaagccgguugacaacaccuacuauaaggaggcggaaaaagagaaucucguggagcaaucgauccccucaaacgcuugcagcagucuggaaguagaggccgcaauuuccaggaagacuccugcccagccacagcggcgcucucuucgacugagcgcucagaaagauuuggaacaaaaggagaaacaccaugugaagaugaaggcaaaacguugugccacacccgucaucauugacgagauccucccuuccaagaaaaugaaggugucaaauaacaaaaagaaaccagaagaggaaggaagugcucaccaggauaccgccgagaagaaugcgagcucucccgaaaaggcaaaaggcagacauacaguuccuugcaugccaccggccaagcagaaauuccugaaguccaccgaggagcaggaacuggagaaaucaaugaagaugcaacaggaaguggucgagaugaggaagaaaaacgaagaguuuaagaaacucgcuuuagccgguauagggcagcccgugaagaaaagcguaagucaaguuacuaagucuguggacuuccacuuucggacagaugagcgcaucaagcagcauccuaaaaaucaggaagaguacaaggaagucaacuucaccuccgagcugagaaaacacccaagcucgcccgcaagggugacgaagggauguacuauugugaaaccuuuuaaucuuucucagggcaagaagcggaccuucgacgaaacagucuccacuuauguuccauuggcucaacagguggaggauuuucacaaacgcacccccaaccgauaccaucugagaucaaagaaagacgacaucaaccuacucccgaguaagagcuccguaacaaaaauuugcagggauccucagacccccgugcugcagacgaagcaccgggcccgugcggucacuuguaaaucuacagccgagcuugaagcagaggaacuggagaaguugcaacaguauaaguucaaagcucgcgagcucgacccaagaauccuggaaggcgggccuauauuacccaagaaaccacccgugaagccuccaaccgagccgauuggauuugaucuggaaaucgagaaaaggauucaggaacgggagagcaagaagaaaacugaggacgaacauuucgaguuccacucacgacccugcccuacaaagauccucgaagauguugugggugucccagagaaaaaggugcuucccaucaccguaccuaaaaguccagccuuugcucugaagaaucgcauuagaaugcccacgaaggaagacgaggaggaagaugagccgguugugauaaaagcccagccugucccacacuacggcgugcccuucaagccucaaauccccgaagcaaggaccgucgagauuuguccauuuuccuucgacagccgggauaaagaacgccaguugcagaaggagaaaaagaucaaggagcuacagaaaggggaagugccuaaguuuaaagcccugccccucccacauuucgacacaauaaaccugccggagaagaaaguuaagaaugugacucaaauugaaccuuuuugccuugagaccgauagaaggggagcucugaaagcgcagacauggaagcaccaguuggaggaagaacuccgucaacagaaggaagcagccuguuucaaagcucggcccaacacuguaaucucucaggagccauuuguccccaagaaagaaaagaaaucaguggccgagggccugagugguagcuuaguucaggagccuuuccaacuggcaaccgaaaagcgagccaaggagagacaggaacuagagaaaaggauggcugaaguggaggcccagaaggcacagcaacucgaggaagcgcgccugcaggaggaggagcagaaaaaggaggaacuugcucgguugagaagggagcugguccauaaagccaauccaauccgcaaguaccaggggcucgaaauuaaguccucugaccaaccccugacagugccuguaucgccgaaauuuagcacccgauuccacugcuga

SEQ ID NO: 64148 - RNA, 543 nt, Artificial Sequence
  derived and/or modified sequence opt3 from TRA2A__Homo_sapiens__NP_001269688
augagcaacagaaggcggcacaccggcucccgcgccaaucccgacccuaacacaugccuggggguguucggacucucucuuuacacuacggagcgagaucugcgugaagucuuuucaagauaugguccauugaguggcguuaaugugguauacgaccagaggaccgggcggagccgcggauucgcuuuuguguauuucgagagaaucgaugacuccaaggaagcaauggagagggccaacggcauggaauuagauggucggcgcauucgagucgacuacucuauaacaaaaagagcgcauacuccgacccccgggaucuauaugggaaggccuacacacucgggcggcgggggagguggcgggggaggcggugggggaggcggcgggggacggcgucgcgauucauacuaugacagagguuacgauaggggcuacgaccgguaugaggauuacgacuaucgauaccgcagaagcccaagucccuauuacuccagguaucggucucgcagcagauccaggucauacaguccucgucgguacuga

SEQ ID NO: 64149 - RNA, 567 nt, Artificial Sequence
  derived and/or modified sequence opt3 from TRA2B__Homo_sapiens__NP_001230808
augagcaccagaaggcggcacgugggcaaccgcgccaaucccgacccuaacugcugucugggggucuucggacucucccuuuacacaacugagcgagaucugcgugaaguguuuucuaaguaugguccaaucgcugacguuucaauuguauacgaucagcaaaguagaaggagccggggcuucgcauuuguguauuucgagaaugucgacgaugccaaagaagcgaaggagcgcgcuaacgggauggaauuggacggaagaaggauacggguggauuuuuccaucacgaaacgcccgcauacccccacaccuggcauuuacaugggucgaccaacuuaugggucuucgagaaggcgggacuacuaugaucguggauacgaccgcggcuacgaugacagagauuauuacucaaggagcuaucggggcgggggagguggcgggggaggcuggcgagccgcacaggaccgcgaccagaucuacagaaggcggagucccuccccuuauuacucucgcgguggguauagaagcaggucccguucacggaguuacagcccacgaagauacuga

SEQ ID NO: 64150 - RNA, 1371 nt, Artificial Sequence
  derived and/or modified sequence opt3 from TRABD2A__Homo_sapiens__NP_001074293
augagccccugguccugguuccugcuccagacccuuugccuguugccuacaggcgccgcuucuagaagaggggcaccaggaacugccaacugugaguuaaagccgcaacagucagaacugaauaguuuucuauggacgaucaaacgggaucccccuagcuacuucuuugguaccauucacgugccauauacacgcgucugggacuucauacccgacaacuccaaggaggcguuucuccagucuucgaucguuuacuucgaacuggaucuuacugacccuuauaccauuucagcucugacaagcugccagauguugccacaaggcgagaaucuccaggaugugcugccccgagacaucuacugucgucugaaaagacaucucgaauauguaaaguuaaugaugccucuguggaugaccccagaucagagggggaaaggacuuuacgccgacuauuuguuuaacgcaauugccggcaauugggagcggaagcgcccggugugggucaugcugauggugaacagucuaacugagguugauaucaaguccagaggugugcccguccucgaccuguuccuugcucaggaagcagagaggcugcggaaacaaacaggggccguggaaaagguagaggagcagugccacccuuugaauggacucaacuuuucucagguuccaaauuucauaaacgcuacccugcccccucaggaacgcaucacggcccaagagauugauagcuacuuacgaagagaacugaucuacaaaaggaaugagcggauuggcaagcgugugaaagcgcuccuugaagaguuuccagacaagggcuucuuuuucgcauucggggccggacauuuuauggguaacaauacuguccuggauguguugcgcagagagggcuaugaaguggagcacgcucccgccgggaggccgauccauaagggaaaauccaagaaaaccucaacacggccuacucuaaguaccauauucgcacccaaggucccaacacuggaaguuccugcucccgaggccgugagcucuggccacuccacccucccaccccugguaucacgaccugguagcgcggacacgccaagugaagccgagcagcgcuuuaggaaaaagaggcggcgcucucagagaaggccgcgucuucggcaauucuccgaccugugggugcgauuggaggaaagcgauauugucccccagcuccaggugccuguucuggacagacacaucucgacugaguuaaggcugccacgccgggggcauucucaccauucccagaugguggcaucaagugcuugucuaagccucuggacacccgucuuuugggugcugguacuugccuuccaaaccgaaacuccuuugcuguga

SEQ ID NO: 64151 - RNA, 1131 nt, Artificial Sequence
  derived and/or modified sequence opt3 from TRABD__Homo_sapiens__NP_079480
auggacggcgaggaacagcaacccccucacgaggccaacguggaaccagucguuccgagcgaggcuuccgaacccgugccuagaguacugucuggggauccacagaaucucucagacguggaugcauucaaccuucuguuggagaugaaguuaaaaaggcggcgccagcgacccaaucugccucguaccgucacacagcuaguggccgaggacggaaguagaguuuacguggucgguacugcgcauuuuagcgaugacuccaagagggaugugguaaaaacgauccgggaaguucaaccagacguggucgugguggagcucugccaguaucgcgucucuaugcugaagauggaugaaucgacccuucugagagaggcucaggaguugucacucgaaaaacugcagcaagccguuaggcagaacggccugaugagcgggcucaugcagauguuacugcuuaaggugagugcacacauuacagagcaguugggaauggcccccggcggugaauuucgggaggcuuucaaggaagcauccaaaguaccuuucuguaaguuucaucugggggaccgcccaauaccggugacuuucaaacgagccaucgcugcccuaucuuuuuggcaaaaggucagacucgcguggggacugugcuuccuuagcgaucccauuuccaaagacgauguggagagguguaagcagaaggaccuguuggagcagaugauggcagaaaugaucggcgaguuuccugaccuccaccggaccauuguuucagaacgugauguguaccugacauauauguuacgccaagccgcuagaaggcuggagcucccacgggccagugacgcagaaccccgaaaaugcgucccuagcgugguaguuggcguggucgggaugggacaugugccagguaucgagaagaauuggucuaccgaucuuaacauacaggagaucaugacugugcccccgccuuccgucucaggccgcguuagcagacuggcugugaaagccgcguucuuuggguugcuaggauacagucuguauuggaugggcaggcggacagccucucucguacugucccuucccgcagcucaguacugucugcagcgcgucaccgaagccagacacaaguga

SEQ ID NO: 64152 - RNA, 939 nt, Artificial Sequence
  derived and/or modified sequence opt3 from TRADD__Homo_sapiens__XP_011521722
auggccgcuggccagaacgggcacgaggaaugggugggaagcgcauaccuguucgucgaguccucucucgacaagguugugcuuucagaugccuaugcgcauccccaacagaaaguagcuguguacagagcccugcaggcagccuuggcugaaagugguggcagcccugacgucuuacagaugcugaagauccacagguccgauccacaacuaauugugcagcuccgguuuugcgggcgccagccguguggacgauuccugcgugcauauagagagggcgcccuuagggcugcccugcagcggucuuuggcggcagcccucgcucaacauucgguuccccugcagcuggaacuccgcgccggugcagagagauuagacgcucugcuugccgaugaggaaaggugcuugucauguauacuggcgcagcagccugaccggcuacgcgaugaggaacucgccgagcuggaggacgcacuucgaaaucugaaaugcgggagcggagcuagaggcggcgauggggaaguggccagugcuccauugcaacccccugucccaucccucucugaggugaagcccccuccaccgcccccuccagcccagaccuuucuguuccagggacaacccguaguuaacaggccuuuaagccugaaagaccagcagacauuugcacgguccgugggucucaaguggcguaaggucggccgcucacuucagagaggguguagggcccugcgggauccagcuuuggacagucuagcguacgaauaugagcgagaaggacuguacgagcaagcauuccagcuccugcgcagauuugugcaggccgagggcaggcgggcuacucuucagcgccugguggaagccuuggaggaaaaugagcucacgagccuggcagaagauuuacugggucuaaccgaccccaacgggggacucgccuga

SEQ ID NO: 64153 - RNA, 885 nt, Artificial Sequence
  derived and/or modified sequence opt3 from TRAF1__Homo_sapiens__NP_001177876
augaagcaguggaaagccagacugggcugcgggcucgagagcggacccauggcucuugaacaaaaccuguccgacuugcaguuacaggcagccguggaggucgcgggugaucuggaaguugacuguuacagggcuccuugcucugagucacaggaggaacuagcccuccaacacuucaugaaggagaaacugcuugcagaacuggagggcaaguugcggguguuugaaaauaucguagccgugcucaacaaagaggucgaggcuagucaucuggcacuggccaccagcauucaccagucccagcucgaucgcgaacgaauauuaucucuggagcagcgugugguugaacuucaacagacauuggcucagaaggaccaggcccuggggaagcuagagcaaucgcucagacugauggaagaggcgucauucgauggaacuuuucuuuggaaaaucacgaaugugaccaggcggugucaugagagcgcaugcggccgcacagucagucuguucuccccagccuuuuauacugcuaaguacgguuauaaauugugucucagacuguacuuaaacggggacggaaccggcaagaggacacaccugucucucuucauugugaucaugcggggcgaauaugaugcccuucugccguggcccuuucgcaauaaaguaaccuucauguugcuagaccagaacaaucgagagcaugcaauugaugcuuuuagaccugaccugagcuccgccucauuccagaggccacaaagugaaacuaacguugcgagcgggugcccccucuuuuucccucugucuaaacuucaguccccaaagcacgccuacgugaaggaugacacaauguuucugaaguguaucgucgagaccucaacguga

SEQ ID NO: 64154 - RNA, 1506 nt, Artificial Sequence
  derived and/or modified sequence opt3 from TRAF2__Homo_sapiens__NP_066961
auggccgcugcaagcgugacucccccuggcucccuggagcuccuucagccaggguucucuaagacacuguugggaacuaaauuagaagccaaguaccugugcucagcguguagaaacguccuaaggcggccguuucaagcucagugcggucaccgcuauuguaguuucugccucgccagcauccuguccucuggcccccagaauugugcagccugcguucaugaggggauuuacgaagagggaauaucgauccuugaaucaagcagugcuuuuccugacaacgcagcccgacgugagguggagucccugccagcuguaugucccucugauggcugcacguggaaagguaccuugaaggaauaugagagcugucacgaagggagaugcccucucaugcugacagaguguccagccugcaaaggacuggugaggcucggcgagaaggaacggcauuuagagcacgaaugccccgagcgcucccugucauguagacauugcagggcgccuuguugcggcgcagacgucaaggcccaccacgaaguguguccaaaauucccgcuuacuugcgauggguguggaaagaaaaagauuccccgggagaaauuucaggaccauguuaagaccugcgguaagugucgcgugccuugccgauuccacgcuaucggcuguuuggagacagucgaaggggagaaacaacaggaacaugaggugcaguggcugagagaacaccuagccaugcuccugaguagcguacuugaggcaaagccacuguugggagaucagucucacgcuggcuccgagcuccugcaaaggugcgaaucauuagagaaaaagaccgccacuuuugaaaauauuguuugcgugcugaaccgggaggucgaacguguggcgaugacagccgaggcauguagccgccagcauagacucgaccaggauaaaaucgaggcucuuaguucuaaggugcagcaacuggaaagguccauagguuugaaagaccuagccauggcugaucuggagcagaagguccucgaaauggaggccagcaccuacgacgggguuuucaucuggaagauuucggauuuugcacggaaacgacaggaggccguggcuggacgcauccccgcgauuuucucuccugcauuuuauacguccagauacggcuauaagaugugccugaggaucuaccuuaauggcgacgggacuggacgggguacccaccugucauuguucuuuguagugaugaaaggcccaaacgaugcccuccugcgcuggcccuucaaucaaaaggucacauuaaugcugcuagaccagaacaauagagaacaugugauagacgcuuucaggccggauguuaccaguagcuccuuucagcguccugugaacgacaugaauauugccucuggguguccccucuucugcccagucagcaaaauggaggcaaagaacucauacgugcgggaugacgccaucuuuauuaaggcuaucguagaucugaccggacuuuga

SEQ ID NO: 64155 - RNA, 1458 nt, Artificial Sequence
  derived and/or modified sequence opt3 from TRAF3__Homo_sapiens__NP_001186356
auggagagcuccaagaaaauggacucucccggcgcccugcagaccaacccuccacucaaacuucacacagauagaucagcugggacuccgguguucguccccgaacaaggagguuacaaggagaaguuuguuaaaacgguggaagacaaguauaagugcgagaaaugucaucugguauugugcaguccuaagcagaccgaauguggccacagguucugcgagagcuguauggcagccuuacuguccucuucgucaccaaaaugcacagcgugucaggagagcaucgugaaggauaaagucuuuaaggacaauugcuguaagcgggaaauucuagcucuccagauauacugccgcaacgagagucgagggugugccgaacaacugaugcuuggacaucuguuggugcaccucaaaaaugauugccauuucgaggagcugcccugcguucguccugacuguaaggaaaaagugcugagaaaggaucucagggaccacgucgagaaagcaugcaaguaucgggaagccacuuguucccacugcaaaucucaggugccaaugaucgcuuuacagguaagccugcuucagaacgaguccguugaaaagaauaagucaauucaaaguuugcauaaccagaucuguagcuuugagauugagaucgaacgccagaaagagaugcugagaaauaacgaaucuaagauacuacaccuccagagggugaucgauucccaagcagagaaacugaaggaacuugacaaagagauucggcccuuccgccagaauugggaggaagccgauucaaugaaaagcagugucgagucucugcagaaccgagugaccgaauuggaguccguggacaagagcgcuggccaagucgccagaaauacaggucuccuggaaucgcaguuaucuaggcaugaucagaugcuguccguucacgacauccggcucgcggacauggaucuucguuuucaggugcuggagaccgcaucauacaacgggguauugauuuggaagauccgcgacuauaagagaaggaaacaagaggccgugaugggaaagacucuaagucuguacagccagccuuucuauacaggcuacuuuggcuacaaaaugugcgcucgggucuaucucaauggggauggaauggguaagggcacccaccugucccuuuucuuugugauaaugcgaggggaauacgacgcccuguugccauggccguucaagcagaaaguuacgcucaugcugauggaucagggaucuagccgcagacauuuaggcgacgcauuuaagcccgauccuaacucaaguuccuucaaaaagccaacuggugagaugaauauugcuagcgggugucccguguucgucgcccaaaccgugcuggaaaacggaacauauaucaaagacgauacuauuuuuaucaagguaaucguugacaccucugaucuaccugacccauga

SEQ ID NO: 64156 - RNA, 1878 nt, Artificial Sequence
  derived and/or modified sequence opt3 from TRAF3IP1__Homo_sapiens__NP_001132962
augaacgccgcuguggucagaaggacccaagaggcacugggcaagguuauccggcgacccccucucacagaaaaacuucugagcaagccaccguuccgcuacuugcacgacauuauaacugaggugauccguaugacgggguuuaugaaaggauuauauaccgaugccgaaaugaaguccgacaauguaaaagauaaggacgcgaagauuucuuuccugcaaaaagcuaucgauguggucgugaugguuucaggugagccccuacucgccaagccugcaagaauuguggccggccaugaaccagagaggacaaacgagcugcuucagaucauagggaaaugcugucugaauaaguugaguagcgacgaugcuguccggcgcgugcucgcaggagaaaaaggcgagguaaaggguagagccucccugacuucuaggucgcaggaacuggacaacaagaauguucgggaggaggaaucacgcgugcacaaaaacaccgaggaucgaggggacgcugaaaucaaggagagaagcacaaguagggaucggaaacagaaggaggaacucaaagaggaccguaagccccgcgaaaaagauaaggacaaggagaaagccaaggaaaauggaggcaacagacauagggagggcgaacgggagcgagcgaaagcacgcgccagaccugacaaugagaggcaaaaggaucgggggaaccgcgaaagagacagggauuccgagcguaaaaaggaaaccgagcggaagucugaaggagguaaagagaaggagcgauuaagagacagggaucgcgaacgggacagagauaaaggcaaggacagggaucgccgacgggucaaaaauggggagcacagcugggaccuggaucgugaaaagaacagagagcaugacaagccagagaaaaaguccgcuucaaguggagaaaugagcaaaaaguugucugacggcacuuuuaaagauuccaaggccgagacagaaaccgagauuucaacgagggcaagcaagagucuuacuaccaaaacaucuaagcgccgguccaaaaauagcguggaaggugacucgacuucugaugcugagggggacgccggacccgcgggccaggauaaguccgaggugccugaaaccccagagaucccgaacgaacugucaaguaauauuagaaggaucccccgaccuggcagcgcccgcccagcacccccucgggucaaaagacaggacuccauggaggcucuacagauggauaggucugggagcggaaagacaguuucaaacgugauaaccgaaagucacaacuccgacaaugaggaggaugaccaauucguaguggaagccgcuccacagcucagcgagaugucugaaauugagauggucacggccguggaacuggaggaggaagagaaacacgguggccuuguuaagaagauccuggaaacuaaaaaggauuacgagaaauugcagcagucacccaagccgggggagaaagaacguagucucuuugagagcgcauggaagaaggaaaaagacauuguguccaaggagaucgaaaaacugcgcacaucuauccaaaccuuaugcaagucggcccugccucucggaaaaauuauggauuauauacaggaggacgucgacgcuaugcagaacgagcuucaaauguggcauagcgaaaaucggcagcacgcggaggcacugcagcaggaacaaagaaucacugauugugccguggagcccuugaaggcugaacuagccgagcuggagcagcucauuaaggaccagcaggauaaaaucugcgcaguaaaggccaacauacugaaaaaugaagagaagauucagaaaaugguuuacuccaucaaccuuacaucaaggcgauga

SEQ ID NO: 64157 - RNA, 1695 nt, Artificial Sequence
  derived and/or modified sequence opt3 from TRAF3IP2__Homo_sapiens__NP_001157753
augaacagaagcauccccguggaggucgacgaauccgagccuuacccaucucagcugcucaagccgauucccgaauauucaccugaggaagagagugagccacccgccccuaauauaaggaacauggccccaaauagccuuuccgcacccaccaugcugcacaacucuucgggcgauuucucacaagcccauagcacauugaaauuagcgaaucaccagcggccuguuagucgccaggugacuugccugcgaacgcagguacuagaagacuccgaggauucuuuuugucguagacauccagggcucggaaaggcuuucccgagcgguugcuccgccgugucagaacccgcaagugagagcgucgugggcgcccugccugcugagcaccaauuuucuuucauggagaaaaggaaccaguggcuuguuucccagcugucagcagccagcccagacaccgggcaugauagugacaagucugaucaguccuugcccaaugcuagcgccgacucgcucggaggcucucaagaaauggugcagcggccucagccacaccgcaacagagcgggucuggaucugcccacaaucgacacuggguacgauucccagccgcaagacguccucggaauuaggcaguuagaacggccucugccccuuaccucaguguguuauccacaggauuugccucgcccccugcgaaguagagaguuuccacaauucgaaccccagagguacccugcaugcgcccagaugcuaccaccgaaucucagcccccacgcuccuuggaacuaucauuaccacuguccaggcucccccgaccaucagguaccuuauggccacgacuacccacgggccgcauaccaacagguuauccagcccgcucugccggggcagccucuuccaggagccucugugcguggucugcaccccguccaaaaagugauuuugaauuauccuagccccugggaucaugaggagcgcccagcgcagagagacugcucauuuccuggccuccccaggcaccaggaucagccacaucaccaaccgccuaaccgggccggggcacccggagaaagucuggaguguccagcugaauuacgaccccaggugccucagccacccuccccugccgcugucccgcgcccacccagcaauccuccagccagaggcacacugaagaccucuaaccuccccgaggaacuuaggaagguuuucaucacuuacucaauggacacagcaauggaggugguaaaauuugugaauuuccuguuggucaacgguuuucagaccgccauagauaucuucgaggaccggauucgcgggaucgauauuaucaaguggauggaaagauaucuaagggacacggugaugauaauuguugcuaucaguccuaaauacaagcaagauguggagggagcggaaagccagcuggacgaggaugaacauggccuccacacuaaauauauucaccguaugaugcagaucgaguuuaucaagcaaggcuccaugaacuuccgguucauuccgguccuguuucccaaugcaaagaaagagcaugugccaaccuggcuucagaacacacacguauacucuuggccuaagaauaaaaagaacauacuguugcgacuccugagagaagaggaauauguugcucccccaagggggccuuuacccacucuacagguggucccacuguga

SEQ ID NO: 64158 - RNA, 1413 nt, Artificial Sequence
  derived and/or modified sequence opt3 from TRAF4__Homo_sapiens__NP_004286
augcccggcuucgacuacaaguuucuggagaaaccuaagagaaggcuccuuugcccacugugugggaaaccgaugcgggaacccgugcaggucagcacaugcggacaccgcuucugugauaccugcuugcaagaguuuuuauccgaagguguuuucaaguguccugaggaccagcugccacuagauuaugccaaaaucuaccccgacccugaacucgaggugcagguacugggccuuccaauucgaugcauacauucugaggaagggugucguuggucaggaccccugagacacuugcagggccaucucaacacuugcaguuuuaaugugaucccuuguccaaacaggugcccgaugaagcugagccggcgcgaucugcccgcucaccuccaacaugacuguccuaagagaagguuaaaaugcgaguucugcgguugugauuuuuccggggaagcauaugagucucacgagggaaugugcccacaggaaucggucuacugugagaauaagugcggcgcccggaugaugcgccgacugcuugcgcagcacgcuacgucagaaugucccaaaagaacccagccuugcacauauuguacuaaggaguucguguuugacaccauucaaagccaucaguaccagugcccaagguugcccguugccuguccgaaccagugcggcguggggacagucgcacgggaagaucugccuggacaccuaaaagacaguuguaauaccgcccucgugcugugccccuucaaggauuccgguugcaagcaucguuguccaaaacuugcuauggcacgccacguagaggagucuguuaagccucaccuggccaugaugugcgcuuuggugagcagacaaaggcaggaacuccaggagcugcggcgagaauuagaggaacuguccgucggcucagacggggugcucaucuggaaaauuggaaguuauggccgcagacuucaagaggccaaggcgaaacccaaccuggaguguuuuagcccagcauucuacacucauaaguacgguuauaaacuacaggugucugccuuuuugaaugggaacggauccggcgaaggcacacaccugucacucuacaucaggguccugcccggggcuuucgauaaucuucuggaguggccuuucgcccggcgcguuaccuuuagcuugcucgaccagagugacccaggacuggcaaagccgcagcaugugacggaaacuuuccaccccgauccuaacuggaagaauuuucaaaaaccagguaccuggagaggcucuuuagacgaguccagccugggguucggauaucccaaguuuauaucgcaucaggauaucaggaaacguaacuacguacgggacgaugcuguguucauucgagccgcggucgaacuaccuagaaagauccucucuuga

SEQ ID NO: 64159 - RNA, 1674 nt, Artificial Sequence
  derived and/or modified sequence opt3 from TRAF5__Homo_sapiens__NP_665702
auggccuacagcgaggaacacaagggcaugcccugcggguucaucagacagaacuccggaaauucuauuucacuggacuuugagccuaguauagaauaucaauucguggagaggcucgaagaacgguacaaaugugcuuuuugccauagcguccuucacaacccacaucagaccgguuguggccaccgcuucugccagcauuguauccuguccuugcgagaguuaaauacaguuccgauuugccccguggauaaggaaguaaucaaaucucaggagguguuuaaggacaacuguugcaaacgugaaguccugaaucuauauguguacuguucgaacgcaccugggugcaaugccaagguuauucucggaagauaucaagaucaccuucagcagugucuuuuccagccagugcaaugcucaaacgagaagugcagggagcccguccugcggaaagacuugaaggaacaccucagcgcgaguugucaguuucgcaaagagaagugccuguacuguaaaaaggaugugguaguuaucaaucugcagaaccaugaagagaaucucugcccugaauauccaguguucugucccaacaauugcgcuaagauaaucuuaaaaacugaggucgacgagcaccuggccguguguccugaagcagagcaggauugcccauuuaagcauuacggcugugccgugacggacaaaagaaggaaccuucaacagcacgaacacuccgcuuugcgggagcauaugcgccugguccuagaaaagaauguucagcucgaggagcaaauuucugaucugcacaaaagccuugaacagaaggaguccaaaauccagcagcuggcagaaaccauuaagaaguuggagaaagaguucaagcaauuugcccaacucuucgguaaaaacgggucauuucugccgaacauccagguguucgcuagucauauagacaagagcgccugguuagaggcgcagguacaccaacugcuccagauggugaaucagcagcaaaacaaauucgaucuucgaccccugauggaggcagucgacacagugaagcagaagauuacuuugcuagaaaauaacgaucagagacuggccguucucgaggaagagaccaauaaacaugacacacacaucaacauucacaaggcucagcugucuaaaaaugaggaaagguuuaagcugcuggagggaaccugcuacaacggcaaauugaucuggaaggugacugacuauaagaugaaaaagcgggaagccgucgauggccauacaguguccaucuucucacagagcuuuuacaccagucguuguggguaucgccucugcgcaagagcuuaccugaauggagacgguucuggcagggggucccacuuaagccuguauuucguaguuaugcggggagaguuugauucgcuacuccaguggccuuuccgacagcgcgugacgcugaugcuuuuggaccaaucuggcaaaaagaacauuauggaaacuuuuaaaccagaucccaauuccucaaguuucaagagaccugacggugagaugaacauagccagcgggugcccaagguuugucgcgcauuccgugcuggagaaugccaagaacgcauacaucaaagaugacacccucuuccugaaggucgcuguggaucuuacagaccuggaagauuuguga

SEQ ID NO: 64160 - RNA, 1569 nt, Artificial Sequence
  derived and/or modified sequence opt3 from TRAF6__Homo_sapiens__NP_665802
augagccugcucaacugcgaaaauuccugugggucuucacagagugagagcgacugcuguguggccauggcuuccucuugcucggcagucaccaaggaugacucaguuggcggaacagccagcacugguaaccuuaguuccucuuucauggaggaaauccaaggcuacgauguggaguuugaucccccucuggaaagcaaauaugaguguccaauuugcuugauggcguuaagagaggcuguacagacgccgugugggcacagguucugcaaggccuguauaaucaaauccauucgggacgcaggacauaagugccccguggacaaugaaauccugcuagagaaccagcucuuuccugauaauuucgccaaacgcgaaauucugucacuuauggucaaguguccaaacgagggcugccugcacaagauggaguugcgacaucucgaagaccaccaggcucauugcgaguuugcacugauggauuguccccaaugccagcguccuuuccagaaauuucacaucaauauacacauccugaaggacuguccaagacgccaggugaguugcgauaacugugccgcuagcauggccuucgaagacaaagagauucaugaucaaaauugcccccucgcgaacguuaucugugaauacugcaauaccauuuuaauccgggagcagaugccuaaccacuaugaccuggacuguccaacagcaccgauacccugcacuuuuucuaccuucgguugucaugagaagaugcagcgcaaucaccuugccagacacuugcaggaaaacacacaaucccauaugaggaugcuggcucaggccgugcacucacuaagcgucauuccugauaguggguacaucucugaggugcggaauuuucaggaaaccauucaucaacucgagggacgccugguacgacaggaccaccagaucagagaacuuacugcaaaaauggagacacaguccauguauguuagcgagcugaagaggaccauccggacguuggaagauaagguggcugagauugaagcccaacagugcaacggcauauacaucuggaaaauuggcaacuucgggaugcaucucaagugccaggaggaagagaaaccagucgugauccacucgcccggauuuuauacugguaagccuggcuacaaacuguguaugcguuuacaucugcagcucccaaccgcgcaacgcugcgccaauuacauaucucuuuucgugcacacaaugcagggggaguaugacucccaucugcccuggccguuccagggaacuauuagauugaccauccuagaucagucagaagcaccugucaggcaaaaccacgaggaaaucauggacgcuaagcccgagcugcucgccuuucagcggccaacaauuccucgaaaucccaaaggcuucgguuacguuaccuuuaugcaccuggaggcucuuaggcagagaacguucaucaaggaugacacucuguuggugaggugugaaguaaguacacgguuugauauggggagccuccgcagagagggauuccagccaagguccaccgacgccggcguguga

SEQ ID NO: 64161 - RNA, 2013 nt, Artificial Sequence
  derived and/or modified sequence opt3 from TRAF7__Homo_sapiens__NP_115647
augagcuccggcaagucugccagauacaacagguucucagggggacccaguaaucugccuaccccagacgugacaacugguacgcggauggagaccacauuuggcccggcuuucagcgcagucacuaccaucacaaaagccgaugggaccuccacuuauaagcagcacugccgcacacccucuucgucaagcacccucgcguacaguccucgagacgaagaggauuccaugccacccauuucuacgccucguagaagcgacuccgcuauaucaguuaggagucuucauagcgaaucuuccaugucacugcggagcacuuuuaguuugccagaggaagaggaggaacccgagccuuuaguguucgccgaacaaccaucuguaaaacuguguugccagcuauguugcuccguguuuaaggauccggucaucaccacauguggacacacuuucugccgcagaugugcacucaaaagcgagaagugccccguggacaacguuaagcugaccguggucgugaauaacauugccguagcugagcagaucggcgaacuuuuuauucauuguaggcacgguugccggguugcagggucgggaaaaccuccaaucuucgagguggauccccgcggcuguccuuuuacaauaaagcugucugcccgaaaagaccaugaaggcuccugcgauuauagaccagucaggugccccaauaacccgucauguccucccuugcuccggaugaaucuggaggcucaccugaaggaaugcgagcacaucaaauguccacauaguaaguacgggugcaccuucauuggaaaccaggacacguaugagacucaccucgaaacaugucguuuugaggguuuaaaggaguuccugcaacagaccgaugaccgcuuucaugagaugcacguggcccuugcgcagaaagaucaggaaaucgcauucuugagaagcaugcugggcaagcuauccgagaaaauugaccaacucgagaagucucuggaacuuaaauucgacgugcuggaugagaaucagagcaaguugucagaagaccucauggaguuuaggcgggaugccaguaugcugaacgacgaauuaucccacaucaaugcucgacugaacauggggauacucggaagcuacgauccucagcagauuuucaaaugcaagggcacuuuugucggucaucaagggcccguuuggugucuuugcguguauucuaugggagaccuguuguucucaggcaguagcgauaagacaaucaaaguaugggacaccuguacgaccuacaagugccagaaaacacuagagggccacgaugggauugugcuggcccucuguauccagggaugcaagcuguacuccgguucugcagacugcacuaucauugucugggauauacaaaaucuucagaaagugaacaccauccgcgcucaugacaauccaguuuguacacuggugucgagccacaacgucuuguuuuccggcucacucaaggccauuaaggugugggacaucguagggacugagcugaaauuaaagaaagaacugaccggacuaaaccauuggguuagagcgcucguggccgcacagaguuaucuguacucuggcagcuaucagacaauaaagauuugggauaucaggacccuugacugcauccacgucuugcaaacuuccggugggucaguguacagcauugcugucacgaaucaccauaucguguguggcacauaugagaaccugauucacguuugggauauagaaucuaaagaacaggugcggacccucacuggacauguaggcaccgucuacgcccuggcugugaucuccacacccgaccagaccaagguuuucagugccagcuaugaucgcucucuuagagugugguccauggacaauaugauuugcacucagacacuguugaggcaccaagggucagucacggcacucgccgugagucguggacggcuguuuagcggugcuguagauucgaccgugaagguuuggacuuguuga

SEQ ID NO: 64162 - RNA, 1749 nt, Artificial Sequence
  derived and/or modified sequence opt3 from TRAFD1__Homo_sapiens__NP_006691
auggccgaguuccuggacgaucaggaaaccagacucugcgacaacuguaagaaagagauccccguguuuaauuucacaauucacgaaauacauugccaaaggaacaucggcauguguccuacuugcaaggagccauuuccgaaaagcgauauggaaacgcacauggcugcagagcauugucagguuaccugcaaguguaauaaaaagcuggagaagcggcuuuugaaaaagcacgaagagacagaaugccccuuacgccuggccgucugucagcauugcgaccuagagcucuccauucugaaacuuaaggagcacgaagauuacuguggggcgcgaacugagcugugcggaaacugcggucguaauguguugguaaaagaccucaagacccacccugaaguguguggcagagagggggaagagaagaggaacgaggucgcuaucccacccaaugccuaugaugaaucuuggggacaggacggcauuuggaucgcaucacaacugcugcggcagauagaggcccucgauccuccaaugcgcuuacccagaaggccucugcgggcuuucgaaagugacguguuucauaaccgcacaaccaaucagcgaaacaucacugcacagguuagcauucaaaauaaccuuuucgaggaacaggagagacaggagaggaaucggggucagcaaccaccgaaagaagggggagaggaauccgccaacuuggauuuuaugcuggcucuaucucuccagaaugagggccaggccucgucaguggcggaacaagacuucuggcgugcagucugcgaggccgaucagagccacggcgggccccgcagucuguccgacaucaagggagcugccgacgagauuaugcuuccuugugaauuuugcgaggaacuguacccagaggaguugcucaucgaucaucagacaucuuguaaccccagcagagcacugccuuccuuaaacaccgguucaaguagcccaaggggcguggaagaacccgacguaauauuccagaauuuucugcaacaggcugccucuaaccagcucgauucccuuauggggcugucaaauagccacccgguugaagagaguauuaucauuccuugcgaguucuguggagugcaguuggaggaggaaguccuauuucaccaucaagaccagugcgaucagcggcccgcgacggccacuaaccacgugaccgagggcaucccacgacuggacucucagccucaagaaacaucccccgagcucccacgcagaagggugcggcaucagggugaucugagcucgggguaucuugacgauacuaaacaggaaaccgcaaauggacccacaucuugucugccuccaucccgcccgaucaacaauaugaccgcuacguacaaccaguugucaagaaguacuagcggccccaggccuggcugccaaccauccucucccugugucccuaagcucagcaauucagacagucaggauauucaggggcguaaccgggacucccaaaauggagccauagcuccaggucacguuagcgugauccgacccccgcagaaccuguauccugagaauauuguaccaucuuucucacccggcccuagugggagauacggagccagcggcagguccgagggugggcgcaacucucgggugacacccgcagccgcuaauuauagaucgaggaccgcgaaagcaaagccaagcaaacagcagggcgccggagacgcugaagaggaagaggaagaguga

SEQ ID NO: 64163 - RNA, 2862 nt, Artificial Sequence
  derived and/or modified sequence opt3 from TRAK1__Homo_sapiens__NP_001036111
auggcccugguguuccaguuuggccaacccgucagagcucagccucucccagggcuuugccacggaaagcugaucaggaccaacgcaugugacguuugcaauagcacagauuugccggagguggaaauuauauccuuacuggaggaacagcuaccccauuacaaacuccgggccgacacuaucuaugguuacgaucacgacgauuggcugcauacgccucuuauuucuccagacgcgaacaucgaucugaccacagagcagauugaagagacuuugaaguauuuccuccugugugcugagcgcguaggccaaaugaccaaaacauacaaugacaucgaugccgugacccgacugcucgaagagaaggaacgugacuuagagcuggcagccagaauagggcagucacuuuugaaaaagaacaagacucugacagagaggaaugaacuacucgaggaacaggucgagcacauccgggaagaggugagucagcugcgccaugagcuuagcaugaaagaugaacuguugcaauuuuauaccuccgcugcagaggaaucugagcccgaaucgguuugcucaacgccucucaagagaaacgagagcaguuccucugugcagaauuacuuccaccuggacagcuuacagaaaaagcugaaagaucucgaggaagagaacgucgugcuuagguccgaagccucacagcugaagacugagaccauuacauaugaagagaaggagcaacaguugguaaaugacuguguuaaagaacuacgggacgcuaacgugcagaucgccaguauuagcgaggaacuggcgaagaaaacugaggaugcagcccgccaacaggaggaaaucacccaccuccugucucagauagucgaccuucagaagaaagcuaaggccugcgcaguggagaaugaagaacuggugcaacauuugggagcugccaaagaugcgcagcgacagcucacagccgaacugagagaguuagaggacaaguacgcagaauguauggagaugcugcacgaagcucaggaggaacuaaagaaccucaggaauaaaaccaugccaaacacgacuucccggcguuaccauucacugggccuuuuucccauggauagcuuggccgcugagauugaggguacaaugcgcaaggaacugcaacucgaggaagccgagaguccugacaucacccaccagaaaagagucuucgaaacuguuaggaauauuaaccaggugguaaagcagcggucucugacaccauccccgaugaacauccccgggagcaaucaaucgucugcaaugaacucccuucugucaaguugcgugagcaccccucgauccucuuuuuauggaagcgauaucggcaaugucguguuggacaacaaaacaaauucaauuauacucgagaccgaggccgcugaucugggcaacgacgaacgcaguaagaagccagggacacccggaacuccugguucccacgauuuagagaccgcgcugagaaggcuaagccuccggcgcgaaaauuaccugucugagagaagguucuuugaggaggagcaggaacguaaacuucaggaguuggcagaaaagggcgagcugcggucagggagucucacaccaacugagagcaucaugucccugggaacccauucucgauucucggaauuuacaggcuucagcgguauguccuuuucaaguagaucuuauuuacccgagaaacugcagauuguuaagccgcuugaagggagcgccaccuugcaccauuggcaacagcucgcucagccucaccugggaggcauccuagaccccaggccaggcguggucacuaaaggguuccgcacgcuggacguggaucucgacgagguauacugucugaacgauuucgaagaggacgauacaggagaccauauaucccuuccucgguuggccaccucaacucccguucaacacccagagaccagcgcacaccaucccgguaagugcaugucucagacaaauuccaccuuuacuuucacaacgugucgcauucugcacccuagugaugaauuaaccagggugacuccaagccucaacucugccccgacacccgcuugcggcuccaccucacaucugaagaguacaccugucgccacuccaugcacccccagacgacuuagccuggcagagucguuuacgaauacccgggaauccacaacuaccaugucuacgagcuuggggcucguguggcugcuaaaagagcguggaaucucagcggcugucuaugacccucagaguugggauagagccggcagggguucccugcuccacucuuacacuccaaagauggcagugauccccagcaccccgccuaacuccccaaugcagacgcccacaucaagcccucccaguuucgaauuuaaauguaccucuccaccuuaugacaauuuccuggccuccaagcccgcuagcucgauucuucgcgagguucgggagaaaaacgugagaucaucugaaagucaaacugauguauccgucagcaauuugaaccugguggacaagguuaggcgauuugggguggccaaggucgugaacucuggccgcgcacacguaccaacauuaaccgaggaacagggaccgcuccugugcggcccucccgggccagcucccgcccuugugccucggggacugguuccagagggucuaccccucagauguccuacugucaccagcgcgaucggcgggcugcaguugaacuccggaauuaggcguaaucgcucauucccgacaauggugggcaguagcaugcagaugaaagccccagugacgcugaccucugguauauuaaugggggcuaagcucuccaaacaaacuucacugcgguga

SEQ ID NO: 64164 - RNA, 2745 nt, Artificial Sequence
  derived and/or modified sequence opt3 from TRAK2__Homo_sapiens__NP_055864
augagccagucccaaaacgccaucuucaccucucccacaggcgaggaaaaucugaugaacucaaaucacagagacagugagagcauuacugaugugugcuccaacgaagaccucccugaggucgaacuuguuucucuguuggaggagcaguuaccacaguacaggcugaagguggauacgcuauuucucuaugaaaaucaggacuggacccaaucgccgcaucagcggcagcacgcuucagaugcacugagccccguacuugccgaggaaacauuccgcuacaugauacuggggacugaccgaguggagcagaugaccaaaacauauaacgauaucgacauggucacccauuugcucgcggagcgugauagagaccuggaacuggcugccaggauuggacaagcacucuuaaagcggaaucacgugcugagugagcagaacgaaucccuugaggaacaguugggucaggccuuugaucaaguuaaucagcugcagcaugagcuauguaaaaaggacgagcuccugcgcaucgugucuauugcuagcgaagaguccgaaacugauucaaguugcagcacaccucuuagauucaacgagucuuuuucccugucacaaggcuugcuccagcuggaaauguuacaggagaaacugaaggagcucgaagaggaaaauauggcacuuaggagcaaggccugucacaucaaaaccgagacggucacuuacgaagagaaggagcagcaacuggugagugacugcguaaaagaauugcgggagaccaacgcucagaugucucgcaugacagaagaacuauccggaaagagcgacgagcugauacgauaucaggaggagcucucgucucugcuuucccagaucguugaucugcaacacaaauugaaggaacaugugauugagaaggaggaacucaaacugcacuuacaggccucaaaggacgcgcagagacagcugacuauggagcuacaugaacuccaagauaggaauauggagugucuggggaugcuucacgaaagucaggaggaaaucaaagaguugcggagccguuccggcccaaccgcacaccuguacuucucucagagcuauggugccuuuacaggggagucacucgcugccgaaauugagggaaccaugcgcaagaaacugagucuugacgaagaguccagccuguucaagcagaaagcacaacagaagagagucuuugauacggugaggaucgcuaacgacacucggggccgaucuauaucauuccccgccuugcucccuauuccaggcaguaaucgcagcuccgugaucaugacagcgaagcccuuugaaucugggcugcagcaaaccgaggauaaaucguuacugaaccagggaagcuccucagaggaagucgccgguaguucucagaagaugggccagccugggccaagcggagacuccgaucuagcaacugcucuccauagacugucacuuaggcggcaaaacuacuugagcgagaaacaguucuuugccgaagaguggcagcgcaagauucagguucuggcugaccaaaaagagggcgugucugguugcguaacaccgaccgaaucccucgccagucuguguacgacccagagcgagaucacagauuuaucuuccgcaucaugccugagaggguucaugcccgaaaaacuucagaucgugaagccuuuggagggaagucagacucucuaccacuggcaacagcuggcccagccaaaucuaggcaccauucuggaccccaggccuggcgucauaacaaagggguucacucaacucccaggagacgcuaucuaucauauuagcgaucuggaagaggacgaggaagaggguaucaccuuucaggugcagcagccccuugaaguugaggaaaaguugucgacauccaaaccggugaccggcauauuccugccucccauuacuucugcagggggaccagucacgguggcgacagccaacccuggcaaguguuuaagcugcaccaauucaacuuuuaccuucacaaccugucguauccuccaccccagugauaucacucaaguaacaccauccucugguuuucccagccuguccugcgggucaagcggcaguucuuccagcaacacggcuguuaauucgccugcccuuucauaccggcugucuauuggagagaguaucaccaaccgaagagacuccacuacaaccuucagcucuacaaugagcuuggcaaaacuccugcaggagaggggcauuuccgccaagguguaucauucaccaauaagugaaaauccgcuacagccccugccuaagagccucgcuaucccaucuacucccccuaacuccccaucacacagucccugcccgagcccucugccauuugagccccgcguccaccuuuccgaaaauuucuuggccucucggccugcagagaccuuucugcaggaaauguacggguuaagacccucgaggaacccaccugaugugggacaacucaaaaugaaucuggucgaccgccuuaagcgacuggguauugcgcgggugguuaaaaaccccggcgcucaggagaaugggcguugucaggaggccgaaaucggaccacagaagccggauagcgcaguguaucuaaacucaggcuccagucuccuggguggguugagaaggaaucaaucucugccuguaaucaugggcagcuucgccgcucccgucugcacguccucaccaaaaaugggaguguuaaaggaggacuga

SEQ ID NO: 64165 - RNA, 1125 nt, Artificial Sequence
  derived and/or modified sequence opt3 from TRAM1__Homo_sapiens__NP_055109
auggccaucagaaagaaaagcaccaagucucccccugugcugucccacgaguucguccuccagaaccaugcugacauuguuucaugcguggcaaugguauuucuucugggcuugauguucgaaauaacagccaaagcgaguaucauuuuugugacuuuacaauacaaugucacgcugccagcuaccgaggaacaggccacagagagcgugucccuauauuacuaugggaucaaggaucucgcaacuguuuucuuuuacaugcugguggccauuaucauacacgcugucauccaggaauauaugcuugacaaaauuaacaggcggaugcauuucucuaagaccaagcacucgaaauuuaaugagucaggacagcugagcgcauucuacuuguuugccugugugugggguacauucauccucauuagugagaacuauaucuccgauccgaccauacuguggcgcgcuuacccccauaaucugaugacuuuucaaaugaaguucuuuuacauuucucagcucgccuauugguuacacgcguucccugaacuguacuuccagaaaacaaagaaagaggacaucccacgacagcuuguauauauuggcuuguaccuguuucacaucgcaggggccuaucuacucaaccugaaucaucuuggacugguuuugcucgugcugcacuacuucgucgaauuuuuauuccauaucagccgucuguuuuauuucuccaacgagaaguaccaaaagggcuuuucacucugggcugugcuuuucgugcuggguagauugcuaacccugauucucaguguccugacgguuggguuuggacuugccagggcagagaaucagaaacuggauuucagcacuggcaacuuuaauguguuggcuguacggauagccgugcucgcgucuaucugcgucacccaggccuucaugauguggaaguuuauuaacuuccagcugcgcagauggagggaacacuccgcauuccaagcucccgccgugaaaaagaaaccuacaguuacuaagggccggucaagcaaaaaggggaccgagaauggagugaacgguacauuaaccaguaaugucgcugacucuccacgcaacaagaaagaaaaguccagcuga

SEQ ID NO: 64166 - RNA, 1110 nt, Artificial Sequence
  derived and/or modified sequence opt3 from TRAM1L1__Homo_sapiens__NP_689615
augggccugagaaagaaaagcaccaagaaucccccugugcucucccaggaguucauccuucaaaaccacgccgacauugucucuugcguugggauguuuuuccuguugggauuaguguuugaagguacagcugaggcaucaauaguauuccugacucuacagcauaguguggccgucccagcggcugaggaacaggccacgggcagcaaaucccucuacuauuacggggugaaggaucuggcaaccguguuuuucuauaugcuuguugccaucauuauccacgcuacaauucaggaauacguccuggacaaaaucaacaagaggaugcaauuuacuaaggcaaaacagaauaaguucaacgagucuggacaguuuucgguguucuacuuuuucucauguauauggggcaccuuuaucuugauuagcgagaauugccucagugauccgacacugaucuggaaagcccggccccauuccaugaugaccuuccagaugaaguucuuuuauauuucucaacuggcuuauugguuccacgccuuuccugaacucuacuuccagaaaacuaagaagcaggacaucccacgccaguuaguauacauaggucugcaucuuuuucacauuacaggggcguauuugcuguaccuaaaccaccucggacugcuucuguugguucuccauuauuucguggagcuguuaagccacauguguggccuguuuuacuucuccgaugaaaaauaucaaaagggcaucucacucugggcaauugucuuuauccuugggcgacuggugaccuugaucgugaguguccuaacgguuggauuccaucuggccgguagccagaaucguaaccccgacgcucucacuggcaaugugaacguacuggccgcaaaaauugcugugcuuucuuccucaugcaccauacaggccuacgucacauggaaucugaucacuuuguggcuccaaagauggguggaggauagcaacauucaggcgaguuguaugaagaaaaagaggucucgguccagcaaaaagcgcaccgagaaugggguuggaguggaaacaucgaacagagucgacugcccuccaaagaggaaagagaagucuuccuga

SEQ ID NO: 64167 - RNA, 1113 nt, Artificial Sequence
  derived and/or modified sequence opt3 from TRAM2__Homo_sapiens__NP_036420
auggccuucagaaggcggaccaagagcuacccccuguuuucccaggaguucgugauccacaaccaugcugacauuggcuuuugccucguccuuuguguucugauaggguugauguucgaagugacagcaaaaacugccuuuuuauucauccugccucaauauaauauuucuguaccaacggcggauucagagaccgugcacuaccauuauggaccgaaggaccuagucacaauccucuuuuacauuuucaucacuauaauccugcacgcugugguucaggaauauauucuugauaaaaucaguaagcgccugcauuugagcaaagugaagcacuccaaguuuaacgagucuggucagcucgucguguuccacuuuaccucgguaauuuggugcuucuacguuguggucacagaaggcuaucugaccaauccccgaucacugugggaggacuacccucaugugcaccucccauuucaggugaaauucuucuacuuaugucaacuggccuauuggcuucaugcauugcccgagcuguacuuucagaagguccguaaagaagagaucccuagacagcuacaguauauaugccucuaccugguucacauugccggggcuuaucuucugaacuugagcaggcucggacugaucuuacugcuccuucaauacaguacugaguuccuguuucacacagcacgguuguucuauuuugccgaugaaaauaacgagaagcuauucuccgcuugggccgcgguguuuggcguaacccgccuguucauucucacgcuggcagugcuugccaucgguuuugggcuggcuagaauggaaaaucaggccuucgacccagagaaaggaaacuuuaauacuuuguucuguaggcucugcguccuguuacuggugugugcagcucaggccuggcuaauguggcgguuuauccauucucagcuccgccacuggcgagaauacuggaacgagcaaagcgcgaagagaaggguucccgccaccccucggcugccagcacgucuuauuaagcgcgaauccggcuaccaugagaauggcguggucaaagcugagaacgggacaucaccgagaacuaagaaauugaagagucccuga

SEQ ID NO: 64168 - RNA, 1956 nt, Artificial Sequence
  derived and/or modified sequence opt3 from TRAP1__Homo_sapiens__NP_001258978
auggccagagagcugagggcucuccuucuguggggccggcgcuugcgacccuuacugcgugccccugcacuagcggcugugccagggggaagcaccuccaagcacgaguuccaggccgaaacuaaaaagcuccuggacaucgucgcaagaucucuuuacucagaaaaagagguuuuuauuagggaacugauaaguaacgccagcgaugcuuuggagaagcuccggcauaaacugguguccgacggucaagcacugccggagauggaaauccaccuccagacaaaugccgagaagggcacgauuaccauccaggauacagggauuggaaugacucaggaagaguuaguaucuaaccugggcaccaucgcucgcucggguucaaaggccuuccuugacgcguugcaaaaucaggcagaggccagcaguaaaauaaucgggcaguuuggagugggcuucuauuccgcuuuuauggucgccgauagaguggaaguuuacucuaggagcgcagcucccggcucccugggguaucaguggcuaucagacggaagugguguguucgagauugccgaagcgagcggcguccggacagggaccaagaucauuauccaucucaaaucugauugcaaggaguuuuccucagaagcccgcgugcgagacguaguuacuaaauacagcaacuucgugaguuuuccucuguaucuuaauggaagaaggaugaacacacugcaagcaauauggaugauggauccaaaggacguccgggaguggcagcacgaggaguucuaccguuauguggcucaggcccaugauaagccccgcuacaccuugcacuacaaaacggacgcuccucucaauauuagaucuaucuuuuaugugccagauaugaagcccuccauguucgacgucagcagggaacugggcucgucuguugccuuauacucccggaaagugcugauucagacuaaggcaaccgacauccucccuaaauggcuucgauuuauccgcgguguaguggauucagaagacauuccacugaacuugaguagagagcuacugcaagaaagcgcccucauaaggaagcugcgggauguccuucagcagcgccugaucaaauucuucauugaccaauccaagaaggaugcugagaaauaugcgaaguuuuucgaggacuacggguuguuuaugagagaaggaaucgugacagcaacugagcaggaaguuaaagaggauauagccaagcuccugagguaugaaucuagcgcuuuaccgucaggccagcugaccagucuauccgaguacgccagccguaugcgggcaggcacacgaaauauuuauuaccucugugcccccaacagacaccuggcugagcauucuccuuacuaugaagccaugaaaaagaaggacaccgaggugcuuuucugcuuugaacaguucgaugaguugacgcugcuccaccugagggaguuugacaaaaagaaacuuaucucagucgaaacugauaucgugguagaccauuacaaggaggaaaaauucgaggaccgcaguccagcagcggaaugucugagcgagaaggagacagaagaguugauggcuuggaugcggaauguucucggguccagagugaccaacgucaaggugacucugagguuagauacacaccccgccauggucaccgugcuggaaaugggagcagcccgccacuuucuacgaaugcaacagcucgcuaaaacgcaggaggaacgggcccagcugcuucaaccuaccuuggagauuaauccacgucaugcacugaucaagaaacucaaccagcugagagcuucugagcccgguuuagcccagcugcuuguugaccagauuuaugaaaaugcgaugauagccgcuggcuugguggaugacccgagggcaaugguagggcgccucaacgagcugcuagucaaggcccuggaacggcacuga

SEQ ID NO: 64169 - RNA, 3780 nt, Artificial Sequence
  derived and/or modified sequence opt3 from TRAPPC10__Homo_sapiens__NP_003265
auggacgccagcgaggaaccccugccuccagugaucuacaccauggagaacaagccgauugucacaugcgcuggcgaucagaaucucuucacuuccguuuaucccacgcuuucucaacagcugccuagagaaccaauggaguggaggcggucauacgggcgcgcacccaaaaugauacacuuggaaaguaacuuugugcaguucaaggaggaguuacugccuaaagaaggaaauaaggcccuacucaccuuuccauuccugcauaucuauuggacagaguguugcgacacugaaguauacaaagcgaccgugaaggaugaccuuacaaaguggcagaacguccugaaagcucacagcuccguggauugguugauuguuaucguggagaaugacgccaagaaaaagaacaaaaccaauauucucccccgaacuucuaucgucgauaagauacguaacgacuuuuguaauaagcaaucggauagaugcgugguacugucagacccucugaaagauagcaguaggacacaggaguccuggaacgcauuccucaccaaguuacggacgcugcuuuugaugucuuuuacuaaaaaucuggguaaguucgaagacgauaugcgcacccuaagagagaaaaggacagaaccaggcuggagcuuuugugaguauuucaugguucaggaagaacucgccuuuguguucgagaugcugcagcaauuugaagacgcucuuguccaguacgacgagcuggaugcauuguucucccaguauguggugaacuucggggccggagacggcgcuaauuggcucaccuuuuucugccagccggucaagucauggaacggucugaucuuacggaaacccauugauauggaaaagcgcgagaguauccaacgaagagaagccacucugcucgaccuuaggagcuaccuguuuucucggcaguguacauugcuacuguuccuccagcguccuugggagguugcgcaacgcgcacuggagcuucugcauaauugcgugcaggaauugaagcuccuggagguauccgugccacccggggccuuagauuguugggucuuucugucaugccuagaagugcuccagagaauugagggauguugcgacagggcucagaucgauagcaacauagcccacaccguuggccuguggaguuacgcaacggaaaaacuuaagucuuugggcuaucugugcgggcucguguccgagaaaggaccuaacagcgaggaccugaaucggacugucgaucuucuggcugguuugggcgccgaacgaccagagacagcgaacaccgcccaaucgcccuacaagaaacucaaggaagcacugucuuccguggaggcuuucgagaagcauuauuuagaccugucacacgccacuauugaaauguacacaaguaucgggcgcauuagaagcgcuaaauuuguaggaaaggaucuagccgaguucuauaugaggaaaaaggcaccgcagaaagccgaaaucuaccuccagggcgcucugaagaauuaucuugcggaggguugggcauugccuaucacccacacgcggaagcagcuggccgaaugucaaaaacaucucgggcagauugagaacuaccugcagaccuccucuuuacuggcuagcgaccaccaucuuacagaggaggagcgcaagcacuuuugccaggaaauauuggacuucgccucacaacccagugauuccccaggacacaaaaucguucucccuaugcauagcuuugcacagcugagagaccuacacuucgaucccucuaaugccgugguccaugugggcggcguccuguguguggagauuacuauguacucacagaugccaguucccgugcacguagaacagaucgucgugaacguucauuuuaguauagagaagaauagcuauaggaaaaccgcugaguggcucacaaagcacaagacuuccaacgggauuaucaauuucccuccagaaaccgccccguuccccgugucucaaaacucgcugccugcacuugaguuguacgaaauguuugagcguagcccauccgacaauucacugaacacaaccggaaucauuugccggaauguccacauguuacuccgaagacaggaaaguucuagcucccuggagaugcccucagguguggcgcuugaggaaggcgcucauguacugagguguagccacgugacuuuggagccuggggccaaccagaucacguuccgcacacaagcaaaagaaccaggaaccuauacucuccggcagcugugcgccucuguuggcuccgucugguuugugcuaccccauauuuacccgauagugcaguaugaugucuacagucaggagccucaacugcacguugagccacucgcugacagccugcuugccgguaucccccagagagugaaguucaccgugacaaccgggcacuauacuauuaaaaauggcgauucuuugcagcuguccaacgcagaagcuauguuaauccucugucaggccgagucaagggcgguagucuacaguaacacacgcgaacaaagcucggaggccgcucugcgaauccaguccucugacaaggugacgagcauuucacuuccuguugcacccgccuaccaugugauagaauuugagcuggagguccuaagucucccauccgcuccugcccugggaggcgaaucugauauguuggggauggcagagccccaccggaaacauaaggacaaacagcguaccggaagaugcauggugacuacagaucacaagguuagcaucgacuguccaugguccauuuauucaaccgugaucgcgcugacauucagcguaccguuuaggacuacccauaguuuacucucuuccgguacgcgcaaguacguccaggugugcgugcaaaaucugagcgaacuugauuuccagcugucggacucauauuuggucgacaccggcgauucuacagaccuccagcugguuccucuaaacacucaaagucagcagcccauuuacuccaaacagagcguguuuuucguaugggagcugaaguggaccgaggaaccacccccuucucuucacugucgguuuagcgugggguucuccccagccucagaggaacaacucaguaucagccugaaacccuauacauacgaguuuaaggucgaaaauuucuucacuuuguauaacgugaaagcugagauauuuccuccgucuggaauggaauacugcagaaccggcucccugugcucauuagagguucucaucacgaggcugagugaucuucuggagguggacaaggaugaagccuugacagagagcgacgaacacuucuccaccaagcucauguacgaggucguggauaauucuucgaacugggcaguuugugguaaaagcugcggggugauuucaaugccagucgcugcccgagcaacucaucgcguacacauggaggugaugccccuguuugccggcuaucuaccucugccagacguucggcuuuucaaguaccucccccaucacuccgcucauaguucucagcuggaugcggacagcuggaucgaaaaugauuccuugucaguggacaaacacggagaugaccagccugacucuagcaguuuaaaguccagaggcagcguccacucugccuguucauccgagcauaaagggcugccgaugcccaggcuccaggcacugccagcuggacaaguguuuaacaguagcucggguacacagguacuugugauuccuucucaggaugaccacguccuggaaguuuccgugaccuga

SEQ ID NO: 64170 - RNA, 3402 nt, Artificial Sequence
  derived and/or modified sequence opt3 from TRAPPC11__Homo_sapiens__NP_068761
augagccccacccagugggacuucccuguggagcugugcuguagaccaauggccuuugucacacucacuggccuugauguuguguacaacgcuguacacagggcagugugggacgccuucugcgcgaaucggcgcgcugaucgagucccgaucuccuuuaaggugcugcccggggaccaugaauauccuaaaugucguccaaagagaacgucuuacgagugguauauucccaaaggaauauugaagaccgguuggaugaacaaacacuuaaaucugguuccugcccuaguggucguguucuacgaacucgauugggacgagccacaauggaaggaaaagcagucagagugcgcaacaaggguagagaucguucggcagagucugcagggccgcaacacuaaaguggccgucgugcuuauucaaaagaaaacaccccugccuccaggggaagaugugaucgcuagcgagagagcagccgcuuuguguaaugccugcgaacucuccggaaagucucuguuuguccugccgcauaccgaccaccucguuggcuauauuaucagguuagagaacgcguucuacgagcaugcacagaccuauuacuacacugaaauacggcgcgugaaaucgcacaaggaguuucugaauaagacaacccaccagcuuuuguucguacgacaucaguuuaaaaucgccuucuuuucagaacugaagcaagauacgcagaacgcucugaaaaauuauagaacugccuacaaccucgugcacgagcugagggcacaugaaaccaauauucuugagaucaagacaauggcugguuucauuaacuauaaaaucugucggcugugcuuucagcacaauacucccuuggacgccauagcgcaguuccguaagcacauugaucucuguaaaaagaagaucgggagcgccgagcugaguuucgaacaugacgcauggauguccaaacaauuucaggcuuucggagauuuauuugacgaggccauuaagcugggccucaccgcuauccagacacaaaacccuggcuucuacuaucagcaggccgcauacuaugcccaggaacgcaaacaacuugcuaagacccugugcaaucacgaggcgucugucauguacccaaaccccgacccuuuggaaacgcagacuggggugcuagauuuuuacggacagagaagcuggaggcaggguauccuguccuucgaccucucagauccagagaaagagaagguuggcauucuggcaauacaacuuaaggaacggaacgugguccauagugagaucauuaucacacuguugagcaaugccguggcucaguuuaaaaaguauaaauguccccgaaugaagucucaccucaugguacagaugggggaagaguacuauuacgccaaagacuauaccaaggcacugaaguuacuggauuacguuaugugcgacuaucgcuccgaaggaugguggacucuacucacaucagugcugaccacggcccuuaaaugcagcuacuugauggcucagcugaaggauuacauaaccuauagucucgagcugcuuggcagagccucuacacugaaagacgaucaaaaguccaggauugagaaaaacuugaucaauguccucaugaacgaaagcccggacccugagcccgauugugacauccuggcagugaagacugcgcagaaguuaugggcugaccggauuucgcuggccgguucuaauaucuucaccauugggguccaggauuuugugccauucguucagugcaaagcaaaguuucaugccccuuccuuccacguggacguacccguccaauuugauauauaccuaaaagcugacuguccacaccccauccgcuucucaaagcucugcgugaguuucaacaaucaggaauauaaccaguuuuguguuauugaggaggccagcaaagcaaaugaagugcuggagaaccuuacacaaggaaagaugugcuuggucccuggcaaaacuagaaagcuacucuucaaguuuguggcuaaaaccgaagauguaggcaagaaaaucgagaucacauccguggaccuggccuuagggaaugaaaccggaagguguguuguccugaacuggcaggguggcgggggagaugcggccucuagccaggaggcacuucaggcugcccguucauucaagcggcgaccaaaauugccggacaaugaggugcauugggauaguauuauaauccaggcuuccacuaugauuaucagcagagugcccaacauuucuguccaccuccugcaugaaccuccagcccuaacgaaugagauguacugccugguugugacagugcaaucacacgaaaagacccagaucagggacguaaagcucacugcaggccugaaacccggucaggaugcgaaccuuacccaaaagacacacgucaccuugcaugggacugagcugugugacgaaaguuauccugccuuacucacagauauaccagugggcgaccugcaccccggagagcagcuugagaaaaugcuguacguucgcugcggcacgguggggagccggauguuuuuggucuauguguccuaccucaucaacaccacuguugaagagaaggaaauuguguguaaaugccauaaggacgagacaguaaccaucgaaacagucuucccguuugauguggcugugaaguucgucucuacuaaauuugagcaccuggagagaguuuacgccgacauuccuuuccuacugaugaccgaucuccugucggcaagcccaugggcucuuacgaucguguccucagaauugcagcuggcccccaguaugaccacaguagaccaguuagagucucaaguggauaaugucauacuccagacuggagaaagcgcauccgagugcuuuugucugcagugcccuucacuugguaacauugagggcgggguggccaccggacauuauaucauuagcuggaagaggacaucugcuauggaaaauauccccauaaucacuaccguuauuacgcugccacacgugaucgucgagaacauuccucuacacgugaaugcggaccuccccuccuucggccgcguucgagaaagucugccagugaaauaccauuugcaaaacaagacagaucugguccaggacguagagaucagcguggaaccgucugaugccuuuauguucuccgguuuaaaacagauacggcuccguauucugccugggaccgagcaggagaugcuuuauaauuucuacccccugauggcaggcuaucaacaguugccaucacucaacaucaaucugcuaagauuucccaacuucacuaaucagcugcuuaggcgcuuuaucccuacaaguauuuucguuaagccacagggacggcucauggacgauaccagcaucgcugccgccuga

SEQ ID NO: 64171 - RNA, 438 nt, Artificial Sequence
  derived and/or modified sequence opt3 from TRAPPC1__Homo_sapiens__NP_067033
augaccgugcacaaccuguaccucuucgacagaaauggcgucugccuucauuauagcgaguggcacaggaagaaacaggccgggauccccaaggaagaggaauacaaacugauguauggaauguuguuuuccauucggucuuucguuucaaagaugaguccuuuagauaugaaagacgguuuucuggcuuuccaaacaagccgcuacaagcuacauuauuacgagacuccaacgggcauaaaggugguaaugaacaccgaucucggggugggaccgauccgagacguccugcaccauauuuauuccgcacuuuacguggaacugguugugaaaaaucccuuguguccucucggccagacaguccagucugagcuguuucguucgagacuggauucauacgugaggagccucccauucuuuagugcccgggcggguuga

SEQ ID NO: 64172 - RNA, 525 nt, Artificial Sequence
  derived and/or modified sequence opt3 from TRAPPC2__Homo_sapiens__NP_001122307
augagcuccuggaagcaggacagaucuggccugaggucaaccgagcucaacgugcuugaauaccaaccccugugcgccguccggagucacaucuugaaaacaaugagcggguccuucuauuuuguuauugugggacaucacgauaauccuguauucgagauggaauuuuuaccagcugguaaggcagagucuaaagacgaucaucgccaccugaaccaguucauagcccaugcggcucuagaccucguggaugaaaauauguggcugucgaacaauauguaccuuaagacugucgacaaauuuaacgagugguucgugucagccuuuguuacggcaggccacaugcgauucaucaugcugcacgauauucgucaggaggacgggaucaagaacuuuuucaccgauguguaugacuuguacauuaaguuuagcaugaauccguucuaugaacccaauaguccuaucagauccucugccuuugauaggaaaguccaguuccucggaaagaaacaucugcugagcuga

SEQ ID NO: 64173 - RNA, 660 nt, Artificial Sequence
  derived and/or modified sequence opt3 from TRAPPC4__Homo_sapiens__NP_057230
auggccaucuucagcguguacgucguuaacaaggcuggcgggcugauuuaucagcucgacuccuacgcacccagagccgaggcggagaaaaccuuuucuuauccucuugaucuguuguuaaagcugcacgacgaaagggugcuaguagcuuucggacaacgggaugguauacgcgugggccaugccguccucgcaaucaaugggauggacgugaacggacgauacacagccgauggcaaagaaguucuggaguaucuugguaauccagcuaacuacccggugucaauucguuuugggagacccaggcugacgaguaaugaaaaguugaugcucgcaagcauguuccacucccuguuugccaucggaucucagcugucgccugagcagggcucaagcggcauugagaugcucgaaacugacaccuucaaauuacauugcuaucagacacugacugggaucaaguuugucgugcuugcugauccacggcaagccggaauagacaguuugcugcgcaagaucuacgagauuuacuccgauuucgcgcucaaaaaccccuuuuauucucuagaaaugccuaucagaugugagcuguucgaccagaaucuuaagcuggcauuggagguagccgaaaaagcugguaccuuuggcccagggagcuga

SEQ ID NO: 64174 - RNA, 3447 nt, Artificial Sequence
  derived and/or modified sequence opt3 from TRAPPC9__Homo_sapiens__NP_001153844
augagcgugcccgacuacaugcaaugcgccgaggaucaccaaacccugcucgucguugugcagccuguaggcaucguguccgaagagaacuucuuuagaauuuauaagaggauauguucugucucacagaucagugugcgggacagccagcgcguucuuuacauucgauaucgucaucacuacccaccggaaaauaacgaguggggagauuuccaaacacauagaaaaguggucgggcugaucacuauuacggacugcuuuuccgcuaaggauuggccccagaccuucgaaaaauuucacgugcagaaggagaucuaugguucuacauuguacgacucgagguuauucguauuuggccugcagggggagauaguugaacaaccucggacugauguggcauucuauccaaauuacgaggacugucagaccgucgaaaaacgcaucgaggauuuuauugagucacuauucaucgugcucgaaagcaagagacuggacagggccacagauaagaguggagacaaaauuccccuucugugcgugccuuuugagaagaaagauuucgucggcuuggacaccgacucccggcauuacaagaaacgcugucagggucgaaugagaaagcacguuggggaucucugccugcaggcgggaaugcugcaagacucucucgugcacuaucauaugagcguagaauuacugagguccgugaacgauuuucuuugguugggcgcugcccuggagggccuauguucagcaagugucaucuaccacuauccagggggaacugguggcaagagcggggcccggcguuuccagggaucuacacuccccgcugaagcagccaaucgccauagaccuggcgcucaggaggugcugauagacccaggugcccuuaccacgaacgggauuaauccggauacuuccaccgagaucggaagggcgaaaaacugccugucacccgaagacauuaucgauaaguacaaagaggcaaucagcuauuacaguaaguauaaaaaugccggcguuauugaauuggaggcuuguauaaaggccgugcggguccucgcaauccaaaaacgaucuauggaagccuccgaguuccugcagaacgcuguguacauuaauuuacgccagcugagcgaggaagagaagauccagagauacucgauacucucugaacuuuaugagcugauuggcuuucacaggaaguccgcguucuuuaaacggguagccgcaaugcaaugcguugcuccuucaaucgccgaaccaggguggcgcgcuuguuacaaguugcuacuggagacacuccccggauauagucugagccuugacccuaaagauuucuccagagguacucacaggggcugggccgcagugcagaugcgucuguugcaugagcucgucuacgccucucggcgaauggggaacccagcucugagcgugagacacuuaucauuucugcuacagaccaugcucgacuuccugagugaucaggaaaagaaagacgucgcgcaaucccuugagaauuauacaagcaagugccccggaaccauggaaccgaucgcauugccuggcggucugacgcugcccccagugccuuuuacuaagcuccccauuguuaggcaugugaaacuucugaacuugccagccucucuccgcccccacaagaugaaaucacuguuagggcagaauguaaguacaaagagcccuuucaucuacuccccaauuauagcucauaaccggggcgaggagagaaacaaaaagaucgacuuucaguggguccagggagaugugugcgaaguucaacugaugguguauaauccgaugcccuucgagcuaagggucgaaaacaugggccuccugaccucugggguggaguuugaaucgcuuccugccgcauugagccugccagccgaguccggacucuaccccguaacucugguggguguuccucagacaaccggcacgauuaccgucaauggguaccacacaacuguguucggaguguuuucagacuguuuacuggauaaccuuccaggcaucaagaccagugguucuacagucgagguuauccccgcuuugccgcgccuccagauuagcacuucccugccucgaucagcccacagccuacagccaucuuccggggacgaaauaaguaccaaugugagcgugcaacuguauaacggcgagucucagcagcucaucauuaaacuggaaaauaucggaauggagccccuugaaaaguuggagguaacauccaaaguccugaccacuaaggagaaauuauacggcgauuuccucucauggaagcuggaagagacgcuugcacaauucccucugcagcccgggaagguggcgacauuuaccauuaacaucaaaguuaaguuggacuucaguugccaggaaaaucuccugcaggaucuaagcgacgauggaauaucgguguccgguuuuccacugucuagcccuuuccggcaagucgugcgucccagaguugagggcaaaccagugaacccgccugaaucaaauaaggcuggggacuauagucauguaaaaacucucgaggccguccugaacuuuaaguacuccggaggccccggucacaccgagggguauuacaggaaucuuucuuugggccugcauguggaaguggagccaagcgucuucuuuacacgcguuuccaccuuacccgcaacuucaacacggcagugucaccuccugcuugauguguucaacagcacggaacacgagcugaccguaaguacuagaucuuccgaggcccuaauccuccaugcuggagaaugccagaggauggccauucagguggacaaauuuaauuucgagagcuuuccugaaucgccaggcgagaaggggcaauucgcaaaccccaagcagcuggaagaggagcgacgcgaagcucggggauuggagauccacucaaaacugggcauuuguuggagaaucccuucuuuaaagaggaguggugaagccuccgucgaggggcuccugaaccagcuugugcuggaacauuugcagcucgcgccgcugcaaugggauguucuaguggacggacagccaugcgaccgugaggccgucgcugcaugucaggugggcgaucccguucgccuggaggugcggcuuacaaauagaagcccuaggucugucgguccauuugcccucaccguagugcccuuccaagaccaccagaacggcguucauaauuaugaucugcacgacacagugagcuucgucggguccucaacuuuuuacuuggaugcugugcagccuaguggacagagcgccugccugggcgcauuacucuuccuguacaccggggacuuuuuccuucacauacgauuucaugaagauucuacguccaaagagcugccgcccucaugguucuguuugccaaguguacacgugugcgcgcucgaagcccaggcuuga

SEQ ID NO: 64175 - RNA, 561 nt, Artificial Sequence
  derived and/or modified sequence opt3 from TRAT1__Homo_sapiens__NP_057472
augagcggcaucuccgggugccccuucuuucuguggggacuccuugcccuguuggguuuagcucuggugauuucucuaauauucaacaucucacacuacgucgagaagcagagacaagacaaaauguauaguuacagcuccgaucauaccaggguugacgaauauuacauugaggauacaccuaucuauggcaaucucgacgauaugauuucugaaccaauggacgagaacuguuacgaacagaugaaggcacggccggagaaaucggugaauaagaugcaggaggccacucccucagcgcaggcuacgaacgaaacccaaaugugcuaugccagccuggaucacaguguaaaagggaagcgccgaaagccucguaaacagaauacacauuuuuccgacaaggauggagacgagcagcuucacgcaaucgaugccucugugagcaaaacuacccuggucgacuccuucucaccagaaagucaggcuguggaggagaacauacaugaugaccccaucagauuguuuggccucauuagggcaaagcgggaaccuaucaauuga

SEQ ID NO: 64176 - RNA, 1176 nt, Artificial Sequence
  derived and/or modified sequence opt3 from TRDMT1__Homo_sapiens__NP_004403
auggagccccugagagugcucgaacuuuacagcggcgucgggggaaugcaccaugcccugagggaguccugcaucccugcucagguuguggcagccauugacguaaacaccguggcgaaugaagucuauaaguacaacuucccacacacacaauuguuagcuaaaacuauagaggguaucacgcuggaagaguuugaucggcuaucuuucgacaugauucucaugucaccgcccugucagccuuuuacccgcaucggccgacagggggauaugacagacagucguacuaauagcuuccugcauauucuugauauccugccaagauugcagaagcuccccaaauauauacugcuggagaacgugaagggauuugaaguuuccucuaccagggaccucuuaauccaaacaauugagaauugcggcuuccaguaccaggaauuucugcuuucgccuaccucauuggguaucccaaacagccggcugcgcuauuuccuaauugccaaacuccagagugagccccugccuuuucaagcaccaggacaggugcuuauggaguucccgaagaucgaauccguccacccccagaaguacgccauggauguggagaauaaaauacaggaaaagaacguagagccuaauauuucuuuugacgggagcauccaauguuccggcaaagaugcuauucuguucaaguuggaaacugcagaggagauccauagaaagaaccagcaggacucagaucucaguguuaagaugcugaaggacuuuuuagaagaugacacagacgugaaucaauaucugcucccacccaaaagccuucugagguacgccuugcuacuggauaucguccagccuaccugccggcgcucuguguguuucacgaagggcuacggguccuauauugagggaacugguucagugcuccagaccgcugaagacguccagguugagaacauauacaaaagccugacaaaucuuagucaagaagaacagaucacuaagcuguugauucucaaacugcgauauuucaccccaaaggagaucgccaacuuacugggcuuucccccggaguucggguuuccugagaaaauaacagugaagcagagauacaggcuacucggaaauucucugaacguacacguggucgcgaaacuuauuaaaaucuuguaugaauga

SEQ ID NO: 64177 - RNA, 1386 nt, Artificial Sequence
  derived and/or modified sequence opt3 from TRDN__Homo_sapiens__NP_001238916
augaccgagaucacagccgaaggaaacgcuagcacuacgaccacagugauugacuccaagaaugggucuguccccaaaucaccuggaaagguucugaaaagaacugugaccgaggauauaguaacaaccuucaguagcccagcagccuggcuccuugugaucgcgcugauuaucacuugguccgcugucgccauugugauguuugacuugguugauuacaagaacuucucugcaucgucaaucgccaaaauagguagcgacccguuaaagcuggugagggaugcuauggaagagacaaccgacuggaucuauggcuuuuucagucuacucuccgauauuaucucuagcgaagacgaggaggaugacgauggggacgaagauacggacaagggagagauugacgaacccccucugcggaaaaaggagauccacaaagauaagacugagaaacaggaaaagccagagcgcaagauacaaaccaaagucacacauaaggaaaaagagaagggcaaagaaaaggugcgagagaaagagaagcccgaaaagaaagcaacucacaaggagaaaauugaaaagaaagagaagccugaaaccaagacacuugccaaagagcagaagaaagcuaagaccgccgagaaauccgaagagaagacgaagaaagaaguaaagggugggaaacaggagaagguuaaacagacugcggcaaaggugaaggaaguccaaaagacaccaucaaagcccaaagagaaggaggacaaagaaaaggccgcugugaguaaacaugagcagaaggaucaguacgccuuuugccguuauaugaucgacauuuucgugcacggagaucugaagccuggccagagcccagcaaucccgcccccuuugccaaccgaacaggcuucuagacccacuccugccuccccagcgcucgaggagaaagaaggcgagaagaaaaaggccgagaaaaaggucacaucagaaaccaagaaaaaggcagaaaaagaggacaucaagaaaaagagcgagaaggaaacggcuauugauguugagaaaaaggaacccgggaaagccagugagaccaagcaaggaacagugaaaauagcugcccaggcagccgcuaagaaggacgagaaaaaggaagauucuaaaaagacuaaaaagccggcggagguagaacagccuaaagguaagaagcaagagaaaaaggaaaaacauguggagcccgcaaaguccccuaaaaaggaacacagcgucccaucggacaaacaggugaaagccaagaccgagagggcuaaagaggaaaucggcgccguuucuauuaagaaagcagugcccgggaagaaggaggagaaaacaacuaagaccgucgaacagggcaaaaagaaauga

SEQ ID NO: 64178 - RNA, 1659 nt, Artificial Sequence
  derived and/or modified sequence opt3 from TREH__Homo_sapiens__NP_001287994
augcccggcagaaccugggagcugugccuccuucuguuguuagggcugggacuagguagccaggaagcccucccuccaccgugugaguccgaaaucuacugccacggcgagcugcuuaaccaagugcagauggcuaagcuguaucaggacgauaaacaguucgucgacaugcccuugucuauugcaccugaacaaguucuccagacauuuacugagcugucaagggaucauaaucacaguauaccacgggagcagcugcaggccuucgugcaugaacacuuucaagcgaaggggcaggagcuccagcccuggacgccugcugacuggaaagauagcccacaguucuuacaaaagaucuccgacgccaaacugcgcgcaugggccggacagcuucaucaguuguggaagaagcugggcaaaaagaugaaacccgaaguacuaucucacccugagcgauuuucgcucauuuacucagagcacccauucaucgugccgggugggcguuuugucgaguucuauuacuguuauggacaugugcccaacggcggcagaguuuacuaucugcaaaggagccagccuccacuucugaccuugaugauggauugcuaccucacacacacuaaugacaccgcuuuucugcaggaaaacauugaaacauuagcacuggagcucgauuucuggaccaagaaucggacugugagugucucccuugaagggaaaaacuaccuguugaaucgcuauuacgugcccuauggagguccuagaccagagucuuacagcaaggacguagagcuagccgauacacugcccgaaggcgacagggaggcucucugggccgaacugaaggcgggggcagaguccggaugggauuuuucaagucgguggcuuaucggcgguccgaacccuaauagccugucugggauacgcaccuccaaauugguucccguggaccucaacgccuuccugugucaggcugaagaguuaaugucaaauuuuuauagccgacugggaaacgacagucaagccacgaaguacagaauccuaaggucucagcggcucgcagcucugaauacuguccuuugggaugagcagaccggcgccugguucgacuaugauuuggagaaaaagaaaaagaaccgugaguucuacccauccaaucugacaccucucugggcgggcugcuuuagcgaccccgggguggccgauaaagcacugaaguaccuugaagacaaccgcauucugacuuaucaguacggaaucccaaccucguugcaaaagacaggucagcagugggauuuccccaacgcuugggccccucuccaggaccuggugauuagaggcuuagcuaaagccccacugaggcgggcacaagaagucgccuuucagcuagcucagaauuggauccgaaccaacuucgauguuuauucucagaaguccgcgauguacgaaaaauaugacgugucaaaugggggacaaccgggcggugggggcgaguacgagguacaggaaggauuuggcuggacgaacggggugguccucaugcugcuugaucgcuauggagacagauugacaaguggugcaaagcuggccuuccucgagccccauugucuggcugccacuuuacugccuagccuuuugcucucccugcuaccaugguga

SEQ ID NO: 64179 - RNA, 678 nt, Artificial Sequence
  derived and/or modified sequence opt3 from TREM1__Homo_sapiens__NP_001229518
augagaaagaccaggcuguggggccuccuuuggaugcuguucgugagcgaguugcgggccgcuacaaaauuaacugaagagaaguacgaacugaaagaggggcagacgcuagacgucaagugcgauuauacccucgaaaaauuugcauccucucaaaaggccuggcagaucauucgcgacggagagaugcccaagacacuggcguguacugagcgaccuaguaaaaacucacacccaguucaggugggucguauaauccuugaagauuaccaugaccacggccuguugagaguaaggauggugaaucuccaggucgaggauagcgggcuguaucaaugcgugauuuaccagccgcccaaggaaccucauaugcuguucgaccggauccgccucguugugaccaaaggauuuuccggcacaccagguucuaacgaaaauucgacccagaacgucuauaagauucccccuacuacaaccaaggcuuuauguccacuguacacgucacccagaacugugacccaggccccuccaaaaagcacagcagauguaaguacuccggacuccgagaucaaucuuaccaacguuacagauauaaucagguauucuuuccaagugcccgggccuuuggucuggacccugagcccacuauuucccucccucugcgccgagcggauguga

SEQ ID NO: 64180 - RNA, 660 nt, Artificial Sequence
  derived and/or modified sequence opt3 from TREM2__Homo_sapiens__NP_001258750
auggagccccugagacuccuuauccuguuguucgugaccgaauuaagcggcgcccacaacacaacugucuuucaggggguugcuggacaaucccuacaggugucuugcccuuacgacucaaugaagcauugggguaggcggaaagcauggugucgccagcugggcgagaaggggccaugccagcgaguagugaguacgcacaaucucuggcugcuuagcuuccugcguagauggaacggauccaccgccauuacagaugacacuuugggcgguacccucacaauaacccugaggaaucugcaaccgcaugaugcggggcucuaucagugucagucuuuacacggaucggaagcugacacucugcggaaaguccuuguggagguuuuggccgauccccuggaccaucgcgaugcaggcgaccuaugguuuccuggcgaaucagagagcuucgaggaugcccacguggaacacaguaucuccagagcugagaggcaugucaaggaagacgaugggcggaaaucuccaggagaggugcccccugguacaagcccagcaugcauucucgccaccuggcccccuggccugcuuguacuguuguggcaggagacgacucucccagaacacuguuuuuccuggacccuggaggcugggacaggauga

SEQ ID NO: 64181 - RNA, 600 nt, Artificial Sequence
  derived and/or modified sequence opt3 from TREML1__Homo_sapiens__NP_001258736
augggccugacccuccuucuguuguuacugcuagggcucgagggacaggguaucgugggcagccugcccgaaguccuucaagccccuguuggguccucuauucuggugcagugccacuacagauugcaggacguaaaggcucagaaagugugguguagguuccucccagagggaugccaaccgcuggucucaagugcaguggaucggcgcgcccccgcgggccgacguacauuucugacugaccucggugggggauuacugcagguugaaauggugacgcuucaggaggaagaugcuggcgaguauggcuguauggucgacggggccagaggaccucagauauugcauagggugagccugaacauccuaccacccgaggaagaggaagagacccacaagauugguucccucgcagagaaugccuucucugauccugcuggcucggcaaacccacuggaacccucacaagacgagaaaagcaucccucuuauuuggggagccguacuguugguugggcuccugguggcugccgucguguuauuugcggugauggcaaagcggaaacaggaaagucugcucuccggcccaccgcgccaguga

SEQ ID NO: 64182 - RNA, 966 nt, Artificial Sequence
  derived and/or modified sequence opt3 from TREML2__Homo_sapiens__NP_079083
auggcccccgcuuuccugcuccuucuguuguuauggccucagggcugcgugagcgggccauccgcagacucugucuacaccaagguuagacugcuagagggagaaacacucucagugcaauguaguuauaaagguuacaagaacaggguagagggcaaaguguggugcaagauccggaaaaagaagugugaaccgggguuugcccgcgucugggugaaaggaccccgauaucugcuucaggaugacgcgcaggcuaagguugugaauauuacuauggucgcccugaaauugcaggauagcggccguuacuggugcaugagaaacacguccgguauacucuauccucugaugggguuccaacuggacgugucuccagcaccccagaccgagaggaauaucccuuuuacacaccucgauaacauuuuaaagucgggaacuguaaccacaggccaggccccaaccucaggccccgacgcuccuuucacuacagggguuaugguguuuaccccaggacugaucacgcuuccgcgguugcuggcaagcacucgccccgccaguaaaaccgguuacuccuucacagcuacuucuaccacaagccagggcccuagaaggaccauggggucccaaacggucacugccucaccaaguaaugcgcgggauagcucugcaggacccgaauccauuucaacaaagagcggcgaccuaaguacccgcucuccuacuacaggucucugucugaccucccgaagccuucugaacagauugccaucgaugcccucuaucaggcaucaggauguguauuccacggugcucggggucguucugaccuuacuggugcucaugcuuauaaugguauacggauuuuggaagaaacggcacauggccucauacaguaugugcagcgacccguccacacgugauccucccggccgcccagagccuuauguggaggucuaccugaucuga

SEQ ID NO: 64183 - RNA, 3603 nt, Artificial Sequence
  derived and/or modified sequence opt3 from TRERF1__Homo_sapiens__XP_006715208
augggcgaccagcaacuguacaagaccaaccacguggcccaugggagcgagaaucucuucuaucagcagcccccucuuggaguccacuccggucugaaccauaauuacggcaacgcuguuacagggggaggcauggaugcaccacaggccucuccgaucucaccccacuuuccucaagacacuagagaugguuugggguuaccagugggaaguaaaaaucugggccagauggacacgagcaggcagggcggguggggaucccaugcgggucccggcaaccacguacagcuacgggggaaucucgcuaacucuaauaugauguggggagccccugcacaagccgaaccaaccgauggcuaucaguacacauauucgcaggcuucagagauucgcacucagaagcugaccagcggugugcuucacaaacuggacaguuucacacaagucuuugcaaaccagaauuugcgaauacaggugaacaauauggcccaaguucuccauacccaguccgcugugauggauggggcccccgacucugcgcugcgucagcugcucagccagaagccuauggaaccaccggcacccgccaucccuuccagauaccaacaggucccacagcagccccacccuggauucacuggcggcuuaucaaaaccagcucugcaaguggggcagcaucccacacagggacaccuuuauuacgauuaccagcaaccguuggcccagguaccuguucaggguggccagccccugcaagcaccacagaugcuaagucagcacaugcaacagaugcagcagcaucaauauuacccuccccagcagcagcaacaggcugggcagcagaggauuagcaugcaagagauccagacccagccacaacagauucggcccucucagccucagccaccgccccaacagcagcagccucaacagcuccagcugcagcaacgccagggauccaugcagaucccacaguauuaccaaccccagccuaugaugcagcaccuucaagaacagcagcagcaacagaugcaucugcagccacccucauaucacagagacccgcaucaguacacgccugagcaagcccacacugugcaguugauaccacucggcagcaugagucaguauuacuaccaggagccccaacagccuuauucucacccccuguaccagcaaucccauuuaagccagcaccagcagagggaagauucgcaacugaagaccuauucuuccgaccggcaggcgcaggccaugcucucaagucauggugaucuugggccaccugacacaggcaugggagaccccgcaagcuccgaucugacucgcgucucuagcaccuugccacaccgaccgcuacugucaccuaguggcauccaccucaacaauauggggccccagcaucaacagcuguccccaagcgcuauguggccccagaugcaccuuccugacgguagagcccagccaggaucucccgagucaaguggccaaccuaagggggcuuuuggagaacaguucgaugccaaaaacaagcugacaugcagcauuuguuugaaagaguuuaagaaccucccggcacugaauggccauaugaggucccacggugggaugcgggccucuccaaacuuaaaacaggaggaaggcgagaaggugcugcccccucagccacaacccccucuaccgcccccaccucccccaccucccccaccgcagcucccucccgaagcugagucgcugaccccaauggugaugcccgucagcguuccugugaaacuuuugccacccaagccuuccucacagggauucacgaauaguacuguagcggcaccgucugcccgugacaagccagcuagcuccaugucagaugacgaaaugcccgugcuggagaucccucgcaaacaucaacccagcgucccaaaggccgaggaaccucucaaaacagugcaggagaagaaaaaguuuagacacaggcccgaaccacuguucauuccuccgcccccaucuuacaacccuaaucccgcagccuccuauaguggcgcuacccuuuaccagagccagcugcggucuccacgaguuuugggggaucaccuccuguuagacccuacucaugagcugcccccguauacaccaccucccaugcuauccccagugcgccaaggaucaggucucuuuaguaacguccugaucagcggccacgggcccggagcccauccucagcuuccguugacgccccugaccccaaccccuagagugcuccugugcagguccaauucgauagauggcucuaacguaacaguuacucccgguccuggggaacagaccguggacgucgagccacggauuaauaucggcuuacgcuuccaggcagagauucccgaacugcaagauaucagcgcgcuugcucaggacacacacaaggccacuuugguguggaaaccuuggccagagcucgaaaaccaugaccugcagcagagagucgagaaucuacugaaccucuguugcucaagugcacugcccggaggcgggaccaauuccgaauuugcccuucacucuuuguucgaggcuaagggagaugugaugguugcccuggagauguuacuccugaggaaaccggugcgucuuaagugucacccucuggcaaacuaccauuacgcuggcagcgacaaauggacauccuuggaacggaaacucuucaauaaggcccuggcgaccuauucaaaggauuuuaucuucguacaaaagauggucaaaagcaagacuguggcccagugcguugaguacuauuacacguggaaaaagauuaugcgacuagguagaaagcacaggacacgccuggcugaaauaaucgacgauugugugaccagugaggaggaagaggaacucgaggaagaggaggaagaggacccagaagaggaucggaaaucuacuaaggaagaggaguccgaaguccccaaaagcccugagccacccccggugccuguacuggcacccaccgaagggccaccucuucaggccuugggacaacccucgggcucauuuauuugcgagaugccaaacuguggugcuguguucucuaguagacaggcccugaacggccaugcaaggauccacgggggaacaaaucagguuaccaaggcgcgcggcgccauacccuccgggaaacagaagccuggaggcacucaaagcgguuauugcucugucaagagcuccccaucacacaguacaacgagcggggaaaccgacccgacuacaauuuuucccuguaaagagugcggaaagguguucuuuaaaaucaagucucgaaacgcucauaugaaaacccaccggcagcaggaggaacagcaacgucagaaggcccagaaagcagcuuucgccgcagagauggccgcuacaaucgaaagaacuaccggcccugugggugcgccaggcuuacucccccuggaucagcuuucccugauuaagccuaucaaggacgucgauauucuagacgaugacguugugcaacagcucgggggagugauggaggaggccgaaguagucgacacggaucuguugcuggacgaucaggacucaguguuacuccaaggcgaugcagagcuguga

SEQ ID NO: 64184 - RNA, 915 nt, Artificial Sequence
  derived and/or modified sequence opt3 from TREX1__Homo_sapiens__NP_009179
augcagacccugaucuucuuugacauggaggccacaggccuccccuucagccaaccuaaggugacugaacuuugccuguuggcuguccacagaugugcauuagaguccccaccgacgucucaggggcccccuccaaccguucccccuccacccagggugguagauaaacugucacuaugcguggccccuggaaaggcguguaguccagcugccagcgaaauuacaggucucuccacugcaguccuggccgcucauggccggcagugcuuugacgauaaccuugcaaaucuguugcucgccuuccugcgccgacagccgcaacccuggugucugguggcucacaacggggaccguuacgauuuuccucucuuacaggccgagcuggcgaugcuuggauugaccucugcacuggacggcgccuucugcguugauucgauaacagcucuaaaagcccucgaaagagcaucaagcccaagugagcauggucccaggaaguccuauucucuggggagcaucuacacccggcuuuauggacaguccccuccagacucacacacugcugagggcgaugugcuggccuugcucaguauuugucaguggcgcccccaagcgcuguuaagaugggucgacgcccaugcaaggccguuuggcacaauccggccuauguacggggugaccgcuagcgcccgcacgaaaccccgaccaucugcuguaacuaccacagcccaccuggcaacuaccagaaauacauccccuucacucggagaaagcagggguaccaaggaucuucccccaguuaaggaccccggcgcccugagucgggagggguugcuagcuccucugggacuccuggcgauucuuacgcuggcaguggccacuuuguauggccucucucuggcuacaccaggugaauga

SEQ ID NO: 64185 - RNA, 711 nt, Artificial Sequence
  derived and/or modified sequence opt3 from TREX2__Homo_sapiens__NP_542432
augagcgaggcccccagagcugaaaccuucguguuucuggaccucgaggcaacaggccuuccuuccgucgaaccagagaucgccgaacugucuuuguucgcgguucacaggucaaguuuagagaacccggagcaugaugaaagcggggcucuggugcuaccccggguacucgacaagcugacucuuugcauguguccugagcgcccauuuacggccaaagcauccgaaauuaccggacugucuucggaggguuuggcccgaugccguaaggcuggcuucgauggggcaguggucagaacacuccaggccuuucugucaaggcaagcuggacccauaugucugguggcccacaauggcuucgacuacgauuuuccucucuuaugcgcggagcugcggcgccuuggugcaagauugccaagggacacuguuugucuggauacccuacccgcccuccgggggcuggaccgcgcucauagccacggaacacgagccagaggcaggcagggcuauagucuugggucccuguuccaucgguacuuucgugcagaaccuucugcugcccacagcgcggagggagaugugcacaccuugcuccugaucuucuuacaucgcgccgcagaacugcucgcuugggccgacgagcaggcuagagguugggcccacauugaaccaauguaucuuccgcccgaugacccuucccuggaggcauga

SEQ ID NO: 64186 - RNA, 3075 nt, Artificial Sequence
  derived and/or modified sequence opt3 from TRHDE__Homo_sapiens__NP_037513
augggcgaggacgaugccgcucugagagcagggagcaggggacucuccgaccccugggccgauucuguggguguccggccucgcaccacagaacgacacaucgcgguucauaagcgucuugugcuggcuuucgccguaucauugguggcauuacuggccgucacuaugcuagcugugcuccugagucuuagauuugacgagugcggcgcaagcgccacgccaggggcugauggaggcccguccgguuuccccgaaaggggagggaacggcucucugccuggcucggcccggcgcaaucaccaugcagggggagacucauggcagccagaggcggguggcguugccagccccgggaccacaagugcucaaccuccauccgaagaggagagagaacccugggagccuuggacucaguugaggcucucuggacaccugaaaccacugcauuacaaccucauguuaaccgccuuuauggaaaauuucacauuuagcggcgaggugaacgucgagauugcaugucggaaugcuacccgcuaugugguacugcacgccucccgaguugcgguggaaaagguccagcuugccgaggauagagcauucggugcugugccgguggccggguuuuucuuguacccccagacucaaguccugguugugguacuaaacaggacacucgacgcucagcggaauuauaaccugaaaauaaucuacaaugcccuuauugaaaacgagcuguugggauuuuuccguucaaguuaugugcuccacggcgaacgcagauuucugggcgucacccaguucagcccuacgcaugcaaggaaggccuuuccaugcuucgaugagcccaucuacaaagcuacuuucaagauuucuaucaagcaccaggcgaccuauuuaucccugucaaauaugccuguggagacaagcguuuuugaagaggacgggugggugacugaucauuucagucaaaccccacucaugucuacauacuaccuugcaugggccauauguaacuuuaccuaucgggaaacgacuacaaaauccggagucgugguacgacuguacgcucgccccgacgccaucagaagggguagcggcgauuaugcauugcacauuaccaagcggcuaaucgaguucuacgaagacuauuuuaaaguuccguacucgcugccuaagcucgaccugcuugccgugcccaaacacccauaugcugccauggagaauugggggcugucuauuuucgucgagcagcgcaucuugcucgauccuuccgugucaaguauaagcuaccuguuagacgucacuauggugauuguucaugaaaucugccaccagugguuuggagaucuggugacacccguauggugggaggacgucuggcuaaaggaaggcuucgcacauuacuuugaguucguggguaccgauuaucucuacccaggguggaacauggaaaagcagagauuucugacggacguucuucacgaggugauguugcuggauggccucgcguccucucaucccgucagccaagaggugcugcaggcuaccgacauugauaggguauucgacuggaucgccuauaaaaagggagcagcccuuauccguaugcuggcuaauuuuaugggccacucaguguuccagcggggguugcaagauuaccucacaauucacaaauauggaaacgccgcacgaaacgaccuguggaauacuuuaagugaagcucugaagagaaacgguaaauacguuaauauacaggaggucauggaccaguggacccuacagaugggcuauccugugaucacaauucucgggaacacuaccgccgaaaauaggaucauaauuacacaacagcauuucaucuacgauaucuccgcgaagaccaaagcccugaaguugcagaacaauagcuacuuguggcagauuccacugacuaucguggucggaaaccgcucucacguuucaagugaggcuauuauaugggugagcaauaaguccgagcaucaccggaucacguaucucgacaaaggcucuuggcuguuagguaacauuaaucaaacaggguacuuuagagugaacuaugaucugaggaauuggcgccuuuugaucgaccagcucauccgaaaccacgaaguacugucggucagcaaucgggcaggccuaauugaugacgccuucucccuggcucgugccggauaccucccgcagaacauaccccuggagaucauuagauaucuuucagaagagaaggauuuucuuccuuggcaugcagcgaguagggcccuguacccauuagacaaacuccuggaucgcauggaaaacuauaauaucuucaacgaguacauucuuaaacagguggcuaccacuuacaucaagcugggcuggcccaagaauaacuuuaaugggucuuugguucaagccagcuaucagcacgaggaacuccggagagaggugauaaugcuggcauguuccuucggaaacaagcauugccaccagcaggcuucaacccuaaucagcgacuggauuucuuccaauaggaaccgaaucccucugaauguccgcgauauuguguacuguacagguguuagucuccuggacgaagaugugugggaguuuaucuggaugaaauuccauagcaccacugccguaucugaaaagaaaauacuuuuggaggcacugacaugcuccgacgaccggaacuuacucaauagacugcuuaaccugucacuaaauagugaggucgugcucgaucaagacgccauugaugugaucauucacgucgcuaggaacccacacggccgugaccuggcguggaaguuuuuccgcgauaaauggaagaucuugaauacgcgguauggggaagcccuguuuaugaacagcaaguuaauaucgggaguuaccgaguuccucaacacugaaggcgagcugaaagaacuuaagaauuuuaugaaaaacuacgacgguguggcagcugccuccuucucuagagccguagagacaguggaggcuaaugucagguggaagaugcuguaucaggaugaauuguuccaguggcucgggaaagcacugcgacauuga

SEQ ID NO: 64187 - RNA, 729 nt, Artificial Sequence
  derived and/or modified sequence opt3 from TRH__Homo_sapiens__NP_009048
augcccggcccuuggcugcuccuugcccuggcuuugaccuuaaaccugacaggggugccaggagguagagcacagccggaggccgcgcaacaggaagcugucacugccgcagagcaccccggccuagacgauuuccucaggcagguugaacggcugcuuuuucugcgcgagaauauccagcgauugcaaggggaccagggagaacauagcgccucccagauuuuccagucugauuggcucucaaagcgucaacacccuggcaaaagagaggaggaagaggaagaggguguggaggaagaggaagaggaagaagggggagcuguaggcccacauaagaggcagcaccccggccggcgcgaggacgaagcaaguuggagcguggaugucacgcagcauaaaagacagcacccugggaggcgguccccauggcuggccuacgcugugcccaagcgccaacacccuggacgaagacuggccgacccaaaagcgcagaggucuugggaggaagaggaagaggaggaggagcgggaagaggaucucaugccggaaaagcgucagcaucccgguaagcgcgcauuaggcgggccuugcggaccacaaggcgccuauggucaggcugggcugcuuuugggacugcuagacgaucucucgagaucacagggcgccgaggagaaaaggcagcaccccggccggcgagcagcuuggguucgcgaaccucuggaggaauga

SEQ ID NO: 64188 - RNA, 1197 nt, Artificial Sequence
  derived and/or modified sequence opt3 from TRHR__Homo_sapiens__XP_011515565
auggagaacgaaaccgugagcgagcugaaucagacacaacuccagcccagagccgucguugcucuugaauaccaggugguaacuauccuguugguguuaauuauaugcggccuggggaucgucggaaacauuauggugguucuaguggucaugaggacgaagcacaugcggaccccuacaaauuguuaucucgugucccuggcaguagccgaccuuaugguucugguggcggcugguuugccaaacaucacugauucuauuuacggcucaugggucuauggguacgugggaugccucuguaucaccuaucugcaguaccugggcauaaaugccaguagcugcuccaucacagcauucaccauugagcgcuauaucgccauuugucauccgaucaaagcucaauuucucugcacuuucucucgagcaaagaaaauaauuaucuuugugugggccuucacaucguuauacuguaugcugugguuuuuccuuuuggaccugaacauuucaaccuacaaggaugcuaucgucaucagcugcgguuauaaaauuagucguaauuacuauucccccauauaccuaauggacuuugggguuuucuaugugguaccuaugauccucgccacggugcuguacggauuuauugcgagaauccuuuuccugaacccaauacccucugauccuaaggaaaauagcaagacuuggaaaaacgacuccacccaccagaauacaaacuugaaugucaacacuucaaauagguguuuuaacaguaccgugagcucucggaagcagguuacaaaaaugcucgcaguggucgugauucuguucgccuuacuguggaugccauaucgcacccucguaguugugaacuccuuucuuucaagccccuuccaggagaauugguuccuguuguuuugcagaaucuguaucuaccuaaacagugcuauuaauccugucaucuacaaccugaugucucaaaaguucagggccgcauuucggaaacucugcaauugcaagcagaagccaacggagaaaccggcuaacuauuccguggcccugaauuacagcgucauuaaggaaucggaucauuucucuacugagcuugacgauauaacagugaccgacacuuaucuguccgcgacaaaaguuucauuugaugacaccuguuuggccagugaagugagcuucucccagucuuga

SEQ ID NO: 64189 - RNA, 231 nt, Artificial Sequence
  derived and/or modified sequence opt3 from TRIAP1__Homo_sapiens__NP_057483
augaacagcgugggcgaggccugcaccgacaugaagagagaauacgaucaguguuucaauaggugguuugcugagaaauuccugaagggggacuccucuggagaucccugcacagaccucuuuaaacgguaucaacaguguguccagaaggcaaucaaagaaaaggagauuccuauagaaggucuugaguucaugggccacgggaaggagaaaccagaaaacucaaguuga

SEQ ID NO: 64190 - RNA, 1119 nt, Artificial Sequence
  derived and/or modified sequence opt3 from TRIB1__Homo_sapiens__NP_079471
augagagugggccccgucaggagcgccauguccggggcuucucagccucggggaccagcacugcucuuuccggccacccgcgguguucccgcgaagcgacuucuggacgcugaugacgccgcagccguggcugcaaaaugcccucguuugucagaguguaguagcccacccgauuacuuauccccuccaggcucucccugcucgccucaaccaccgcccgccgcuccuggggccggaggcgguucagggagcgcgccaggacccaguagaaucgcagacuaucugcuacucccucuggccgaaagggagcacguaucccgggcucuuuguauucauacaggccgcgaacugagaugcaagguguuuccaauaaaacacuaccaggauaagaucaggcccuauauucaguugccgucucauagcaacaucacuggcauugucgaggugauccucggggaaacgaaagccuacguuuucuuugagaaggacuucggagauaugcacuccuaugugcggucacgcaagcgacugagagaggaagaggcagcuaggcuguuuaaacagauagucagugccguggcgcauugucaccaaagcgccaucguacucggugacuuaaagcugcggaaauucguuuucucuaccgaggaacguacacagcuucgcuuggagucccuggaagauacucacauuaugaagggcgaggacgaugcacuaucagacaaacaugggugcccugcuuacgugagccccgaaauccucaauaccacaggaaccuauaguggcaaggccgcugaugucuggucucugggugugaugcuuuacacucuguugguggggagauacccauuccacgacuccgacccuagcgcccucuuuucgaagauuaggcggggacaguucuguauccccgagcauauaucuccaaaagcacgaugccugauucgcuccuuacugagaagggaacccucagagcggcucacagccccugagauccuucugcacccaugguuugaaagugucuuggagccgggcuauauugauagcgaaaucggcaccuccgaccagaucguucccgaguaccaagaagauucugacauuagcucauucuuuuguuga

SEQ ID NO: 64191 - RNA, 1032 nt, Artificial Sequence
  derived and/or modified sequence opt3 from TRIB2__Homo_sapiens__NP_067675
augaacauccacagaagcaccccuauuacaauagccagguacggccggucccgcaauaagacucaggacuucgaggaacugucuucaauccgaagugcugagccuagccaauccuuuucuccaaaccucgggucgccgucacccccugaaacgccaaaucuuagccauugcgugaguuguauuggaaaauaucuguuguuagagccccuggaaggugaucacgucuuccgugcaguucaucuacacuccggcgaggagcucgugugcaagguauuugacaucucuuguuaccaggaaagccuggccccuugcuucugucuuuccgcgcauucaaacauuaaucagaucaccgagauaauccugggggaaacaaaagccuauguguuuuucgagagaaguuacggagauaugcacagcuuugucaggacuugcaagaaauugcgggaggaagaggcugcacgccucuucuaucagauugccucugcuguggcacacugucaugacggcggucugguucugagagaucucaaguuaaggaaguuuaucuucaaagacgaggaacggacccgcgugaagcuggaaucccuugaggaugccuacauuuugcgaggggacgaugacucacugagcgauaaacacggaugcccagcuuaugucagucccgagauccuaaacacaucuggcuccuacagcggcaaggccgcggacguguggucgcucgggguaaugcuguacaccaugcuuguuggaagauauccuuuucaugauauagaaccaucuucccuguucucaaaaauuaggcggggucaauuuaauaucccggagacuuugagucccaaggcaaagugucucauucguagcauccugcgcagagaaccuuccgagagguuaacaucucaggaaauccuggaccacccaugguucagcaccgacuucucagugaguaacuccgccuacggcgcuaaagaggucagcgaucagcucgugcccgacgugaauauggaggaaaaccuugaucccuuuuucaauuga

SEQ ID NO: 64192 - RNA, 1077 nt, Artificial Sequence
  derived and/or modified sequence opt3 from TRIB3__Homo_sapiens__NP_001288117
augagagccaccccucuggcugcacccgccggcagccucuccaggaagaaacggcuugagcuggacgauaacuuggacacagaacgcccagugcagaagcgagcgcguucugggccgcaacccagauuaccuccaugccugcuaccccucucaccuccaacugcucccgauagggccacggcagucgccaccgcuagucggcugggaccuuacguucuucuggagccagaagaggguggccgcgcauaucaggccuugcacuguccgacagggacugaauauaccugcaaaguguaccccguacaggaggcucucgccgugcuggagccuuacgcgagacugccaccccauaagcacgucgcaaggccuacagaagugcucgccggaacccaguuacuguaugcuuucuuuacucggacacauggcgacaugcacagccuuguucgcucccgacauagaaucccagagcccgaagccgcaguguuguucaggcaaauggcuaccgcccuggcgcacugucaccagcauggucuaguccuccgggaucugaaacuuugccguuuuguguucgccgaccgcgagagaaagaagcugguauuggagaaucucgaagauucuuguguucugacggggccggacgauucguuaugggacaaacacgcaugcccugcuuacgugggacccgagauucugucaagcagggccaguuauuccggcaaggcugccgaugucuggucucucggcguggcacuuuuuacuaugcuggccgggcauuacccauuccaggacagcgaaccuguguugcuauuuggaaaaauacggcgaggugcuuacgcgcugcccgcaggccucuccgccccagcucgcugucuggucagaugccuucugaggcgggagcccgccgaacgcuugaccgcaacagggauccuccugcacccuugguuaagacaggauccaaugccgcuggcccccacuaggucacaccuaugggaggcugcccaaguugugccugacggacucggccuggacgaggcacgugaagaggaaggugaucgggagguagugcuuuauggguga

SEQ ID NO: 64193 - RNA, 1446 nt, Artificial Sequence
  derived and/or modified sequence opt3 from TRIM10__Homo_sapiens__NP_006769
auggccagcgcugcauccgugaccucucuggccgacgaggucaacugccccaucugucagggcacacucagagaaccuguuacuauugauugcgggcacaauuucuguagggcgugccuuacgcgguacugugagauaccaggaccggaccuggaagagucaccuaccugccccuuguguaaggaaccauuucgccccgguaguuuccgaccuaacuggcaauuagcuaaugugguagagaacaucgagcgucugcagcuagugagcacacucggccugggggaagaggaugucugccaggaacauggagagaaaauuuauuucuucugugaggacgaugaaaugcagcuuugcgugguuuguagagaggccggcgaacacgcaacucauaccaugagguuucuggaggacgccgcugcaccauaccgggaacaaauccacaagugcuugaaaugccuccgcaaggagagagaggaaauucaggagauccaguccagggaaaauaaacggaugcaagugcugcugacacaggucucuaccaagcgccaacaggugauaucggaguucgcccaucuccgaaaguuuuuagaagaacagcagucaauccugcuugcucaguuggagagccaggauggugacauucugagacaaagggaugaauuugaccuacucguagccggggagaucugucgguuuagugcgcugauugaggagcuugaagagaaaaacgagcgucccgcacgcgaacuguugacugauaucagauccacacucauaaggugcgagacccggaagugucgaaaaccuguugccgugucuccagaacugggacagcgcauuagagacuucccgcagcaggcuuuaccccugcaaagggagaugaagauguuucucgagaaacuuugcuucgaacuggauuaugagccugcccacaucagcuuggacccacagacgucccaccccaagcuacugcucucagaagaccaucagcgggcacaguuuaguuacaaguggcaaaauagcccugauaacccacagcgcuucgacagagcuacuuguguccuggcccacaccggcauuacaggcgggaggcauacuuggguggugucuaucgaucuugcgcacggagguuccugcaccgucggcguugugucagaggacguacagcguaaaggggaacugcgguugcgacccgaggagggagugugggccgucagacucgcauggggcuucgugagcgcucuggguaguuuuccgacaagguuaacccugaaggaacagccucgccaaguucgggugucucuagauuaugaggucgggugggugacguucacuaaugccguaacaagagaacccaucuacaccuuuacugcuuccuucacaaggaaaguuauuccauuuuucggacucuggggccgcggcagcucguuuucucuguccucauga

SEQ ID NO: 64194 - RNA, 1407 nt, Artificial Sequence
  derived and/or modified sequence opt3 from TRIM11__Homo_sapiens__NP_660215
auggccgcucccgaccugagcaccaaccuccaggaggaagcaacaugcgccaucugucuugauuacuucacugacccugugaugacggauugcggccacaauuuuuguagagagugcauuaggcgguguugggggcaaccagaaggaccguaugcgugccccgagugucgcgaacuguccccucagcgaaacuugcguccaaauagacccuuagcuaagauggccgagauggcaaggcggcugcauccuccaucucccgucccucaggguguuugcccagcccaccgcgagccgcuagcugcauucuguggcgacgaacucagacugcuuugcgccgcuugugagaggucaggggaacauugggcccaccgggugcgcccccugcaggaugcggcagaggacuugaaagccaagcucgagaaaagucuggaacaucugcgaaagcaaaugcaggaugcucucuuauuucaggcccaggcagacgagaccugcguacuguggcagaaaaugguggaaagccaaagacagaacguccuuggagaguucgaaagguugcggcgucugcuagcugaggaggaacagcaacuccugcagcgccuugaggaagaggaacuggagguguugccuagacucagggagggcgccgcgcaccugggucagcaauccgcccacuuagcagaacugauagcugagcucgaagggcggugccagcuuccagcccugggauugcuacaggauaucaaggacgcucugcgacgcguucaggaugugaagcuccaacccccugaggucgugccaauggaacugagaacaguauguaggguucccggccuuguggagacucugcggcgcuuuagaggcgacgucaccuuggauccggacacagccaauccugagcucauucugucugaagacaggcguucggugcagcgaggggauuuacggcaggcacugcccgacucaccagagagauucgauccuggacccugcgugcuaggucaggaaagguuuaccagcggccgccauuacugggaggucgagguuggggaccggacaaguugggcccucggaguguguagagaaaacguaaauaggaaagagaagggcgaacuguccgcugguaacggguucuggauccuuguguuuuugggaucuuauuacaauagcuccgagcgcgcgcuggcaccacuccgagaucccccucggcgugucggcauuuuccuggacuaugaagccggccaccuuucauuuuacagugcuacugaugggagccuguuguucaucuuuccagagauaccguucucuggaacccucagaccccuguucuccccuuuaucaagcaguccaacgcccaugacuaucugcaggccuaaagguggcucuggggacacccuggccccacaauga

SEQ ID NO: 64195 - RNA, 1233 nt, Artificial Sequence
  derived and/or modified sequence opt3 from TRIM13__Homo_sapiens__NP_001007279
auggacgugauggagcugcucgaagaggaucuuaccugccccaucuguugcagccuguucgacgauccuagagucuugccauguucccacaacuuuugcaagaaauguuuagaaggcauucuggaggggucuguuaggaauagucuauggcggccggcccccuucaagugcccuacaugucgcaaagaaacuucagcuacgggaauaaacagccuccaggugaauuacucccugaaggguaucguagagaaauauaacaagauuaagaucucuccaaaaaugcccgugugcaagggccaucuugggcaaccucugaauauuuucuguuugaccgacaugcagcucaucugcggaauaugugcaacacgaggcgagcacacuaaacaugucuucugcucgaucgaagaugccuacgcgcaggagcgugacgcuuuugaaucacuguuccagagcuuugagaccuggagaaggggugaugcccugagucggcucgacacauuagagaccuccaagcgcaaaucucugcaacuuuugacuaaggauagcgacaaggugaaagaguucuuugaaaagcugcagcacacacuagaucagaaaaagaacgaaauucucuccgacuucgagaccaugaaacuggcaguuaugcaggccuaugauccagaaaucaauaaacuuaacacgauucugcaagagcagagaauggcuuuuaauaucgcagaggccuucaaggacgugucagaacccauagucuuuuugcagcagaugcaagaguucagggaaaagauuaaggugaucaaagagacuccucucccaccgaguaaccugcccgcuagcccuuuaaugaagaauuucgacaccucucagugggaagauauuaaacugguagacguugauaagcucucccuuccacaggacacagggacuuuuaucucaaaaauccccuggagcuucuacaagcuguuuuugcuaauucugcuccugggacuugugauagucuucggcccuaccauguuucuggaguggaguuuguucgaugaccucgccacauggaagggcugccugucuaacuuuuccagcuauuuaaccaaaacggcggauuucaucgagcaaucgguguuuuacugggaacaggugacugacggguucuuuauuuucaaugagcgguuuaagaacuucacacuggucguucuaaauaacguggcagaauuuguauguaaauauaagcuccuguga

SEQ ID NO: 64196 - RNA, 1398 nt, Artificial Sequence
  derived and/or modified sequence opt3 from TRIM15__Homo_sapiens__NP_150232
augcccgccaccccuagccugaaggugguccacgagcucccagcuugcacacuuugugcaggcccgcuggaagacgccguuacuauccccugcgggcauacguucuguagauugugcuuaccugcgcugucccagaugggagcucaaucuucagguaaaauucuacucuguccacugugccaggaggaggaacaggccgaaacccccauggcaccugugccacuuggcccccugggggagacauacugugaggaacacggagagaagauauacuuuuucugcgaaaacgaugccgaguuuuuguguguauucugcagggagggcccuacucaucaggcucacaccguggguuuucucgacgaagcaauccaaccauaucgggaucgccugcgaagucgucuggaggcccucagcacagaaagagacgagauugaagaugucaaaugucaggaggaccagaaguuacaggugcugcuuacccaaaucgaguccaaaaagcaucagguugaaacugcuuucgagagguugcagcaggaacuggagcaacagcggugccuacuccuggcccgccuuagagaacuggagcagcaaauuuggaaggagagggaugaauauaucacaaaagugucugaggaagucacccgguugggggcacaggugaaggagcucgaagagaaaugccagcagccggcgucggagcuguuacaagacguacgcguuaaucagucacgaugugaaaugaagacguuugugagccccgaggccauaaguccugaucuggucaaaaagaucagagacuuccacaggaagauucucacucuuccagaaaugaugcggauguuuuccgagaaccuggcucaccauuuggagaucgauucuggagugauuacccuagacccccagacagccagccguucccuggugcucucagaagaucgcaaaagugucagauacacuaggcagaagaaaagccugccugacucuccacuucgguucgacggccugcccgcaguuuugggcuuuccgggguucuccucaggacgacaccgcuggcaaguggaucuccagcugggugacggcgggggaugcaccguaggcguggcuggugagggggucagaaggaagggagaaaugggcuuaagcgccgaggauggcgugugggcgguuaucauaagucaucagcaguguugggccucuacauccccugggaccgaccugccccuaagcgaaauuccacggggagugcgcgucgcacucgauuaugaggcuggucaagugacgcugcacaaugcccagacucaggagccuaucuuuacauucaccgcuucguucucuggcaaaguauuucccuucuuugccguuuggaagaaaggguccugccuuacuuugaagggauga

SEQ ID NO: 64197 - RNA, 1695 nt, Artificial Sequence
  derived and/or modified sequence opt3 from TRIM16__Homo_sapiens__NP_006461
auggccgagcuggaccucauggcucccggcccucuuccaagagcaaccgcccagccgcccgcgccucugagcccagauuccgggucucccucaccugacaguggaagcgcuuccccaguggaagaggaagaugucgguucuucggagaaguugggcagggaaacagaggagcaagacucagauagcgccgaacagggggaccccgcaggagagggcaaagaaguuuuaugcgauuucugucuggacgauacucggcgcgugaaggccguaaaaaguugccuaacguguauggugaacuacugcgaggagcaccuccagccucaucaggucaauaucaagcugcaaucccaccuucugaccgaaccagugaaagaccauaacuggcgauauuguccggcucaccauucucccuugagcgcauuuugcuguccugaucagcagugcauuugucaggacugcugucaagagcacuccggucacacaauaguuucacucgaugccgcucguagagacaaggaagccgagcugcagugcacucagcuggaccucgaaaggaaguuaaaacugaaugagaacgcgaucagucggcuucaggcaaaucaaaagagcguguuggucucuguguccgagguaaaagccguugcugaaaugcaguucggggagcugcuagccgcagugcgcaaggcucaggccaacgucaugcucuuucuggaagagaaagaacaagcggcccuuucacaggcaaauggaauuaaggcucaucuggaguacagaagcgccgagauggaaaagaguaaacaggaguuggaaaggauggcugccaucucuaacaccgugcaguuccucgaggaauauugcaaguuuaaaaauacagaggauauuaccuucccauccguguacgucggccugaaggacaaauuaagcggcauccggaagguuauaacugagucgacagugcaccugauccaacuccuugaaaacuauaaaaagaagcugcaggaguuuucuaaagaagaggaguacgauauucgcacccagguauccgcagugguccagcgaaaguauuggacgucaaaacccgaaccuaguacuagagagcaauucuugcaguacgccuacgacaucaccuuugauccagacacagcucauaaguaucuaaggcugcaggaagagaaucggaaagugacuaacaccacacccugggaacacccguacccugaucuccccagccguuuccugcacuggcgccagguucuuucccaacagucucuguauuugcauagauacuauuuugagguggagauuuucggggcgggaaccuacgucggucucacguguaagggcaucgacaggaagggggaagaacggaauagcugcauaucaggaaacaauuuuaguuggucccugcaguggaacggcaaagaguucacugcaugguauagcgauauggagacaccauuaaaggccgguccuuuccgacgccuggggguguacauugacuuucccggaggcauccuaucuuucuacggcguagaauaugauaccaugacucucguucacaaauuugcuuguaaguucucagagccaguguacgccgcauuuuggcugaguaaaaaggagaacgccauuagaaucgucgaccuuggggaggaacccgaaaagccugcuccgagcuuggugggaacagccccauga

SEQ ID NO: 64198 - RNA, 1434 nt, Artificial Sequence
  derived and/or modified sequence opt3 from TRIM17__Homo_sapiens__NP_001020111
auggaggccguggaacuggcuagaaagcuccaggaggaagcaaccugcagcaucugucuugacuacuucacagaucccgucaugacuacgugcggccacaacuuuuguagggccugcauucaacuguccugggagaaagcgcgggggaagaaaggacgccgaaagcguaaagguucuuucccuuguccagaaugcagagagaugucaccgcagaggaauuuguuacccaaccggcugcuaaccaagguugcugagauggcccagcagcauccuggccuccaaaagcaggaccugugucaggaacaccaugagccacuuaaacuguuuugccagaaggaucaaagucccauaugugugguaugccgcgaaagcagagagcacagguugcaucgggugcucccugcagaggaagccguccagggguauaaacugaagcuggaggaagacauggaguaccuccgcgaacagaucacacgaacuggaaauuuacaggcuagagaggagcaaucccuggcagaauggcagggcaaagugaaggagaggcgggaacguauuguucuugaguucgaaaagaugaacuuguaucugguggaggaggaacagcgccuacuccaagcccuggagaccgaagaggaagagacagcuucuagacuuagggagucggucgccugucuggaucggcagggucacucauuggaacuccuguuacugcagcucgaggaacgaagcacccaggggccacuucaaaugcugcaggacaugaaagagcccuugagucgcaagaauaacguguccguacagugcccugagguugcgccaccgacuagacccaggacagugugccgggucccuggacagaucgaagugcuacgcggcuuucuggaggauguggucccagacgcaaccucugccuaccccuaucuccugcuuuacgaaagcagacaaaggcguuaucugggcuccucaccugaggggaguggauucuguagcaaagaucgguuuguugcuuacccaugcgccgugggucagacggcauucucuuccggccgacacuacugggaaguagggaugaauauuacuggagacgcuuugugggcccucggcguguguagagauaacgucucaaggaaggaccgcgugcccaaaugcccggagaaugguuuuuggguugugcagcugagcaaggggaccaaauauuuaaguacauucucugcgcugacuccugucaugcuaauggagcccccaucccauaugggaaucuuucucgauuucgaagccggcgaggugagcuuuuacucgguaucugacggcucccaucugcacaccuauucacaggcaacauucccugggccccuucaaccauucuuuuguuugggagcucccaagaguggucagaugguuauaagcaccgugacgaugugggucaagggcuga

SEQ ID NO: 64199 - RNA, 1428 nt, Artificial Sequence
  derived and/or modified sequence opt3 from TRIM21__Homo_sapiens__NP_003132
auggccagcgcugcaagacugaccaugaugugggaggaagugacaugccccaucugucucgacccuuucgucgagccaguuuccauugaaugcggccacucuuuuugucaggagugcauaucacaaguggggaagggagguggcaguguauguccggugugcaggcagcgguuccuucugaaaaacuugcgccccaaucgacaguuagccaacauggucaauaaccugaaggaaaucagccaggaggcgcgugaggggacucaaggagaaagaugugcugugcauggcgagaggcuacaccucuuuugcgaaaaagaugguaaggcccuguguuggguuugcgcacagucccggaaacaucgcgaccacgccauggugccucuugaggaggcugcacaggaauaccaggagaagcugcaagucgccuugggggaacucagaaggaagcaggagcuggcugaaaaacuggagguggagauugccaucaagcgggcggauuggaaaaagacgguagaaacccagaaaucucgcauucaugcagaguucguucagcaaaagaauuuucucguggaagaggaacagcgacaguuacaagagcuggagaaggacgaaagagagcagcuuaggaucuugggagaaaaagaggccaagcuggcucagcagucgcaagcccuacaggaacucauaucagagcuggaucggcguugucacagcagugcacuugagcuguugcaggaagucaucauugugcucgagcgcuccgaaucuuggaaccugaaagacuuagauaucacaagcccagagcugagauccgugugccacguccccggccucaagaaaaugcuuaggacuugcgcuguucauauuacccuggacccugauacagccaauccaugguugauccuaucagaggaccggcgacaggugcgccugggcgauacccaacagaguauacccgggaacgaagagagauucgacagcuauccuaugguacucggagcgcagcacuuucauucugguaagcacuacugggaaguggaugucacuggcaaagaggccugggaccuggggguguguagggacuccguucggcgcaagggacacuuccuucugucaagcaagaguggcuuuuggacaauuugguuguggaauaaacagaaguaugaagcagguaccuacccacaaacgccgcuccauuuacaggugcccccuugccaggucgggaucuuccuggauuaugaggcuggaauggugucuuuuuacaacauuacugaccacggcucccugaucuauagcuucucggagugugccuuuaccggcccacuaagacccuucuucucuccuggguuuaaugauggagguaaaaacacagcuccacucacucugugcccccuuaauaucggcucccaggggucaaccgacuacuga

SEQ ID NO: 64200 - RNA, 1485 nt, Artificial Sequence
  derived and/or modified sequence opt3 from TRIM22__Homo_sapiens__NP_001186502
auggacuucagcgugaaggucgauaucgagaaagaaguuaccugccccauuugucuggagcuccuuacagaaccucuguccuuggacugcggccacucuuuuugucaggccugcauaacugcuaagaucaaagagucagugauuaucaguagaggggaaagcuccuguccaguaugccaaacgagguuccagccgggaaacuuacggcccaaucgccaucuggcaaacauuguggagcgagucaaggaggugaaaaugucuccucaggaaggucagaagcgugauguuugugagcaccauggcaagaaacuacaaaucuuuugcaaggaagacgggaaagugauauguugggucugcgagcucucgcaggagcaccagggacaucagaccuucagaaucaaugaagugguaaaggagugucaagaaaaacugcagguugcccuucagaggcugauuaaggaggaucaggaagcggagaaguuggaggacgauauccggcaagaacgcacagcuuggaaaauugagagacagaagauccucaaaggcuuuaacgaaaugagggugauacuggacaaugaggaacagcgggagcugcaaaagcucgaggaaggugaggucaacguguuagauaaucuggccgcagccacugaccagcuugugcagcagcgccaagaugcuucaaccuugauuagcgaccugcagcgaagacuaagggggaguuccgucgaaaugcuccaggauguuaucgacgugaugaaacggucugagagcuggacacugaagaaaccaaaguccguaucaaagaaacuuaagaguguguuccguguccccgaccugagcggaaugcuccagguguugaaagaacugaccgauguucaauacuauuggguggacgucauguuaaacccuggcucugcaacuuccaauguggccauuucaguagaucagcgccagguuaagacagugagaaccugcacguuuaaaaacagcaauccaugcgacuucagugcuuuuggcgucuucgggugucaguacuuuucuuccggaaaguauuacugggagguggaugucagcgguaagaucgccuggauccugggcgugcacucgaaaauuucuucccucaacaagaggaaaucaaguggguucgcguuugaccccagcguuaauuauuccaagguguacucucgguaucgaccucaauacggauacuggguaauaggccuucagaacacuugcgaguauaaugcauucgaagauagcucaaguuccgacccaaaaguccugaccuuguucauggccgugccgcccugucgcaucgguguuuuucuagauuacgaggcugggauugugagcuucuuuaacgucacaaaccacggagcccugaucuauaaguucucuggcugcagauuuucaaggccugcauacccauauuucaaucccuggaacugucucgugccuaugacuguaugcccacccaguagcuga

SEQ ID NO: 64201 - RNA, 1725 nt, Artificial Sequence
  derived and/or modified sequence opt3 from TRIM23__Homo_sapiens__NP_001647
auggccacccugguggucaacaagcucggcgcugggguugacagcggaagacaggguuccaggggcacagcagugguaaaagugcuugagugcggggucugugaagauguguucucucugcaaggagacaagguuccccgguuguuacugugcggccacacugugugucaugauugccuaacgcgccucccucugcacggucgagccauccguuguccauuugacagacaggucaccgaucuuggggacucaggaguguggggccugaaaaagaauuucgcguugcucgagcugcuggaaaggcuccagaacggcccgauugggcaguacggagcugccgaggaaaguauagguaucagcggcgaguccauuauccggugcgaugaggacgaagcacauuuagccucuguauauuguacaguuugcgcuacucaccuguguucggagugcucacaagugacccauagcacaaaaacccuugcaaagcaccgcagaguccccuuggccgauaagccucacgagaaaacuauguguagucagcaucaggugcacgcuauugaguuugugugccuggaggaagggugccagacauccccacuaauguguugcgucuguaaggaguacggaaaacaucaaggccacaagcacucuguucucgaacccgaggccaaucagaucagggcgagcauacuggacauggcacauugcauccggaccuucacggaagagauuuccgauuauucacgcaaacuuguggguaucguacagcacauugaagggggagaacagaucguggaggacggcauaggcauggcccauacugaacacgucccugggaccgcugagaacgcccgaaguuguauuagagcauacuuuuaugaucugcaugaaacauugugcaggcaagaggagauggcucucagcgugguugacgcccacgugcgggaaaagcugaucugguuacgucagcagcaagaggacaugacuauucugcucucugaagucuccgcggccugucuucacugcgagaagacccugcagcaggaugacugucgcgugguauuggcaaaacaggaaaucacaagacuacuggagacccuccaaaagcagcagcagcaauucacggagguugcugaucauauccagcuggacgccucaauuccagugacuuuuacaaaagauaauaggguccacauaggacccaagauggaaauccggguggucacccuuggucuggacggcgcugggaaaacuacaauuuuguucaagcucaaacaggaugaguuuaugcagccuaucccaaccauaggauucaacguggaaacgguugaguacaagaaucugaaguuuaccauuugggacgugggcgguaaacauaaguuacgaccgcuguggaaacacuauuaccuaaacacacaagccguagucuucgugguugauagcagucaccgcgacagaaucucugaggcacauuccgaacucgccaagcugcuuacugagaaagaauugagggaugcucugcuccugaucuuugcgaauaagcaggacguggcaggggcccuuagcgucgaggaaauuaccgagcuguugucgcuccacaagcugugcuguggccggucuugguacauccagggaugcgacgcucgcuccggcaugggguuauaugagggacuggauuggcuaucaagacagcucguggccgccgguguacuggacguggcauga

SEQ ID NO: 64202 - RNA, 3051 nt, Artificial Sequence
  derived and/or modified sequence opt3 from TRIM24__Homo_sapiens__NP_003843
auggagguggccgucgaaaaggcuguugcagccgcggcugccgcaagcgccgcugcauccggcgggcccucugccgcuccuucaggagagaacgaagccgagaguagacaggguccagacagcgaaaggggcggggaggcggcacggcugaaucuccuugauaccugcgccgugugucaccaaaacauccagucccgcgcuccgaaacuguugcccugcuuacauucuuucugucagcgaugccugccugccccacagcguuaccuaaugcuccccgcaccuaugcugggaucggcugagacaccacccccuguaccagccccgggcucacccgugagcgguaguuccccuuuugcgacucaagucggggugauuagauguccaguuugcucucaggaaugugccgagaggcacauaaucgacaauuucuuugugaaggauacgaccgaaguccccagcuccacaguggagaaaucaaaccagguaugcacaaguugugaggacaaugcagaagcuaacggauucugcguugaguguguggaauggcuuugcaagaccugcauucgggcccaucagcgcgucaaauuuacaaaggaucacaccgugagacaaaaggaggaagugagcccugaggcugucggcguuacuucucagaggccaguguucugucccuuucauaaaaaggagcagcugaaauuguauugcgaaacaugugacaagcuaaccugccgggauugucagcugcuggagcacaaagaacaccgcuaccaauucaucgaggaagccuuucagaaucagaagguaauuaucgacacgcucauaacuaaguuaauggagaaaaccaaguauaucaaauucacaggcaaccaaauucagaaucgaaucauugaggugaaccagaaucagaagcaagucgaacaggauaucaaaguggcaauauuuacucugaugguugagauuaacaagaaagggaaggcccuuuugcaucagcuggaaucccuagcuaaggaccacagaaugaaacucaugcagcaacagcaggagguggcgggacugucaaagcagcuugaacaugucaugcacuucagcaaaugggcagugaguucugguuccagcaccgcccuguuguacucgaagaggcucaucacauaucggcugcgucacuuacugcgcgcuagaugcgaugccucuccgguaaccaauaacacgauucaauuucauugugacccuuccuucugggcacagaauaucaucaaccucggcucacuuguuauugaggauaaagagagucagccccagaugccaaagcaaaacccuguggucgaacagaauagccagcccccauccgggcugucuagcaaccaauugucaaaguuccccacucagauaagucuagcccagcugaggcuccagcacaugcaacagcagcagccuccaccgcggcugaucaauuuucaaaaccauucccccaaaccuaauggaccagugcuucccccucacccacagcagcugcgauaucccccgaaccagaauauuccucgccaagcuaucaagccaaaccccuugcagauggccuuccucgcacagcaagcgauaaaacaguggcagauuagcucuggccaggguacaccuucaaccacuaauaguacaagcuccacccccucuucgccaacgaucaccagcgcugccggguacgacggaaaggcauuuggcuccccuaugaucgaccugucaagucccgucggcgggucuuacaacuuaccaagccugccggauauugacugcuccucaacaaucaugcuagauaauauugugagaaaagacacuaacauagaucauggacaaccuaggcccccaagcaaucggaccguucagucucccaacuccagugugccuagcccaggucucgccggccccguaacaaugacuucuguccacccuccgauccgcuccccaucagcuaguagcguggggucgagaggauccucuggcagcucaaguaagcccgccggugcagacuccacccacaagguuccuguggucaugcuggagccaauuaggaucaaacaggaaaauucugggcccccugagaacuacgauuucccggugguaaucgugaagcaggagagcgacgaagagucccguccccaaaacgcuaauuauccacggucaauucuuacuagcuugcugcucaacaguucucaguccagcaccucggaagagacuguucugcgaucagaugccccugacucuacgggcgaucagcccggacuucaucaggacaauaguuccaacggcaaaagcgaauggcuggacccaucucaaaagagcccuuugcacgucggggagacaagaaaagaggaugaccccaaugaagauuggugugcggugugccagaacggaggugagcuccuguguugcgaaaagugcccaaagguguuucauuuauccugucacgucccgacccugacuaauuucccuucaggcgaguggauaugcaccuuuuguagggaccuaaguaaacccgaaguugaguacgauugcgacgccccaagccacaacucugagaagaaaaagacagaagggcucgugaaacugacccccaucgauaagcgcaaaugugagcggcuuuugcuguuccucuauugccaugaaaugucccuggcuuuucaggacccugugccauuaacuguacccgauuacuauaagauuaucaagaauccuauggaccugucaacaauuaaaaagagacuucaggaggauuacaguauguauagcaaaccggaagacuucgucgcagauuuuagguugaucuuccaaaacugugccgaguuuaaugagccagacuccgaaguggcuaacgccggaauaaagcucgagaauuacuucgaggaacugcucaaaaaccuguaccccgagaagcgcuucccuaagcccgaauuucgaaaugagucugaagacaacaaauucucggaugacagcgaugacgauuuuguucagccacggaagaaacgucucaagucaaucgaggaaagacagcugcuuaaauga

SEQ ID NO: 64203 - RNA, 1893 nt, Artificial Sequence
  derived and/or modified sequence opt3 from TRIM25__Homo_sapiens__NP_005073
auggccgagcugugcccccucgcugaagaacuuagcuguuccaucugccuggaaccuuucaaggagccagugaccacaccguguggccacaacuuuugcgggucuuguuugaaugaaacuugggcaguccagggaucacccuacuuaugcccucaauguagagccguuuaucaggcgaggccacagcugcauaaaaacacggugcuaugcaauguaguggagcaguuccuccaagcugaccuggcccgggagcccccugcagaugucuggaccccacccgcccgcgcuagugcaccuagcccaaacgcccagguggcuugugaccacugccuuaaggaagccgcgguuaaaacaugucuggugugcauggcauccuuuugccaggagcauuugcagccgcacuucgauucucccgccuuucaagaccauccucuccagccacccguccgagaucugcugcguagaaaguguucgcagcacaauaggcuccgggaguucuuuugcccugagcacucagaguguauuugccauauauguuuaguggaacacaaaacuugcagcccagcuagucugucccaggccucugcagaccuugaggcuaccuugcgccauaagcugacaguaauguacagccaaaucaacggugccuccagagcgcuagaugacguuaggaaucggcagcaggaugugcgcaugaccgccaaccgaaaggucgaacaacuccagcaggaguauacugaaaugaaagcacugcuugacgcuucagagacaaccaguacgagaaagauuaaagaggaagagaagagggugaauagcaaauucgauacuaucuaccagauucuguugaagaagaaaucugaaauccaaacccucaaggaggaaauagagcagucccugacaaaacgggacgaguuugaguucuuagaaaaggccucaaaacugcguggcaucagcacuaagcccguguauauuccggaagucgagcucaaccacaaacuuaucaaggggauucaccagaguaccaucgaucugaagaaugaauugaaacaguguauaggacgccuacaagagccuacacccucuuccggcgacccaggugagcaugacccugcuagcacccacaagucgacgagacccguuaaaaaggugucuaaagaagagaagaaguccaaaaagccacccccuguaccagcccugccgucaaaacuccccacuuuuggggcaccugaacagcugguggaucuuaagcaggccggacuggaggcugcggcaaaagccacaaguagccauccaaacuccaccucuuugaaggcuaagguccucgagacuuuccuggccaaaagcaggcccgaauuacuggaguacuauauuaaggugauccuagacuacaauacagcacacaacaaaguugcccucucagaaugcuacaccguggcuagugucgccgagaugccucagaauuaucggccacauccccaacgauuuacguacuguucccaggugcugggccuucacugcuauaagaaaggcauucacuacugggaaguagaguugcagaagaacaacuucugugggguuggaaucugcuaugguagcaugaaucgccagggcccggagucuagacuggggaggaacucagcaaguuggugcguggaaugguucaauaccaagaucagcgcguggcauaacaaugucgagaaaacacucccuuccacuaaggcuacccgggugggaguccugcuuaacugugaucacggcuuugugauuuucuuugccguugcagacaaagugcaucugauguacaaguuccgcguagauuuuacagaagccuuguauccagcuuucugggucuuuucugccggugcaacucucucgauaugcagccccaaauga

SEQ ID NO: 64204 - RNA, 1620 nt, Artificial Sequence
  derived and/or modified sequence opt3 from TRIM26__Homo_sapiens__XP_005249435
auggccaccagcgcuccccugagaucccucgaggaagaggugacaugcucuaucugucuugacuaccugagggauccugucacuauugacugcggccacguuuucugucggucaugcacgaccgaugugcgcccaauaagugggagccgaccgguaugucccuugugcaagaaaccuuuuaagaaagaaaacauccguccaguguggcaguuagcaucccuggucgagaauauugaaagacuaaagguggacaaaggaaggcaacccggugagguuacacgggagcagcaggaugccaagcucugugaacgccauagagagaagcugcacuauuacugcgaagacgauggcaaacuucugugugugaugugcagggagucucgggagcaucgcccucacacugcggucuugauggaaaaggcugcccagccacaucgagagaaaauccucaaccaccugucgacccugagaagggaccgggauaagauucaaggguuccaggcaaaaggagaagccgacauccucgcugcauuaaagaagcugcaggaucagcgucaauauauaguggccgaguuugaacagggccaccaguuccuucgcgagagagaggaacauuugcuggagcagcuagcuaaacucgaacaagagcugacagaagguagggagaaguuuaaaucacgagggguaggagagcuugcccggcuggcguugguuaucagcgaacucgagggcaaggcacagcagcccgccgcugaacugaugcaagacacccgcgauuucuuaaauagauacccuaggaaaaaguuuugggugggcaaaccaauugcccgggucgugaagaagaaaacuggggaguucagugacaagcugcucucccuucagcgcggacugagagaauuucaggguaaauugcuaagggaccuggaguauaagacagugucugucacccucgauccgcagagcgcauccggcuaccugcaacuuucagaggacuggaaauguguuacguauaccagucuguacaagagcgcuuacuugcacccccagcaguucgauugcgaaccuggggugcucggaucuaagggcuuuacuugggguaaaguauauugggagguggaagucgagcgugaggggugguccgaagacgaggaagagggagaugaagaggaggaaggcgaggaagaggaagaggaggaagaggccggcuacggggacggauaugaugacugggaaacagaugaggacgaagagucacugggugaugaggaagaggaagaggaggaagaggaagaggaaguguuagagagcugcaugguuggcguggcgcgggacagugucaagcgaaaaggggaccugucucuaagaccagaggauggagugugggcccucaggcuguccagcucgggcaucugggcaaacacuucucccgaagcugagcuuuucccugccuugcgcccacggagaguagguauugcucuggacuacgaagggggcaccguuacauuuaccaaugccgagucccaggaacucaucuauacguucacugcaacauucaccaggcgccuggugcccuuucuuuggcugaaguggccgggaacucgauugcuccugcggccuuga

SEQ ID NO: 64205 - RNA, 1542 nt, Artificial Sequence
  derived and/or modified sequence opt3 from TRIM27__Homo_sapiens__NP_006501
auggccagcggcuccguggcugagugccugcagcaagaaaccacaugucccgucugccuccaguacuucgcagagccuaugaugcuugacugugggcacaacaucugcugugccugccuggcgagauguuggggaacugcugaaacgaauguuucuugcccacaguguagggagaccuuuccgcagcggcauaugcgccccaaccgacacuuggccaaugugacacaauuaguaaagcagcugcguacugaaagaccuucagguccaggcggggagaugggagugugcgagaaacauagggaaccccuaaagcucuauugugaggaagaucagaugccuauuugcgucgugugcgaccggagucgcgagcacagaggccauagcguucugccacuugaggaagcaguggaggguuucaaagaacagauacaaaaccagcuggaucacuugaagagggucaaagaccucaagaagcggcgccgagcccagggggagcaggcuagagcagaacugcugucccucacccaaauggagagggagaaaaucgugugggaauuugagcaguuauaccacucucugaaggaacaugaguaucggcuuuuggcccgucuggaagaacuagaucucgcuauuuacaauucgaucaacggagccauuacacaguucucauguaauaucagccaccugaguucccuuauagcgcaacuggaggaaaaacagcagcagcccacccgcgaguugcuccaagacaucggcgauacucugucuagagcagaaaggauucggaucccugagccauggauuacaccgcccgacuuacaggaaaagauccauauauuugcccagaaaugccuguuccucaccgagagccuuaagcaguuuacggagaagaugcaauccgauauggagaaaauucaggagcugcgagaagcucaguuguauucaguagacguuacucuagauccugacaccgccuacccaagucugauccucagcgauaaccugcgccaggugagauauucuuaccuucaacaggaccugcccgacaauccugagagguucaacuuguuuccauguguccucggcucccccugcuucauugcagggcggcacuacugggagguggaagugggagauaaggcuaaauggacaaucggugucugugaggacucaguuugccgcaagggcggggugacuagcgccccgcagaauggauuuugggcgguaagucugugguauggcaaagaauacugggccuuaaccucuccuaugacagcacugccccuaagaaccccacuccagaggguggguaucuuccuggauuaugacgcuggggaggucuccuuuuacaacgugacggaacguugucacacuuucacauucagccaugccaccuuuugcggaccuguucggcccuauuucucgcuuucuuacuccggcggcaagucagcugccccauugauuauaugucccaugagugggaucgauggauuuagcggucacgugggcaaucaugggcacuccauggagacuucuccuuga

SEQ ID NO: 64206 - RNA, 2508 nt, Artificial Sequence
  derived and/or modified sequence opt3 from TRIM28__Homo_sapiens__NP_005753
auggccgcuagcgcagccgcggcuuccgccgcagccgcuucugcagccucaggcagucccgggccuggagaggguagcgcuggcggggaaaagagauccaccgccccaucugcggcagccucggcuucagccagcgcagcugccaguuccccggcgggaggcggugccgaggcacuggaacuccuugagcacugcgggguguguagggaacggcugcgccccgagcgagagccucguuuguuaccaugccugcauucugcuuguagcgccugccuaggacccgcugccccugcagccgcuaacuccucaggcgacggcggggcggcaggagaugguacagucguugacuguccagugugcaaacagcaauguuucaguaaggauaucguagaaaauuacuuuaugagagacagcggcucuaaagccgcuacugaugcccaggacgcaaaccagugcuguacguccugcgaggauaaugcccccgcuaccucauauuguguggaaugcagcgagccucucugcgagacaugugucgaagcccaccagagggugaaguacacuaaagaccauaccguucggaguacagggccagcaaagucucgcgauggagagagaaccguguauugcaacguccacaagcaugaaccgcuggugcuuuucugugaguccugcgacacucugacauguagggauugccaauugaaugcgcacaaagaccaccaguaccaguuucucgaagaugcuguacggaaccagcgcaagcugcuggccagccucguuaaacgauuaggcgacaagcaugcaacccugcaaaaaucgacgaaggaggugagaucuuccauuaggcaggucucagacgugcagaagcgggugcaggucgauguuaaaauggccauacuucaaaucaugaaggaguugaauaaacguggucgcgugcugguaaacgacgcucagaaggugacugaagggcagcaagagagacuagaaaggcagcacuggaccaugacaaaaauucagaagcaucaggagcacauccuccgguucgccaguugggcacuggaaagcgauaauaacacugcccuucuguuguccaaaaagcucauuuauuuucaacugcaccgagcuuuaaagaugaucgucgaccccguggagccucauggagagaugaaauuccagugggaucugaaugcguggaccaagucugccgaggcuuuuggcaaaauaguugcagaacgcccaggcacaaacagcaccgggcccgccccuauggcuccacccagagccccgggaccucucucaaagcaggguaguggcuccagccagcccauggaagugcaagagggguacggauucggcucuggugacgauccauauucaagugcagaaccucacgucagcggggugaaaaggucccggucuggcgagggagagguaucgggccuuaugcgcaagguucccagagugagccuggaaagguuggaccuagaucugacggcggacucccagccacccgucuuuaagguguucccugggucaacuacagaggauuacaaucucaucgucauugaacguggagccgcugccgcagcuaccggucagccaggcacugccccggcagggacacccggagccccuccacuggcuggcauggcgaucgugaaagaggaggaaaccgaggccgcaauuggugcucccccuacggccaccgaagggccagagacaaagcccguucuuauggcccuggcugaaggcccgggagcagagggcccucgguuggccaguccaucugggagcacuuccucaggacucgaggugguagcgcccgaagguaccagcgcuccuggcgggggacccggcacacuggacgacucugccacuaucugucgagucugccagaaaccaggugauuuagugauguguaaccaaugcgaguuuuguuuccaucuggacugccaccuaccugcacuccaggauguucccggggaagagugguccugcagucugugucaugugcuuccagacuugaaggaagaggauggcagccugucucucgacggagccgauuccaccggcgucguggcuaaacugucaccggcaaaucagagaaagugcgagaggguacuucuggccuuguuuugucacgaaccuugccgcccccuccaccagcuggcgacagacaguaccuucagcuuagaucaaccagggggaacucuggaccuaacgcucauacgggcuagacugcaggagaaacuuucgcccccuuacuccucuccacaggaguucgcccaagaugugggcaggauguuuaagcaguucaacaaguugacagaagacaaagcagauguucagagcauuaucggucugcagcgcuuuuucgaaacccgaaugaacgaggccuuuggggacacuaaguucucagcuguccucguggagcccccuccgaugagucugccaggagccggcuuauccucucaagaacugagcgguggccccggggacggaccuuga

SEQ ID NO: 64207 - RNA, 1767 nt, Artificial Sequence
  derived and/or modified sequence opt3 from TRIM29__Homo_sapiens__NP_036233
auggaggccgcugacgcaagcagauccaacgggucuucacccgaagccagggaugcgcggaguccuagcggcccauccggaucucuggagaaugguaccaaggcugacggcaaagaugccaagacaacuaacgggcacggaggcgaagcagccgaggguaaaucgcucgggucagcucuuaagccgggagaaggccgcagcgcacuguucgccggcaaugaguggcgacgucccaucauucaguuuguggagaguggggacgauaaaaacuccaauuacuucucuauggacagcauggaaggaaagagauccccuuaugcugguuugcaauuaggcgccgcgaagaaaccacccgucacguuugcagagaagggggaacugaggaaaucaauauucagugagagccggaagccuaccguuucuaucauggagccaggagaaacacgcagaaacuccuaccccagggccgauacuggccuauuuucacggagcaaaagugguucugaggaagugcucugcgacuccuguauugggaauaagcagaaggcuguaaaaagcugccuggugugucaggccucguucugcgagcuucaucugaagccucacuuggaaggagcagcuuuucgcgaucaucagcuccuggagccaauccgagacuucgaggccagaaaauguccgguccacggcaagaccauggaacuguuuugccaaacagaucagaccuguauuugcuaucucuguauguuccaggagcauaaaaaccacucuacugugacaguugaagaggcgaaggccgaaaaagagaccgaguuaucccugcagaaggaacaacuucaguugaagaucauagagaucgaagacgaggcagaaaaauggcagaaggagaaagauaggauuaagucauuuacgacuaaugagaaagcuauccuggaacagaacuuccgggaccuagugcgugaccucgagaagcaaaaggaagagguccgcgccgcucuggagcagagagaacaggaugccguggaccaaguaaaaguuauuauggaugcacuugacgagagggccaaggugcugcacgaagauaaacagacccgggagcaguugcauaguaucagcgacuccguccucuuucugcaggaguucggcgcuuuaaugucuaauuacagccugcccccuccacuccccacauaucacgugcuucuggaaggggagggauugggucaaucacuaggcaacuucaaggaugaccugcucaaugugugcaugcgacaugucgagaaaauguguaaggcggaucugagucgcaacuuuauagaaagaaaucacauggaaaacgggggagaccacagguacguuaacaauuauacuaacuccuucggcggugaguggagcgcaccugauaccaugaagcgguacucuauguaccuuacaccaaaagggggcgugcgcaccucauaucagcccaguagcccgggaagauuuacgaaggaaacuacacagaaaaauuucaacaaucuguacggcaccaaggggaacuauacuuccaggguaugggaguacucuucgagcauucaaaauuccgacaacgacuugccugugguccagggaucaaguucuuuuagccucaaagguuaucccucccugaugcguucacagagcccaaaggcccagccucagacauggaagucuggcaaacaaaccauguuaucccauuaccggcccuucuaugugaauaaggggaacggaaucggcaguaaugaggcuccauga

SEQ ID NO: 64208 - RNA, 2235 nt, Artificial Sequence
  derived and/or modified sequence opt3 from TRIM2__Homo_sapiens__NP_001123539
auggccagcgagggcaccaacauccccuccccuguggucagacagauugacaagcaauuccugauaugcucuaucugucucgaaagguacaaaaauccaaagguucuuccgugccugcacacauuuugugagcggugcuugcagaacuauauucccgcucauucauuaacucugaguuguccugugugccgccagacgagcauccuaccagaaaaagggguagcagcccuccagaauaacuucuuuauuaccaaucugauggaugugcuucaacgaacacccggauccaacgcggaggaaucuucgauccuggagacugucaccgcuguggccgcagguaagccuuugucauguccaaaucacgacggcaacguuauggaguucuacugccagagcugugaaacagccaugugccgugaguguaccgaaggggagcaugcugagcaccccacugugccucucaaagaugucguggaacagcauaaggcaagucugcagguacaacuggacgccguuaauaagagacucccagagauagauuccgcuuuacaguuuaucucugaaauuauccaccagcugacaaaccagaaagccagcauuguggacgauauccacuccaccuucgacgagcuucaaaagacguugaaugucaggaaaucagugcugcuaauggaacucgaggugaacuauggacugaagcauaaaguccuucagagucagcuggauacuuugcuccaaggccaggagagcauaaagucuugcuccaauuuuaccgcgcaggcacugaaccacgguacagaaacugagguuuuacuggugaagaaacagaugucagaaaagcucaaugagcuugccgaccaagauuucccgcugcauccccgggaaaacgaccaguuggauuuuauuguagagaccgaggggcugaaaaagagcauccacaaccuaggaacaauucucaccacgaaugcuguggccagugaaacugucgcaacaggcgagggccugcgccagaccaucaucgggcagccuaugucugugacuauuacaaccaaagacaaggacggagaacuuugcaaaacggguaacgcuuaccugaccgccgaguuguccacaccagauggcagcguugcggacggggaaauacucgauaauaagaacggaacuuaugaguuccuguacaccgugcaaaaggagggcgacuuuacauuaucgcugagacuauaugaucagcacaucagggguucucccuucaaacucaaggucauucgguccgccgacgugucaccuacuaccgaagggguaaaacgccgaguuaagaguccaggaagcggccaugugaaacagaaggcagucaagagacccgcuuccauguacucuacaggcaaaaggaaggagaauccgaucgaagaugaccugauauuucggguggggaccaaaggacguaacaagggugaguucacuaaucuucagggcgucgccgcuagcacgaacgggaaaauuuugaucgccgauucaaauaaccaaugugugcagaucuucaguaaugacggacaguuuaagucccgcuucggcauuagagguaggagcccugggcagcugcaacggcccacaggcguugcagugcacccaucuggagauaucauuauagccgacuacgacaacaaguggguaucaaucuuuaguagcgauggcaaauucaagaccaaaauuggguccggaaagcucauggguccuaaaggcgucucuguggaccgaaaugggcauaucaucguuguggauaacaaggcuugcugugucuuuauuuuccagcccaauggaaagauagugacucgcuuuggcucgagagguaacggggacaggcaguucgcgggcccacacuuugcagccguaaacagcaauaacgagaucauuaucaccgauuuccauaaucacuccgugaaaguuuuuaaccaagaaggagaguucaugcugaaguuuggcucaaauggggaaggaaacggucaguucaaugcucccacaggcgucgccguggacaguaacgggaauauuaucguggcagauuggggaaacucucggauacaggucuucgacggcagcgguuccuuucuuucauauaucaauaccagcgccgauccucuguacgggccacagggcuuggcucucacuucugacggacacguugugguggccgauuccggcaaccauugcuucaaaguauaucgcuaccugcaauga

SEQ ID NO: 64209 - RNA, 1278 nt, Artificial Sequence
  derived and/or modified sequence opt3 from TRIM31__Homo_sapiens__NP_008959
auggccagcggccaguucgugaacaagcugcaagaggaagucaucugccccauuugucucgacauacuucagaaaccuguuaccaucgauugcgggcacaauuuuugucugaagugcauuacacagaucggagagacuuccugugguuucuuuaaaugcccauuguguaagacgucugugaggaaaaacgcuauuagauucaauucauuacugcggaaccuaguagaaaagauccaggcacuccaagccagugaggugcagagcaagcgcaaagaagcgaccugcccgcgacaucaggagauguuucacuacuucugugaggacgauggcaaguuucugugcuucgucugucgugaauccaaagaccauaagucucacaaugugucgcuuauagaggaagcugcccagaacuaucaagggcagauccaggagcagauucaaguucugcagcagaaagagaaggaaacagugcaagucaaggcacagggagugcauagaguagauguuuuuacugaccagguggagcacgaaaaacagaggaucuugaccgaguucgaacuccugcaccaaguccuggaggaggaaaagaauuuucucuuaucacggauuuacuggcugggccaugaggguacagaagccgggaaacacuauguggcuagcaccgagccccagcuuaacgauuugaagaaacugguggacagucuaaagacuaaacagaauaugccuccacgccagcuccuggaagauaucaaggucguucuuugcagauccgaggaguuccaauuucugaaccccacaccugugccauuggaacucgagaagaaacugucugaagcaaagagcaggcaugacuccauaaccggaucacugaaaaaguucaaagaucaguuacaggccgaccggaagaaggaugagaaucgcuucuuuaaaaguaugaacaagaaugacaugaaaagcuggggccuccuucagaagaacaaucacaaaaugaacaagacgucugaacccggcuccucaagcgcugggggacgaacuaccagugguccuccaaaccaccauucuuccgccccgagccacucgcuguucagagcgucuuccgcaggcaagguaacauuucccgugugcuugcuagccucauacgacgagauuagugggcaaggagcuagcucccaggauacuaaaaccuucgacgucgcccugucugaggaacuccaugcagcucugagcgaguggcuuacagccaucagggcgugguuuugugaagugccuucaaguuga

SEQ ID NO: 64210 - RNA, 1962 nt, Artificial Sequence
  derived and/or modified sequence opt3 from TRIM32__Homo_sapiens__XP_011516700
auggccgcugcagccgcgagccaccugaaccucgacgcucuuagagaggugcuggaaugccccaucuguauggaguccuucaccgaagaacaguugaggccuaaguuacugcauugcggccacacaauuugucggcaaugccuagaaaaacuccuggccucuucaauaaaugggguccgcuguccauuuugcaguaagaucacucgaauuacgagccuuacccagcugacagauaacuugacuguucucaaaaucauugacaccgcaggacuguccgaggccgugggucugcucaugugucguucuugcggcagaagguuaccgcggcaguucugucgcucgugcgggcugguacuuugugagcccugcagagaagcugaucaucagccuccaggacacugcacauugcccgugaaggaggcagccgaagagaggcggcgcgacuuuggcgagaaacugacccgacuaagagaacucaugggugagcugcaaaggcggaaggcugcccuugaaggggucucaaaggaucugcaggcgcguuacaaagcaguguugcaggaguauggacaugaggagcgcagaguucaggacgagcucgccaggagccggaaguucuuuacuggcagucuggcugaaguggagaaauccaauucucaagucguggaggaacagagcuacuuacugaacaucgccgaaguacaggcaguuucccgaugugauuauuuccucgcuaagauaaaacaggccgacguggcgcuucuggaggagacagccgaugaagaggaaccugaguugaccgcaucacuaccacgcgaacugacgcuccaagacgucgagcugcuuaaggugggccacguggggccccugcagaucggacaggcugucaagaaaccuagaacuguuaauguggaggauaguugggccauggaagcuaccgccagcgcagccucuacauccguaacuuuuagggagauggacaugucaccagaagagguggucgcuagcccgcgggcgagucccgcaaagcaacgcgguccugaggccgcuucuaacauucagcagugcuuguuccucaaaaagaugggcgccaaaggguccaccccaggaauguuuaaucugcccgugagcuuauacguuacaucgcagggcgaagugcuggucgcagauagagguaacuauaggauccaaguguucacccguaagggguuucuaaaagagauucggcgaucuccuuccggaaucgacucauucguacucaguuuucugggcgccgaccuuccaaauuugacgccccugagcguugcuaugaacugucagggccucauaggggugacugauuccuacgacaauucucugaaggucuauacacuugauggacacugcguggccugucauagaagccagcugucaaagccgugggguauuaccgcauugccuaguggccaguucgucgugacugacguugaagggggaaaacucuggugcuucacaguggauaggggcuccgguguagucaaguacagcugucugugcucugcggugcgccccaaauuuguuaccugugacgcugaggggacgguguacuucacccaaggcuuaggacugaaccuagaaaaucggcagaacgagcaccaucucgagggcggguuuucaaucggaagugucgguccagauggccagcuggggagacagauuagccacuucuuuuccgaaaaugaggacuucaggugcaucgccggaauguguguggaugcacgcggcgaccuuaucguagccgauucuucgcgaaaggaaauuuugcacuuuccuaaaggugggggcuauagcgugcugauacgggagggacucacaugccccguuggcaucgcucugacuccaaaggggcaauuacugguccuugacugcugggaccauuguauuaagaucuacuccuaucacuugcguagauacucaacccccuga

SEQ ID NO: 64211 - RNA, 1467 nt, Artificial Sequence
  derived and/or modified sequence opt3 from TRIM34__Homo_sapiens__NP_067629
auggccagcaagauccugcucaacgugcaggaggaaguuaccugccccauuugucuugagcuguugacagaaccuuuaucccuggacugcggccacucucuauguagagcuugcauaacugucucaaauaaagaggcagugacgaguaugggagguaagagcuccuguccaguaugcgggaucucuuacucguucgaacaucuccaagccaaccagcaccuggcgaauauuguggagaggcuuaaagaggucaagcugucaccggauaacggcaaaaagcgggacuugugugaucaucacggggaaaagcuccugcuguuuugcaaagaggaccgcaaggugaucuguuggcucugcgaacgaagccaggagcaucguggacaccacaccguuuuaacagaggaaguguucaaagagugucaggaaaagcugcaagcuguccuuaaaagauugaagaaggaggaagaggaggccgaaaaacuggaggcagauauuagggaagagaagaccaguuggaaauaucaggugcagacugaacggcagcgcauccaaacagaguuugaccagcuaagauccauacucaauaacgaggaacagagggagcugcagcggcuugaagaggaagagaagaaaacccuggauaaguucgccgaggcugaagacgaguugguacaacagaaacagcucguucgcgaacugaucucugauguggagugccgaagccaaugguccacuauggaguuacugcaggacaugucaggcauuaugaaguggagugaaaucuggagacucaagaaacccaagauggucagcaaaaagcugaaaacaguguuucaugcaccugaucugucuaggauguugcagauguuccgggagcuaaccgccgugcguugcuacugggucgacguuacgcuuaauuccgugaaccucaaucugaaccuuguacugucagaagaucagcgccaagugauuagcgucccaaucuggcccuuucaguguuauaauuacgguguguuggggagucaguauuucucuuccggaaagcacuacugggagguugacgugagcaagaaaacugcuuggauacucggcgucuauugcagaaccuacucgaggcauaugaaguacgugguacggcgaugugccaaccgccagaaucuguauacaaaauacagaccuuuauuuggcuauuggguuauugggcugcaaaacaagugcaaauacggaguguucgaagagucucuauccucagacccagagguccucacucugaguauggcggugcccccuuguagggucgguguguuucuugauuaugaagcaggcaucguuagcuucuuuaaugugaccucccacgggucuuugauuuacaaguucagcaagugcuguuucucacagccaguauauccguacuuuaaccccuggaacugcccugccccaaugacacugugucccccuaguuccuga

SEQ ID NO: 64212 - RNA, 1482 nt, Artificial Sequence
  derived and/or modified sequence opt3 from TRIM35__Homo_sapiens__NP_741983
auggagagaagccccgacguguccccuggcccaucuaggucauucaaggaagaacugcucugcgccgucuguuacgauccguuucgggacgcuguuacccuucgcugcgggcacaacuucugucgaggaugcgugagucguuguugggaaguacaggugagccccacaugcccugucuguaaagauagagcauccccagccgaccugaggacuaaucauacguugaacaauuuaguggagaagcugcuacgggaagaggcggagggugcucgcuggaccucuuauagauuuucgaggguuugccggcuccaccgcggccaacugucacuuuucugucuggaagauaaagaguugcucugcuguagcugccaggccgacccccgacaucaggggcacagagugcagccugucaaggauacagcacaugacuuuagggccaaaugccggaacauggaacacgcucugcgugagaaggcaaaggccuucugggcuaugcgcagaaguuacgaggccaucgcgaaacacaaucaaguggaagcagccuggcuggagggaaggauucggcaggaauuugauaagcuccgagaguucuuacgcguagaggagcaggcuauacuggacgccauggcagaggaaacuagacagaaacaacuuuuggcugaugagaagaugaaacagcugaccgaagagacagaaguucuagcccaugagaucgagaggcuccagauggaaaugaaggaggacgauguguccuuucugaugaagcacaaaucucggaagcgcagacuuuucuguaccauggaaccagagcccguccagccuggcaugcugauugacgugugcaaauauuuggguagccuccaauacaggguguggaagaaaaugcuggcguccgucgaaucaguuccauuuaguuucgacccgaacacugccgcagggugguuaagcgugucugaugaccugacauccguaaccaaucauggauaucgugugcaggucgagaaccccgagcgguuuucaagcgcuccuugucuccuuggcagucgaguguucucucagggcucccacgccugggaaguugcucugggaggguugcaaagcuggagagugggugucgugaggguacgccaggauucgggcgccgaggggcacucucauuccugcuaccacgacacgcggucaggauucugguauguuuguagaacucagggcguggaaggugaucauugcgucaccagugacccagcaacaagcccccuagugcuggccaucccuaggcgccuccgagucgagcuggagugugaagagggggaacuuuccuuuuacgaugcugagcggcacugccaucuguacacuuuccacgcgcguuuuggagaagugagaccauauuucuacuugggcggcgcacgcggggccggacccccggagccucucaggauuuguccccugcacaucucuguuaaggaggaauuagacgguuga

SEQ ID NO: 64213 - RNA, 183 nt, Artificial Sequence
  derived and/or modified sequence opt3 from TRIM36__Homo_sapiens__NP_001017397
augagcgaguccggcgaaaugucugaguucggguacaucauggaacugauugccaagggaaaaaugcccgacuggagaagggguuaucggugccgccagggcugugggaagaccacagagcucgcuacugcaacggauuuuucacaaaccggaaacaaaaguggcaagcacuucaaaacauga

SEQ ID NO: 64214 - RNA, 2895 nt, Artificial Sequence
  derived and/or modified sequence opt3 from TRIM37__Homo_sapiens__NP_056109
auggacgagcagagcguggaauccaucgccgaggucuucagaugcuuuauuuguauggaaaagcugagggaugcucggcucugcccccacuguucuaaacuuugcuguuucucaugcauacgccgauggcugaccgagcaacgugcacaguguccucauugcagagccccauugcaguuaagggaacugguuaacugucggugggcggaggaggugacacagcaacuagacacucuccagcugugcagucuuacgaagcacgaagagaaugaaaaagauaagugugagaaccaucacgagaaacugagcguauuuugcuggaccugcaagaaguguaucugccaucagugugcuuuguggggcgggaugcacggaggucacacauucaaaccgcucgccgaaauuuacgagcagcaugugacuaaggucaaugaagagguggcaaaacugcgcagaaggcugauggaacucaucuccuuaguucaagagguggagcggaacgucgaagccgugcgcaaugcuaaggacgagcgaguaagagaaauuaggaacgcaguugagaugaugaucgcccggcuggauacccagcuuaaaaauaaguugauaacacugaugggccagaagaccucucuaacucaggaaacagagcuccuggagucgcuucugcaagaaguggagcaccaguugcguucaugcagcaaaagugaacucaucuccaagucuagcgagauucugaugauguuucagcaaguccaucgcaaacccauggcuuccuucgugaccacgccugugccacccgacuuuacuucagaauuagucccuaguuaugauagcgccaccuucguucuggagaacuuuucuacacucagacagagggcggacccaguguacuccccuccucuucagguaucagggcuguguuggcgguugaagguguauccagauggaaauggcgucgugcgagguuacuaucuaagcguuuuccuggagcucagugcagggcugccggaaacuucuaaauacgaguaucgcguggaaaugguccaccaguccugcaacgaccccaccaagaauaucauuagagaguuugccagcgauuucgaggugggagaauguuggggcuacaacagguuuuuccggcuugaccuguuggcuaaugagggcuaccucaacccucaaaaugauacaguaauccugcgcuuccagguuagaucgccaaccuuuuuccagaaaucuagggaccagcacugguauauaacgcaauuagaagccgcacagacuuccuacauucagcagaucaacaaccugaaggagcgucuaacaauugaacucucacggacccaaaagagucgagaccugucucccccugauaaucaucuuuccccacagaacgacgaugcuuuggagacuagagccaaaaagucugcgugcagcgacaugcugcucgaagggggacccacaaccgccucagugagggaggcaaaagaggaugaagaggacgaagagaagauccagaaugaggauuaucaccaugaacugagugacggugaucuugaccuggauuuggucuacgaggacgaagugaaccagcucgacggcuccagcagcucagcuaguagcacggccaccuccaauacagaggaaaacgauaucgacgaggagacuaugucuggggaaaaugaugucgaguauaacaauauggaacuggaggagggagaauuaauggaggacgcugccgcagccggcccggcugguucgagccacggguacgugggauccucaagucgcauuucucggagaacccaucuguguagcgcggcaacauccucacuacucgauauagacccucugauccuuauucacuugcuggaucucaaagacaggagcucuaucgaaaaccuguggggcuuacaaccccgcccacccgccucccugcuucagcccacugcuaguuauagccgaaaggauaaggaccagcggaaacaacaggccauguggcguguuccaucugauuugaagaugcucaaaagacugaagacccagauggcagaggugaggugcaugaaaacagacguaaagaauacccuauccgaaauaaagucaaguagcgccgcuucgggcgauaugcagacuucccuguuuucugccgaccaagcagcgcucgcugccugugggacggagaacagcggacgccugcaggaccuugguauggaguugcuggcaaaaucaagugucgccaauugcuacauucggaacuccacaaauaagaaaucuaacagccccaagccugcuagauccucaguggccggcagcuuaagucucaggcgagcaguugauccaggggaaaacucucgcuccaaaggagacugccagacccugagcgagggcucgccggguucaucucagagugggucccggcacagcucucccagagcucuuauccauggcagcaucggagauauucugccuaagacugaagacaggcaauguaaggccuuggauuccgacgcgguggucguggccguauucucaggccucccagcuguggagaaacgucgcaagaugguuacccugggggcaaaugccaaaggaggucaccuagaaggccugcagaugacagaucucgagaacaauagugagaccggggaacugcagcccguccuuccugagggagcuagcgccgcaccagaagagggcaugucuuccgacucagauaucgaaugcgacacugagaacgaggaacaggaggaacauacaaguguggguggguuucacgauagcuucauggugaugacgcaacccccggacgaggauacccacuccucuuuuccugacggcgagcagauuggaccagaagacuugucguucaauacugaugagaacagcggccgguga

SEQ ID NO: 64215 - RNA, 1398 nt, Artificial Sequence
  derived and/or modified sequence opt3 from TRIM38__Homo_sapiens__XP_005248857
auggccagcaccacauccacuaagaaaaugauggaggaagcuacgugcucuaucugucugucacucaugaccaaccccgugaguauuaauugcggccacagcuacugucaucuuugcauaacagacuucuuuaagaacccuucccagaaacaacugagacaggagacuuucuguugcccacaguguagggcaccguuucacauggauucuuugcggcccaauaagcaguuagggucgcugaucgaagcccuaaaagagaccgaccaagaaaugucaugcgaggagcauggagaacaguuccaccucuuuugugaggaugaaggucagcugauuugcuggcgcugugagcgagcgccucagcauaagggccacacaaccgcucuugucgaggacguuugccaaggguauaaggaaaaacugcagaaggccgugacuaaauugaagcagcucgaggaucguugcacagaacagaaacugagcaccgcaaugagaaucacgaaguggaaggagaaaguacaaauucagaggcagaagauccggagugacuucaaaaaccugcaauguuuucuccacgaagaggagaaguccuacuuauggcgccuggaaaaagaggaacagcagacucuuucuagauugagggauuaugaggccggacugggccuaaagagcaaugaacucaaaucccauauacuggagcuugaggaaaagugccaggguucagcucaaaagcuguugcagaacgugaaugacacccucagucggagcugggcagucaaacuggagacaucugaagccguguccuuagagcugcacacuauguguaacguuucaaagcucuacuucgaugugaaaaagaugcuucgcagccaucaggucagugugacccuggacccagauacagcucaccacgaauugauccuaucugaggaccgaagacagguaaccaggggguauacgcaagagaaucaggauacuuccagccggcguuuuacagccuuccccugcguucugggaugugaaggcuuuaccucgggccgcagauacuucgagguggacgucggggaaggaacugguugggaccucggcgugugcauggagaacgugcagagggggacaggaaugaaacaggagccucaaucuggcuuuuggacccugcggcuuuguaagaagaaagguuaugucgcgcugacguccccacccaccucauugcaucuccacgaacagccucuguuaguugggauuuuccuggauuacgaggcaggagugguaaguuucuacaauggcaacacaggcugccauaucuuuacuuucccaaaggccagcuuuuccgacacccuacgaccguauuuccagguguaccaguauucuccccucuuucugccuccacccggggauuga

SEQ ID NO: 64216 - RNA, 1557 nt, Artificial Sequence
  derived and/or modified sequence opt3 from TRIM39__Homo_sapiens__NP_067076
auggccgagaccagccugcucgaagcuggcgcauccgccgcgucuacagcugccgcacuugagaaccugcaaguggaagccucaugcagugucuguuuggaguacuuaaaggaacccguuaucauugagugcgggcacaauuucuguaaggcuugcauaacuagauggugggaggaccuggaaagggauuuuccuuguccagugugccggaaaacgagccgcuaucgaucccuacguccgaacagacagcucggaucuaugguagagaucgcaaaacagcugcaggccgugaagaggaaaauucgggacgaaucgcuuuguccccagcaucacgaggcucugucauuguucugcuacgaggaucaagaagccgucugucucaucugcgcgauuagccauacccaccgcgcacauacagugguuccucuggacgaugccacucaggaguauaaggaaaagcugcagaaaugucucgagccauuagaacagaagcugcaagagaucaccagaugcaaaaguuccgaggaaaagaaacccggugagcuuaagagguugguggaaucucggcgccagcagauacugcgagaguuugaagaacuacacagaaggcucgacgaggaacagcaaguccugcuuagccggcuggaggaagaggaacaggauaucuugcagcgucuccgcgagaaugcugcccaccugggcgacaagagaagggauuuagcacaucuggcugccgagguggaagggaaaugccuccaauccggauucgagaugcuuaaggacguaaaaucaacacuggaaaagaacauuccucggaaauuuggcgguaguuugagcaccaucuguccacgagaucacaaggcgcuacuggggcucguuaaagagauuaaucgcugcgagaaggugaagacuauggaagucacaucuguguccaucgagcuggagaaaaacuucucaaauuuucccagacaguacuucgcccuuaggaagauacugaaacaguugauugcagacgugacccucgauccugagacggcucauccaaaccuggucuuaagcgaagaccggaagaguguuaaauuuguggagacucgccugagagaccuaccggauacccccaggcguuucacauuuuauccuuguguacucgccacugagggauucaccucuggccggcacuacugggaaguggaggucggcgacaagacacacugggcuguggggguuugccgagauuccgugagcagaaagggagaacugaccccacuucccgagacggguuauuggaggguccgcuuguggaauggcgacaaauacgccgcaacuacaaccccuuuuacuccacugcauaucaaggugaaacccaagcggguagggauuuuccucgauuacgaagccggaacacugucguucuauaacguuaccgacagaucucacaucuacacguuuaccgauacauucacugagaaacuuuggccgcuguuuuauccuggcaucagggcuggucgcaagaaugcggcacccuugaccauucgaccaccuacagacugggaguga

SEQ ID NO: 64217 - RNA, 2235 nt, Artificial Sequence
  derived and/or modified sequence opt3 from TRIM3__Homo_sapiens__XP_011518146
auggccaagagagaggacagccccggcccugaagugcagccaauggauaaacaauuccuggucugcuccaucugucucgacagguaccagugcccgaagguucuucccugucugcacaccuuuugcgagcgguguuugcagaacuauauuccugcucagucuuuaacacugucaugcccagugugucgccaaacuagcauacuacccgaacaggggguaagcgcacuccagaauaacuucuuuaucuccucucugauggaggccaugcagcaagcgccugauggagcucaugacccagaagauccccacccucuuucgguggucgccggucgaccacugucaugcccgaaucaugagggcaaaacgauggaguucuacugugaagcaugcgagaccgccauguguggggaaugccgugcuggagagcacagagagcauggcacaguguugcucagggacguuguggaacagcacaaggcagcccugcagcggcagcuggaggcuguccgcgguagacucccccaauuaagcgccgcgauugcacugguagggggaaucagucagcagcuucaagaaaggaaagccgaggcuuuggcccagauuuccgcagcuuuugaagaucuggagcaggcccuacagcaacggaagcaggcgcucgugucugaccuggagacuaucugcggcgccaagcagaaaguucuucagagccaacuggauaccuugcgccagggccaggaacacauaggguccucauguaguuucgcagagcaggcucuccgacugggaagcgccccugaaguguuacuggucagaaagcauaugagggagcggcucgcugcccuugcagcccaggcuuuuccagaacguccccacgagaacgcgcaacuggaguuggugcuagaaguggacggucugcgcagaucuguccucaaucugggcgcacuucugacaaccuccgccacugcucaugagacaguugccaccggggaaggauugaggcaggcacucgugggccagccugccucacugacgguaacuaccaaagauaaggacggucgguuagugcgaacagggagcgcugagcugcgcgccgaaaucacuggaccagauggcaccagacuacccgucccggugguugaccacaaaaacggcacauaugagcucguguacaccgcaaggacggagggggaacugcuuuugaguguccugcucuauggacaaccugugcgggguucucccuuccgcguaagagcgcugaggccaggcgaccuuccucccuccccagaugacguuaagcgucgggugaagagucccgggggaccuggcucgcacguccgacagaaagcugugagaaggccaucuuccauguacucaacuggugggaagcgcaaagauaauccgauugaggacgaacuggucuuucgggugggcaguagaggaagggagaagggcgaguucacaaacuugcaggggguuagcgccgcauccucuggacgcaucgugguagccgauagcaauaaccaaugcauucaggucuuuucaaaugaaggucaguucaaauuucgauucggcgugcgggggcguagucccggacagcuccaaagaccuaccggcguugcuguggacacuaacggugauaucauagucgccgacuaugauaauagguggguguccauuuucagcccagaggggaaguuuaaaacaaagaucggcgcaggacgccugaugggccccaaggggguagcuguggaccggaacggacauauuaucguugucgauaauaaaucuuguugcguguucaccuuucagccuaacgguaaguuagugggcagauucgggggaaggggcgccacggaccgacacuuugcggguccacauuucgucgccguuaacaauaaaaacgaaaucguggugaccgacuuucacaaucauucaguaaaggucuacagugcugauggggaguuccuguuuaaauucggcagccacggagaaggcaacgggcaguuuaaugcacccacaggaguggccguugacuccaacggcaauauuauaguggcugauugggguaacucucgcauccaggucuucgacucgagcggguccuuucuaucauacauuaauaccagugccgagccgcucuauggaccucaaggccuggcacuuacuucugauggucacgugguuguggcggacgccggcaaccauuguuucaaggcuuaccgguauuugcaguga

SEQ ID NO: 64218 - RNA, 777 nt, Artificial Sequence
  derived and/or modified sequence opt3 from TRIM40__Homo_sapiens__NP_001273562
augaucccccugcagaaggacaaccaagaggaaggcgugugcccuauuugucaggagagccucaaagaagccgucuccaccaauugcgggcaccuuuucuguagaguuugccugacacagcauguggagaaggcuucugcaucaggaguauuuuguugcccauuguguaggaaaccgugcagugaagagguguuagguacuggcuacauaugucccaaccaccagaagcgggucugccgcuucugugaggaaagccgacugcuacucugcguggagugccugguuuccccugaacauaugucucaccaugagcuuacgaucgagaaugcccugucgcacuauaaagaacguuugaacagaaggucacggaagcuccgcaaggauauugcggagcugcaaagacugaaagcucagcaggaaaagaaacuccaggccuuacaauuucagguggaccacgggaaucauaggcuggaggcaggaccagaaagccagcaccagacccgggagcaacuuggcgccuugccccagcaguggcugggucaacuagagcauaugccugcugaagcagcccgcauccucgauauuagucgagcugucacacagcugagaucccuugugaucgaccuggagaggacugccaaggaauuggauaccaacacacucaaaaaugcgggggaccuguuaaaccggucugcaccacagaagcuggagguaauauacccccagcucgaaaagggaguuagcgagcuucuguugcaaccuccacagaaacuauga

SEQ ID NO: 64219 - RNA, 2172 nt, Artificial Sequence
  derived and/or modified sequence opt3 from TRIM42__Homo_sapiens__NP_689829
auggagaccgccaugugcguguguugccccuguugcacauggcagagauguugcccucaacuguguagcugccucuguugcaaguucaucuuuacuuccgaaaggaacuguacgugcuucccaugcccguacaaagacgagcggaauugucaguuuugccacuguaccugcucugaaucacccaacugucauuggugcuguugcaguugggcuaaugauccuaacuguaagugcuguugcacagcaagcuccaaucuuaacugcuauuacuaugagucucgcuguugccgaaauacuauuauaaccuuccacaaaggccgucugagaucgauccauacaucaagcaagaccgccuugaggacugggaguuccgacacacaggucgaugaaguuaaaucuauuccagcgaacagccacuuagugaaucaucugaacugucccaugugcucccggcuacgccuccacucauuuaugcugccuuguaaucacagucuuugcgagaagugucugagacaguugcaaaagcaugcugagguaaccgaaaacuucuuuauccucauuugcccagugugugacaggagccacugcaugcccuacucuaauaaaaugcagcugccugagaacuaucugcauggacggcucacgaagcgcuacaugcaggaacacgguuauuuaaaauggcgauucgauagauccucaggcccaauccugugucaggucugcaggaauaagcggauagccuacaaacguugcaucacuugucgccuuaacuugugcaacgacugucugaaggcauuucacagcgauguggccaugcaagaccauguuuucguggauaccagugcugaggagcaggacgaaaagauuugcauccaccauccgucuuccagaauuaucgaguacuguaggaaugauaacaaacuacucugcacauuuuguaaguucagcuuucacaaugggcaugacacuauaucgcugauugaugcaugcucugaacgggccgcuucccuuuucucagccaucgcgaaauucaaggcaguccgauaugagauugacaacgaccugauggaauuuaauaucuugaaaaacaguuucaaggccgauaaagaggcuaagcgcaaggagaucagaaauggauuucucaaacugaggagcauuuuacaggaaaaggagaaaauaaucauggaacagauugagaaccuggaagugucccggcaaaaggagaucgagaaauacguauauguuaccacaaugaaggugaaugaaauggacggccucauagccuacucuaaggaggcacuuaaagaaaccggucaggucgcuuuccugcagagcgccaagauuuugguggaucaaaucgaggacgggauccagacgacuuaucgccccgauccucagcuaagacugcacucaauuaacuacgugccacucgacuuugucgaacugaguuccgcgauccacgagcuuuuccccacaggaccuaaaaagguuaggagcucuggcgauucacugccaagucccuauccggugcauagcgagaccaugauugcccguaaaguaacuuuuuccacacacucuuugggcaaucagcauauauaccaacggucgagcuccaugcucucauucaguaacaccgacaagaaggcaaaaguggggcuggaggcuuguggacgagcccagucugcuacgccugccaagcccaccgaugguuuauacacauauuggagcgcaggcgccgacucccagucaguccagaauagcuccuccuuucacaacugguacaguuucaaugaugggagcgugaaaacuccaggaccuaucguuauuuaucaaacccugguguaccccagagcugcgaaggucuauuggacaugcccagcagaagacguggacucuuuugaaauggaguucuacgagguaaucacuucucccccuaacaacguucagauggaacuauguggccagaucagggauauuaugcagcaaaaucucgagcugcacaaccuuaccccaaauacagaauauguguuuaaaguccgcgccauaaacgacaaugguccggggcaguggucagauaucugcaagguggucacccccgacggacauggcaagaaccgggcuaaauggggcuugcugaagaauauucagagugcccuccagaaacacuucuga

SEQ ID NO: 64220 - RNA, 1035 nt, Artificial Sequence
  derived and/or modified sequence opt3 from TRIM44__Homo_sapiens__NP_060053
auggccagcggcgugggggcugcauucgaggaacugccccacgacggaaccugcgaugagugugaaccugacgaggccccaggugcggaagaggucugcagagaguguggcuuuugcuacuguaggcggcaugcugaagcccaccgccagaaguuccucucccaucaccuugcagaguauguucaugggucucaagccuggacaccgcccgcugauggagaaggcgcagguaaagaggaggccgaagugaagguagagcaggaacgagagaucgaaucagaggcuggggaggaaagugagagcgaagaggaauccgagucugaggaagagucggaaacugaggaagagucagaggacgaaagcgaugaggaaagugaggaggacuccgaagaggaaauggaggaugaacaggagucugaggccgaagaggacaaccaggaagagggagaaagcgaggcggagggcgaaacggaggcagaauccgaguuugauccugaaauugagauggaggccgaacguguggcuaaaagaaagugcccagaccacggccuggauuugucaaccuacugucaagaggacaggcaguuaauaugcguccugugucccgugaucggggcccaccagggacaucagcuaaguacacucgaugaagcauucgaggagcugcggagcaaagacucugguggccuuaaggcugccaugauugaacugguugagcgcuugaaguuuaaauccucagacccuaaggugacuagagaucaaaugaaaauguucauccagcaggaauuuaagaaaguccagaaggugauugcggacgaggaacaaaaggcccuccaccugguagauauccaggaggcaauggcuaccgcccauguuacagagauacuggcugacauccagagccacauggauaggcucaugacccaaauggcccaggcaaaagaacaguuagacacaaguaaugagucugccgaaccaaaggcugagggggaugaagagggacccuccggcgcgagcgaggaagaggacacuuga

SEQ ID NO: 64221 - RNA, 1464 nt, Artificial Sequence
  derived and/or modified sequence opt3 from TRIM50__Homo_sapiens__NP_835226
auggccuggcaagugagccugcccgagcucgaagacagacuucagugcccuaucugucuggaggucuucaaggaaccauugauguuacagugcggccacuccuacuguaaagggugccugguuucucuaucaugucaucucgaugcugagcugaggugcccggugugucggcaggcaguagacggaaguagcucccuucccaacgugucucuggcccgcgucauugaagcguugcgacucccuggugauccagagcccaaggugugcguucaccaucguaauccucugucgcuguuuugugagaaagaccaggaacucauaugcggcuuaugugggcugcuuggaucacaccaacaucacccagugacccccgucagcacaguguauaguagaaugaaggaggaauuggcugcccugaucuccgagcuaaaacaggagcagaagaagguagaugaacucauugcaaaacugguuaacaauaggacucggaucgugaacgagucugacgucuucagcugggugauucgcagagaauuucaggagcuucaccaucugguggaugaagagaaggccaggugcuuggagggcaucggugggcacacgcggggacucgucgcuucccuggacaugcaauuagaacaggcacagggcacccgcgagcgacuggcccaggcugaaugcguucucgagcaauucggcaaugaagaucaucacaaauuuauaagaaaguuccacucaauggccaguagggcggagaugccucaggcacggccacuugagggggccuuuagcccgaucucuuucaaacccggacugcaucaggcugacauuaaguugacaguguggaagcgucuauuucgcaaaguacugccugccccagaaccccucaagcuggauccugcaacugcucacccacuucuggaguuguccaaagguaacaccgugguccaauguggccuccuggcccagagaagggcgucacagcccgaacgguucgacuacagcacaugcguguuagccagucgaggguuuucuuguggacgccauuauugggagguuguggucggcuccaagagcgauuggagacugggugugaucaaagggaccgcaucgaggaagggaaaacuaaaucggucuccggaacacggcguauggcucauuggccugaaggaggggcgcguuuacgaggcuuucgccugcccuagagugccccuuccagucgcuggacauccucacaggaucgguuuguaucugcacuacgaacagggcgagcucacauuuuucgacgccgaccgucccgaugaccugcggccacuuuauacuuuccaagcagauuuucaggggaagcuguaccccauauuggacaccuguuggcaugaacgaggauccaacucacucccuauggugcugccaccgcccaguggcccugguccauuaagccccgagcagccuacgaaacuguga

SEQ ID NO: 64222 - RNA, 2268 nt, Artificial Sequence
  derived and/or modified sequence opt3 from TRIM56__Homo_sapiens__NP_112223
auggugagccacggcuccucucccucacugcucgaggcccuuaguagcgacuuccuggcuugcaagaucuguuuggaacaguuaagagcaccuaaaacccugccaugccuacauacauacugucaagauugccucgcccagcuggcggacgggggaaggguccgguguccggagugccgcgaaacuguucccgugccuccagaggguguagcuuccuuuaagacgaacuucuuugugaauggccuucuggauuuggucaaagcccgagcauguggggaccuccgugccggaaagcccgcuugcgcacuguguccucuggugggcgguaccucuacagggggaccagccacugcuagaugccucgauugugccgacgauuuaugccaggcgugcgcagacggccacagguguacccggcagacacauacccaccgcguuguggaucuggucggcuauagagccgggugguacgacgaagaggcuagggagcggcaagccgcacagugcccccagcauccuggagaagcccuucgcuucuugugucagccaugcucgcaacugcuaugucgagagugcagacucgauccgcaccuggaccaccccugucuuccucuggcugaagcggugagggcccggcguccagguuuggagggccuccuggcagggguagauaacaauuuaguugagcuggaagcugcccgcagaguggagaaagaagcucucgccaggcuucgggagcaggcagcccgagucggaacucagguggaagaggcugcggagggcgugcugcgcgcauugcuagcccagaagcaagaaguccugggucagcucagagcucauguugaggccgcagaagaggccgcuagggaacggcuggccgagcuugaggggcgcgaacagguggcaagagcggcugccgcauuugccaggcguguacugucauugggacgggaggcugaaauucucagccuggagggcgccauagcacaacgauuaagacagcugcagggcugccccugggcuccugggccagcccccugucuacucccgcagcuggaacuucacccuggauugcuggacaagaacugccaucuccugaggcuuaguuucgaggagcaacagccccagaaagacgguggcaaggauggggcgggaacacagggcggugaagagucccaaucucgccgggaagacgagccaaaaaccgagagacaagggggcgugcagccucaggccggagauggcgcucagacgcccaaggaagagaaagcacagacuaccagggaagagggggcccagacacuggaagaggaccgcgcucagacuccacacgaggauggagguccccaaccucaccgaggcgggcggccaaauaagaagaaaaaguuuaaaggacguuugaaguccaucuccagagaaccgucacccgcccucggcccuaaccuggacgguaguggguuacugccaaggcccauuuucuauuguagcuuuccuacccgcaugccaggcgauaaacggucucccagaaucacaggacuaugcccguucggcccuagggagauucucgucgcagacgaacagaaucgagcgcugaagcgcuuuucccuuaacggggauuacaaaggaaccgugccaguucccgaggguugcucaccuuguagcguggccgcuuugcagagugccgucgcauucucugcuuccgcccggcuguaucucaucaaucccaacggcgaagugcaauggagaagggcacugagcuuaucgcaggccucucaugcuguagcggcccugccauccggggaccguguugcagugucagucgcuggacacguggaggucuacaauauggagggcagucuugccacgcgcuuuauaccuggugggaaggccagccggggcuugagagcucucguguuccugacuacaagcccccagggacauuucguuggcucugauuggcagcaaaacagcgugguaaucugcgacgggcuaggacaggucgugggcgaauauaaggguccagggcugcacggaugucagccgggcucaguuaguguggacaaaaaggguuacauuuuucucacccugagggaggucaauaaagugguaauccuugauccuaagggcuccuugcugggggacuucuuaacugcauaccauggacucgaaaaaccccgagugacaaccaugguugauggccgguaucuggucgugagccuuucuaacgggacgauucacaucuuucgcgugagaucaccagacaguuga

SEQ ID NO: 64223 - RNA, 1461 nt, Artificial Sequence
  derived and/or modified sequence opt3 from TRIM58__Homo_sapiens__NP_056246
auggccugggcucccccuggcgagagacugagggaagacgcacggugcccagugugucucgauuuccuucaggagccggucagcguugacugcgggcacuccuuuugucugcgcugcaucucugaguucugugagaagucagauggagcccaagguggcguguacgcgugcccccagugucgagggccuuuucguccaaguggauucagacccaacaggcaguuggcuggcuuaguagaaagcgugcggcgccugggucuaggggccggaccuggcgcaagaaggugcgcccggcauggcgaggaccucucccgcuuuugugaggaagaugaggcugcacugugcugggucugugacgccgggccagaacaccgaacccauagaacagcuccccuucaggaggccgcgggaucuuaucaagugaaacugcagauggcauuggagcucaugaggaaggaacuggaggaugcccugacucaggaagcuaauguugguaaaaagacggugauuuggaaagagaaggucgaaaugcagcggcaacguuuccgccucgaguuugagaagcacagaggcuucuuagcccaggaagaacagaggcagcugcggcgacuugaagcagaggaacgcgcuaccuugcaaagacugagggagucgaaaucacggcuagugcagcagagcaaggcccucaaagagcuggcggacgaacuucaagagcgcugccagagaccugcccugggguugcucgaaggaguaaggggcguucugagucguuccaaggcagugacacgguuagaggcugaaaacauaccaauggagcugaaaacugccugcuguaucccgggucgaagagagcuccuuaggaaguuucaggucgaugugaagcuggaccccgcuaccgcccauccuucuuugcuacugacagcagaucuccgcagcgugcaggacggggaaccauggcgggauguccccaauaacccugagagauucgacaccuggccaugcauucugggacuucaauccuuuucaaguggcaggcacuacugggaaguucuggugggcgagggggccgaguggggauuggguguaugucaggacacucucccccgcaaaggcgaaacaaccccgagcccugagaauggggugugggcucugugguuacugaagggaaacgaauauaugguccuagcgucucccuccgugccacuccugcagcuugagucaccucgaugcaucggcauuuucuuggauuacgaagccggugagaucagcuuuuauaauguuacggacgggaguuacauauauacuuucaaccagcuguucucuggccuccugcggcccuacuuuuucaucugugaugcaaccccacuuauucugcccccuacaacuaucgcuggauccggcaauugggccagccgugaccacuuggauccagcaucggacgugagagaugaccaucucuga

SEQ ID NO: 64224 - RNA, 1212 nt, Artificial Sequence
  derived and/or modified sequence opt3 from TRIM59__Homo_sapiens__NP_775107
augcacaacuucgaggaggaacugaccugccccaucuguuacagcauuuuugaagacccuagagugcucccaugcucccauacauucuguaggaauugccuugagaacauacugcaggccucuggcaauuuuuauaucuggcggccguugcgcauucccuuaaaguguccuaacugccgaucaaucacugaaauugcuccaacggggaucgagagucugcccgucaauuucgcacuacgugccauaaucgagaaauaccaacaggaagaucacccugacauuguuaccuguccagagcauuauagacagccccucaacguguacugccugcuugauaagaaacugguauguggacacugcuugacaaucggucagcaucacggccacccuauugacgaucuccaaagcgcguaucugaaggaaaaagacacuccacagaagcugcucgagcaguuaaccgauacacauuggaccgaccugacucaccuuaucgagaaguugaaagaacagaagucccauucugagaaaaugauacaaggggauaaggaagcugugcugcaguacuuuaaagagcuaaaugacacacucgaacagaagaagaaaucguuccugaccgcccuuugugaugucggaaaccugauuaaucaggaguauacgccgcaaaucgagaggaugaaggaaauucgggagcagcaguuggaacucauggcacugacuaucucauuacaagaggaaagcccccugaaauuucucgagaagguggacgauguucgccagcacgugcagauccuuaaacagagaccucugccagagguccaacccguggaaauuuacccuaggguaaguaagauauugaaagaggaauggucccggaccgagaucggccagauuaagaacguucuaaucccaaagaugaaaauaucucccaagcgcaugagcugcuccuggccggguaaagacgaaaaggagguggaguuccugaaaauucucaauaucgucguggugacacugaucucagucauucuuaugaguauccuguuuuucaaccagcacauuauaacuuucuugagcgaaaucacccucauuugguucucugaggccucccugucaguuuaccagagcuuaaguaauucucugcauaaggugaagaacauccuaugccacaucuuuuaucuccugaaagaauuuguauggaagauugugucccauuga

SEQ ID NO: 64225 - RNA, 1482 nt, Artificial Sequence
  derived and/or modified sequence opt3 from TRIM5__Homo_sapiens__NP_149023
auggccagcggcauccuggugaacgucaaggaggaaguuaccugccccauuugucucgagcuucugacacagccuuuguccuuagacugcgggcacucuuucugucaggcuugccugacugcaaaucauaaaaagucaaugcuagauaaaggagaaaguagcuguccagugugcagaauauccuaccaaccggagaacaucaggcccaaucggcacguagccaacauuguggaaaagcuccgcgaggucaaacugucuccugagggucagaagguggaccauugugcgcgacacggcgaaaaacuucuguuguuuugccaggaggaugggaaaguuaucuguuggcucugcgaacguucgcaagagcauagaggacaccacacguuccugaccgaggaaguggcuagggaguaucaggucaagcugcaggccgcacucgaaauguuacggcagaaacaacaggaggccgaggaacuggaggcugacauucgcgaagagaaggcaucauggaaaacacagauccaguacgauaagacuaaugugcuugccgacuuugaacaauugagagauauacuggacugggaggaaagcaacgagcuacagaaucucgagaaggaagaggaagauauccugaaaagucuuaccaacuccgagacagaaaugguacagcaaacccagucucugagggaguugauuagcgaccucgagcaucggcugcagggcuccguuauggaauuacugcaggguguggauggggucaucaagcgcacugagaaugugacacucaaaaagccagaaaccuuccccaaaaaccaacgaagaguguuuagggcuccugaccuuaagggaaugcuggaggucuuccgggaguugacggauguucgucgcuauuggguggacguaacuguggccccaaauaacauuucaugugcggucaucagugaagacaaaagacaggugagcucucccaagccucagauaauuuacggcgcaaggggcacccgguaucagacauuuguuaauuucaacuacugcacugggauccuaggaucccaaucaauuaccagcgguaagcacuauugggagguggaugucaguaaaaagacagccuggauccugggcgugugcgcuggguuucagccagacgccauguguaauaucgaaaagaacgagaacuaccagccgaaguacggauauuggguaauuggccucgaagaggguguuaaaugcucugcauuccaggauuccagcuuucauacccccucggugccuuucauagucccacugucugugaucauuugucccgaccgagucgggguguuucuugauuacgaggcuugcacgguuuccuucuucaauaucacuaaccacggauuucugauauauaaguucucacacuguaguuuuagccaaccuguguucccauacuugaauccccgcaagugcggcguaccgaugacacucuguuccccuucuagcuga

SEQ ID NO: 64226 - RNA, 1065 nt, Artificial Sequence
  derived and/or modified sequence opt3 from TRIM62__Homo_sapiens__XP_011540007
augcccgagaagaccgccguggaccagccuuggacacaagcucugagagaacucaaagaucagcuucaggcacugcaggacagcgagagggaacacacugaggccuugcaauuacugaagcggcagcuagcggaaacgaaauccucuaccaagucacuccgcacaacuaucggcgaggcuuucgagcgacugcaucgucuucugagagaaaggcagaaagccauguuggaggaacucgaggcagauaccgcccggacacugaccgacauugagcagaagguccaacgcuacagucagcagcugagaaagguucaggaaggggcucaaauacuccaggagagguuagcagaaacugaucggcacacauuucuggccggaguggcuagccuuuccgagcgcuugaaagguaagauccaugaaaccaaccugacguaugaggacuucccaacuucuaaauacaccggcccgcuacaguauacaauuuggaagucgcucuuucaagauauccaccccguaccugccgcgcugacucuugacccagggaccgcacaucagcgacugauuuugucagaugacugcacaaucguggccuacggaaaucuccacccccagccucugcaggauagcccaaaaagauucgacgucgaggugaguguuuuaggcuccgaggcuuuuucuagcggugugcacuauugggaagucgugguagccgaaaagacccaauggguuauagggcuggcacaugaggcugccuccaggaagggaucaauccagauucagcccagucggggcuucuacuguaucgugaugcacgauggcaaccaguauagcgcgugcacggaaccuuggacucgucucaauguccgcgacaaacuugacaagguggggguguuucuggauuacgaccaaggauugcuaauuuucuacaacgccgaugacaugucuuggcuguauacauuuagagagaaauucccagguaagcucuguuccuacuuuucaccgggccagagccaugcaaaugggaaaaacguccagccccugaggaucaauaccguucggauauga

SEQ ID NO: 64227 - RNA, 3651 nt, Artificial Sequence
  derived and/or modified sequence opt3 from TRIM66__Homo_sapiens__NP_055633
auggccagaaacugcagcgaguguaaggaaaagagggcugcacacauccugugcaccuacuguaaucgguggcucugcuccucuuguacagaggaacaucgccacucacccgugccuggagggccauucuuuccgcgagcccagaagggaagucccggugucaacggcgggccuggagacuucacucuuuauugcccacugcauacgcaagagguuuugaaauuauuuugugaaaccugcgauaugcugacaugucacagcugccuagugguagagcauaaggagcaccguuguagacacguggaagagguccuccagaaucagaggaugcugcuugaaggcgugacuacccagguugcgcauaaaaaguccucucugcaaacaucggcuaagcagauugaggaccggauauucgaggugaaacaccagcaucgcaaggucgaaaaccagaucaaaauggccaagaugguguugaugaaugagcucaacaaacaagcaaauggucugauugaggaacuggaagggaucaccaacgagagaaagaggaagcucgagcagcaguuacagucaauuaugguacugaaucggcaauuugaacacguucagaacuucaucaauugggccgugugcagcaaaacaaguguccccuuucuuuucuccaaggaguugauaguguuucagaugcaacgccugcuagaaacuucuugcaacaccgauccuggaagcccaugguccauccgauucacgugggagcccaauuuuuggacuaaacagcucgcuucacugggcuguauuaccacagaaggcgggcagaugaguagagcagacgccccugcuuacggaggucuucagggcagcucuccauucuaucaaucccaccagucaccgguggcccagcaggaggcgcugagccaucccagucacaaguuucaaucuccugcagucugcuccagcucgguuuguugcucucauuguuccccagugucacccaguuugaaagggcagguaccuccacccagcauccacccggcccauuccuucaggcagccucccgagauggugccacagcaacucggaucucugcagugcagcgcuuuacugccucgggaaaaggagcucgccuguucaccccacccacccaaacuucugcagccuugguuggaaacucagccaccggucgagcaagaaaguaccucccagcgucuaggccagcaacugacaagccagcccgugugcauuguuccuccacaggaugugcagcaaggugcacacgcucagcccacccuccagacgccuucuauccagguccaauucgggcaucaccagaagcugaaacuuucacauuuucagcagcaaccacagcagcaacugcccccgccuccacccccuuugccccacccaccucccccacucccgccucccccacagcagccccacccuccacugcccccuagucagcauuuagccagcucccaacacgagucuccgccaggacccgcguguucgcagaacauggacauaaugcaucacaaauucgagcuggaagagaugcagaaggaucuagaacuccugcuucaggcccaacagccuagcuugcagcugucccagacuaaaucaccacaacaucuccagcagacaauugugggccagaucaauuacauuguacgccaacccgcaccuguucagagucagucucaagaggagacccugcaggcuacugacgaaccgcccgccagccagggcuccaagccagcucuaccucuggauaaaaacacagccgcagccuugccccaggcuucaggggaggaaaccccacucagcgugccucccgucgacucuacgauccaacacuccaguccaaacguggucagaaagcacagcaccucucuguccaucaugggauuuucaaauacauuagagauggaacugaguagcacuaggcuagagcggccgcucgagccucagauucagucgguguccaaccugaccgcgggugcaccccaggccguuccaucucuuuugagcgcucccccuaagauggugucaagucugacauccguacaaaaucaggccaugccaucucucacuaccagccaucugcagacaguccccuccuuagugcacucaaccuuccagagcaugccuaaccugauaagugauucuccgcaagcaauggccucccuugcuagcgaccauccacaggccggccccucguugaugucagggcacacucaggcaguuccuucucucgcgacgugcccccugcaaaguaucccaccuguguccgauaugcagcccgaaacaggaagcucuagcuccucaggccgaaccagugguagccuauguccacgcgacggggcugacccuucucuggagaaugcccucugcaaagucaagcuggaggaaccgauuaaccuuuccgugaaaaagcccccauuggcaccuguagugucaaccaguacugcccugcagcaguaucaaaaucccaaagaaugcgagaacuuugagcagggcgcuuuagaacucgaugccaaggagaaucagagcaucagagcauucaacuccgaacauaagauaccauacguuaggcuggagcggcuuaaaauuugugcugccucuucgggagaaaugccugucuuuaagcugaaaccccagaagaaugaccaagauggcagcuucuugcucaucaucgagugcgggacagagucauccaguaugucuauuaaagugagccaggaccgccuguccgaagcgacccaggccccgggacuagaggguagaaaggugacugucacaucacuggcuggccagaggccaccugaaguugaggggacgucucccgaggaacaccgucucaucccacggacccccggagcaaagaaaggcccuccggcccccauugagaacgaagauuuuugugcugugugccugaaugguggggagcuuuuguguugcgaccgauguccaaagguguuccaccugagcugccauguaccugccuuacucaguuuucccggcggagaaugggucuguacucugugcagaucccuuacacaaccugagauggaguaugauugugaaaacgcaugcuacaaucagccaggcaugagggcgagccccgggcugucuauguacgaccagaaaaagugcgagaaacuugugcucucacuguguugcaacaacuugucccugccuuuccacgaaccaguuagucccuuagcccgccauuauuaccagauaaucaagcggccgauggaucucagcauuaucagaaggaaacugcaaaagaaggacccugcucacuauaccacaccagaggaaguggucucggaugugcgccuuauguuuuggaauugugccaaauucaacuaccccgacucugagguugcagaggcuggacgaugccuggaaguguucuuugaggguugguugaaggaaaucuauccugagaaacgguucgcccagccacgucaggaagacuccgauagcgaggagguaucaagugaaucuggcuguuccacuccccaaggguuuccguggccucccuacaugcaggagggcauucagccaaagagaaggcgccggcacauggaaaaugagagagcaaaaaggaugagcuuccgacucgccaacucaauaagucaggucuga

SEQ ID NO: 64228 - RNA, 789 nt, Artificial Sequence
  derived and/or modified sequence opt3 from TRIM68__Homo_sapiens__NP_001291425
augcagaagcuggagcucaaccacagcgaacuuauccaacagucccaggugcuguggagaaugauugccgaguugaaagaaaggucucagcggcccguccgcuggauguuacaagacauacaggagguucugaaucgaucaaagaguuggagccuacagcagccugaaccaaucucccucgagcugaaaaccgauugccgugugcuuggccugagagagauuuugaagacauacgcugcagacguaaggcucgauccggacacugccuauucucggcugaucgugucggaagaucgcaaaagaguccauuacggggacacgaaccaaaagcugcccgauaauccugagagguucuaucgguacaacauugugcucggaucacaguguaucagcaguggucgccacuauugggaaguugaggugggcgaccgauccgaguggggguuaggagucugcaagcagaauguggauagaaaagaaguaguuuaccugucuccacauuauggcuuuugggugauaaggcuucggaaggguaacgaguaccgugcggggaccgacgaauaccccaucuugagccugccugucccaccccgcagagugggaauuuucguggauuaugaggcucacgacaucuccuuuuacaaugucacagauuguggcucacauauuuucacuuuuccuagguauccauucccgggccggcuacuccccuacuuuaguccuugcuauagcaucgggaccaacaauacagccccacuggcaauauguucucuugacggagaagacuga

SEQ ID NO: 64229 - RNA, 891 nt, Artificial Sequence
  derived and/or modified sequence opt3 from TRIM69__Homo_sapiens__NP_001288073
auggaguuccugaagcuccaccaguuucuucauagcaaagaaaaggacauccugaccgaguugagagaagagggcaaagccuuaaacgaagagauggagcugaaucuaucccaacuccaggaacagugccugcuugcuaaggauaugcuggugucuauucaggcaaaaacagagcaacagaacucauucgacuuuuugaaggauauaacuacgcuccugcacagucuggaacaggggaugaagguccucgccaccagggaguuaaucagccggaaacugaaucuuggacaguacaagggucccauucaauauaugguuuggcgcgagaugcaggacacauuguguccuggccuguccccacuaacucucgauccgaaaaccgcgcaucccaaccuggugcuuucuaagucgcagacaucaguauggcacggggacaucaaaaagauuaugccugaugacccagaacgauucgauagcaguguggcuguccugggaucccguggcuuuaccucugguaagugguacugggagguggaaguugccaaaaagacuaaauggacagugggggucgugagagagagcaucauaaggaagggauccugccccuugaccccugaacagggcuucuggcuccugcgguuacgcaaucaaacggaccugaaagcacucgaucuuccaucauuuagucugacuuugaccaacaaucuagacaagguaggcaucuaucuggauuacgaagggggacagcucagcuucuauaacgccaaaacaaugacucauauuuacaccuuuucuaauacauucauggagaagcuguaucccuacuuuuguccuugccuuaacgacgguggcgagaauaaggagccacugcacaucuugcacccgcaguga

SEQ ID NO: 64230 - RNA, 2529 nt, Artificial Sequence
  derived and/or modified sequence opt3 from TRIM6-TRIM34__Homo_sapiens__NP_001003819
augugcggcagcgagagaauccugcaggccgggaacauucucgaaauaagggugggacaagcuggugcacggcgcgucgccaccaugacaucccccguucuuguggacauccgagaggaaguaacuuguccuauuugccuggaguuguuaacggaaccacugucuaucgauuguggccacucauucugccaggcguguauuaccccgaaugggcgugagagugugaucggacaggagggcgaaagaagcugccccgucugucagacauccuaccaaccugguaaccuaaggccaaaucggcaucucgcuaacauagugcgcagacugagggagguugugcuugggcccggaaagcagcugaaagccgucuugugcgcagaccacggcgaaaagcuccagcuguuuugucaggaggauggcaaagugaucugcuggcugugugagcggucucaagaacaucgcgggcaccauacuuuccucguagaggaaguugcccaggaguaucaggaaaaguuucaggagucgcugaaaaaguuaaagaaugaggaacaagaggcugaaaaacuuaccgcauucauucgagagaagaaaacaucauggaagaaccagauggaaccugagagaugcaggauccagaccgaguuuaaucaauugcggaacauucuggaccguguggaacagcgcgagcuaaagaaacucgaacaggaggaaaagaaaggacugagaaucauagaggaggccgaaaaugaucuuguccaccagacucaaagccugagggaguugauuagugaccucgaacggcgaugccaggguuccacaauggagcuguuacaggaugugucugacgugaccgagcgcagcgaguucuggacgcugagaaagccagaggcucuccccacuaaacuuagguccauguuucgggccccugaucugaagcgcauguugagagucuguagggaacuaaccgacguucagucauacugggcgauccaaggcagucugacacgucgggagagacgagcaagcggggugaggacucgccggucucagggauccucagccauggcuagcaaaauucuccugaacguacaggaagaggugaccugcccaaucugucuugagcuguugacagaaccgcucagucuggauugcggccacucuuuauguagagccugcaucaccgucuccaauaaggaggcagugacgagcaugggugggaaaucgucuugucccguuugcggaauuuccuauucauucgaacaucugcaggcuaaccaacaccuagccaauauaguggagaggcucaaggaagucaagcugaguccugacaacggcaaaaagcgcgaucuuugugaccaucacggcgagaaauugcugcucuuuugcaaggaggaccgaaaagugaucuguuggcugugcgaacggagccaggagcaccgugggcaucacacuguacuuacagaagagguuuucaaggaaugccaggagaagcugcaggcgguguugaaaagacucaagaaagaggaagaggaagccgagaagcuggaggcagauauuagggaagagaaaaccuccuggaaguaccaaguccagacugaacgccagcggauccaaacagaguuugaccaguuaagaucuauacugaauaacgaagaacagagggagcuacagcgacucgaagaggaagagaagaaaacccuggauaaguucgcugaagccgaggacgagcuugugcaacagaaacaguugguccgcgaacugauuagcgauguggagugucggucacaguggaguacgauggaacuccugcaagacauguccggaaucaugaaguggagcgagaucuggagacugaaaaagccaaagaugguuucuaaaaaguuaaaaaccguguuucaugcucccgaucuuucaaggauguugcagauguuccgugaacucacagccguacgcugcuauugggucgacgugacucugaacaguguuaaucuaaaccugaaucucgugcugagcgaggaucagcggcaggucauuuccgugccuaucuggccauuccaauguuacaacuaugguguacuuggcucucaguacuuuucgagcgggaagcacuacugggagguggacguuuccaaaaagaccgcauggauuuugggagucuauugcagaacauacucaaggcauaugaaauauguggugcgacggugugccaaucgccagaaccuguacacuaaguauagacccuuauucggcuacugggucauaggucuccaaaauaagugcaaauaugggguuuuugaagagagucugucuagcgauccggaagugcuuacccuguccauggcugugccucccuguaggguaggcgucuucuuggacuacgaggcgggaaucgugucauuuuucaacguuacaagccacggcucucucauuuacaaguuuuccaaaugcuguuucagucagccaguguauccuuacuuuaaucccuggaacugcccagcacccaugacccuguguccuccaagcucuuga

SEQ ID NO: 64231 - RNA, 2607 nt, Artificial Sequence
  derived and/or modified sequence opt3 from TRIM71__Homo_sapiens__NP_001034200
auggccagcuuccccgagaccgacuuucagaucugccugcucuguaaggaaaugugcggcuccccugcuccacuuucuucaaacaguagcgcauccucuucgucaagccaaacaaguacuuccucugggggagguggcgggggaccgggcgccgcggcuagaaggcugcacguguugcccuguuuacaugccuucugccggccuugucuggaggcacaccgccuaccagccgcuggugggggagcagccggcgaaccccucaaacugcgaugcccugucugugaucagaagguugugcuugcugaggccgcgggcauggacgcacugccaagcuccgccuuuuugcucucaaaucugcuggaugcuguaguggccacggcagacgaacccccuccaaagaacgggcgugcuggagccccggcgggugccggcgggcauaguaaucacagacaucacgcacaccaugcucaccccagggccagcgcuucugccccuccacucccccaggcaccucagccacccgccccgucccggucagcuccuggaggccccgcggcaagcccaagugccuuacugcuucgcagaccucaugguuguucuuccugcgaugaggggaacgcugccagcucgaggugcuuggacugucaagagcaccugugcgauaauugcguccgggcacaccagcgcgugcgacuaaccaaggaccauuacauugaaagaggacccccaggccccggcgccgcugccgcagcgcagcagcucgggcugggaccuccauucccgggucccccuuuuucuauacuuuccguuuucccagagaggcugggcuuuugucaacaccaugaugacgaaguguugcaccucuauugcgauacauguucaguccccaucugccgggaguguacuauggggcgucauggaggccacaguuucauuuaccugcaggaggcuuuacaggacagccgcgcccugaccauccagcuccuugcagaugcccaacaggguagacaggcuauucaacuguccaucgaacaggcccagacaguggcagagcagguagaaaugaaagcuaagguugugcaaucugaggucaaggccgugaccgcgaggcacaaaaaggccuuggaggagcgggagugcgaacuacuguggaaaguggagaagauacgacaggucaaagcuaagagccucuaucugcagguugaaaaacuucgccagaaccugaauaaauuggagucaacuaucagugcagugcaacagguacucgaagaggggagagcccuggacauuuuacuggcuagggaccggaugcuagcccaggugcaggagcucaagacaguccgcucccugcuucaaccucaggaagaugacagagugauguuuaccccacccgaucaggcauuguaccuggcgaucaagagcuucggcuuuguuucuucaggagccuucgcuccgcucacgaaggccacuggcgacgggcugaaaagggcacuucagggaaagguggcuaguuuuaccgucauugguuaugaucaugacggcgagccucgucugagcgggggagauuugauguccgccgugguacucggcccagacgguaaccuguucggggcagaaguuucugaucaacagaauggcacauacguggucucguaucggccccaguuagagggagaacaccuggugagcgucacucuauguaaccaacauaucgaaaauuccccuuucaaagugguugugaagucaggccgaaguuacguagggauaggacuccccggucugucuuuuggcagcgagggggacuccgauggaaaacuuugcagaccauggggcgucucaguggacaaagaagguuacauuaucguugccgacaggagcaacaaucgcauucagguguucaagccuuguggggcuuuucaccacaaauucggcaccuugggaucucggcccggccaguuugauagaccagcgggggucgccugcgacgcauccaggcgcaucgugguagcugauaaggacaaccaucgaauccagauuuucacauuugagggacaauuccugcucaaauuuggcgaaaaggguaccaagaaugggcaguucaacuauccgugggauguggccguuaacagugagggaaaaauacuggucagcgacacgcggaaucaccguauccaguuauuuggcccugaugguguguuccugaacaaguacggcuuugagggggcccuuuggaaacauuucgacucucccagaggaguggcuuucaaucacgaaggccauuuggucguuacugauuuuaacaaucacaggcuccuggugauucacccagacugucaguccgcacgcuuccuagggucagagggaacaggcaacggucaauuucugcggccccaggggguggccguagaucaggaaggaagaaucauagucgcggacaguaggaaucaucgagugcagauguucgagagcaacggcucguuucucugcaaguucggugcucaaggcuccggguuuggacagauggaucgcccuucuggcauugccaucaccccagacgggaugaucguuguggucgacuucggaaauaaccggauucugguguuuuga

SEQ ID NO: 64232 - RNA, 1434 nt, Artificial Sequence
  derived and/or modified sequence opt3 from TRIM72__Homo_sapiens__NP_001008275
augagcgccgcucccggccugcuccaccaggagcuuuccugcccucuguguuugcaauuauucgacgcaccagugaccgccgaaugcgggcauucuuuuuguagagcgugccugggaagggucgcuggugagccggccgcagauggcacaguucuaugucccugcugucaggccccuacucggccacaggcucucucaacgaaccugcagcuugcacgccugguggaaggguuggcccaaguaccccagggacacugcgaggaacaucucgacccucugaguaucuacugugagcaggaucgagcucuggugugcggcgucugugccagccucgguucccaccgugggcauagauuacugccagcggcagaggcccacgcuaggcuuaagacccaguugccccaacagaaacugcagcuacaggaagccugcaugcggaaggagaaaucuguggcaguucucgaacaccaacugguggaggucgaggaaacagugcgccaguucagaggagcuguaggcgagcagcuuggcaagaugaggguuuuucuggccgcguuggaagggucgcucgaccgggaggccgaacgcgugcgaggagaggcuggugucgcacugagaagggaguuaggcucacugaauagcuaucucgaacaacuucggcagauggagaaagugcuggaagagguggccgauaagccucagacugaguucuugaugaaguacugccuagucaccagucgucugcagaaaauucucgcugaauccccaccgcccgcccgccuggacauacaacuuccuaucauuucugaugacuuuaaguuccagguuuggagaaaaauguuuagggcacugaugccagccuuggaggaacucacauucgaucccagcuccgcucauccuucacuggugguaaguagcucugggcggcgaguggaguguuccgaacagaaggcgccacccgcaggagaggacccgcgccaguuugauaaagccgucgcugugguugcccaccaacaguuaucagaaggcgagcauuauugggagguggacgucggugauaagccuagaugggcacugggggugaucgccgcugaagcccccaggcggggacgccuacacgcaguaccaagccagggccucuggcugcuuggcuugagagaggggaagauucuggaagcgcacguugaggcuaaagagccuagggcccuccguagucccgaacggcgaccaaccagaaucggacuguaccuuucuuucggugacggcgugcuguccuuuuaugacgcaagcgaugccgacgcuuuggucccccucuucgccuuucaugagaggcugccucgcccaguguacccguucuucgaugucugcuggcacgacaaggggaaaaacgcacagcccuuacugcuagugggaccugaaggcgcugaggccuga

SEQ ID NO: 64233 - RNA, 753 nt, Artificial Sequence
  derived and/or modified sequence opt3 from TRIM73__Homo_sapiens__NP_944606
auggccuggcaagugagccugcucgaacuugaagacagacugcagugccccaucuguuuggaggucuucaaggaauccuuaaugcugcagugcggccacucuuacuguaaagggugccuaguuucacucaguuaucaucuggauaccaaggugagguguccuaugugcuggcagguaguggacggaagcuccucucuuccaaacgucucgcuggcuugggugauugaggcauugcggcucccgggugaucccgaaccuaaaguuugugugcaccaucgcaauccacugucacuguuuugcgagaaggaccaggagcucauauguggcuuaugcgggcugcuuggaagccaccaacaucaccccgucacaccugugaguacuguauguucccgaaugaaagaagaguuggccgcgcuguucucugaacuaaagcaggagcagaagaaaguugaugagcucaucgcuaagcuggugaaaaaccguacgagaauugucaaugaaagcgacguguuuuccugggugaucaggcgggaguuccaggaacuucgccacccagucgaugaggaaaaggccagaugccuggagggcauuggugggcauaccaggggauugguugcaucacucgacaugcaacuggagcaggcccagggcacacgggaacgcuuagcucaggcagagugcgugcuggaacaauuuggcaacgaggaucaccaugaguucaucuggaaauuucacaguauggccagccgauga

SEQ ID NO: 64234 - RNA, 750 nt, Artificial Sequence
  derived and/or modified sequence opt3 from TRIM74__Homo_sapiens__XP_011514491
auggccuggcaagugagccugcucgaacuugaagacuggcugcagugccccaucuguuuggaggucuucaaggaauccuuaaugcugcagugcggccacucuuacuguaaagggugccuaguuucacucaguuaucaucuggauaccaaggugagauguccuaugugcuggcagguaguggacggaagcuccucucuuccaaacgucucgcuggcuugggugauugaggcauugaggcucccgggugaucccgaaccuaaaguuugugugcaccaucggaauccacugucacuguuuugcgagaaggaccaggagcucauauguggcuuaugcgggcugcuuggaagccaccaacaucaccccgucacaccugugaguacuguauguucccgcaugaaagaagaguuggccgcgcuguucucugaacuaaagcaggagcagaagaaaguugaugagcucaucgcuaagcuggugaaaaaccgaacgcguauugucaaugaaagcgacguguuuuccugggugaucagaagggaguuccaggaacuucggcacccagucgaugaggaaaaggcccgcugccuggagggcauuggugggcauaccagaggauugguugcaucacucgacaugcaacuggagcaggcccagggcacaagggaacgguuagcucaggcagagugcgugcuggaacaauuuggcaacgaggaucaccaugaguucaucugguuucacaguauggccagccgcuga

SEQ ID NO: 64235 - RNA, 1656 nt, Artificial Sequence
  derived and/or modified sequence opt3 from TRIM8__Homo_sapiens__NP_112174
auggccgagaacuggaagaauugcuucgaagaggaacugaucugucccauuugccuccacguguuugucgagccuguucagcuuccauguaaacauaacuucugcagaggcuguauaggggaggcuugggcaaaggacagcggacuggugaggugcccggaauguaaucaagccuacaaccagaaacccgguuuggagaagaauuuaaaacugaccaacaucguagaaaaguuuaaugcgcuacacguggagaagccuccagcugcccuccauugcgucuucugucggcgcgggcccccucugccagcacagaaagugugccuucgaugugaagcccccugcugccagucccacguucaaacacaucugcagcagccuucuacugcucguggccacuugcucguggaggcagaugacgucagagccuggucauguccacagcacaacgcuuauaggcuguaccauugcgaggccgaacaaguggcgguaugucaguauugcuguuacuauaguggagcacaccagggccauagcguuugcgauguggagauucggcgcaaugaaaucagaaagaugcugaugaaacagcaagacaggcucgaggaacgggagcaggauauugaggaccaguuauacaagcuggaauccgauaaacgccuugucgaggaaaaggugaaccaauugaaggaggaagugcgacugcaguaugagaaacuacaccagcuccuggacgaggaucuuagacagacggucgaaguucuggacaaggcccaagcuaaauuuuguucugagaaugccgcacaggcuuugcaccucggugaaaggaugcaggaggccaagaaacuguuagggucgcugcagcuccuuuucgauaagaccgaagacgugucauuuaugaaaaacacaaagagcguaaagauccugauggaucggacucaaaccugcacaaguuccucuuugagcccgaccaaaauaggacaucuaaauuccaagcuguuccucaacgagguggcgaaaaaggagaaacagcugcguaagaugcuugaaggccccuuuucaacuccugucccauuccugcagagugugcccuuguacccuuguggcguuucuagcuccggggccgagaagcgcaaacacucaacagcauuuccagaagcuagcuuccucgagaccaguucuggacccguggguggccaguacggggccgcuggaacggccuccggcgagggucaaagcgggcagccgcugggaccuugcucgucuacucagcauuuagucgcacugcccggcggcgcccagccagugcacuccucaccuguauuucccccaagucaauaucccaaugggagcgcugcgcagcagccuaugcuaccacaauacggagguagaaagauccucguuuguuccguggacaacugcuauugcucuagcgucgcaaaccauggcgggcaccagccguaccccaggucaggacacuucccuuggaccgugccaagucaggaauauucccauccccugccuccaacacccagcgucccgcagucucuuccuucauuggccgugcgggacuggcuggaugcuagucaacagccaggccaccaggacuucuaccgaguuuauggucagcccagcacuaaacauuacgugaccuccuga

SEQ ID NO: 64236 - RNA, 2133 nt, Artificial Sequence
  derived and/or modified sequence opt3 from TRIM9__Homo_sapiens__NP_055978
auggaggaaauggaggaggaacugaagugccccgugugcggcagcuucuacagagaaccuaucauucucccaugcucccacaaccuuugucaggccugcgcuaggaauauacugguccaaaccccggagucugagucaccccagagucaucgggcagccgggagcggaguuuccgacuaugauuacuuggacuuagauaaaaugucucuguauucggaagcggacucagguuacggcagcuaugggggauuugcuagugccccuacaacuccaugucagaagucccccaacggcgugcgcguauucccuccagcaaugcccccuccagccacgcaccuaucuccggcucucgcacccgugccucgaaauagcugcaucaccuguccacagugccaucguucccugauucuugaugacagaggucugaggggguuucccaaaaaccgggucuuggagggagugaucgaucgcuaccaacagucaaaggccgcugcccucaaaugucagcugugcgaaaaggcgccuaaggaggcaacaguuaugugugagcagugcgacguguucuauugcgauccauguagacugaggugccaucccccgcggggcccucucgccaaacaccgcuuagugcccccagcucaaggccgagucaguagaaggcugagcccucggaagguaucuacuuguaccgaccacgaacuugagaaucacuccauguacugcguucaguguaaaaugcccgugugcuaccaguguuuggaagaggggaagcauucaagccacgaagucaaagcccugggagcaauguggaagcuacauaagagucagcucucucaagcucugaacggucuuuccgaucgugccaaagaggcgaaggaguuucuggugcaguugcgcaauauggugcagcaaauucaggaaaacagcgucgaguucgaagccugccucguugcacagugugacgcucugaucgaugccuuaaauagaaggaaagcucagcugcucgcccgggugaacaaggagcacgaacacaaacuuaagguagugcgagaccaaauaucgcauugcacagucaaacugcgccagaccacuggcuugauggaguauugucuagaggugaucaaggaaaaugacccaucuggguuucugcagauuuccgaugcacucaucagaaggguucaccugacagaggaccaguggggaaagggcacccuuacgccccggaugacuaccgauuucgaccugucauuggauaacaguccucuccugcaaagcauucaucaguuagacuuugugcaggucaaagccuccucuccagugccggcuacacccauccugcagcuagaagagugcugcacucacaauaacagcgcgacccucucauggaagcaaccuccacugaguacaguacccgcagaugguuacauacuugaauuggacgaugggaauggaggccaguuccgcgagguuuaugugggcaaagagaccauguguacggucgacgggcugcauuuuaacuccacuuacaacgccagagugaaggcuuucaauaaaacaggagucagcccuuauucuaagacccucgugcugcagacuucagaaguugccugguuugcauucgauccagguagugcccacagcgacauuauccuuuccaacgacaaucugacagugaccuguucuucguacgaugacaggguagucuugggcaagacgggguucagcaaaggcauucacuauugggagcucaccguggaucguuacgacaaccaucccgauccggcuuuuggaguugcccggauggacgugaugaaggaugucaugcuggguaaagacgauaaggcaugggcgauguacguggacaauaaccgauccugguucaugcacaauaacucacauacaaauagaacugaagggggcaucaccaaaggagcuacaaucggcguauuacuggaucuaaacaggaagaaucucaccuuuuucauuaacgacgagcagcaagggccuauagccuuugauaauguggagggacuguucuuuccagcaguuagucuuaaccgcaauguccaggugacuuugcacacaggucugcccgugccugacuucuauucuagccgggccuccaucgcuuga

SEQ ID NO: 64237 - RNA, 7098 nt, Artificial Sequence
  derived and/or modified sequence opt3 from TRIOBP__Homo_sapiens__NP_001034230
auggaggaagugcccggcgacgcccugugcgagcacuucgaagcuaacauccucacccagaauagaugucaaaacugcuuucauccugaggaagcccacggggccagguaccaggagcuucggagcccauccggggcggaggucccguauugugaucugccccgcugcccuccagcucccgaagacccuuugucugccucaacgagugguugucagagcguuguggauccaggcuuacgacccgggccuaaacguggaccauccccgucugcuggccugcccgaggaagguccuacugccgcuccaagaucgaggucacgggagcuagaggcaguacccuaccucgaagggcugacuaccagccuuugcggaaguuguaaugaggacccuggcuccgauccaacaucuagccccgacuccgccacuccggaugacaccucaaacaguagcucuguggauugggacacagucgaacgccaggaggaagaggcuccuuccugggaugagcuggccgugaugauucccagaaggccacgggaaggcccucgcgcggacucaagccaacgagcacccaguuugcucaccagaucuccaguugggggagaugccgcuggucagaaaaaggaggacacuggcgggggaggcagguccgccggucagcauugggcacggcugcguggggaaagcggacugucgcucgagcgccacagaucuacauuaacccaggcuuccucaaugacgccccauaguggcccuaggagcacuaccucccaagccucuccagcgcagcgggacacagcccaggcagcuagcacucgagaaaucccgcgcgccucaaguccccacagaaucacccagagggauacaucccgggcuagcucuacccaacaggagauuucacgcgccaguagcacgcagcaagagacuuccagagcaucuucgacacaggaagacaccccuagggccagcuccacucaggaggauacaccacgugcuucaaguacccaguggaauacgccccgggcgucuagcccuucccgaucaacccaacuggacaacccaagaacaagcucuacucagcaggauaauccccagaccuccuucccgacaugcacuccucaaagggaaaacccacgcacccccugugugcagcaggacgauccucgggcaaguagccccaauagaacaacccagagggagaacucucgcacuuccugcgcccaacgagacaauccaaaggcuucacggacgaguagcccuaaccgugccacaagagauaaucccaggaccucgugugcacagcgcgacaacccacgggccuccucuccgagcagagcuacuagggauaauccuaccacaucaugcgcccagcgagacaacccccgcgcaagucggaccuccucuccaaacagagcgacuagggacaauccccguacaagcugcgcucagcgcgauaacccucgggccuccucaccaagcagagcaacgagggacaaucccaccacaagcugugcccaacgagauaacccucgggcuucucgcacauccagcccgaauagagccaccagggacaacccacggacaucgugcgcacagcgagauaaucccagagcuucaucuccuaaccgcgccgcgagggacaauccaacuaccaguugugcccagcgugauaacccccgggcuuccagaacgagcucuccuaauagggcaacccgcgacaacccgcgaacaagcugcgcccaaagagauaauccccgggcuuccucaccaaacagggccacucgcgacaauccuaccacaaguugugcacagcgugauaaccccagagcgagccggacuucuuccccaaacagggccacccgcgacaauccucgaacgucaugcgcucagagagauaacccccgggccaguagcccaaauaggacaacccagcaagacuccccgcgcacuucuugugcaagaagggacgauccucgggcuucgagccccaaccguacaauccagcaggaaaauccacgcaccucaugcgcccuucgagacaaccccagagcauccaguccuucuaggacuauucagcaagagaauccacggaccagcugugcccagcgcgaugaccccagagcuuccucaccuaacaggacaacgcagcaggagaauccgcggaccucuugcgcgcgaagagauaacccacgcgccagcaguaggaaucggacuauccaacgugacaaccccagaacauccugugcacagagggauaauccucgcgcuagcucucccaaccggaccauacagcaagaaaauuugcgaacaucaugcacuagacaggacaacccaaggaccuccaguccuaaccgcgccacgcgggauaaucccagaacaagcugcgcccagcgugacaaccugagggcuucgucuccaauccgggcaacccagcaagauaauccucgcacuuguauucagcagaacaucccgcgauccagcucaacccagcaagacaaucccaagacaaguugcacuaaaagagauaaccuaaggccaaccuguacacagcgggaccgcacgcagucuuuuuccuuccagagagacaauccuggcaccagcucaagucaaugcuguacucagaaggagaaccucaggcccagcuccccacaccgaucuacacaguggaauaacccucggaauagcagcccccaccguaccaacaaggauauuccgugggccucauuuccacugagaccuacucagucugacgggccccgcacaaguucgccaagcagguccaaacaaucugaaguccccugggcgucaaucgcacuucggccuacccagggagauagaccgcagacgagcucccccagucgcccagcccaacacgacccuccccagucuagcuucgguccuacucaguauaaucugccaucaagggcaaccuccaguagccauaaccccggccaccagucuacaucccgaaccucaagcccuguguacccagccgcuuauggggcacccuugacuucgccggagccuucucaaccacccugcgccguauguauaggacaccgggaugcgccuagagcuaguuccccacccagguaccuccagcaugacccguuuccuuucuuucccgagccacgcgccccugaaagcgagcccccacaccaugaacccccuuauauuccaccggcaguuugcaucggccaccgugaugcaccccgggcuucauccccuccaagacauacacaguucgaccccuuuccuuuccugccagauaccucugacgccgagcaccagugucaaagcccccagcacgaaccuuuacagcugccggcaccagugugcauugguuacagggaugcuccccgcgccaguuccccuccccgacaggcgccagagccuagccuccuuuuucaagaccugccccgggccucuacagagucauuggucccaaguauggacucccuacaugaauguccgcacaucccuacucccgugugcaucgggcauagagaugcaccauccuucucuucgcccccuaggcaggcuccagagcccucacuguucuuucaggacccuccgggcaccagcauggaaucccucgccccaaguacggauucucugcacggaagccccgugcuuauuccucaagucugcauaggccaccgcgacgcuccaagagcauccucacccccucggcaucccccaagugaucuggccuucuuggccccgucuccuagccccggguccucaggagguagcaggggcucugcuccaccuggggagacacgucacaaucucgaacgagaggaguacaccguucuggcggacuuacccccaccucgcagacuggcacagcggcagcccggaccgcaggcccaauguuccaguggcgguaggacucauagcccagggcgcgcugaaguggagagacuauuuggccaggaacggaggaagucggaggccgcaggagccuuccaggcucaggaugaaggccgaucccaacagccuucucaggggcagucacaacuccugcguagacagagcagucccgcgccaucccgccagguaaccaugcuucccgccaaacaggcagaguugacacggaggucucaagcugagccuccgcacccauggagccccgaaaagagaccugagggagaccgccagcugcaggguucaccccucccaccucggacuuccgccaggacccccgaacgagagcugagaacgcaacggccacuugagaguggccaggcagggccuaggcagccgcugggaguguggcagagccaagaggaacccccaggcucucaggguccucaucgccacuuggaacguucaugguccagccaggaagggggccucggacccggcgggugguggggaugcggcgaaccaucucugggugccgcuaaagccccugagggggcguggggaggcacaaguagagaguauaaggaaucguggggucagcccgaggcaugggaagagaagccgacccacgaauuaccacgagagcugggcaaaagguccccucuaacaagucccccagagaacuggggaggacccgccgaaucaucucaaagcuggcauuccggcacuccuaccgcugucggguggggagccgagggcgcuugucccuacccacgggguagugaacgcagaccugagcucgauuggagggaccugcuuggguugcugcgggcaccgggagaaggcgugugggcccgcguucccucacucgauugggagggucuguuagagcugcuucaggcuagauugccacgaaaggacccugccggccacagggaugaccucgcacgggcgcuggggcccgaacuaggaccaccuggcacuaacgacgugcccgagcaggaaucucauagccagccggaggggugggccgaggcuacaccugucaauggacacuccccagcccugcaaagucagagccccgugcagcucccuuccccagcaugcaccucuacgcaauggcccaaaaucaagguaacucguggcccugcuaccgccacacuggcaggucuugaacagaccgggccauugggaucacgcagcacagccaaaggccccucgcugccggaguuacaguuucagccugaggaacccgaagaguccgagccaaguagaggucaagauccccucacugaccagaagcaggcugauucugcggacaaaaggccugccgaaggcaaggcagggagcccacugaagggacggcuuguuaccucauggagaaugcccggcgaucgcccuacgcuguucaacccauuuuugcucucccugggggugcuacgauggaggcggccggaccugcucaauuucaaaaagggauggaugucuauucuggaugagcccggcgaaccuccaagucccagccuuacaacuaccuccacaucacaguggaaaaagcauugguuugucuugaccgacagcucucugaaauauuacagagauaguacugcugaggaagccgacgaguuagauggugagaucgaccuccguuccuguaccgaugugacagaauaugccguccaacgcaacuacggguuccagauacacacgaaggacgcaguguauacucugagcgcuaugaccucaggaauuaggcggaauuggaucgaggcccuuagaaagacaguucgaccuaccucugcgccagacgugacuaaacuguccgauucgaacaaggaaaaugcucuacacagcuacaguacacagaaaggcccccucaaggccggcgagcagagggcagggucugaaguaaucucccgcggagguccgcggaaagccgacggccaaagacaggcucuggauuacgucgaguugagcccucugacccaggcaucaccacaaagggcccgcacgcccgcgcguacuccugaccgguuagcuaagcaggaggaacucgagagagaucuggcccagcgaagugaagagaggcgcaagugguuugaggcaacagacucccggacccccgaagugccagccggggagggaccgagaaggggccuuggugcuccucugaccgaagaucagcaaaaccgcuugagcgaggaaauugagaaaaaguggcaggagcucgaaaaacugccccuaagagagaauaagcggguuccacugacugcccuucucaaccagucucgaggggaaaggcguggacccccuucagacggccaugaggcacuggaaaaagaggugcaggcuuugagagcccaacuggaggcguggcgguuacagggcgaagccccacagagcgcacuccgcucccaggaggaugggcacauacccccuggauauauuucucaagaggcuugcgagaggagucuggccgaaauggagucgagccaucagcaggucauggaggaacuucagcgacaccacgagagagaacugcaacgguugcagcaggagaaggaguggcuccuggcagaagagacagcugccaccgccuccgcgauagaagcuaugaagaaagcauaccaagaggaacuaucacgcgagcugucuaagacaaggagccuucagcaggguccagacggccucagaaaacagcaucaaagugauguggaggcccugaagcgggaauugcagguauuauccgagcaguauucacagaaaugucuggaaaucggggcucucaugcgucaagccgaggaacgcgagcacacucugaggcgaugccagcaggagggacaggaacuucugagacauaaucaagaguugcacggccggcuaucugaagagauugaccagcugagggguuucaucgcaagccaggggaugggaaacggcuguggccgcuccaaugaaagaaguagcugcgagcucgaggugcugcuucggguuaaggaaaacgaguuacaauaccugaaaaaggaaguccagugucucagggacgaguugcagaugaugcagaaggauaaacgcuuuacgucugggaaguaucaagacguguacguggagcugucacauaucaaaacccgauccgaaagagagauugaacagcucaaggagcaucugcgucuugccauggcugcgcugcaggaaaaagagagcaugcggaauaguuuggccgaguga

SEQ ID NO: 64238 - RNA, 9294 nt, Artificial Sequence
  derived and/or modified sequence opt3 from TRIO__Homo_sapiens__NP_009049
augagcggauccucugggggagccgcugcacccgccgcgucaagcgguccugcugccgcagccagcgcugcaggcuccgggugcggaggcggugccggggaaggagcugaagaagccgcgaaggaccuggcagauaucgccgcuuucuuuagaucuggcuucaggaaaaacgacgaaaugaaggccauggaugugcucccaauucuuaaagagaaggucgcauaccugucgggcgggcgggacaaacgcggagguccgauauugaccuuucccgcucgaucaaaucacgaucguaucagacaggaagacuuaaggcggcugauuagcuaucuagccuguaucccuagcgaggagguuugcaagcgcggcuucacagugauuguagauaugagaggguccaagugggacucuaucaaaccacuccugaagauacuucaagagagcuuucccuguugcauccauguggcgcugauuaucaaaccugauaacuucuggcagaagcagaggacuaauuuuggauccucaaaauucgaguuugaaacgaacauggucaguuuggagggccucaccaaggugguugacccaagccagcugacacccgaguucgaugguugucuggaauacaaucacgaggaauggauugagauccggguggccuuugaagacuauauaucuaacgcaacucauaugcucucccgcuuagaggagcugcaagauauucuugcuaagaaagaauugccucaggaccuggagggggcccgaaauaugaucgaagaacacucacagcuaaagaaaaaggucauuaaagcuccaaucgaagaccucgaucuggagggacagaaacuucugcaaagaauccagagcagugagucuuucccgaaaaagaacuccggcagcggcaaugccgacuugcagaaccuccugcccaaggugucgaccauguuagauaggcugcauucuacacggcagcaccuccaccaaauguggcauguacguaaacuuaagcuggaccagugcuuucaguugcgccuauucgaacaagaugcagagaaaauguucgacuggauuacccacaauaaggggcuguuucucaacuccuacacugaaauaggaacaucacauccucacgccauggagcugcagacccagcacaaucauuucgcuaugaacuguaugaauguuuaugugaacaucaacagaauuaugagugucgcgaauaggcuuguggaaagcggucacuacgcaucccagcaaauccggcagauagccucucagcuggagcaggaguggaaggcuuuugccgcagccuuggaugaacgaagcacgcuccuggacaugucaaguauuuuccaucaaaaggcugagaaguauauguccaacguggauagcuggugcaaagccuguggcgaagucgacuuaccaucugagcugcaggaucuagaggacgcaauccaccaucaccaggggaucuacgaacacauuacucucgcguacucagagguuagucaggacggaaagagccugcuugauaaauugcaacgcccccugaccccuggcuccucugacucgcucacagcuagcgccaauuauuccaaggcagugcaucacguacuggaugugauccaugaaguccuucaccaccagagacagcuggagaacauuuggcagcauaggaaagugcgguugcaccaacgccuccagcugugcguuuuucagcaagacgugcagcaggucuuagauuggauagaaaaucauggugaggccuuccugucaaagcacacuggggugggcaagagucuacauagagcuagggcccuccagaaacgucacgaggacuuugaagagguagcacaaaacaccuacacaaaugcugauaagcugcuugaagccgcggagcaguuggcccagaccggagaaugugacccagaggagaucuaucaggcugcacaccaacuggaagaucggauucaggacuucguucgaagaguggagcagaggaaaauccuccuggauaugucugucagcuuucauacgcacgugaaggaauuauggacuuggcuggaggaacuucagaaagaguugcucgacgaugucuacgccgaguccguggaagcuguucaagaccugaucaagcgcuucggccagcagcaacagacaacccuacaggugacuguaaacgucauuaaggagggggaagaccugauacagcaacuccgggauucagccaucagcucuaauaaaacaccccauaacuccaguauuaaucacaucgagaccgugcugcagcagcuugacgaggcacagagccaaauggaagaguuguuucaggaaagaaagauuaaacuggaguuauuccuccagcugaggaucuuugaacgcgaugcgauagacaucauuucugaucuugaguccuggaacgacgagcugucacagcaaaugaaugauuucgacacggaagauuugaccaucgccgagcagcgacuccagcaucacgcugacaaggcccugacaaugaacaaucuaacuuucgauguuauucaccagggacaagaccugcuccaguaugugaacgaaguccaggcaagugguguggagcugcuuugcgaucgggacguagacauggcuacccgugugcaagauuugcuggaauuuuuacaugagaaacagcaggagcucgaccuggccgcagaacagcacagaaagcaucuugagcaaugcguucagcugaggcaccuacaggccgaagucaaacaggugcucggcuggauccgcaacggggagagcaugcugaaugcuggauugauaacagcgucgucccugcaagaagccgagcaguuacagcgggagcacgaacaguuccaacaugcaauugagaagacucaccagucugcucuccaggugcaacagaaggccgaagccaugcugcaggcuaaccauuacgauauggacaugaucagagauugugcagagaaagucgccagccacuggcagcaacuuaugcugaagauggaggacagguugaaacucguuaaugcgucaguggcuuuuuauaagaccagugaacaggugugcuccguacuggagucucuagaacaggaguacaaacgagaagaggauugguguggcggugccgacaagcuggggccgaacagcgagacagaucaugucaccccuaugauuuccaagcaccuugaacagaaagaggcauuccucaaggccugcacucuggcucgccggaaugcagacguguuuuugaaauaccugcacagaaacucaguuaauaugcccggcauggugacgcauaucaaggccccagaacaacaggucaaaaacauauuaaaugaacucuuccagagggaaaaccgugugcugcacuauuggacaaugcgcaagcggagacuugaucagugucaacaguacguuguguuugagaggagcgcgaagcaggcucuggaguggauccaugacaauggagaguucuauuugaguacccacacuucuaccggcuccagcauucagcacacacaagagcuccugaaagaacaugaggaauuucagaucaccgccaagcagacuaaagagcgaguaaagcuacugauucaacuugcagacggguucugcgagaaaggacacgcccaugcugccgaaaucaagaagugugucacagcaguggauaaacgguaccgcgacuuuucgcucagaauggagaaguauaggacgucacuggaaaaggcuuuggguauaucuagugauuccaacaagagcucuaagagcuuacagcuggacauuaucccugccuccauccccggcucagaggugaagcuccgggaugcggcccacgagcugaaugaagagaaacgaaagagugcaagacgcaaggaguucauuauggcugaacuuauccagaccgaaaaagccuacgucagggaccugcgugagugcauggauacuuauuugugggagaugacaagcgggguugaagagauuccacccggaauagugaacaaggaacuaaucauuuuuggcaauaugcaggagaucuacgaguuccauaacaacauuuuccugaaagagcucgagaaguacgaacaacugccugaggacguaggucacuguuuugugaccugggcugauaaauuccagauguaugucacauacugcaagaauaagccagacucuacucagcuuaucuuagaacacgcaggguccuauuuugaugagauacagcaacggcauggccuggccaacucaaucaguagcuaccucauuaaaccggugcagagaaucaccaaguaucaguugcugcucaaagaacugcuuacguguugcgaggagggaaagggcgaaauuaaagacgggcuggagguuauguuguccgugcccaagagggccaaugaugcuaugcaccuaucuaugcuggaaggauucgacgagaacaucgagucgcagggcgaacucauauuacaagagagcuuucaggucugggacccuaagacccugauucgcaaaggucgagaaagacaucuuuuccuguuugagaugucacucguguucuccaaggaaguuaaagauaguucugggcggagcaaguacuuguauaaauccaagcuguuuacaucagagcucggagugacugagcacgucgaaggcgacccaugcaaguucgcgcuguggguagguaggacccccacaucugauaauaaaaucgugcuuaaggcaagcaguaucgagaacaaacaggacuggauuaagcacauacgcgaaguuauccaagagcguacuauucaucuaaaaggcgcccugaaggaaccuauccacauuccaaagaccgcucccgccacgagacagaaagggcggagggauggagaggacuuggauucccagggcgacgggagcucucagccggauacaaucucaauagcaucccgcaccagucaaaauacuuuagacagcgauaagcugucgggaggcugugagcucacaguggucauccaugacuuuaccgccugcaacucuaaugaacugacuauucgaagaggucagaccguggagguacuugaacggccucacgauaaaccagacuggugucuggugaggacaacggaccgcucccccgcugcggaggggcucgucccuugcggcagcuuguguaucgcccauucaagaaguucuauggaaauggagggcauuuucaaccacaaggauucccugagcguuucaaguaaugacgcaagucccccagcuuccguggccucucuacagccucacaugaucggugcacagagcucccccggcccaaaaaggccggggaacacccugcggaaguggcucacuucaccugugcgucgccuuucuaguggaaaagccgauggccaugucaagaagcuggcucacaaacauaagaaaucgcgagaggugagaaagagcgccgacgcggggucccaaaaagauucugacgauucagcagccacaccccaggacgaaaccguugaggaaaggggacggaaugagggcuuaagcuccgguacauugaguaagucuagcucauccgggaugcagaguugcggagaggaagagggcgaagagggugcugaugccguaccacugcccccuccaauggcuauacagcaacacagccuccugcagcccgacucucaggaugacaaggcauccucacgccuucuggugagaccuacuagcucggaaaccccgucugccgcugagcucgucagugccauugaggaauuggugaaauccaagauggcacuggaggacaggccaagcucacuauuaguugaucaaggcgacuccucuagccccaguuucaacccuuccgauaauagccugcucucuucaaguuccccaaucgacgaaauggaggaacggaaaaguucuucgcuuaagcgaagacauuacgugcugcaggaguuggucgagacggaacgcgauuacgugagggaccugggguauguagucgagggauacauggcgcucaugaaagaagauggcgugcccgacgauaugaaggggaaggacaaaaucguuuuuggaaacauucaccagaucuaugauuggcaccgggacuucuuucugggcgagcuugaaaagugucucgaggauccugagaaacuggguucauuguucgugaagcaugaacguagacugcacauguacauagccuauugccagaacaaaccgaaaagcgagcauauugucuccgaauacaucgacacauuuuucgaggacuuaaagcaaaggcuagggcaccgccugcagcucaccgaucuucugauuaaacccgugcagcggaucaugaaguaucaguugcugcucaaagacuuucugaaguacaguaaaaaggcuucucuugauacuagcgaguuagaacgagccguugaggugauguguauagucccaagaaggugcaaugacaugaugaacgugggacgccugcaaggcuucgauggcaaaauuguagcacaggggaagcucuugcugcaggacaccuuucuagugacagaucaggacgcuggacugcucccucgguguagagaacguaggaucuuccuuuuugagcaaaucguuauuuucuccgaaccccuggauaagaaaaaggguuuuucaaugccaggcuucuuguucaaaaauaguaucaaggucucuugccugugccucgaggagaacguggaaaaugacccuuguaaauuugcccugacuagccggaccggggauguggucgagacauucauuuuacacuccucaagccccucuguacgccagacguggauacaugaaaucaaccagauucuugagaaucagcgaaacuuucugaaugcacucaccuccccaaucgaauaccaaagaaaccacaguggaggcggugggggaggcggcagcgggggaucggguggcgggggaggcuccggugggggaggcgccccgucuggcgggucaggacauagcgguggcccuaguuccugcgggggagcucccucuacuagcaggucacggccaucccgcaucccccagccugugagacaccauccacccguucuagugaguagcgcggccucuucacaggcagaggcugacaagauguccggcacaagcaccccugguccgucucugccacccccuggggccgcccccgaggcaggaccaagugcuccuucgaggcgacccccaggcgccgacgcggaaggcuccgagcgggaagcugagccuauuccgaagaugaaagucuuggaaagcccccguaagggggccgcaaaugccucaggaucuagcccagaugcuccugcaaaagacgccagagcgucccuggguacucucccccuuggcaagccacgcgcuggggccgcaaguccucugaacucacccuugucuagcgccgugccgucccugggaaaagagccauucccucccaguagcccacuccaaaagggcgguuccuuuuggucuucaauacccgcuagcccugccucgaggccgggguccuucacauuucccggagauagugacucuuuacagcggcagaccccaagacacgcagcuccuggcaaggauacggaccgcaugagcacuuguucauccgccucugagcagaguguucaaagcacccaguccaauggcucagaaagcucuaguuccagcaacaucucaacaaugcuggugacccacgauuauacugcggucaaagaggacgaaauuaauguguaccagggggagguagugcagauccuugccucuaaccaacagaauauguuccugguuuuuagggcagcuacagaucagugccccgccgcagagggauggauuccugguuucguccuaggccauaccuccgcugugaucguggaaaacccagacgggacacucaagaaaucgacuagcuggcacaccgcccugcgauugcggaagaaaagugagaagaaggauaaagacggaaagagagaaggcaaacuggagaacgguuauaggaagucucgcgaagggcucuccaauaaagucagcguuaaacuucugaaccccaauuacauauaugaugugccuccagaguuuguaauccccuuaucagaggugacgugugaaacaggcgagaccgucgugcugcguugccggguuuguggaagaccgaaagccaguauuacuuggaagggcccugaacauaacaccuugaauaacgacgggcacuacuccaucagcuauucugaccucggagaggcgacacugaagauugugggugucacuaccgaagaugacggcaucuacacgugcauagcuguaaaugauauggggucagcaagcuccucugccagucuaagggugcuuggaccaggcauggacgguauuaugguuacauggaaagauaacuucgacucguuuuacagcgagguggcugagcuggggcgcggccgauucuccgucgugaagaaaugugaucagaagggaaccaaacgggccgucgcaacuaaguucgugaauaagaaacucaugaagagagaccaaguuacacacgaacugggcaucuugcagucacugcagcauccccuccuuguggggcuguuagauaccuuugagacuccuacaucuuauauucugguauuggaaauggccgaccaaggaaggcuccuggauugcgugguccgcugggguagccuaaccgagggcaaaaucagagcucaccuuggggaaguucuggaggcggugcgguaccuccauaacuguaggauagcccaccuggacuugaagccagagaauaucuuagucgaugaaagucuggcaaaacccacgauuaagcucgcugacuucggagacgccgugcagcuuaacacuaccuauuacauccaucagcugcuaggcaauccggaguuugcagccccugaaauuauccuggguaaccccguaucccucacaucagauaccuggucuguggggguuuugacauaugugcugcuuagcggcgucuccccauuccuggacgauaguguggaggagacuugccucaauauaugccguuuagacuuuagcuucccugaugacuacuuuaagggagucucucagaaagcuaaggaguucguguguuuucuguugcaagaggaucccgccaaacgaccaucagcggcacuggcccuccaggaacaguggcuucaggcuggcaacgggcgcuccaccggaguucuggacacgagcagacuaacaaguuucauugagcggaggaagcaccaaaacgauguacgccccaucagaucuaucaaaaauuuucugcagucccggcucuugccuaggguguga

SEQ ID NO: 64239 - RNA, 1806 nt, Artificial Sequence
  derived and/or modified sequence opt3 from TRIP10__Homo_sapiens__NP_001275891
auggacuggggcaccgagcugugggaucaguucgaagugcucgagagacacacacaaugggggcuugaccuguuggauagguacgucaaguuuguuaaagaacggacugagguggaacaggccuaugcuaagcaguuacgcagccuggugaaaaaguaccuacccaaacgaccugcaaaggacgauccagaguccaaguucucucagcaacagucauuuguacagauccuccaggaggucaacgacuucgccggacaacgugaacugguggcggagaaucuuaguguuagagugugccuggaauugacgaaauauagccaggagaugaagcaggagaggaaaaugcauuuucaggaaggucggcgcgcucaacagcagcucgagaacggcuucaagcaacuggaaaauuccaaaagaaaguuugagagggauugucgggaagccgagaaggcagcccagaccgcugagcgccuggaccaggauauuaacgcaacaaaagccgacgucgaaaaggcuaaacagcaagcccaccuccgaucucauauggcggaggaaucgaagaaugaguacgcagcccaguuacagagauucaacagggaucaggcucacuuuuauuucucacaaaugccgcagauauuugacaaacugcaggauauggacgaacggcgugccacucgccuuggggcaggauacggcuugcugagcgaggcugagcuagaagugguacccaucauugccaagugccucgaggguaugaaaguugcggccaaugcaguggacccuaagaacgauagucauguccugaucgaacuucacaaguccggguucgcuagaccaggagacguggaguuugaagauuucucucagcccaugaauagggccccuagcgacuccucacugggcaccccaagugauggccggcccgaguugcgagggccuggacgcagcagaacaaaaagguggccauucgguaagaaaaacaagccgcggcccccuccacucucuccccugggcgggccugugccauccgcuuuacccaauggaccgccuucaccccgcagcggcagagacccacuggccauucucagugagaucucuaaauccgucaagccuaggcuugccagcuuucguucgcugcgggguucucgagggaccguugugacugaagauuucucccacuugcccccagagcaacagagaaagaggcuacagcagcaacuggaagaacgcucacgggagcuccagaaagaaguagaccagagagaggcccugaagaaaaugaaggauguguaugagaaaacaccccaaaugggagacccugcuagucuugagccacagauagcggaaacccugagcaacaucgagagguugaagcucgagguccagaaguacgaagcauggcuggccgaggcugaaucccgcguguuaucuaaucgaggcgauagccugucacggcaugcccguccgcccgacccuccagcaagugcacccccugacuccagcucuaacucagcuagucaggauacgaaagagagcuccgaagaaccacccucugaggaaucgcaagacacuccgauuuacaccgaguuugaugaagacuucgaggaggagccuacaagcccaaucggccacuguguugccauuuaucauuuugagggguccucagaaggaacuaucaguauggcagagggugaagaucuaucucucauggaggaggacaagggcgauggguggaccagagugaggcgcaaagaaggaggcgaggguuacguccccacaagcuaucugcgggugacccuuaauuga

SEQ ID NO: 64240 - RNA, 5940 nt, Artificial Sequence
  derived and/or modified sequence opt3 from TRIP11__Homo_sapiens__NP_004230
augagcuccuggcugggcgggcucggaucuggucuuggccagucacuggggcaagugggaggcaguuuggccagcuuaaccggucagaucuccaacuucacaaaggacaugcugauggaggggacugaagaggucgaagcugagcuacccgauucuagaacgaaagaaauugaggcaauacacgccauccucaggucggagaaugaacggcugaagaaacuuugcaccgaccuggaggaaaagcaugaggcgucagagauucagaucaaacagcaaagcacaaguuaccgcaaccaguugcagcagaaggaaguugagauuucccaccucaaggcucgacaaaucgcccugcaggaucagcugcucaaauuacagucugcagcccaaagcgugccuuccggagcuggcgugccagcaacuaccgccucaaguagcuuugcuuauggcauaucucaucacccguccgccuuccaugacgaugacauggauuuuggggacaucauuucaagccagcaggaaaucaaucgucugaguaacgaggugucuagacuugaauccgaggucggacacuggaggcacauugcgcaaacaagcaaggcacaggguaccgauaauucggaccagucugagaucuguaaauugcagaacauaauuaaggaacugaaacaaaaucggucccaggagaucgaugaccaucagcacgaaaugucagugcuacagaacgcccaucaacagaagcucacugagauuagucgcagacacagggaggaacugagcgauuacgaggaacggaucgaggaacuugagaaucuguugcagcagggcggguccggaguuaucgaaacagaccucucuaagauuuaugagaugcagaagaccauacaggugcugcagaucgagaaggucgaaagcacgaaaaagauggagcaguuagaagacaaaauuaaggauaucaacaaaaagcugucaagugcugagaaugaccgcgauauacuccgaagagagcaagaacagcuuaacguggagaagaggcagauuauggaagagugcgaaaaucugaaauuggaguguuccaagcuacaacccagcgccguaaaacagucugacacuaugaccgagaaggaacggauccuggcacagucagcuaguguugaggaaguguuccgucuccagcaagcccugagcgaugcggagaacgaaaucaugcgccuuuccucucugaaucaggacaacucguuggccgaggauaaccucaaacugaagaugagaauugaggucuuagaaaaggagaaaagccugcuaucccaggaaaaggaggaacuccagaugucacugcuuaaauugaauaacgaguacgaggugaucaagaguacagcaacuagggacauuucucuggauagcgaacuccacgaccugcggcuuaaucuggaggcuaaagaacaagaguugaaccaguccauaucagagaaggaaacccucaucgccgagauugaagaacuggaucgacagaaucaggaagcuacaaagcauaugaucuuaaucaaagaccaacugagcaagcagcagaacgagggcgacucuauuauauccaaacuaaagcaagaucucaaugacgagaaaaagcgcgugcaccagcuggaagaugacaagauggauaucaccaaagagcuugacguccagaaggaaaaauugauucagagugagguugcccugaacgaucuccaucugacgaagcaaaaauuagaagacaagguggagaaucugguagaucagcuuaacaaaagccaggagucuaauguguccauccagaaggaaaacuuggagcucaaggaacacauuagacaaaaugaggaagaacugucaaggauccggaacgagcuaaugcagagucugaaucaggacagcaacucgaacuuuaaagauacucuccugaaggaacgcgaggcagaagucagaaaucuuaaacagaacuuguccgagcuggagcaauuaaaugaaaaccucaagaaaguggccuucgacguuaagauggagaaugaaaagcuggugcuugcuugcgaggaugucaggcaucagcuggaagaguguuuggcggguaacaaucagcucucucuggagaaaaacacaauaguggaaacccuaaagauggagaaaggggaaaucgaggcagaacugugcugggccaagaaacgucuccuggaggaggcuaauaaguaugaaaagacuauugaggaacuuagcaacgcccggaauuugaacacaucagcacugcaguuagagcacgaacaccucaucaaacugaaucaaaagaaagacauggagauugccgagcuuaagaaaaacaucgaacagauggacaccgaucauaaggagacgaaggacguacugaguuccucucuagaagaacaaaaacaacucacccagcugauaaauaagaaagagauuuuuaucgaaaaguugaaagagcgaagcuccaagcugcaggaagaguuagauaaauacucacaggcucucagaaagaacgaaauucugaggcaaacaaucgaggagaaggaccgcagccuuggaaguaugaaagaagagaacaaucaucugcaggaagaguuggaacggcucagagaggagcagucuaggacugccccuguugcagauccaaagacccuggacuccgugacagaacuagcgagcgaggucucgcagcugaacacuauaaaagaacaccuugaggaagagaucaagcaccaccagaagauuaucgaggaucagaaucagucaaagaugcagcuccugcaaucuuugcaggaacagaagaaagagauggacgaguuccgcuaucaacaugagcagaugaacgcuacccacacacagcuguuuuuagagaaggaugaagagauuaaaagucuccagaagaccaucgaacaaauaaaaacucagcugcaugaggaacgacaggacauucagacggauaauuccgacaucuuccaagagacaaaggugcagagccuuaacaucgagaauggcucugaaaagcacgaucugagcaaagccgagaccgaacgguuggucaagggcauuaaagagcgugaacucgagaucaagcugcuaaacgagaaaaauauuucccugacuaagcagauagaccagcuuucaaaggacgaaguggggaaacucacccaaaucauucagcagaaggaucuggagauccaggcauugcaugccagaauuaguagcacaucucacacccaagacguuguguacuuacagcagcaacugcaggcuuacgccauggaaagggagaaaguauuugcaguccucaacgaaaagacucgcgaaaauucccaccugaaaacagaguaucauaagaugauggauaucguggcugccaaggaagcggcccuuauaaaacugcaggacgagaacaagaaauugucaacgcgguucgaaaguagcggacaggauauguuuagagagaccauccaaaaucuauccaggauuauccgagagaaggacauugaaaucgaugcucugucucagaaaugucagacucuccuggcaguucuucagacaucgagcaccgguaacgaggccggcgggguaaauucaaaccaauucgaagaguuacugcaggaacgcgacaagcucaaacagcaggucaagaagauggaggaguggaaacaacaggugaugacaacuguacagaacaugcaacacgaauccgcucaguugcaggaggaacugcaucagcuccaagcccaggugcugguugauagugacaauaacucuaaacuucaggucgauuacaccggacugauacagagcuaugagcaaaaugaaacgaaauugaagaacuucggccaggagcuagcacaggugcagcacuccauuggucaacugugcaauaccaaagaccucuuacuggggaaacuugacaucaucucaccccagcugucuagcgcgagucucuugacaccucaguccgccgagugucugcgggcuagcaagucugaagugcucucagaguccagugaacugcuucaacaggagcuagaggagcugagaaagagcuugcaggagaaggaugccacuauuaggaccuuacaggaaaacaaucaucgucugucggacucuauagcagcuacauccgagcucgaacgcaaagagcacgagcaaacugauagcgaaaucaagcagcugaaagagaagcaggacguccuucagaagcugcucaaagaaaaggauuugcugauuaaagccaagucagaccaacuacugaguucuaacgagaauuuuaccaacaaaguuaaugaaaacgagcuccuucggcaggcagugacgaaucugaaggagagaaucuuaauuuuggaaauggauaucggcaagcugaaaggagagaacgaaaagauaguggagacauacaggggcaaagaaaccgaguaucaggcccuccaggagacuaauaugaaguucuccaugaugcugcgagaaaaagaguuugaaugccacagcaugaaggagaaagcucuugcguucgaacaacugcucaaggagaaggagcaggggaaaacaggagaauugaaccagcuguuaaaugccguaaagucaaugcaggagaaaaccgucguguuucaacaggaacgggaccagguuaugcuagcacugaagcaaaaacagauggagaacacugcucuccagaacgaggugcagcgccuuagagauaaggaguucaggaguaaucaagagcuggaacgguugcgaaaccaucugcucgagagcgaagacuccuacaccagagaggcccuggccgcugaggaucgcgaagcaaaacuuaggaaaaaggucacagugcucgaggaaaaacugguuucuagcuccaaugccauggagaacgcgucacaccaggcuucugugcagguagaaaguuugcaggagcaacugaaugucgugucgaagcagcgugacgagacggccuuacagcuaagcgugucccaggaacaagucaaacaguaugcacugucucucgccaaccuucagaugguucuggagcauuuucaacaggaagagaaggcuauguacucagcagaauuggagaagcagaaacagcugaucgccgaguggaagaaaaaugcggaaaaccucgaggguaaggugauuagccugcaagaaugucuugaugaggcuaaugccgcauuagacuccgccagucggcugaccgagcagcucgacguaaaagaggaacaaaucgaagaguugaagagacagaacgaacugaggcaagagaugcuagaugacgugcagaagaaacugaugucucucgcuaauagcucagagggcaaggucgauaaagugcuuaugcgcaaccuguucauugggcacuuucacacuccaaagaaucagcgacaugaaguuuugagacugaugggauccauccucggcgugcggagggaggaaauggagcagcuguuccacgacgaucaagguggggucacacgcuggaugaccggcugguuaggaggcgggaguaaaagcgugcccaacacaccucuucguccaaaucagcagucuguugugaacuccucauuuagcgaacuguucgucaaguuucucgagacugagucgcauccgucuauacccccuccaaaacuaaguguacacgacaugaagccccuggauuccccuggaagacggaagagggacaccaacgccccagagagcuucaaagauacggcagagucacgcuccggucgaagaacagacgugaaucccuucuuggcuccgcggucugccgcgguuccucugauuaaccccgccggccucgggccaggaggcccuggucaucuucuguugaagcccaucagcgaugugcugccaaccuuuacuccccucccugcauuaccagacaauagugcuggggucgugcugaaagaucuucugaagcaguga

SEQ ID NO: 64241 - RNA, 870 nt, Artificial Sequence
  derived and/or modified sequence opt3 from TRIP13__Homo_sapiens__NP_001159732
auggacgaggccgugggcgaucugaagcaggcucuccccugcgucgcagaaagcccuaccguucacguggagguacaucaaagaggguccucuacagccaaaaaggaagacaucaaccuuucagugaggaaacuguugaaucggcacaacauugucuucggagauuacacuuggacggaguuugacgaaccauucuuaacccgcaaugugcagaguguuagcauaaucgauacagagcugaaggugaaagacucccagccgauugaucuaucugcguguacugucgcucuccauaucuuucagcugaacgaggacggucccucgucagaaaaucuugaggaagagaccgagaacauuaucgccgcaaaucacugggugcugccugccgcugaguuccauggcuugugggauagccucguauaugacguugaagugaagagucaucugcuggauuacgucaugacaacccucuuauuuuccgacaagaacgucaauucuaaccugauaacuuggaaucgaguggugcuuuugcacgggccacccggaacaggcaaaaccagccugugcaaggcacuagcccaaaaacucacgauccgucuguccucaagauauagguacggucagcuuauugaaaucaacagucacagccuguucucuaagugguuuuccgagucagggaaauugguuacuaagauguuccagaagauucaggaucucaucgacgacaaagaugcucugguguuuguauuaauagacgaaguggagagccugaccgccgcgcggaaugcaugucgcgccggaacagagccuagugaugcuauuagagucgugaacgccguucucacucaaaucgaccagauuaagagguga

SEQ ID NO: 64242 - RNA, 1746 nt, Artificial Sequence
  derived and/or modified sequence opt3 from TRIP4__Homo_sapiens__NP_057297
auggccguggcuggcgcagucagcggggagccccugguucacuggugcacccagcaacucagaaagacauucggacuugacguguccgaagagaucauucaguacguacugucuauagaaucagccgaggaaaucagggaguaugugacugauuuguuacaggguaacgagggcaaaaaggggcaguuuauugaagaacugaucacgaaauggcaaaagaaugaccaggaacuaauuagugauccucuccagcaguguuucaaaaaggacgagauccuggauggacaaaagagcggcgaccaucuuaaacggggucgcaagaaagggcgaaaccgucaggaggucccagcguuuaccgaaccggauacaacugcugaggugaagacccccuucgaccuggccaaagcacaggaaaauuccaacucuguuaagaagaaaacaaaguuugugaauuuguacaccagagagggacaggauaggcucgccguccugcugccuggccggcacccaugcgacugucucggccaaaaacauaaguuaauaaacaauugccugaucugugggcgcauugugugcgaacaggagggaucgggucccugucuuuucugcggcacuuugguauguacacacgaggaacaggauauccugcaaagagacucaaacaaaagccagaagcuacucaaaaagcugaugagugggguugaaaauuccggaaagguggauauuucuaccaaagaccuucugccucaucaggaauugaggaucaagagcggccucgagaaagcuauaaagcacaaagacaagcuguuagaauuugaucggacguccauucgccgaacucaggucaucgacgaugagucagacuauuucgcaagugauagcaaccaauggcugucuaagcucgagagagaaacccuucagaaaagggaggaggagcugcgggaauugcgucacgccucccgccuaucaaagaaagugacaauugacuuugcugguagaaagauccuggaggaggaaaauagccucgccgaguaccauaguaggcuggaugaaacuauccaggcgauugcaaacgggacccuuaaucagccacugacaaaauuggaccggucuuccgaggagccccucggagugcuggucaacccuaauauguaucaaagcccaccgcaguggguugaucacaccggcgccgcuucgcagaagaaggccuuccgaucuuccggcuuuggguuagaguucaacucauuucagcaucaacugcgcauacaggaccaggaguuccaggaaggauucgaugguggcuggugccuaagugugcaccaacccugggcaagccuccugguaagagggaucaaaaggguggagggacgguccugguacacgccucaccgcggcagacuuuggauugcugccacugcgaagaaaccaucuccccaggaagucagcgaguugcaggccacauauaggcugcuccgugguaaggacguggaguuuccuaacgacuacccaucagggugucugcuuggcugcguugaucugaucgacugcuugagucaaaaacaguucaaggaacaguuucccgauauaucccaggagagcgacucuccguucguguuuauuuguaagaauccucaagaaauggucgugaaauuccccaucaagggaaacccaaaaaucuggaagcucgauucaaaaauucaucagggcgcaaagaaagggcugaugaagcagaauaaggcuguauga

SEQ ID NO: 64243 - RNA, 1431 nt, Artificial Sequence
  derived and/or modified sequence opt3 from TRIP6__Homo_sapiens__XP_011514847
augagcggccccaccuggcugccuccaaagcagccggagcccgccagagcuccucaagggagggcaaucccacggggaacacccgguccuccacccgcccacggcgcggcucuccagccucauccacgcgugaacuucugcccgcuucccuccgaacaguguuaccaggccccugggggaccagaggaccgaggccccgcaugggucgguucucacgggguucugcaacauacucagggauugccugccgaucguggcggcuuaagaccagggucacuggacgcugaaauugaucuacucaguagcacgcuggcagagcuuaauggagguaggggccacgccucccggcgccccgacagacaggcuuaugaaccgccucccccuccugccuacaggaccgggucucugaaacccaacccagcgucgcccuugccugcaucaccauauggaggcccgacacccgccagcuacacuaccgcuaguacaccagccgguccagcauuucccgugcagguaaagguggcucaaccuguccgggggugcggaccaccccgccgaggcgccucccaggcgucuggcccgcucccugggccacauuucccccugccuggaagaggugagguguggggccccggguauaggagccagcgggagccaggaccuggcgccaaagaagaggcagcugguguuuccgggcccgccggccguggacgcggcggggaacacggaccacaggugccgcugucacaaccucccgaggaugagcucgacagauuaaccaagaaacugguccacgauaugaaucauccacccaguggugaauacuuuggccagugugggggaugcggcgaggacgugguaggugauggggcuggcguuguggcccuugacagggucuuccacgugggauguuuugugugcagcacuugucgggcacaguugcgaggccaacauuucuaugccgucgaacgcagagcuuacugcgagggguguuacguugcgacacuggaaaagugcgcaaccuguucucagccuauacuagauaggauccuccgggccaugggaaaggcuuaucacccagguugcuuuacgugcgugguaugucaccgcggccuggacgggauucccuucacuguggaugccaccucccagauccauugcauugaggacuuucacagaaaauucgcaccuagguguucagucugcggaggcgccaucaugccggagccaggucaggaagagacagugcguauaguugcucuugaccggagcuuucauaucggguguuacaagugcgaagaguguggccuguugcucaguucugaaggagagugccaaggcuguuauccccuggaugggcacauuuuaugcaaagccuguuccgcauggcgaauccaggagcugagcgcgacugugaccacagacugcuga

SEQ ID NO: 64244 - RNA, 261 nt, Artificial Sequence
  derived and/or modified sequence opt3 from TRIQK__Homo_sapiens__XP_011515284
augggcagaaaggacgccgcuaccaucaaacugcccguggaucaguacaggaagcaaauugggaaacaggacuauaagaaaacaaagccuauacuccgggcaacuaaacuuaaggccgaggcgaagaaaacggcuaucggaauuaaggaagucggucugguuuuggccgcaaucuuagcccugcuacucgcuuucuacgcauuuuucuaucugcgccuuaccacagauguggacccagaucuggaccaggaugaggacuga

SEQ ID NO: 64245 - RNA, 1020 nt, Artificial Sequence
  derived and/or modified sequence opt3 from TRMT10A__Homo_sapiens__NP_001128137
augagcuccgagaugcugcccgccuucaucgaaaccucuaacguggacaagaaacagggcauuaaugaggaucaagaagagucacagaagccuagacucggggaaggaugcgagccaauaaguaaaaggcagaugaagaaacuuaucaagcagaagcaaugggaggaacagcgggagcugcgcaaacagaagcgaaaagaaaagcguaaaagaaagaaguuggagaggcagugucaaauggagccgaacagcgacggucacgaucggaaacgcgucagaagggacguugugcauuccacauuacggcugauuaucgauugcucuuuugaccaccuaaugguacucaaggauauuaaaaagcugcauaaacagauccagcgcuguuacgcugaaaauagacgagcacuucaccccgugcaguucuaucugacuucgcauggcgggcaauugaagaaaaacauggacgagaaugauaagggaugggucaacuggaaggacauacacaucaaaccugaacacuacucagagcucauuaagaaagaagaucugaucuaucugacgagcgacaguccaaauauucucaaggaguuagaugaguccaaagccuacgugaucggcggucugguugaccauaaccaccauaaggggcuuaccuauaagcaggcgucugacuacggaauaaaucacgcucaguugccccugggcaacuuugugaaaaugaauagcaggaagguccuagccgugaaccacguauucgaaauuauccucgaguaucuggaaacacgggauuggcaagaggcauuuuucacuauucuuccucagcguaaaggcgccguuccaaccgacaaggcuugcgaauccgcaucacaugauaaucagagugugcgcauggaggaagggggaagcgacucugauuccucagaggaggaauacagcagaaacgagcuggacaguccccacgaagagaaacaggauaaggagaaucauacagaaucuaccgucaacuccuugccucacuga

SEQ ID NO: 64246 - RNA, 1347 nt, Artificial Sequence
  derived and/or modified sequence opt3 from TRMT12__Homo_sapiens__NP_060426
augagagagaacguggucguuagcaauauggaaagggaguccggcaagcccguggccguaguggcugucgugaccgaaccuugguucacacagcgguaccgcgaguaucugcaacgacagaaacucuuugacacucagcaccguguugaaaagaugccagaugggucuguggcacuuccgguccugggagagacguugcccgagcagcauuuacaagaacugagaaacaggguggccccugguucaccaugcaugcuaacccagcuccccgacccuguaccaaguaaacgggcgcagggcuguagccccgcucagaagcugugccuugagguuucccgcuggguggaagggagaggagucaaauggucugccgagcuggaggcagauuugccuaggucguggcaacggcacggcaaucuccugcugcucucagaagacuguuuccaggccaagcaguggaagaacuuagguccagagcugugggaaacaguggcucuugcauugggggugcagcgccuggccaaacgaggaagagucagcccggauggcacuaggacccccgcuguuacacuacuccugggcgaccauggguggguggagcacguagauaauggaauccgguacaaguuugacgugacccaaugcauguucaguuuugguaacauuacugaaaaacuucgugucgccucccugucuugugcgggcgagguguugguugaucucuaugcagggauaggauacuucacacugccuuuucuugugcaugccggcgcugccuucguccacgcaugcgaguggaauccacacgcugugguagcccugcgcaacaaucucgaaaucaacgguguugcggacagaugucagauucauuuuggggauaauaggaaguuaaaacugagcaacaucgccgaccgggugauuuugggacuaauccccuccucagaggaaggcuggccuauagcaugccagguccugcgacaagaugcuggcgggauccuccacauucaucagaauguggagaguuucccaggaaagaaccugcaggcccuuggugucagcaagguggaaaaagagcacuggcuguauccccagcaaaucaccacgaaucaguggaagaacggcgcuacucgcgacucuagagggaaaauguuguccccggccaccaagccugaguggcagaggugggcagaaucagccgagacacggauugcuacucuccugcagcaaguucacggaaaacccuggaagacccagaucuuacauauacagccagugaaaagcuacgcgccucacguagaccauauuguccuggaucuagaauguugccccuguccaagugugggcuga

SEQ ID NO: 64247 - RNA, 1893 nt, Artificial Sequence
  derived and/or modified sequence opt3 from TRMT1__Homo_sapiens__NP_001136026
augcagggcagcucccuguggcucucucuuaccuucagaucagccagggugcugagucgggcucgcuuuuucgaguggcaaagccccggguugccuaacacagcagccauggaaaauggaacugguccauacggcgaggaacgaccgcgugagguccaggaaacgaccguuacagagggggcggcuaagaucgccuuucccuccgcaaacgagguguucuauaauccuguacaggaauuuaacagagacuuaacuugcgccgugauuaccgaguucgcuaggauacagcugggagcaaaaggcauccaaauuaaggucccaggugaaaaagauacacagaaggugguuguggaccuaucugagcaggaggaagagaaagucgaacucaaggagucggaaaaucuggccucaggggaucagccccggaccgcugccgugggagagaucugugaggaaggccuucacguacuggagggcuuggcggcaagcgggcuccgcaguauuagauuugcccuggaaguuccuggacugagguccguggucgcuaacgacgccucuacucgggcaguggaucucauccgccgaaaugugcaauuaaacgacgucgcucaucugguucagccaagccaggccgaugcgagaaugcuuauguaccagcaccaaaggguguccgagcgguucgacguaauagauuuggaccccuaugguaguccugccacauuucuggaugcagcugugcaggccgucucagaaggcgggcuacucugcgugaccuguacggacauggcuguucuggccggaaauagcggcgagacuugcuacucuaaguauggugcaauggcccuuaaaucccgugcuugucaugagauggcgcugcgcaucguguugcacucacucgaucugagagcaaacugcuaccagagguucgucgugccauuacugagcauuagugccgacuuuuauguacggguuuucgugcgagucuuuaccgggcaagcuaaggugaaagccucugcacgcgccaaguucuccgcugccuguggaccgcccgucacaccugaaugcgagcauuguggccagagacaccagcucggcgggccaaugugggcagaacccauccacgaccuugauuucgugggaaggguucuggaggcggugagcgcuaauccuggucgguuucauacuucggaacgcauuagaggcguauugucugucaucaccgaggagcuaccagacgugccccuguacuacacacucgaucagcuguccucaaccauacacugcaacacgccgagucuucugcaauugaggagcgcccuccugcaugcagacuuccguguuuccuuaucucacgccuguaaaaaugcugugaagacugaugccccugcaagcgcucugugggacauuaugcggugcugggaaaaggagugccccgucaaacgagaaagacuaucagagacaaguccagccuuuaggauccucuccguggagccucgccugcaggcgaacuucaccauucgggaagaugccaaucccagcucuagacagagggggcuuaagcgcuuucaggcuaacccagaggcaaacuggggaccccgaccucgggcccguccaggcgguaaagcugccgacgaagcaauggaggaaagaaggcgcuugcugcaaaauaagcggaaagagccgcccgaggauguagcgcagagagccgcuaggcucaagacuuucccuuguaaacgauuuaaggaagggacaugccagcgcggcgaccaguguugcuauucacacaguccacccaccccucgggugagcgccgaugcagcuccagacugucccgagacguccaaccaaaccccgccuggaccaggcgccgcagccgggcccggaaucgacuga

SEQ ID NO: 64248 - RNA, 2274 nt, Artificial Sequence
  derived and/or modified sequence opt3 from TRMT44__Homo_sapiens__NP_689757
auggccgaggugggcagaaccgggaucagcuaccccggagcucugcucccucaggguuucugggcagccgucgaaguuuggcuugagaggccacaaguggcgaacaagcggcugugcggcgcucgcuuggaagcccgaugguccgcagccuuaccgugugcugaggcacgugggcccggaacaucugccggcucagaacagaaagagagagguccugggccaggacagggcagucccggcgggggaccugguccaaggagccuguccggccccgagcaggggacugcuugcugugaacuagaggaagcccaaggacagugccagcaggaggaggcgcaacgggaagcagccucuguaccucuccgcgacucgggccacccaggucaugcugaggggagagaaggagauuuuccggccgcagaccuggauucacuuugggaggacuucagccagagucuggcuaggggcaauuccgaauugcucgccuuucugacgucuagcggcgcggggucccagcccgaggcccagcgggagcuggaugugguccuccgcaccgugauuccuaagacaucaccacacugucccuuaacuaccccucgaagagaaauaguugugcaagacguccugaacggaacaaucaccuuccuuccauuggaggaagaugacgaggguaaucugaaagugaagaugaguaacguauaucagauucagcuaagccauucuaaagaagagugguuuaucuccguucucauuuucugccccgagagguggcacucagauggcaucguguacccgaagccuacuuggcugggggaagaacuucuggcaaaguuggcuaaauggagcgucgaaaauaagaaaagugacuuuaagucuacacucucccugauaagcaucaugaaauauucgaaggccuaccaagaguuaaaggaaaaauauaaggagauggugaaaguguggcccgaggucaccgauccagaaaaguucguuuacgaggacguggcuauugccgcauaucugcucauccuuugggaagaggagcgggccgaacgucgccugacggcuagacagucuuuuguagauuugggauguggcaacggucuacuggugcauauucucuccucagaggggcacccuggcaggggaaucgacguccggcgacgcaaaauaugggacauguacggcccccagacucagcuggaagaggaugcgauuaccccaaaugacaagacacuuuuccccgauguggacuggcugaucgggaaccacagugaugaauugacuccuuggauuccaguuaucgcagccagaagcuccuacaauugcagguuuuucgugcucccguguugcuuuuucgacuucaucggacgguauucucgcagacaaagcaaaaagacccaguacagggaguaucuggauuuuauuaaggaggucgguuucacauguggcuuucauguggacgaagauugcuuacguauacccucaaccaaacggguaugccugguugggaagagucgaacguacccuuccagcagagaggcuucuguggacgagaaaaggacucaguauaucaagucacgccggggauguccagucagucccccuggcugggagcuaagcccaucccccagauggguggccgcagguucugccgggcacugcgauggccagcaagcucucgacgccagggucggaugugugacacgcgcaugggcggcugaacauggcgccgggccgcaggcagagggaccuuggcugccagguuuccacccccgagagaaagccgaacggguucguaacugcgcugcccuuccuagagacuuuauugaucaggugguauugcaggucgcaaaucugcuccugggcgggaagcaacuuaacaccaggucgagccgcaauggaucccugaagacuuggaacggcggugagucauugagucucgcugaaguggccaaugagcuggacacagaaaccuuacggagacugaaaagggagugugggggccuacagacgcuccugcgaaacucucaccagguuuuccagguggucaacggacgcgugcauauccgggauuggagagaggaaacccuuuggaagacaaaacaacccgaggcgaagcagagguugcugagcgaagccugcaaaacucgucucuguugguuuuucaugcaccauccagacggcugcgcucuguccaccgauuguugcccuuuugcacacgggcccgccgaguuacgcccaccgcggacaacuccuagaaagaagauaucauga

SEQ ID NO: 64249 - RNA, 1530 nt, Artificial Sequence
  derived and/or modified sequence opt3 from TRMT5__Homo_sapiens__NP_065861
auggugcuguggauccucuggagacccuucggcuuuagcgggagguuccuuaagcuggagucccacucuauuaccgaaucaaaaaguuugauaccugucgccuggacaucuuuaacucagaugcugcuagaggcuccaggaaucuuucuccugggucaacggaagcgcuucuccacgaugccggaaaccgagacacaugaacgagagacugagcuuuucucucccccuucggacguucguggcaugaccaaacuggauagaacagcauucaagaaaaccgugaacauuccaguauugaaggugaggaaggaaaucgucucaaaacucaugcggagccugaagcgcgccgcgcugcagagacccgggauuaggcgggugaucgaggacccugaagauaaagagagucgccucauaauguuagacccauacaagaucuuuacucacgauuccuucgagaaagcugaacugucuguucuugagcaguugaaugugagcccccagauuuccaaguauaaccuggaacuaacauacgagcauuuuaagucagaagagauccuccgagccguccugccugagggacaagacgugaccaguggcuucagcagaauuggucacaucgcacaucuuaaucugagggaucaccaguugccauuuaaacaccucauagggcagguaaugauugacaagaacccgggaaucacgucugccguuaauaaaauuaacaauaucgauaacauguaucggaauuuccagauggaagugcuguccggcgagcaaaacaugaugacuaagguccgugaaaauaacuacaccuaugaguuugacuucucaaaaguguacuggaauccccgcuuaagcacagaacauaguagaaucacugagcugcucaagccuggcgaugugcuuuucgacgucuuugcugggguuggaccauucgcaauucccguggccaaaaagaacugcaccguauuugcuaaugaucugaacccugagucucacaagugguugcuauauaacuguaaacugaauaagguggaccagaaagucaagguguucaaccucgacgguaaagauuuucugcagggcccaguuaaggaggaacuuaugcagcuguuggggcucuccaaggaaaggaaacccagcgugcaugucgugaugaaucugccggccaaggcgauagaguucuuaucggcauuuaaauggcugcuagacggacaaccuugcagcuccgaauuucuccccaucguacacuguuacucauuuaguaaggaugccaacccagcugaggacguucggcagcgagccggcgcagugcuggguauuagccuugaggcuugcuccucuguccacuuggugcgcaaugucgccccuaacaaagaaaugcuguguaucacauuccagauacccgcgagcgugcucuacaagaaucaaaccagaaacccagagaaucaugaagaucccccucugaagaggcagcggacggccgaggcauuuucagacgagaaaacucagauuguuaguaacacauga

SEQ ID NO: 64250 - RNA, 924 nt, Artificial Sequence
  derived and/or modified sequence opt3 from TRMU__Homo_sapiens__NP_001269711
augaugugcagcggcgccgacgcuaucgcaaccgggcacuacgccagaacaucccuggaggaugaagagguguucgaacagaagcaugucaaaaagcccgagggacucuuuaggaaccgguucgaaguucgcaaugcggugaaacuucugcaagcugccgacucuuuuaaggaucagacuuucuuuuugucacagguaagucaggacgcauuacgacguacgauuuucccucuggguggccuaaccaaagaguuugugaagaagauagccgcugagaacagacuccaccauguccugcagaaaaaggaaagcauggggauguguuucaucggaaaaaggaauuuugagcacuuccuucugcaauauuugcagccacggccgggccauuuuauuuccaucgaagauaacaaggugcucgguacacacaaagggugguuccuguacacucugggacagcgcgcaaauauuggcggccucagagagcccugguauguuguggagaaggacucugucaagggggauguguuuguagccccuaggaccgaccacccagcuuuauaccgggaucugcuucgcacaucgcgaguucauuggaucgccgaggaacccccugcggcauuggugagagacaaaaugauggaaugccacuucagguuccggcaucaaauggcccuggucccaugugugcuaacccucaaccaggauggaacugugugggucacagcuguucaggccgugcgugcacuggcuaccggucaguuugccguauucuauaagggcgacgagugccuugggucaggaaaaauacugcgcuugggccccagcgcguacacgcuccaaaagggucagagaagggccgggauggcaacugaaaguccuuccgauucuccagaggacggaccgggccugagccccuuacuguga

SEQ ID NO: 64251 - RNA, 4296 nt, Artificial Sequence
  derived and/or modified sequence opt3 from TRO__Homo_sapiens__NP_001034794
auggacagaaggaacgauuacggcuaucgggugccccuguuccaggggccucucccaccgcccggaagccuuggucugccuuuuccacccgacauccaaaccgagacaacugaagaggauuccgucuuguuaaugcacacgcugcuagccgcuaccaaggacucucucgcaauggauccuccaguugugaaucgccccaaaaagucaaaaacaaagaaagccccuauuaagacuauaaccaaggcggcuccagccgcaccgcccguaccugccgcuaacgaaaucgcaacaaauaaaccaaagauuaccuggcaggcccugaaccuucccgugaucacucagauuagucaggcucugccuacaaccgaggucacgaauacucaagccagcuccgugaccgcgcagccaaagaaggcaaacaaaaugaagcgaguuacagccaaggcugcccagggcucucagucgcccacugggcaugaaggaggcaccauccaauugaaaucaccgcuccaggugcugaagcugccugucauaagccagaauauccacgcacccauugcuaacgagagugccuccucucaggcgcucaucacaagcauuaaaccaaagaaagccuccaaggcuaaaaaggcugccaauaaggcuaucgccucagcaaccgaggugaguuuagccgcuacggcgacucauacagcaaccacucaaggucagauaacaaacgaaaccgccagcauucacacgaccgcugccucuauccguacuaaaaaggcauccaaagccagaaagacuauugcuaaaguaaucaauaccgacacagagcauaucgaagcccugaacguuacugaugcagcgaccaggcagauugaggcuucaguggucgccauacggccuaaaaagagcaaagggaagaaagcagccagucgcggacccaauucuguguccgagaucagcgaagcuccacuugccacacaaauugugaccaaccaggcauuggcugccacucugagagucaagaggggcucgcgggcgcgcaaagccgcuacgaaggcacgagccacagagucucagacccccaaugcugaccagggcgcccaagcaaagaucgcguccgcccagacuaacguuucagcucuagaaacccagguggccgcagcuguacaggcccucgcagaugacuaccuggcccaacuuagucuggagccuacaaccagaacuagggggaaacggaaccguaagagcaaacacuugaauggagaugaacgcuccgguucuaacuauagaaggauaccauggggccggcgaccggcucccccucgcgacguggcgauucuccaggagagagccaauaagcuggucaaauacuuacuggugaaggaucagacaaagaucccaaucaaaaggagcgacaugcuccgggacguuauucaggaguaugaugaauacuuccccgagaucauugaacgcgcaucauauacgcuugagaagauguuuagagugaaccugaaagaaauagacaagcaaaguuccuuguacauccuaauuagcacccaggagucuucagcugggauccugggaacuacaaaagauaccccuaagcucggccugcuuauggucauccugagugugauuuucaugaaugguaacaaagccagcgaggccguaauaugggaaguuuugaggaagcucgggcugcguccaggagugcggcacuccuuauuuggcgagguccgaaagcugaucacagacgaguucgugaaacagaaguaccuagaauauaaaagaguccccaauucuaggccgccugaauacgaguuuuucuggggccuccgcucguaucaugagacuagcaagaugaaagugcugaaguuugcuugccggguucagaagaaagauccaaaggacugggcagugcaauacagagaagccguagagauggaaguccaggcggcugccguggcaguugccgaggcugaggcaagggccgaagcgcgcgcucagauggggauuggagaggaagccguggcaggucccuggaacugggaugacauggauaucgacugucuuacccgagaggaauugggcgaugacgcccaagcauggucccgguucucauuugagauugaggcccgugcacaggaaaaugcugacgccaguacgaacgucaauuucucuagaggggcgagcaccagggccggauuuuccgauggcgcaucaaucagcuucaacggugcuccuucuuccagugggggcuucagcggaggccccgggauaacauuuggaguggccccaucuacuuccgcuucauucaguaauaccgcaagcaucucguuugguggcacacuguccacuucuagcucauucaguuccgccgccucuauuagcuuugggugcgcucacuccaccucaacgagcuucaguucugaggcguccaucagcuuuggaggcaugccuuguacaucggcaucauucucuggugggguaaguuccagcuuuucuggcccccucagcaccuccgccacuuucucaggaggcgcuaguagcggguuuggagguacacugucuaccacugccggcuucuccggggugcuuucaaccaguacgagcuuuggauccgcaccaacaaccucuacuguuuucucgagcgcccugucaacauccaccggcuucggugggauuuugaguacaucugucugcuuuggcggaagcccguccucaucuggcagcuucgggggaacucucaguaccuccaucuguuuuggcgguagcccuugcacgucuacaggguucggaggcacccugucaacuuccgugaguuuugguggcagcucgucuaccuccgcuaacuucgggggaacauuaagcacuucaauauguuuugacggcagucccucuaccggggcgggauucggcggugcccugaauacauccgcuagcuuugggucagugcuaaacacgaguaccggauucggcggugcaaugagcacuuccgccgauuuuggcgggacacucucuaccagcgucugcuucggaggcuccccagggacuucaguuucuuuuggaagugcacugaacacaaaugccggcuaugguggggcugugucgaccaacacggacuucggaggcacucuuagcaccuccguguguuucgguggcucucccucaacaagcgccggguuuggaggcgcguugaauaccaacgcauccuucgggugcgccguaaguacuucugcuagcuuuucaggagccgucuccacaagugcuuguuucagcggcgcaccuauuaccaauccagguuuugggggagccuucucuacauccgcuggcuuuggcggggcccugucaacugcagcggauuucggagguacccccagcaacucgaucggcuuuggggccgcuccuucuacgaguguguccuucggaggcgcccaugguacaagccucugcuuugggggagcaccgucaaccucccugugcuucggcucugcuagcaauacuaacuuauguuucggcgggccacccaguaccuccgccugcuuuagcggagcaacaucuccuucauucugugacgguccaaguacuuccaccggcuuuagcuucgggaauggacugucuacgaacgccggcuuuggugggggacuuaauacaucggcuggcuucggcgggggauuggguaccucagcgggcuuuagcgggggacucuccacaaguucuggcuucgauggugggcugggaacaagcgccggcuuuggcgggggacccgguaccuccacuggcuucgggggaggccuagguacaucagcaggguuuaguggaggccugggcaccucugcuggguucggagguggccucguuacgagcgacggguuuggaggcggucuggggacuaacgccuccuucggcucaacccuuggaacaagcgccggcuucucugggggauuguccaccagugaugguuuuggcagccgcccuaaugcaucguucgaccgggggcuguccacaauuaucggauuuggcucugguucaaacacuagcaccggguucacgggcgaaccgaguacauccacuggauuuucuagcggccccucauccauagugggguucaguggagguccaagcaccggcgucggguuuugcucuggaccuucaacauccggcuucagcggugggcccucuaccggcgcuggauuuggcgggggaccaaauacuggcgccgguuucgggggaggcccuaguaccucggcggguuuuggcuccggggcugccagcuuaggagcauguggcuucucauacggguga

SEQ ID NO: 64252 - RNA, 1578 nt, Artificial Sequence
  derived and/or modified sequence opt3 from TROVE2__Homo_sapiens__NP_001035828
auggaggaaagcgugaaccagaugcaaccccugaaugagaagcagaucgccaacucccaggacggcuacgucuggcagguuaccgauaugaauagacuccacagguuccuuugcuuugggucugaaggagguacauauuacauuaaagagcaaaagcugggcuuggaaaacgcugaggcauuaauacggcugaucgaggacgggcgcggaugugaagugauucaggagaucaaaucauucagucaggaaggccgaacuacgaagcaggagccuaugcuauuugcccucgcgauuugcagccaauguuccgauaucucuaccaaacaggcugccuucaaggcaguaucggaggugugccguauaccaacacaucuguuuacuuucauccaguuuaagaaagaccuuaaggaaucaaugaaaugugguaugugggggagagcccugaggaaggcuauugcagauugguauaaugagaaaggaggcauggccuuggcucucgccgucaccaaguacaagcagcggaacggcuggagccacaaagaccugcugcgccucagucauuuaaagccguccucugaagggcuggcgaucgugacaaaauauauuaccaagggauggaaagagguucacgaacuuuacaaggagaaagcauugagcguggagacugaaaagcugcuaaaguaucucgaggccgucgaaaaagugaagagaacaagggaugagcuggaaguaauccaucuuauagaggagcaccggcugguucgcgaacacuugcucaccaaucaucugaaauccaaggagguguggaaggcuuuacugcaagaaaugccccucacggcccuucugcgaaacuuggguaaaaugacugcaaauucaguccuagagccuggcaacagugaagugagccuggugugcgagaagcucuguaaugagaaacugcuuaagaaagcuaggauucacccauuccauauccugauugccuuggaaaccuacaagacagggcacggacucagaggcaaacugaaguggcggcccgacgaggaaaucuuaaaggcgcuggaugccgcauuuuacaaaacuuucaagaccgucgagccuacagguaaacguuuucuacucgcuguugacgugucugccuccaugaaccagcgcguacuggggucaauccuuaaugcuagcaccguggccgcagccaugugcauggucgugacgagaacugagaaggauaguuauguuguggcuuucucugacgaaauggucccaugucccgugacaaccgauaugacuuugcagcaaguacugauggcgaugucccagauuccugcaggaggcacagacugcagccucccaaugauaugggcccagaaaaccaacacgccggcugacguuuuuaucguguucaccgauaaugagacauucgccggcgggguccaccccgcaauugcccugagggaauaccggaagaagauggacaucccugcuaaacuuauaguguguggaaugacuucgaacgguuuuaccauugccgauccagacgaucgagcacugcagaacacauugcucaauaagucuuucuga
